United States Patent 12,371,699 (NUCLEIC ACIDS ENCODING CRISPR-ASSOCIATED PROTEINS AND USES THEREOF) - sequence listing, part 10

SEQ ID NO: 7466 - RNA, 3396 nt, synthetic construct
  misc_feature 1..3396: note = Cas9 variant
  source 1..3396: mol_type = other RNA
atggcgcaacacgtattcggcttggacataggcatcgcaagcgttggctgggccatcctaggcgaacaaaggataatcgacctaggcgtgcgttgcttcgataaagccgaaaccgccaaagaaggggacccactcaacctgacacgccgccaagcacgactattacgccgcagactctacagacgagcttggcgcctaactcaactatcgcgactactaaaacgcaaaggcctgatagcagacgcaaaactcttcgccaaagcaccctcatacggtgactctgcctgggagctacgccgccaaggcctggaccgtttacttacgcccttagaatgggccagagtcatataccaccaatgcaaacacaggggcttccactggacttcgaaggccgaagaagcaaaagccgactcggacgcagaaggcgggagggtaaaacaaggattggcccacacgaaagcgcttatgcaagccaagaactaccggagcgcagcagagatggtcctagccgagttccctgacgctcaaagaaacaaacgaggacaatacgataaagcactaagccgtgtcctcctcggcgaagaactcgcactactgttcgcgacccaacgccgactaggaaacccacacgcatcagatttcttcgaaaaactaatactaggcgacggagaccgaaagagcggactattttggcaacagaaacccgcactctcgggagccgaccttttaaaaatgctcggtaaatgcacattcgaaaaaggagaataccgggcgccaaaggcctccttctccgtcgaacgccacgtatggctaacacgcctaaacaacctacgaatcgtagttgacggcagatcaagacctctaaacgaagcagaacggcaagcagccctcctcctaccctatcaaaccgagacctcaaaatacaaaaccctcaaaaacgccttcatcaaagcaggcctatggggagatggggtaagattcgggggtctcgcctacccctcacaagcacaaatcgatgcagagaaaacaaaggatccagaagatcaatttctcgtaaaactcccggcgtggcacgaattacgcaaggccttcaaggctgccgggcacgaggccttgtggcaacaaatctctacacccgcgctcgacggcgatccaaccctactagaccaaatagcgaccgttctctccgtatacaaagacggagcggaagtagtacaacaactacgccaactagcactaccagagcccgccgcctctatcgccgtgctcgaaaagattagcttcgacaagttttcaagtctctccctcaaagcgctacgccgaatcgtaccactaatgcaatcaggactccgatacgacgaagccgtcgcccagataccggaatacggacaccacagccaaagaatcgaacccggggcagcgaaacacctctacctaccgccattctacgaagcccaacgaaagtatgcaggcaagggtgaccacatagggtcaatgcaattccgggatgacgcagatatcccacgcaacccagtcgttctccgagcactcaaccaagcccgtaaggtggtcaacgccctgatacgcgaatacggctcccccatagccgtaaacattgagatggcccgcgacctcagccgccccctagacgaacgaaacaaagtcaaacgggcacaagaagagttccgagatcgcaacgaccgcgccagaagcgagttcgaacgcgacttcgggtacaagccaaaggcagcagccttcgaaaaatggatgctataccgagaacaactaggccaatgtgcctactcccaacaaccactcgatatacaacgggttctagacgaccacaactacgcacaagtggaccatgcactcccctactccaggagctacgacgacagcaaaaacaataaagttctcgtactgacgcacgaaaatcagaacaagggcaacagaactgcattcgaatacctaaccagcttcccagacggcgaagacggagaacgatggcgcacattcgtcgcctgggtacaaggtaacaaggcttaccgcatggcaaaacgtaaccggctactacgcaaaaactacggcgtcgacgaatctaaaggattcatcgaccgcaaccttaacgacacacgatacatctgcaaattcttcaaaaactacgtagaggaacatctacagctcgccgcacgcgcagacggagacacagcacgtcgatgtgtagtcgtcaacggccaactaaccgccttccttcgggcacgctgggggctgacaaaggttcgcggggacagtgaccgccaccacgcccttgacgcagccgtagtagctgcgtgcacccacggcatggttaaggctttagcagactacagtcgacgtaaagaaatcagcttcctgcaagaaggcttcccagaccctgagacaggtgaaatactcaaccccgctgccttcgaccgagcccggcaacacttccccgaaccctggacacacttcgcacatgaactcaaagcccgactcttcaccgatgacctcgcagccctacgcgaagacatgcaaaggctcggaagctacaccaccgaggatctagggcgactgcgaaccctatttgtcagccgagccccacaaagacgcagtgggggcgccgtccacaaagaaaccatctacgcacagccggaatcacttaaacaacaagggggcgtcatagagaaaatcctactaacaagcctcaagctacaagacttcgacaaacttctaaaccccgaaagcaacgaccactttgtcgaaccgcaccgtaacgaacgtctatatgcagcaatacgacaacgactcgaacagttcggtggacgcgccgataaagcattcggcccggacaacctgttccacaaaccagacaaaaacaaccaaccgaccggacctgtcgtccgctcaataaaactcgttcgcggaaagcaaacaggaatacctatccgcggcggcctagccaaaaacgactccatgctcagagtggacatcttcaccaaagcaggtaagttccatctagtgcccgtctacgtccatcacagagtaacaggcctccccaaccgggcaatagtggctttcaaagacgaagacgaatggacactcatagacgaatcattcgcgttcctattcagcgtctacccgaatgactacgtaaaagttaccctgaaaaaggagcaacagagcggatactactccggcgcagaccgctcaaccggcgcaatgaacctatgggcgcacgaccgagcagcatcagtaggcaaagacggcctaatccgaggcataggcgtaaaaaccgccctaagcgtcgaaaaattcaacgttgacgtccttggacggatctacctcgcgccaccagagacacggtccggactcgcctga

SEQ ID NO: 7467 - RNA, 3399 nt, synthetic construct
  misc_feature 1..3399: note = Cas9 variant
  source 1..3399: mol_type = other RNA
atggcccagtacgtcttcggcctagacataggcatcgccagtgtgggatgggcagtcttagacgcccagcgcatcgtcgacctaggagtaaggtgcttcgacaaggcggaaaccgccaaggaaggcgacccgctcaacctaacaagacgccaagcaaggctcctacgacgccgactctaccggagagcgtggcgattaacacaactggcacgcctcttcaagcgagaaggtcttatcgacgacgcaaaactattcgccaaagcgcccagctggacggaaaacgcgtgggagctgcggctcagaggtctggaccatctattaactcccctcgaatgggctcgagttatctatcatctctgtaaacaccgtggattccactggaccagcaaagcagaagaagcaaaagcggagtccgatgccgagggcggcagagtaaaacagggtctcgcccacaccaaagcactcatgcaggtaaagaactaccgatcgaccgcagaaatggtcctcgcagagttcccaggggcccagcgaaacaagcgcggacaatacgataaagcgctgtccagagtcctactcggagaagaactcgccctgctattcgcaacacaacgccggctaggcaacccacacgcgtccgaacacttcgaacagctgatactaggacacggggaccgcaaaagcggcctcttctggcaacagaagccagcactatcgggtgccgacctgctcaagatgctgggcaaatgcaccttcgaaaagacggaatacagggccccaaaagcatcattcagcgccgaacgtcacgtgtggctgacacgcctgaataatctccgaattgtcgtggacggccgagccagaccactaaacgacgcagaacgacaggccgccctcttactaccctatcaaaccgaaacgttcaaatacaaaacgctaaaagccgccttcgtaaaagtcggcctctggggagacggcgtccgcttcggaggcctagcatacccctcccaagcgcaagccgaagccgaaaaagcgaaagacccagaagaccagtttctggtgaagctcccggcatggcacgaactcagaaaagcctttaaagccgcaggccacgaggcactatggcaacagataagcatgcccgccctcgaagaagaccccacactactagaccaaatagccaccgtcttaagcgtatacaaagacggcaccgaagtcgtacaacaactccgacagctagctctacccgagccagacgcctccatcgcagttcttgagaaaatccgatttgacaagttcagcagtctttccctcaaagcactaaggcgaatagtcccccttatgcaaggcggcttacggtacgacgaagctgtcgcacaaattcccgaatacggtcaccactcccaacggatagaccccggagccacgaggcacctctacctacctcccttttacgaagcgcaacgcaaatacgccgggaaaggtgaccgaataggaagcatgcagttccgtgaggacgcagacgtaccccgaaaccccgtggttttacgagccctgaaccaagctagaaaagtagtcaacgccctcatacgagaatacggatcacccgtcgccgtaaacattgagatggcccgtgacctaagccggcccctcgacgagagaaataaagtaaaaagagcacaggaagaatttcgagaccgtaatgacaaagcccggagcgagttcgaacgagacttcgggtacaagcccaaaggcgcggtattcgaaaaatggatgctctacagagaacagctaggccagtgcgcatactcccaacaaccactcgatatacaacgcgtactcgacgacccaaactacgcgcaagtagaccacgcactcccgtattcccgaagctacgacgacagcaaaaacaacaaagtcctagtactcacccgcgagaaccaaaataaagggaaccgaacacccttcgagtacctaacatcattcccaggaggagaggacggtgagcgctggcgtgcgttcgtcgcatgggtccagggcaacaaagcctacagaatggccaaaaggaaccgcctcctacgcaagaactacggcacagacgaatcacggggcttcatcgaccgcaaccttaacgacacacgatacatctgtaaatttttcaaaaactacgtcgaagaacacctacaactagccgcgcgaacggacggagacacagcaagaagatgcgtcgttgtcaacgggcaactgaccgcattcctacgcgcgcgttggggactagccaaagtccgtggcgattcagacagacatcacgccctcgacgcagcagtcgtagccgcatgcacacacgggatggtcaaagcactagccgactacagccgacggaaggaaattgccttcctacaagagggcttccctgacccagaaacaggcgagatcctcaacttagccgccttcgaccgcgcccgcgaacatttcccagaaccatggcctcactttgcacacgagcttaaggcccgcctattcatcgacgacctcgtagccttacgcgaggacatgcagcacctcggaagctacgcacaagacgacctcgacagactcagaacgctatttgtctcacgtgctccccaacgccgaaacggaggggcggtacacaaaggcaccatatatgcccaacccgagaacctcaagcaacaaggcagcactatcgagaaaatcctcctcacaggactcaagctacaagacttcgacaaactcctcaatcccgaaagctccgaccacttcgtcgaaccccatcgtaacgaaagactatacgcggcaatccgacgacgcctggaagagttcggaggaaaagccgacaaggctttcgggcccgacaaacccttttacaaacctgacaaaaacggccaaccaaccggccccatcgtcagaagcatcaaactggtacgcggaaaacagacaggcataccaattagaggagggctagccaaaaacgactcaatgctacgcgtcgacgtcttcacgaaagccggaaaattccacttagtgcccgtatacgtacaccaccgcgtcactggcctcccagacagagccatcgtagccttcaaagacgaagaagaatggaccctcatagacgaatcctacgccttcctcttctccgtctaccccaacgacttcgtctgcgtacaacaaaggggaaaaccactcatcgaagggtactacgccggattagaccgggctaacggcaacataaacgtctgggcccacgacagagcggccagcgttggaaaggacggcttaatacgaggaataggcgtcaaaacggcactcagccttgagaaactaaatgttgacgtactcggcagaatttacccagcacccccggagacaagaaggggactggcgtga

SEQ ID NO: 7468 - RNA, 3399 nt, synthetic construct
  misc_feature 1..3399: note = Cas9 variant
  source 1..3399: mol_type = other RNA
atgaagaaaatactcggggtcgacctcggcataaccagtttcggatacgcgatcctgcaagaaaccggcaaagacctctacagatgcctagacaattctgtagtcatgagaaacaacccctacgatgagaaaagcggagaatcctcacagtccattcgctccacccagaaaagcatgagaagactgatcgaaaagagaaagaaacggatcagatgcgtagcccaaacaatggaaagatatgggatcctcgattatagcgagaccatgaaaattaacgaccccaaaaacaacccgatcaaaaaccgatggcaactgcgagcagtcgacgcatggaagaggcccctgagtccccaagaactatttgcaatatttgcccacatggccaagcaccgcgggtacaagtcgatcgcaaccgaggacctcatctacgaactcgagcttgaactgggactaaacgatcccgaaaaggaatcagaaaagaaagcggacgagagacgccaagtgtacaacgccctcagacacctcgaggagctacggaagaaatacggaggcgagaccatcgcccaaactatacaccgagcagtagaagcaggcgacctacgcagctaccgtaaccatgacgactacgagaaaatgataaggcgggaagacattgaagaagagatcgaaaaagtccttctacgccaagcagaactaggagcactgggtctaccagaagaacaagtgtccgaactcatcgacgagctaaaagcatgcatcacagaccaggaaatgccgaccatagacgaaagtctcttcggcaaatgtacattctacaaagacgagttggcagcccccgcctacagctatctctacgacctatacagactatacaagaaactcgcagacttgaacatcgacggctacgaagtcacacaagaagaccgagaaaaagtaatagaatgggtcgagaaaaagatcgcccaggggaaaaacctcaaaaagattacgcacaaggacctcaggaaaattctcggcctagcgccagaacagaaaatattcggagttgaggacgagcgcatagtaaaagggaagaaagagccccgaacgttcgtgcccttcttcttcctggcggacatagccaaatttaaagagctctttgcatcgatccaaaaacacccagacgccctgcaaatatttagggaactagcagaaatcctccaacgcagcaaaactccacaagaagcgctcgacagactaagggctctcatggcaggcaaaggaatagacacggacgaccgggaactcctcgaactgttcaaaaacaaacgatcaggtaccagagaactatcacatcgttacatacttgaagccctgccactgttccttgaaggctatgacgaaaaagaagtccaacgaatcctcggcttcgacgacagggaagattactcccgatacccaaaatcactgcgccacctccacctccgggaaggcaacctattcgaaaaagaagagaacccgataaacaaccacgcagtcaaaagtctcgcctcatgggcgctaggcctcatcgcagacctaagctggagatacggaccatttgacgaaatcatcctcgaaaccaccagggatgcactccccgagaaaatacgtaaagaaatcgacaaagcaatgcgagaaagggagaaagcactagacaagataataggcaagtataaaaaggagttcccctccatagacaaaaggctagccaggaaaatccaactttgggaacgacaaaaaggacttgacctctactccggcaaagtgataaaccttagccaactgcttgacggatccgcagatatcgaacacatagtaccacaatccctcgggggactctcgacagactataacacaatagtaacactcaaatcagtaaacgccgcaaagggtaaccgactaccaggcgattggctagccggcaaccccgactatagagagcgcatcggcatgctatcggaaaagggactgatcgactggaagaaacgcaaaaacctgctagcacaatccctggacgagatatataccgaaaacacccacagcaagggaatacgagcaacatcctacctagaagccctggtagcccaagtcctaaaacgctactatccatttccagaccccgaactcaggaaaaacggcatcggagtgcgaatgatccccgggaaagtgacttccaaaacacgaagcctactcggcataaaatcaaagagccgagagaccaacttccatcatgccgaagacgccctaatactcagcacactcaccaggggatggcaaaatcgccttcatcggatgctgcgcgataactatgggaaatcagaggcagaactcaaggaactgtggaagaaatacatgccacacatcgaaggcctaacactagcggactacatagacgaagccttccggagattcatgtcgaaaggcgaagaaagcctattctaccgagacatgtttgacaccataagatccatcagctactgggtagacaagaaaccactgtccgccagcagccacaaagaaaccgtatacagcagcaggcacgaggtaccaacactccgcaaaaacatactggaagccttcgacagcctcaacgtcatcaaagaccgccacaaactcacgacggaggagttcatgaagcgctacgacaaagaaataagacaaaaactatggctccacagaatcggaaacaccaacgacgaaagctacagagcagttgaagaacgcgctacgcaaatcgcgcaaatcctgacccgctaccaacttatggacgcccagaacgacaaagagatagacgagaaattccagcaagcactcaaggagctcataacctcccccatcgaggtcacgggaaaactcctccgcaagatgcgcttcgtctatgacaagctcaacgcaatgcagatcgaccgcgggctcgtcgagacagacaaaaacatgctggggatccacataagcaaaggtcccaacgaaaaacttatctttcgacgtatggacgtcaacaacgcccacgagctccagaaggagaggtcgggtatactatgctatcttaacgaaatgctattcatcttcaacaagaaaggactcatccactacgggtgcctcagaagttacctagaaaagggccaaggcagcaaatacatcgcactattcaacccccgattcccggccaatccaaaagcacagccgtccaaattcaccagcgacagcaaaattaagcaagtaggaattggctccgccacgggcatcatcaaagcacacctggatctcgatgggcacgtacgcagctacgaagtattcggcacactacccgaaggcagcatagaatggttcaaggaggaaagcggctacggacgtgtagaagacgacccgcaccactga

SEQ ID NO: 7469 - RNA, 3402 nt, synthetic construct
  misc_feature 1..3402: note = Cas9 variant
  source 1..3402: mol_type = other RNA
atggacctaaattatcgcatcggactcgacattgggatcgcaagtgtaggatgggcggtgttggaaaataacagcaaagacgaaccagtaagaatcgtcgacctaggagtccgcctattcgaagcggcagaggtcccgaagactggtgccgcactagccgagcccagaagagaagcacgaacaacgcggcgccgcctgaggaggaggaagcacagactggagcgaatgaagtggctcctccaagaatacggcctcatccaaaccgaagagttcatgaaacgatatcattcggcgggactcccggacgtataccgactccgatacgagggactggaacgcaaactgaaagatgaggaactcgcgcaaatactaatccacatcggaaaacaccgcggcttcagaagcacacgaaaggctgaactcaaagacaaaaacgacaaagaaacgggagccgtcctcagcgcaacgagagaaaacgaaaagctaatggaagaacacggctaccggacagccggcgaaatgatatacaaagatgacaaattccgcacaggctgcacgtggaaagaagaaggctatcgactgacaccacgaaacaaagaaggagactacaaaaacacgatgctgcgggcattactggaagacgaagtcaaggtaatcttcgactgccagagaaagtttggaaaccaaaaagccagcgaggagctcgagaaagcatacctcgcaataatgaccagccagcgctcgttcgacatgggacccggcaaacaacccgacgggtcagcatcaccctacgcaatggaggggttcggcgacagagtcgggctctgcgccttggaaccgagggaaaaacaagagccacgcgcccccaaagcagcctacacgtcagaactcttcgtagcactacagaaaatcaaccacctcaggatcacggagaaaaatggaaagggccgcggactaaccagcgaagaaagagaaagactaagcgacctgctacacaaaaagaaggaactcacatacggagccgtccggaaagagctacaattagatctccgctaccgattcaacacgctcaactacagcagcaagaaaatgacggaagaggagaaaataaaagacgccgaaaaggcgaagttcgtatccatggtgtcccactacgaataccgaaagcgcatgagtggcatgctagaacaactgagcccagaggaacaagcagacctaatggacgaggtgggaaaaatcctaacactctacaaaaacgacgacacacgatcaagggagttccagaaactcggactggacagcgaaatcaccgaggaactcctggaactgaacccacgcggattccaacacgtctccctcaaagccatgaagaaactcatgccttatctcaaagagggactcacgtacgacaaagcatgtgcggaggcaggatacgatttccaaggctcggtacaaaaagagcggagccgcctactaaaaggcaaggagataacggatatcatcaacgatatcaacaacccagtagtcaaaagaagtgttagccaaacagtgaaagtgataaacgctattatacaaaaatacggctcaccccaggcagtcaacatagagctagcccgggaaatgagccggaactacgacgagcggcggaaaatggaaaagcagatgaaggacagacaatcagaaaacgagcgtgccaagaaagaaatacaagaattaggaaacgcgttccccacaggacaggacatactgaagtaccgcctctggcacgatcaggacggaatttgcatgtatagcgcaaagcggataccgctcgcagaactcttcacaggggcctacgacatcgatcacatactgccatactcaatcacgtttgatgacagctaccgcaacaaagtcctcgtgaccagcgaagaaaacaggcaaaaaggaaaccgcatcccctatgagtatttcggcagtgacagcgaacgctggagcaaattcgaaaccctagtcaacagccgaatccgcgactaccgaaaacaacaaaacctgctcaaacaatcgttcaccgaagaggaaagaaaagagttcaaacaacgaaatctcaacgacaccaaatacataacccgggtcatatacaacatgatacgcgagaatttagccctcgcaccctacaacagcccgggcaaaaagaaacaagtattcgccgtgaacggcggcgtgacagcatacctaaggaaaagatggggaatgtcggcaaaagaccggtcgatagacacacaccacgcccgagacgcagtcgtaatcgcctgctgcacagacggcatgatacagaaaataagcaggaacatacaaggccgtgaactactctacgcacgcggcttcaccgcagtagacgtagagacaggcgagaaattcacccgggacgactttacgagagaccaatgggacgaaatattcggagtacaagtaccgaaaccatgggagtactttaacgaggaactagacataagactcggcgagaacccggtagagttcatcgaaactcactcagacgtgagccggaaacttgactacccagcctggttctacgagaataacattatcagaccggtgttcgtcagcaggatgccaaaccgcaaagtcaccggagccgcccacgcggacacaatacgctccccaagacactatcaagaaacgggatcagtactgaccaagacagcactcatagacctaaaactgaacaagaaaacgggcgaaatcgagaactactacaaaccagagagtgacaccctcctgtataacgctctaaaagaacgcctcgaactatacggaggagacgggaagaaagcatttgaagaacccttctacaaacccaaagccgacggaagccgaggaaacctcgtccggaaagtgaaaacgtacgacaagttaaccctaggcgtgtatgtgaacagccaacacggaatcgccgccaacgcaaacggctctatggtacgggtcgacgtattccgagtatccggaaagtactacttcgtacccgtatacatagcagacgtcgtccgcaagcggctaccaatgaaggccgtggtccaaggcaaacaatacatagactggaaagaaatggaagacaaggacttcatatttagcctatataccagagatctgatatccttcaaatccaaaaatggaaagaaagtgacatgcgtggacggcacatccaaagcagtaaacgaagagatcgtgtactactatggcgccaacatctcgacagcctcgttttccggcaagagccacaacgggtccttcgagttcacgagcctagggatccaaggcctcgaatacctgaagaagtaccaagtcgacgttctaggcaacgtaagcgaagtcaaacgtgagaaaagaatgggcttccgctga

SEQ ID NO: 7470 - RNA, 3402 nt, synthetic construct; identical to SEQ ID NO: 1670
  misc_feature 1..3402: note = Cas9 variant
  source 1..3402: mol_type = other RNA

SEQ ID NO: 7471 - RNA, 3405 nt, synthetic construct
  misc_feature 1..3405: note = Cas9 variant
  source 1..3405: mol_type = other RNA
atgaatggcttagtgctcgggctggacatcggcatcgccagcgtcggggtgggcatcctggagaagaactccgggaagatcgtgcacgccagcagccgcatattccccgcggccaccgccgacaacaacgtcgagcggcgcaaaaaccggcaagctcggcggctccaccgccgtaagaagcaccgcggcgcccggctgaaggacctgttcgagtactatggcctacttaccgacttcagcaaggtgtccatcaatctgaacccgtaccgcctccgggtggacgggttagaccagcagctgacgaacgaggagctgttcatcgcgctcaagaacatcgtaaagcgccggggcatcagctacctggatgacgcgagtgaggacgggggcaccgtgagctccgactacggaaaggccgtcgaggagaaccgcaagctcctggccgagcagacccccggccagatccagctggagcggttcgagaagtacggccagctaaggggagactttaccgtcgtggagaacagcgagaagtgccggctgatcaacgtgttttccaccagcgcgtacaagaaggaggccgagaggatcctgcggaaacagcaggagttcaacaatcagatcaccgatgagttcatcgaagactacctcaagatcctgaccgggaagcgcaagtactatcatgggcccggcaatgagaagtcccggaccgactacggccgcttccgcacggacggggccaccctggacaacatcttcggcatcctcatcggaaagtgcaccttctaccccaatgagtaccgggccagcaaggcctcctacaccgcgcaggagttcaacttgctgaacgacctcaacaacctgacggtcccgaccgagaccaagaagctgagcgaggagcagaagaagaccatcatagagtatgcgaagtccgccaagacgctgggcgccagcaccctgctgaagtatatcgccaagatgatcgacgcgtccgtggaccagatccgcgggtaccgggtggacgtcaacaacaaacccgagatgcacaccttcgaagtgtatcgcaagatgcagagcctcgagaccatcagcgtgggcgagctgtcccggaacattctggacgagctcgcccatatactgaccctgaacaccgagcgcgaggggatcgaggaggccatcaacaccaagttgcgcgacagcttctcccaggatcaagtactggagctagtgcagttccgcaagaacaacagctccctcttcagcaaggggtggcacaacttctccctgaagctgatgatggagctcatccccgagctgtatgagaccagcgaggagcagatgacgatactgacccggttaggcaagcaaaagagcaaggagaccagcaagcgcaccaagtacatcgacgagaaggaggtgacggaggagatttacaaccccgtcgtggccaagtccgtgcggcaggccatcaagatcatcaacgaggcgaccaagaagcacgggatcttcgacaacatcgtcatcgagatggctcgcgaaaacaacgaggaggacgctaagaaggactacatcaagagacagaaggccaaccaggatgagaagtacgccgcgatggagaaggccgccttccagtacaacggtaagaaggaactgccggacaacatcttccacgggcacaaggagctagctaccaaaatccgcctgtggcaccagcagggcgagaagtgcttatacaccggcaagagcatccccatctccgatctgatccacaaccagtacaagtacgagatcgaccacatcctgcccctcagcctgtccttcgacgactccctgtctaacaaggtactcgtactggcgacggctaatcaagagaaggggcagcggacacccttccaggccctggacagcatggacgacgcatggtcctaccgcgagttcaagagctacgtgaaggagagcaagctcctgggcaacaagaagaaggagtacctgctcacagaggaggacatctccaagatcgaagtgaagcagaagttcatcgaacggaacctggtcgacaccaggtacagctccagggtggtgctgaacgccctccaggacttctacaaaaaccacaacttcgacacgaccatcagcgtcgtgcgcgggcagttcacctcccagctgcggcggaagtggggcctggagaaatcccgcgaaacctatcaccaccatgcggtggacgcccttatcatcgccgcgagcagccagctgcggctgtggaagaagcagaacaacccgctcatcgcctacaaggaagggcagttcgtcgactcccagaccggcgagatcatctcactgaccgacgacgagtacaaggagctggtgttcaaggcgccctatgaccacttcgtggacaccctctccagcaagacctttgaggactccatcctgttcagctaccaggtcgactctaaattcaaccgcaagatcagcgacgccaccatctatgccacgcggaaggccaagctggacaaagagaagaaagagtatacctacaccctcggcaagatcaaggacatctactccctggggaccaagacgcccagcaagaccggcttttacaagttcctcgacttatacaacaaggacaagagccagttcctgatgttccagaaggaccgcaagacctgggacgaggtaatcgagaagatcatggagcagtaccggcccttcaaagagtatgacaaggccgggaagctggtggacttcaacccgttcgagaagtaccgccaggagaacggccccatccggaagtactccaaaaagggtaacgggcccgagatcaagagcctcaagtactacgatatcctgctgggcaagcacaagaacatcacccccgaggggtcccgcaacacggtcgcgctcctatcgctaaacccgtggaggaccgacgtgtactacaacatggaaaccaagaagtatgagttcctcggcctgaagtacgccgacctgcccttcgaggagggcggtgcctacggcatctccaccgagacttacaacgagctccgcgaaaaggagggaatcggcaagaacagcgagttcaagttcaccctgtacaagaacgacctgatcctcatcaaggataccgagaccaactgccagcagttcttccgattctggtcccgcacgggcaaggacaaccccaagagcttcgagaagcacaagatcgagctgaagccctatgagaaggccaagtttgagaagggcgaggagctggaggtgctcgggaaggtaccgccctccagcaatcagttccagaagaacatgcagatcgagaacctgtccatctacaaagtgaagaccgacgtgctgggcaacaaacacttcatcaagaaagagggtgacaagcccaaactcaagttttga

SEQ ID NO: 7472 - RNA, 3405 nt, synthetic construct
  misc_feature 1..3405: note = Cas9 variant
  source 1..3405: mol_type = other RNA
atgaacggcctggtgcttggtctggacatcggaatcgcaagcgtcggggtgggcatcctcgagaaaaattccgggaagataatccacgccaacagccgcctcttccccgcggccaccgccgacaacaacgtggagcgtcgcaagaatagacaggcccgccgcctgaaccgccggaagaagcaccgcggcgtccggttccaggacctgttcgaggactacggcctcctgaccgacttctccaaggtgtcaatcaacctgaacccgtacaggctccgggtggacgggctgaaccagcagctaacgaacgaggagctgttcatcgcactcaagaacatcgtcaagcgccggggcatctcctacctggacgacgcgagcgaggacgggggcgctgtgtccagcgactacggaaaggccgtggaggagaaccgcaagctcctggccgagcagacccccggccagatccagctggagcggttcgagaagtacggccaggtccgcggggacttcaccgtcgtggagaacggcgaaaagctccggctgatcaacgtcttctccaccagcgcgtataagaaggaggcagaacgcatcctacggaagcaacaggagttcaacaaccagatcacggacgagttcatcgaggactacctaaagatcctgaccgggaagcgcaagtactaccacggccccggcaacgagaagagtcggaccgactacgggcgcttccgcaccgacggcacgaccctggacaacatcttcgggatcctcatcggaaagtgcaccttctaccccgaagagtaccgggccagcaaggccagctacaccgcccaggagttcaacctgctgaacgacctcaacaacctgacggtgccgaccgagaccaaaaagctgagtgaggagcagaagaaggtgatcgtcgagtacgcgaaggaagccaagaccctcggggcctccacgctgctgaagtacatcgccaagatgatcgacgccagcgtggaccagatccgcgggtatagagtcgacgtcaacaacaagcccgagatgcacaccttcgaggtgtaccgcaagatgcagagtctcgagacgatctcagtgggcgagctgtcccggaacgtcctggacgagctcgcgcacatcctgaccctgaacacggagcgcgaggggatggaggaggccattaacaccaagctcaaggacagctttagccaggaccaggtgctggagctggtgcagttccggaagaacaactccagcctcttctccaagggctggcacaacttcagcctgaagctgatgatggagctcatcccagaactgtacgagacctccgaagaacaaatgaccatcctgacgcgcctcgggaagcagaagtccaaggagaccagcaagcggaccaagtacatcgacgagaaggagctgaccgaggagatctacaaccccgtcgtagccaagagcgtccgccaggccatcaagatcatcaacgaggccacgaagaagcacggcatcttcgacaacatcgtgatcgagatggcgcgggagaacaacgaggaggacgccaagaaggactacatcaagcgccagaaggctaaccaagacgagaagaacgccgccatggagaaggcggccttccagtacaatggaaagaaggagctgccggacaacatcttccacggccacaaggagctggccaccaaaatccggctctggcaccagcagggagagaaatgcctgtacacgggtaagaccatacccatttccgacctgatccacaaccagtacaagtacgaaatcgaccacatcctccccctgagcctatccttcgacgacagcctctcaaacaaggtgctggtactggccacggcgaaccaggagaagggccagcgcacccccttccaagcgctcgacagcatggacgacgcctggtcctacagagagttcaagagctacgtgaaggagtccaaactgctggggaacaagaagaaggagtacttgctgaccgaggaagatatcagcaagatcgaggtgaagcaaaagttcatcgagcgcaacctgattgacactcggtactccagccgcgtcgtgctcaacgccctgcaggacttttacaaggcccataagttcgacacgaccatcagcgtggtcagaggccagttcacctcccagctgcgccgcaagtgggggctcgagaagtcccgggagacctaccaccaccacgcggtggatgccctgatcatagccgccagcagccagctgcgcctttggaagaagcagaacaactctctgattagctacaaggagggccaattcgtggactccgagaccggcgagatcatcagcctgacggacgacgagtacaaggagctcgtcttcaaggccccgtacgatcacttcgtggacaccctgcggtccaagaagttcgaggacagcatcctgttctcctaccaggtagactcgaagtttaacaggaagatctccgacgcgacgatctacgcgacccggaaggccaagctcgacaaggagaagaaggagtacacgtacaccctggggaagatcaaggacatctactcgctaggcaccaaggccccatcaaagaccgggttctataaattcctcgacctgtacaacaaggacaagagccagttcctgatgttccagaaggaccgcaagacgtgggatgaggtcatcgagaagattatggagcagtaccggcccttcaaggagtacgacaagaccgggaaacttgtggacttcaaccccttcgaaaagtaccgccaggagaatggcccgatccggaagtactccaagaaggggaacggccccgagataaagagcctgaagtactacgacatcctgctcgggaaacacaagaacatcacgcccgagggcagccgcaacaccgtggccctgctgtccctcaacccctggcggacggacgtctactacaacatggagaccaaaaagtacgagttcctggggctgaagtacgctgacctcccgtttgaagaagggggcgcctacgggatctcaactgagacctacaacgaactgcgcgagaaggagggcatcgggaaaaactcggagttcaagttcacgctgtacaagaacgacctcatcctgatcaaggacaccgagaccaattgccagcagatcttccggttttggagtcgcacaggcaaggacaatcccaagtccttcgagaagcacaagatcgagctgaagccctacgagaaagcccggttcgagaagggagaggagctcaaggtgctgggcaaggtgcccccgagctccaaccagctccagaagaacatgcagatagagaacctcagcatctacaaggtcaagacggatgtgctgggcaacaagcacttcatcaagaaggagggggacgagcccaagctgaagttctga

SEQ ID NO: 7473 - RNA, 3405 nt, synthetic construct
  misc_feature 1..3405: note = Cas9 variant
  source 1..3405: mol_type = other RNA
atgaacggcctggtgctcgggctggacattggcatcgccagcgtcggggtgggcatcctggagaaaaattccgggaagatcatccacgagaatagccgcctcttccccgccgcgaccgccgacaacaacgtggagcggcgcaagaaccggcaggcgcgccggctgaaccgccggaagaagcaccgcggcgtccggttccaggacctgttcgaagactacggcctcctgaccgacttctccaaggtgagcatcaacctgaatccctaccgcctccgggtggacgggctcaaccagcagctcacgaacgaggaactgttcatcgctctcaagaacatcgtcaagcgccggggcatctcctacctggacgacgccagcgaggacgggggcaccgtgccctccgactacgggaaggcggttaaggagaaccggaagctcctggccgagaagacccccggtcagatccagctggaacggttcgagaagtacggacagctccgcggggacttcaccgtcgaggagaacggcgagaagtgccggctgattaacgtgttcagcacgtccgcctacaagaaggaagccgagcggatcttaagaaagcagcaggagttcaacaaccaaattaccaacgagttcatcgaggactacctcaagatcctgaccggtaagcgcaagtactaccacggccccggtaatgagaagtcccggacagactacgggcgcttccgcacggatggcaccaccctggataacatcttcgggatcctcatcggcaagtgcaccttctacccagaggagtaccgagtgagcaaggccagctacactgcccaggagtttaacatcctgaacgacctgaacaacctcaccgtccccaccgagaccaagaagctgtccgaggagcagaagaaagacattgtggagtacgccaaggagacaaagaccctgggtgctagcaccctcctcaagtacatcgccaagatgatcgacgcgtccgtggaccagatccgcggttaccgggtcgacgtgaacaacaagcccgagatgcacaccttcgaggtgtacaggaagatgcagagcctagaaacgatctccgtcggcgagctcagccggaacgtgctggacgagttagcccacatcctcacccttaacaccgagcgcgaggggatcgaggaagccatcaacaccaagctgatgggcgtgttctcccaggaccaggtcctcgagcttgtgcagttccggaagaacaacagcagcctgttctccaaggggtggcacaacttctcgctcaagctgatgatggagctgatccccgagctctacgaaacgtccgaggagcagatgaccattctgaccaggctgggcaagcagaagtccaaggagaccagcaagcggaccaagtacatcgacgagaaggaggtcaccgaggagatctacaacccggtcgttgccaagagcgtccgccaggccatcaagatcatcaacgaggcaacaaagaagtacggcatcttcgacaatatcgttatcgagatggcccgagagaacaacgaggaagacgccaagaaagactacatcaagcgccaaaaggccaaccaggacgagaagaacgccgctatggagaaggccgccttccagtacaatggcaagaaggagctccccgactccatctttcacggccacaaggagctggccaccaagatccggctgtggcaccagcagggggagaagtgcttgtacacggggaagaacatccccatcagcgacctcatccacaaccagtacaagtacgagatcgaccacatcctgcccctgtccctcagcttcgacgactccctgagcaacaaggtgctggtcctcgccaccgcgaaccaggagaagggacagcgcaccccgttccaggccctggactccatggacgacgcctggtcataccgggagttcaagtcctacgtaaaggacagcaagctactctccaacaagaagaaggactacctgctgaccgaggaggacatcagcaagattgaggttaaacagaagttcatcgagcgcaacctcgtcgacacgcggtactccagccgcgtagtgctgaacgccctgcaggacttctacaaagcgcataagtttgacaccacgatcagcgtcgtccggggccagttcacctcccagctccgccgcaagtgggggctggagaagtcccgggagacctaccaccaccatgctgtggacgcattaatcatcgccgccagcagccagctccgcctgtggaaaaagcagaacaaccccctgatcacgtacaaggaaggccagttcgtcgactccgagaccggggagatcatcagcctcacggatgacgagtacaaagagctggtgttcaaggcgccctatgaccactttgtggacaccctgagatcaaagacgttcgaagactcaatcttattctcctaccaggtcgacagcaagttcaaccgcaaaatatccgacgccaccatctatgccacccggaaggccaagttagataaggagaagaaggagtacacctacacgctggggaagatcaaggacatctacagcctcggcaccaagaccccctccaagaccgggttctacaagttcctggacctgtacaacaaggacaagtcgcagttcctcatgttccagaaggaccgcaagacgtgggacgaggtgatcgagaagatcatggagcagtaccggcctttcaaggagtacgacaaaaccggcaagctggtggacttcaaccctttcgagaagtaccgccaggagaacggccccatctgcaagtactccaagaaggggaacggccccgagatcaagagcctgaagtactacgacatcctcctggggaagcataaaaacattaccccggagggctcccgaaacaccgtcgccctgctcagcctgaacccctggcgcacggacgtgtactacaacatggagaccaagaagtacgagttcctggggctcaagtatgcggacctgccctttgagaagggcggcgcctacgggatcagcaccgagacctataacaagctgcgggagaaggagggcatagggaagaactccgagttcaagttcacgctctacaagaacgacctgatcctgatcaaagacaccgagaccaactgccagcagatctttcgcttctggagtcggaccgggaaggacaaccccaagtcctttgagaagcacaagatcgagctcaagccgtacgagaaggcccgctttgagaagggcgaggagctggaggtgctgggaaaggtcccgccctcatccaaccagttccagaagaacatgcagatcgagaacctcagcatctacaaggtgaagacggacgtgctgggcaaaaagcacatcatcaagaaggagggtgacgagcccaagctgaagttctga

SEQ ID NO: 7474 - RNA, 3405 nt, synthetic construct; identical to SEQ ID NO: 1674
  misc_feature 1..3405: note = Cas9 variant
  source 1..3405: mol_type = other RNA

SEQ ID NO: 7475 - RNA, 3405 nt, synthetic construct
  misc_feature 1..3405: note = Cas9 variant
  source 1..3405: mol_type = other RNA
atgaacggcctggtgctcgggctggacatcggcatcgccagcgagggggtcggcatcctggagaagaactccgggaagatcattcacgccaacagccgcctcttccccgcggccaccgccgacaacaacgtggagcggcgcaagaaccggcaggcccgccgactgaaccgccggaagaagcaccgcggcgtgcggttccaggacctgttcgaggactacggtctcctaaccgacttctccaaggtaagcatcaacctgaacccatatcgcctccgggtggacgggctgaaccaacagctgaccaacgaggaactgttcatcgccctcaagaacatagtgaagcgccggggcatctcctacctggacgacgcgagcgaggacgggggcgccgtctccagtgactacgggaaggccgtggaggaaaatcgcaagctcctggccgagcagacccccggccagatccagctggagcggttcgagaaatacggccaggtccgcggggacttcaccgtcgtggaaaacggcgagaagctccggctgatcaacgtgttctccaccagcgcgtacaagaaggaggccgagcgcatcctgcggaagcagcaggagttcaacaaccagataacggacgagttcatcgaggactacctcaagatactgaccgggaagcgcaagtactaccacggccccggcaacgagaagtcccggaccgactacgggcgcttccgcactgacggaacgaccttagacaacatcttcgggatcctcatcggcaagtgcactttctaccccgaggagtaccgggccagcaaggcctcctacaccgcccaagagttcaacctgctgaacgacctcaacaacctgacggtcccgactgagacgaagaagctgagcgaggagcagaagaaggtgatcgtggagtacgcgaaggaggccaagaccctcggggcctccacgctgctgaagtacattgccaagatgatcgacgccagcgtcgaccaaatccgcggctaccgggtggacgtgaacaacaagcccgagatgcacaccttcgaggtctaccgcaagatgcagtccctcgagaccatcagcgtgggcgagctgtcccggaacgtgctggacgagctcgcgcacatcctgaccctgaacacggagcgcgaggggatggaggaggccatcaacaccaagctcaaggacagcttcagccaggaccaggtcctggagctggtgcagtttcggaagaacaactccagcctcttctccaagggctggcacaacttctctttaaaactgatgatggagctcatccccgagctgtacgagacctccgaggagcagatgaccatactgacgcgcctcgggaagcaaaagtccaaggagaccagcaagcggaccaagtatatcgacgagaaggagctgaccgaggagatctacaaccccgtggtcgccaagagcgtgagacaggccattaagatcatcaacgaggccacgaagaagcacggcatcttcgacaacatcgtaatcgagatggcgcgggagaacaacgaggaggacgccaagaaggactacatcaagagacagaaggccaaccaggacgagaagaatgccgccatggagaaggcggccttccagtacaacgggaagaaggagctgccggacaacatcttccacggccacaaggagctggccaccaagatccgactctggcaccaacagggcgagaagtgcctgtacaccgggaagaccatccccatctccgacctgatctacaaccagtacaagtacgagatcgatcacatcctccccctgagcctgtccttcgacgacagcctcagcaacaaggtgctggccctggcgacggccaaccaggagaagggccagcgcacccccttccaggccctcgacagcatggacgacgcctggtcctaccgggagttcaagagctacgtgaaggacctgaaatccctgagcaacaagaagaaggactacctcctgaccgaggaggacatttccaagatcgaggtcaagcagaagttcatcgagcgcaacctggtggacacccggtacagcagccgcgtggtcctcaacgccctgcaggacttctacaagagtcaccagttcgacacgaccatcagcgtggtgcgggggcagttcacctcccagctgcgccgcaagtggggcctcgagaagtcccgggagacctaccatcaccacgcggtcgatgccctgatcatcgccgccagcagccagctgcgcctctggaagaagcagaacaacccgctgatcacctacaaggaggggcagttcgtggactcccagacgggcgagatcatcagcctgaccgacgacgagtacaaggagctcgtgttcaaggccccctacgaccacttcgtcgacaccctgtccagcaagacctttgaagactccatcctgttcagctaccaggtggactccaagttcaaccggaaaatctctgacgcgacgatctacgccacccgcaaggccaagctcgataaggagaagaaggagtacacctacaccctgggcaagatcaaggacatctactccctggggacgaagacccccagcaagaccggcttctacaagttcctcgacctgtataacaaggacaagtcccagttcctgatgttccagaaggaccggaagacctgggacgaggtgatcgagaagatcatggagcagtaccgccccttcaaggagtacgacaagacggggaagctcgtcgacttcaacccgttcgaaaagtaccggcaggagaacgagcccatacgcaagtatagcaagaagggcaacggccccgagatcaagagcctgaagtactacgacatcctgctcgggaagcacaagaacatcacccccgagggctcccggaacaccgtggccctgctgagcctcaacccgtggcgcaccgacgtgtactacaacatggagacgaagaagtacgagttcctggggctgaagtacgccgacctccccttcgaggagggcggggcgtacggcatttccaccgagacctacaacgagctgcgggagaaggagggtatcgggaagaacagcgagttcaagttcaccctgtacaagaacgacctcatcctgatcaaggacacggagaccaactgccagcagatcttccgcttctggagccgcacgggcaaggacaaccccaagagcttcgagaagcacaagatcgagctgaagccctacgaaaaggcccgcttcgagaagggggaggagctcgaggtcctgggcaaggtgccgccctccagcaaccagctgcagaagaacatgcagatcgagaacctctccatctacaaggtgaagaccgacgtcctggggaacaagcacttcatcaagaaggagggcgacaagcccaaactgaaattctga

SEQ ID NO: 7476 - RNA, 3408 nt, synthetic construct
  misc_feature 1..3408: note = Cas9 variant
  source 1..3408: mol_type = other RNA
atgagcgacctggtgcttggcctggacatagggatcggctccgtaggggtgggcatactgaacaaggtaaccggggagatcatccacaagaacagccgcatcttccccgcggcccaagcggagaacaacctcgagcggcgcaccaaccggcagggtcgcaggttgacgcgcaggaagaagcaccgccgggtacgccttaaccacttgtttgaagagtccggtctgattaccgacttcaccaaggtgtccatcaacctgaacccgtaccagctccgggtgaaggggctgaccgccgagctgtcaaacgaggagctgttcatcgcattaaagaacatggtcaagcatcgcggcatcagctatctggacgacgcctcagacgacgggaacagttccgtgggcgactacgcacagatcgtgaaggagaatagcaagcagctcgagaccaagacccccgggcagatccagctggagcggtaccaaaagtacggccagctgcgcggcgacttcaccgtcgaggaggatgggcggaagcacagactcatcaacgtattccccacttcggcgtatcacgccgaggccctgagaatcctgcaaacgcaacaggagttcaacccccagatcaccgacgagttcatcaacagctacctcgagatcctgaccggcaagcgcaagtactaccacgggccgggcaacgagaaatcccggaccgactacggcaagtacactaccaagaaggacgcacagggacagtacattaccctgaacaacatcttcggcatactcatcgggaagtgcaccttctatcccgaggagtaccgcgcggctaaggcgagctacacggcccaggagttcaacctgctgaacgatctcaacaacttgaccgtgcccaccgagaccaagaagctgtccgaggagcaaaagtaccagatcatcacttatgtcaagaacgagaaggccatggggcctgcgaagctgtttaagtacatcgccaagctcctcgcatgcgacatcgccgatatcaaaggttaccggatcgacaagagcgacaaagcggagatccacacctttgaggcttacaggaagatgaagaccctcgagaccatcgacatcgaacagatcgagcgagaaaagctggacaagctggcttacgtgctcacgctgaacaccgagcgggagggcatccaggaagccctagaccacgagttcgccgacggcaccttttcccaggaacaggtggacgagctcgtgcagttcagaaaggccaacagctccatcttcgggaagggctggcacagcttcagcgtgaagctgatgatggagctgatccctgagctctacgcgacctccgaggagcagatgactatccttactcggctggggaagcagaagaccaccagctccagcaacaagacgaagtacatcgatgagaagcagctcaccgaggagatctacaaccctgtggtcgccaagtccgtgcgccaggccatcaagatcgtgaatgccgcaatcaagaagtacggcgacttcgacaatatcgtcatcgagatggcgcgggagaccaacgaggacgacgagaagaaggccatccagaagatccaaaaggccaataaggcagagaaggacgccgcgatgcgcaaggccgccaaccagtataacgggaaggccgagctgccccacagcgtgttccacggccacaagcagcttgcgactaagatccggttatggcaccagcagggcgaacgctgcctgtacacggggaagaccatctccatccatgacctgatcaacaaccccaaccagttcgagatcgaccacatcctgccactcagtatcacgttcgacgactccctggccaacaaagtgctggtctacgccaccgccaaccaagagaagggccagcggaccccctatcaggccctcgacagcatggacgacgcttggtcctttagggagctgaaggcgttcgtgcgggagagcaaggctctatccaacaagaagaaagagtacctgctgacggaggaggacatcagcaagttcgacgtccgcaagaaattcatcgagcggaacctggtggacacgcgctacgcgtccagggtggtcctcaacgccctgcaagagcacttcaaagcccacaagatcgacaccaaggtgagcgtggtacgcgggcaattcacctcccagctgcgacgccactggggcatcgacaagacgagagacacctaccaccaccacgcggtggacgccctcatcatcgccgcgagctcccagctgaacctatggaagaagcagaagaacacactcgtgagctacagcgaagaccagctgctggacatcgagaccggggagctcatctccgacgacgaatacaaggagagcgtcttcaaggccccctaccagcacttcgtggataccctgaagtccaaggagttcgaagacagcatcctgttcagttaccaagtggacagcaagttcaacaggaagatctccgatgccaccatctacgccacccgccaggccaaagtcggcaaggacaagaaggacgagacctacgtgctcggcaaaatcaaggacatctacgcgctggggacgaagaccccgagcaagacaggtttctacaaattcctggacctctacaacaaagacaagtcccagttcctggtgtaccagaaggaccggaagacctgggacgaggtcattgagaagatcatggagcaataccgcccgttcaaggaaagcgataaaaacggcaaggaggtggattttaaccccttcgagaagtaccggatcgagaacggccccattcggaagtactctcgcaagggcaacggacccgaaatcaagagcctgaagtactacgcctccaagctcggcaaccacatcgacatcacgccgaaagacagcaacaataaggtggtcctgcaatccgtgagcccctggcgcgccgatgtgtacttcaacaaaaccaccgggtcctacgagatcttaggcctcaaatacgccgatctgcagttcgagaaggggaccggcacttaccggattagcgaggagaagtacaatgacatcaagaagaaggagggcgtagacagcgactccgagttcaagttcaccctgtacaaaaatgacctcctgctgataaaagataccgagaccaaggagcagcgcctcttccggttcctgagccgctccatgcccaataagaagcactatgtagagctgaagccctacagcaaagacaagttcgagaagaacgaatccttaatcgaaatcctagggagcgccgacaagtccgggcggtgcatcaaggggctggccaaaagcaacctatccatcttcaaagtgcgaacggacgtcctgggcaaccaacacatcatcaagaacgagggggacaagccgaagctggacttctga

SEQ ID NO: 7477 - RNA, 3408 nt, synthetic construct
  misc_feature 1..3408: note = Cas9 variant
  source 1..3408: mol_type = other RNA
atgggcgtcatcttcctttacgaaaacatcgttaaacccttccccagccgatatgataaagcaataatgaaacgactaaaaggacggcaaacaatgggatacatcctcagtctcgacataggaatagcatcgtgcggatacagtgtactagaaacggacgcgctcggcgtcccttacaaaatcaaaacactaaactccatcatattcacccgagcagagaaccccaaaaccggcgcctccctcgcggagccacgcagaaagtaccgcggcgccagaaggaggaaaagacgcaccagctttcgaaagcaccgcacccgccaactcttcatcacttcaggtcttctctcgaaacaagacatcgcccgctatcttaaccaacaagaaccccacgacgacatctgggaactacgcgtcaagggtctcgacgaaccgctgacaaacctacaactcttccaggtactctactatttcgtcacccacaggggcttcaaaagcaacaggaaagcagaactaaaagataaagacatcggccccgtactaaactccatcaacgcattcaaggaagagatgcagtcacacgactaccgcactatcggagaattatacgcgaacgacccacgattccgcgaccgcaagcataacaaagactacacgaacggtttcctcggtacaatacagcgcagctggctcgtagacgaaataaaaatgctgctaacaaaccaacagagcttcgggaacacacagcttaccagcgagttcatcgaactatacctaaacatattcacctctcagcgcaacttcgatgacgggcccgcaagtggtccctactccggagacctgatagataaaatggtcggcccagacaccttcaaccgctcccgaaaacgggccccacgcgcgacctacacattccaatacttcagcttcttgtccaaactcaacagcctccgaatcgcacccagcatctccgcccctttcgaaaccctcacagtcgaccaacgcgccctaatcacaaaaagactatggggacctgacgtgaaaagcgcagacctcaaattcaaacagatcagaatggttctatccctaccggaaacagccagattcaacctggtcaactacggcaacacccctgagaaggcattagagatcgaagacaagacaaccttcatctccataaaacctctacgcgaaatagaaaaggcactaaccggcaccacactccccgtatcccacgatcaactagatgccatcgcacgcatactaaccgtatacaaaagcgattctaaccgaaagaccgcattccacaaccagacagtactaagtgatgaggtaatcgaacaactgctacccctcaatttctcgaaattcggccacttatccgtcgaaaccatgcaagaaataattccctacctagaacaaggaatggtatactccgacgctgcgacagctgcaggctacgacttccgcaacaaccaaatcgacatggaatacatacgagacaacgtaacaaatccagtcgtcaggcgagccgtatcagtcgccaataagctagtaaaagccgtggtccggcgatacgggaaacccgactcaatacacatagagctcgccagagacctgtctcaaaacttccaagaacgccgacaagatgaagtgcggcagcagaaaaatgcccgagacaacgagaaaatagccaaacgcctcgaagaactcggaatccccgttaatggagtaaacataacgaaaatgaaactgtatgacgaacaacacggaatagatctatacgacctaagcaccaacgcctcaatggccgtaactgacatctttagtgacgaccgttatgaaattgaccatatcatcccatactcggtctcctttgacgactcatacacaaacaaagtactcgtatccgccaaggcaaaccgcgaaaaacgcgacaggatcccaatggaggtattcggcaacgactcggaacgccgccgacaattcgaaaatcgagttaacacaaacatcacaaatttacgtaagaaaaggaacctgttaaaagaaacgttctcagacgaggacaaagcgaaatggaaatcccggaacataaatgacacccgctatctcaatcgcatacttatgaactatctcagccaaaatgtagagtttaccgatgtcctgtccgacgctaaacacgtcatcgccctaaacggcgccgtaactgcaaaaatccgatcccgctggggaatcaccaaggttcgcgcagcaggagacctgcaccacgccgtagacgccgtagtgataggatgcgtcaccgacgcactgatacaagcggtcacccgttacgccaaataccaagaacgccgtgacaacaaagcagcagcggaacaagacctagccgaaaacaaccccgaagaactggacgccaaacaattcagaaaggtatttaacgattacccactgccgtggcccgagttccgagaagaactaatgggcagagtaagttcggaccccagtcagatcatggccggccgtcaatggtcccactacacagccgaggaaatctccgagctaaaacaacccttcgtcgtacgagttccaaaccaccgcatagtcggccccgccacccttgacactgtatacggacaaccaaaccccgatgacggactcataacccagagggtacgaatcaccgacctcaaaccacagaagaacaaggacggcgaagacataataaaagcgggagccaacgtgtacgaactcgcggcagacggcggcaacaaactcgtatacgaatccatactcgatgcgttacaagtagcaggaggcgacggaaagaaggcattccctacaggccgcctcctggtccgcagccctatccaagacatacccgtcgaaagagtacgagttactagcaaagccaccctagtcgttccagtgggccccaaatccgtagccgcaaacggatccatggtacgaatagacgtttacaaaaccccaaagaaatacgtcttcgtccccatctacgtccgcgacacggtaaaagcagagcttccagaccgcgcggtggcccccgtgaaaccgtactcgcaatggtaccagcttcaacccaaagaccagttcctattctcactattcgcaaacgacctgataagattcaaacacccccgcggagtgagtacaaaagaaatcctcaccgacggctcacaggagaaagggaaaagaacagacgtcgtcgggtactttacaggagccgacatcgcgacagccagcatcgcgatcgaaggcccagaccgctccttcagcgcccgcggcatcggcttcgcctccttaaagaatgtcgaaaaactaacagtcaactacttcggcgaactccacagcgtacacgagacacagccaatgcagttccgcgggcaacgcggatga

SEQ ID NO: 7478 - RNA, 3411 nt, synthetic construct
  misc_feature 1..3411: note = Cas9 variant
  source 1..3411: mol_type = other RNA
atgaacggcctagtgctcgggctggacatcggcatcgccagcgtcggggtgggcatcctggagaaggacaccgggaagatcatccacgcctccagccgcctcttccccgcggccaccgctgacaacaacgtggagcggcgctccaaccggcagggccgccggctgaaccgccggaagaagcaccgcagcgtccggctgcaggacctcttcgagtcctacgggctgctgacggacttctcaaagctctccatcaacctgaacccataccagttacgcgtgcaggggatggagaaccagctcaccaacgaggaactgttcatcgcactgaagaacatagtgaagcggcgcggaatcagctacctcgacgacgcctccgaggacgggggcaccgtcagctccgactacgggaaggcggtggaggagaaccggcgactgttgaccgagaagacgcccggccaaatccagctcgagcgcttcgagaagtacggccagctgcgcggggacttcaccgtggaggagaacggcgagaagcggcgcctgatcaacgtcttcagcaccagtgcctaccgcaaggaggctgagcgcatcctccggaagcagcaggagttcaacaacaagataaccgacgagttcatcgaggactacctgacgatcttaaccgggaagcgcaagtactaccacggccccggcaacgagaagtcccgcaccgactacgggcggtttcgcaccgacggcactaccctcgacaacatcttcgggatcctgatcggcaagtgcaccttctaccccgaggagtaccgggccagcaaggcgagctacaccgcccaggagttcaacctgctcaacgacctgaacaacctgacggtgccgaccgagaccaagaagctctccgaggagcagaagaagactatcatcgagtacgccaagagcgccaagacgctgggggcctccaccctgctcaagtacatcgcgaagatgatcgacgccagcgtggaccaaatccgcggctaccgggtcgacgtgaacaacaagcccgagatgcacaccttcgaggtataccgcaagatgcagagcttggagaccatcaaggtcgaggagctgccccggaaagttctcgacgagctggcccacatcctgacgctcaacaccgagcgcgagggcatcgaggaagccatcaactccaagctcaaggacaccttcaaccgggaccaggtgctggagctcgtccagttccgcaagaacaacagctcactgttcagcaaggggtggcacaacttctccctgaagctcatgatggagctgatccccgagctgtacgagaccagcgaggagcagatgacgatcttaacccggctgggcaagcagcgctccaaggagaccagcaagcggaccaagtacatcgacgagaaggagttaacggaggagatctacaacccggtggtggccaagtccgtccgccaggctatcaagatcatcaacgaggccaccaagaagtacgggatcttcgacaacatcgtgatcgagatggcccgggagaacaacgaggaggacgccaagaagaactacatcaagcagcagaaggccaaccaggacgagaagaacgccgccatggagaaggccgccttccagtacaacggcaagaaggagctccccgacaacatctttcacgggcacatggagctcgccaccaagatccgcctgtggcaccagcagggcgagaagtgcctgtacaccggaaagaacatccagatcagcgacctcatccacaatcagtacaagtatgagatcgaccacatcctgcccctgtccctcagcttcgacgactccctgagcaacaaggtgctcgtcctcgcgacggccaaccaggagaaggggcagcggacccccttccaggccctggattccatggacgacgcatggagctaccgcgagttcaaatcctacgtgaaggagagcaagctgctcggcaacaagaagaaggactacctgctgacggaggaggacatctccaagatcgaggtcaagcagaagttcatcgagaagaacctcgtggacacccggtacagcagccgcgtggtcctgaacgcgctgcaggacttctacaagaagcatcagttcgacaccacgatctccgtggtgcgcgggcagttcaccagccagctccggcgcaagtggaagctggagaagtcccgggacacctaccaccaccacgccgtcgacgccctgatcatcgccgccagctcccaactccgcctgtggaagaagcacaacaacccgctgatcagctacaaggacggccagttcgtggactctgaaaccggggagatcgtgagcctctccaacgaggagtataaggagctggtcttcaaggcgccctacgaccacttcgtggacacgctgcggagcaagaagttcgaggactccatcctctttagctatcaggtggactccaagtacaaccgcaagatcagcgacgccaccatctacgccacccggaaggccaagctggacaaggacaagaaggagtacacctacacgctgggcaagatcaaggacatctacgccctcggcaccaagaccccctccaagaccgggttctacaagttcctggacctgtacaagacggacaagagccagttcctcatgtaccagaaggaccgcaagacctgggacgaggtaatcgagaagatcatcgaacagtaccggccctttaaggaatacgacaagaacggcaaggaggtggacttcaacccgttcgagaagtaccgcatcgagaacgggcccatccggaaatactcccggaagggcaacggcagcgtgatcaagagcatgaagtactacgacaacctcctggggaagttcgtcgacatcaccccctccgagagcaagaaccccgtggcgctcttgtccttgaacccgtggcgaaccgacgtgtactacaaccccgagacgcgcaagtacgagttcctcggcctgaagtacgccgacctgtgcttcgggaagggcgggagctacggcatctccgaggtcaagtacaacaagatccgggagaaggagggcatcgggaaggagagcgagttcaagttcaccctctacaagaacgacctgatcctaatcaaggacaccgaaacaaactgccagcagttcttccgattctggtcccggacgggcaaggacaaccccaagagcttcgagaagcacaagatcgagctcaagccctacgagaaggccaagttcgagaagggggaggagctggaggtgctgggcaaggtgccgccctcaagcaaccagttccagaagaacatgcagatcgagaacctctccatctacaaggtcaagaccgacgtgctggggaacaagcacttcatcaagaaggagggcgacgagcccaagctgaagttcaagaagtga

SEQ ID NO: 7479 - RNA, 3411 nt, synthetic construct
  misc_feature 1..3411: note = Cas9 variant
  source 1..3411: mol_type = other RNA
atgaacggcctggtgctcgggctggacatcggcatcgccagcgtcggggtgggcatcctgaagaaggacaccggggagatcatccacaccaactcccgcctcttcagcgccgcgacggccgactccaacatcgagcggcgccggcaccgcggaggcaagcggctgacccgccggaaaaagcaccgcagcatccggctgcacgacctcttcgaggactccgggctgctgaccgacttcagcaaggtgtccataaacctcaacccctaccagctgcgcgtccagggcctggacaaccagctcaccaacgaggagctgttcatcgccctgaagaacattgtgaagcggcgcgggatctcatacctcgacgacgcctccgaggacggcgggacggtgagctccgattacggcaaggccgtcgaggagaaccggaagctgctggcggagcagaccccgggccagatccagctcgaccgcttcgagaagtacgggcaggtccggggcgacttcaccgtggtggagaacggggagaagcgccggctgatcaacgtgttcacaacaagcgcctactccaaggaggccgagcgcatcctgcggaagcagcaggagttcaacaagaagatcactgacgagttcattgagaactacctcaccattttaaccggcaaacgcaagtactaccacggccccgggaacgagaagtcccggacggattacggccgctacaccaccaagaaggaccccgaagggaagtatatcaccctggacaacatcttcggcatcttgatcgggaagtgcacgttctaccccgacgagtaccgcgccagcaaagcgagctacaccgcccaggagttcaacctgctgaacgacctcaacaacctgaccgtgccgacggagacaaagaagctgtccgaggagcagaagaagaccatcatcaagtacgccaagaccgccaagaccctcggggccagcacgctgctgaaatacatcgcgaagctcatcggcgcctccgtcgaccagatccacgggtaccggatcgaccccaacaagaagcccgagatgcacaccttcgagacctaccgcaagatgcagagcctggagaccatcagcgtggaggaaatcccccggaaggtgctggatgagctcgcccacatcctgacgctcaacaccgagcgcgaggggatcgaggaggctatcaacgccacactcaaggataccttctcccaggaccaggttctggagctggtgcagttccggaagaacaacagcagtctcttcagcaaggggtggcacaacttctccctgaagctgatgatggagctcatcccggagctgtacgagacgagcgaggaacagatgactatcctgacccgcctcggcaagcagaagtccaaggagaccagcaagcggacgaagtacatcgacgagaaggaactgaccgaggagatctacaaccccgtggtcgcgaagtccgtgcgccaggccatcaagatcatcaacgaagccaccaagaagtacgggatcttcgacaacatcgtgatcgagatggcccgggagaacaacgaggaggacgccaagaagggctacaacgagcgccagaaggcgaacctggatgagaagaagtccgccatggagaaggccgccttccagtacaacggcaaaaaggagctgcccgacaacgttttccatggtcacaaggagctcgccaccaagatacggctgtggcaccagcagggcgagaagtgcctgtacaccgggaagaacatccccatcagcgacctcatccagaaccagtacaagtacgagatcgaccacatcctgccgctgagcctctccttcgacgacagcttatccaacaaggtgctggtgctcgcaacggccaatcaggagaagggccagcgcacccccttccaggccctggacagcatggacgacgcctggtcctaccgggagttcaagagctatgtcaaggacctgaagctcctgagcaacaagaagaaggactacctgctcaccgaggaggacatcagcaagatcgaggtgaagcagaagttcatcgagcgcaacctggtcgacacccggtacagctcccgcgtggtgctgaacgcgctccaagacttctacaaggagcaccagttcgatacgaccatcagcgtcgtgcgtgggcagttcacctcccaactgcgccggaagtggggcctggagaagtcccgcgagacctaccaccaccacgccgtggacgccctcatcatcgccgccagcagccaactgcgcctgtggaagaagcagaacaaccccctcatctcctacaaggagggccagttcgtcgaccaggagacgggggagatcatcagcctgtccgacgacgaatataaggagctggtgttcaaggcgccctacgaccacttcgtggacaccctcaagagcaaaaagtttgaggattccatccttttcagctaccaggtcgactccaagtacaaccggaagattagcgacgccaccatctacgccacccgcaaggccaagctggacaaggagaagaaggagtacacgtacaccctcggcaagatcaaggacatctacgccctggggtccgagaagctgaagaccggcttctacaagttcctccacctgtacaagaaggacaagagccagttcctgatgtaccagaaggaccggaagacctgggacgaggtgatcgagaagatcctcgagcaatacagaccattcaaggagaaggacaagaacggcaaggaggtggacttcaatcccttcgagaagtaccggatcgagaatgggcccatccacaagtactcccgcaagggcaacgggcccgtcatcaagagcctgaagtactacgacaagaacatcccggagagcttcatcaacatcaccccctccaacagcaagaacaaggtgatcctgcggcagctcaacccctggcgcaccgacgtgtacttcaaccaccagaccgagaagtacgagctgctgggcctcaagtacgcgcacctccagttcgagaagaagaccgggaactactcaatcacgatcgacaaatataacgagatcaaggagaaggagggcgtaagcgaacagtccgagttcaagttcaccctgcacaagaacgacctactgctgataaaggacaccgagaccaaggagcagcagctgttccgtttcctgagccgcacgaagcccaacgtgaagcactacgtggagctgaagccttactcccgggacgagttcgaaaagaacgagcgcctcatcgagatcctgggcagcgtcgacaagtccgggcggttcgtgaagggcctgggcaagagcaacctctccatctacaaggtgcgcaccgacgtcctggggaatcagcacattatcaagaaggagggggaggagcctaagctgaagttctga

SEQ ID NO: 7480 - RNA, 3411 nt, synthetic construct
  misc_feature 1..3411: note = Cas9 variant
  source 1..3411: mol_type = other RNA
atgaacggcctggtgctcgggctggacatcggcatcgcctcggtcggggtgggcatactggagaaggacaccgggaagatcatccacgcatccagccgcctcttcccggctgccacggccgataacaacgtggagcgccgctccaaccggcagggccgccggctaaaccgccggaagaagcaccgctcagtccggctgcaggacctcttcgagggctacgggctgctaacggacttctccaaggtgagcatgaacctcaacccgtaccaactgcgcgtgcagggcatggagaaccagctaactaacgaggaactgttcgtcgccctcaaaaacatcgtgaagcggcgcgggatctcctatctggatgacgccagcgaagacggagggaccgtgtccagcgactacggaaaggcggtagaggagaaccggaaattactggccgagaagacccccggacaaatacagctggagcgcttcgaaaaatacgggcagctccggggcgacttcacggtggaagaaaacggggagaagcatcgcttaatcaacgttttctccaccagcgcctaccggaaggaggccgagagaattttacggaagcagcaagagttcaactccaagatcaccgacgagttcatcgaggactacctcatcatcctgaccggcaagcgcaagtactaccatgggcccgggaacgaaaagtcccggacggactacggccgcttccgcactgacgggactaccttagacaacatcttcggcatcctcatcggcaagtgcacgttctacacagaggagtaccgggcaagtaaggccagctacaccgcccaggagttcaacctgctgaatgacttaaacaacctgaccgtcccaacggagaccaagaagctgtccgaggagcagaaaaagctcattattgagtacgccaagagcgccaagaccctgggcgcgtccaccctgctcaagtacatcgccaagatgatcgacgccagcgtggaccagatccgcggctacagggtggacgtcaacaacaagccggaaatgcacacgtttgaggtgtaccgcaagatgcaaagcctggagaccattaaagtggaggagctgccccggaaggtcctcgacgagctggcccacatcctgacgttaaacaccgagcgcgaagggatcgaggaggccatcaactccaagctgaaggacatcttcaaccgtgaccaggtgcttgagctcgtgcagttccgtaaaaataacagctccctgttcagcaagggctggcacaacttctccatcaagttgatgatggagctaatccccgagctgtacgagaccagcgaggagcagatgaccatcctgacacggctcgggaaacagcgctctaaggagacctccaagcggacgaagtacatcgacgagaaggagctgaccgaggagatctacaaccccgtcgtagccaagtccgtgcgccaggccatcaaaatcatcaacgaggcaacgaagaagtacggcatctttgacaacatcgtgatcgagatggccagggaaaacaacgaggaggacgccaagaaagattacatcaagcggcagaaggcgaaccaggacgagaagaatgcggctatggagaaagccgcctttcagtacaacgggaagaaggaactgccggacaacattttccacggacacaaggagctgaccacgaagatccggctctggcaccagcagggcgagaagtgcctgtacaccgggaagaacatacccatctcggatctgatccacaaccagtataagtacgagattgatcacattctccccctgtccctgagcttcgacgactccctcagcaacaaggtgctagtgctggcgacagccaaccaggagaagggtcaacgcacccccttccaggcccttgactccatggacgatgcatggagctaccgcgagttcaagtcctacgtgaaggacagcaagctgctttccaacaagaagaaggactacctcctgacggaggaggacatcagcaagatcgaggtgaaacagaaattcattgagcgcaacctggtcgatacacgctacagctcccgcgtggtgctcaacgcgttgcaggacttctacaaatctcaccagctagacaccacaatctccgttgttaggggtcagttcaccagccagctgcggcgcaagtggggcatcgagaagtcccgggagacgtaccaccatcacgccgttgacgccctgatcattgccgccagctcacagctgcgcctctggaagaagcacagcaacccgctgatcgcgtacaaggaggggcaatttgtcgactctgagaccggcgagattgtgagcctgtccgacgaggaatacaaggagctcgtgttcaaggccccatacgatcacttcgtcgacaccctgcggagcaagaagttcgaggactccatcctgttcagctaccaggtggactccaaatacaaccgcaagatcagcgacgcgaccatctacgccacgcggaaggccaagctcgataaggagaagaaagagtacacctacaccctgggcaagataaaggacatctacgcgctgggtactaagacgccctccaagactggcttctacaagttcctcgacctgtacaagactgacaagagccagttcttaatgtaccagaaggaccgtaagacgtgggatgaggtcatcgagaagataatcgagcagtaccggcccttcaaggagtacgacaagaacgggaaagaggtcgacttcaacccgtttgagaagtatcgcataggcaatggccccatccggaagtacagcaagaaggggaatggccccgagatcaagtcactcaaatactacgacatcctgcttgggaaacacaaaaacattacgcccgatggaagccgcaacaccgtggccctgttgtccctgaacccttggcggaccgacgtgtactacaacagcgagaccaaaaagtacgagttccttgggctgaagtacgccgacctgtgcttcgaggagggcggcgcttatgggatcagcgaggtcaagtacaagaagatacgcgagaaggaggggatcgggaagaacagcgagttcaagttcacactttacaagaacgacctgatactgataaaggacaccgagaccaactgccagcagttcttccgtttctggtcccgaacaggcaaggataaccctaagagcttcgagaagcacaagatcgagctcaaaccctacgaaaaggccaagtttgagaagggggaggagctcaaggtgttaggcaaggtgcccccttccagcaaccagttccagaagaacatgcagatcgagaacctctccatctacaaagtaaagacggacatcctaggcaataagcacttcatcaagaaagagggggacgagcccaagctgaaattcaagaagtga

SEQ ID NO: 7481 - RNA, 3420 nt, synthetic construct
  misc_feature 1..3420: note = Cas9 variant
  source 1..3420: mol_type = other RNA
atgagcgacctggtgctcggcctggacatcgggatcggctccgtcggggtgggcatcctgaacaaggtgaccggggagatcatccacaagaatagccgcatcttccccgccgcccaggcggaaaacaacctcgagcggcgcaccaaccggcagggccgccggctgacgcgccggaagaagcaccgccgagtacgcctgaaccatctcttcgaggaatccggcctgatcaccgacttcaccaaggtgagcatcaacctgaacccctaccagctccgggtgaaggggctgaccgccgagctgtccaacgaggagctgttcatcgccctgaagaacatggtcaagcaccgcggcatcagctacctggacgatgcctccgacgacgggaatagctccgtgggcgactacgcccagatcgtgaaggagaacagcaagcagctcgagacgaagacccccgggcagatccagctggagcgttaccagaagtacggccagctgcgcggcgacttcaccgtcgaggaggacgggcgtaagcaccgcctcatcaacgtgttccccaccagcgcgtaccacgccgaggccctacggatcctgcagacgcagcaggagttcaacccacagatcaccgacgagttcatcaacagctacctcgagatcctgaccggcaagcgcaagtactaccacgggccgggcaacgagaagtcccggaccgactacggcaagtacacgaccaagaaggacgcccaggggcagtacatcaccctgaacaacatcttcggcatcctcatcgggaagtgtaccttctatcccgaggagtaccgggcggccaaggccagctacacggcgcaggagttcaacctgctgaacgacctcaacaacctgaccgtacccaccgagaccaagaagctgtccgaggagcagaagtaccagatcatcacgtacgtcaagaacgagaaggccatgggccccgcgaagctgttcaagtacatcgccaagctactttcctgcgacgtggccgacatcaaggggtaccggatcgacaagtccgacaaggccgagatccacaccttcgaggcctaccgcaagatgaagaccctcgagaccctggacgtgaagaagatggcgcgcgaggagctggacaagctcgcctacgtcctgacgctgaacaccgagcgggagggcatccaggaggccctcgaccacgagttcgccgacggcaccttcagccaggagcaggtcgacgagctggtgcagttccgcaaggccaactccagcatcttcgggaagggctggcacagcttctccgtgaagctgatgatggagctcatcccggaactgtacgcgaccagcgaggagcagatgacgatcttgacccggctcgggaagcagaagaccacctccagctccaacaagacgaagtacatcgacgagaagcagctgaccgaggagatctacaaccccgtggtggccaagtccgtccgccaggccatcaagatcgtgaacgccgccatcaagaagtacggcgacttcgacaacatcgtgatcgagatggcgcgggagaccaatgaggacgacgagaagaaggccatccagaagatccagaaagccaacaaggccgagaaggacgcggccatgcgcaaggccgccaaccagtacaacgggaaggccgagctgccccactccgtcttccacggccacaagcagctcgcgaccaagatccggctgtggcaccaacagggcgagcgctgcctgtacacggggaagactatcagcatccacgacctgatcaacaaccccaaccagttcgagatcgaccacatcctcccgctgtccatcaccttcgacgacagcctggctaacaaggtgctcgtctacgcaaccgccaaccaggagaagggccagagaaccccctaccaggccctggactccatggacgacgcgtggagcttccgcgagctgaaggccttcgtgcgggagtcgaaggccctcagcaataagaaaaaggagtacctgctgacggaggaggacatctccaagttcgacgtgcgcaagaagttcatcgagcggaatctcgtcgacacccgctatgccagccgggtggtgctgaacgccctgcaggagcacttccgcacccacaagatcgacaccaaggtctccgtggtgcgggggcagttcacgagccagctccgccgccactggggcatcgagaagacccgcgacacctaccaccaccacgcggtcgacgccctgatcatcgcggcctccagccagctgaacctctggaagaagcagaaaaacaccctggtgtcttactcggaggaccagctgctcgatatcgagacgggggaactgatcagcgacgacgagtacaaggagtccgtgttcaaggcgccatatcaacacttcgtcgacaccctcaagagcaaggagttcgaggactccatcctctttagctaccaggtggactccaagttcaaccgcaagatcagcgacgccaccatctacgccactcggaaggctaagctggacaaggagaagaaggagtacacgtacaccctgggcaagatcaaagacatctacgccctcggcaccaaaaccccctccaagacggggttctacaagttcctggacctgtacaagaaggacaagagccagttcttaatgtatcagaaggaccgccggacctgggacgaggtgatcgagaagatcctggagcagtatcgcccgttcaaggagaaggacaagaacggcaaggaggtcgacttcaaccccttcgagaagtaccggatcgaaaacgggcccatccgcaagtactcccggaagggtaacggccccgagatcaagagcctgaagtactacgacaacctcctgggccgcttcgtggacatcaccccgtccgagagcaagaaccccgtggcgctgctctccctgaacccctggcggaccgacgtctactacaacacggagacccgcaagtacgagttcctgggcctcaagtacgccgacctgtgcttcgagaaaggcggtagctacgggatctccaaggtgaagtacaacaagatccgggagaaggagggcatcggcaagaacagcgagttcaaatttaccctgtacaagaacgacctcatcctgatcaaggacaccgagacgaaccgccagcagatattccggttctggagccgcaccgggaaggataaccccaagtccttcgagaagcacaagctggagctcaagccgtacgagaagacccggttcgagaagggcgaggagctgaaggtgctggggaaggtcccgcccagctccaaccgcctccagaagaacatgcagattgagaatctgagcatctacaaggtgcggaccgacgtgctgggcaaccagcatatcatcaagaacgagggggacaagcccaagctcgacttctga

SEQ ID NO: 7482 - RNA, 3420 nt, synthetic construct
  misc_feature 1..3420: note = Cas9 variant
  source 1..3420: mol_type = other RNA
atgaactactataacggattcatcataaccgaaaacgcaatggcgagcaaacacgaaaacctcggcgcactcacattcggcctggacataggtatcgcatctgtaggctgggcagtgctaggggaaaaccgcataatcgaccttggcgtccggtgtttcgacaaagccgaaaccgccaaagaaggagaatccctcaacctagcccggagaacggcccgactgctcagacggcggttacgacgacgagcatggagactgacgaaactggcgcgccttctaaaaagagagggacttatcgccgacaccaacgtcttccagaaacccttcaacctcaaggacgcaaacgagaaagggttatcattctggcaactacgcgtggacgcactggacagaaaactttcagccgaagagtgggcacgtgtcatataccacttatgcaaacaccggggattccactggatctcgcgcgccgaagagaaagccgcggagggcgacagtaaaagtgaaggaggaaaggtaaagcagggcctggccggaacgaagaaactgatgcaagagaaaaactaccgcacagcagccgaaatggtcctaactgagttcccggaagcccagagaaataaacaaggagattactccaaagcactatcgcggattctactaggcgacgaaatgacacaactattcaaacaccaaagggaactaggcaacccccacgcgaccgaaaaactagaagccgcgatattaggcaatggggaccacaaaagcggactcttctgggcgcaaaaccccgccctggccggaaacgaccttctcaaaatgctcggacactgcaccttcgaaaaggcagaataccgcgtcccaaaagccagcttcacagcggaaaggcacgtctggctaacgcgactaaacaacttaagaatcgtagtcgacggaacgacccgacctcttaacgaagcggagagacacttggcactcctcatgccctaccaacaggcaggagatctcacgtacaaacaactccgcaccgcactaacaaaagcaggatacctcccagagagcttccgctacacagggctggcatatgccagcggccaaaaagcggacgaaaaagcaaaagatcccgaaagtgcacccctagttaagctcccggcgtggcacgaactacgaaaaaccctcgaaaagaaagaactcgcatcggagtggcagaaaatctcctcagacgccctagacggcaaaccccaactactagaccaaatagcctgggtcttgagcgtatacaaagacgacaccgaggtcgaagcggaactctgcaaactcaatctaccgaacgcagagaaaatgatcgacgccctcctagacatccgattcgacaaattcagcaacctgagcttaaaagccctccgccaaatcgtccccctgatggaacagggccagcgctacgacgaagcggtagcaaacatacccgaatacggtcaccacagccagctgcacgaagtaggagccggagaacacaaatacctcccaccattctataaagaacgcgacaaaaccggtcgaatggtcttcaacgacgacatggacataccgcgcaaccccgtcgtattacgagccctgaaccaagcacgcaaggtcgtaaatgccctcattaaagagtatggaagcccccacgaagtccacatagaaatggcgcgcgatctaagccgaccacttgacgaaagaagggacgtagagaaactgcaaaaagagttccgagaccgcaacgaaaaggacaaagccctattcgcacaggacttcaacatagtaggcgctgtaaaaggcaaagagttcgaaaaataccaactctaccgagaacaacaaggtaagtgtgcttacagcatcgaacccatggacatacacagactcttcgagcaggggtatgtggagatagaccatgcgctaccatattcacgcagcttcgacgacagcaaaaacaatagagtccttgtattagcaaaggaaaacagggacaaagggaacaggaccccattcgaataccttggcggaaaagacaactcagagcggtggagacaattcgtagcgttcgtagaaggaaacaaatcctaccggctcgccaaacgatcgcgtttgctcaggaaggacttcggaaaagacgaagcaaaaggcttcagggaaagaaacctaaacgacaccaggtacatatgccgtttcttcaaaaactacgtggaacaatacctacaattgcacgaagactccgacgccaagcggtgcgtcgtactatccgggcaaatgacctcattcttaagagcaaggtggggcctcgtaaaagtcaggggcgattcagaccgacaccacgcacttgacggagccatagtggccgcatgcagccactccatggtaaaacgcctcagcgactacagccggcgaaaagaactcgaacaagtccgagcagggttcgttgacgtcgacaccggcgagatcgtcaaccccgctatgtttcagcaagtgcaagaacactttccaaacccatggccacacttcagggacgaagtaaaactgcgcctgaacgtcgacgacccagcgctcctccattccgaaatgaaccgcttcgggacctacagccccgaggccctcaaagcgctccgacccctatttatcagcagagcaccccagcgtcggaatagcggagccgcccacaaggacacaatttacgctcaacccgaacgcctagtcgcccaaggcggcgtgacccagaaagtacccctaacctcactaaccctaaaggacctcgataaactcatagacccccaccgcaacgaaaaactatactcagcaataaggatccgcctagagcaacatggaggcaaaggcgacaaggccttccccgccagcaacccattacgaaaaccagactcggaaggcaacccaaccggccccatcgtacgcggtgtaacaatggtaatcgacaagctctcgggaataccaataaggggcggcatcgccaaaaacgattcaatggtaagggtagacgtattcaccaaggccggcaaattccatctagtccctgtatacgtccaccacgccgtagcaaaagtgctgccgaatagagctgtagtagcgtacaaggacgaaaccgaatggacactaatcgacgacggatttgacttctgcttttcaatgtacccgaacgacctgctgagaataaagctaaggaacgcctcgcacctgggatactatgcctcctgcaatcgctccacgggagcgatcaacctatggtcacacgaccgaaaccaacaagtcggaaaagacggaatgatagaaagcatcggcgtcaagactgcactcaatgtcgaaaaactaaatatagatgtactaggcaaccgataccctgcacctccagagaaaagacgtgacctagcatga

SEQ ID NO: 7483 - RNA, 3423 nt, synthetic construct
  misc_feature 1..3423: note = Cas9 variant
  source 1..3423: mol_type = other RNA
atgaagaacatgacgaaagtcaacgtcggcctggacgtggggatcagctccgccggctggagcgttatcaacgccgagactaaccagatcctcgagtccggcgtccgcctatttagcggctccgacgccgacgaaaacgtgaaccggcgcaatcagcggcagggtcgccggctgttcagacggcgcaagctgcggatccaggaggccaaaaagtacctggaaaacgtgtttcagctgaaagatatcgagcccaaggacgagtggaacccgtacgagattcgcgtgcgggccctcaacgagaaggtgagcaaggaggaactgtccatcgccctgctcaacattgtgaagcaccgcggtatcagctacgaactggaggatgtcaccgacgaggagggcactaacacccagtcattccagagcgggctggactacaaccggcgcctcctgaagaccaagactgtgggcgagatacagtacgaccggctgcaaaagtatgggcaagtgcgcgggcagatccagaccgaggacgggttgctgatcaacatcttccccaccaaaaactacgtcgaggaagtggagaggatcctggaaacccagaagaagtatcaccccgagatcgacgacgtattcatcgagaagatcatctccttcgtgacgagaaagcgtgagtacttcgttggccccggcaacgaaaagagccggacagactacgggatctaccgggaaaacggcgagaccttggacaaccttttcgaaatcctgatcgggaaggataagttctacccggaagagtaccgcgccgcgggcagctcctacaccgcccagatcttcaatctcctgaacgacctgaataacctccgcatccccacgaccgaggaccaccacctgaccaaggcccagaaggaggagatcatcaccgagttaaagaacacgtcccggctcagcggcggaatgctaaagctgatctccaaggtgaccaaggcccccaaggaggagatcagtggctaccggaaagacgagaaggacaagcccgaccttcattccctggcgtactaccggaaacaaaagaacatgctggagaaggagggtatccagatcgccgacttcagcgaggagctcctggacgagctggccaccatgatgaccttaaacacggagccaggagaaatacgcaagcagctgaacaagatcaccaaccagtacgacatcctcacccctgaagtcatcgaggtgctcgttaagaaccatacggccttcgtcgcaacgagcaaccacaagtggcaccggttctccctgaagctgatgaaggagttcatccccgagctcctggagacctcgaaggagcaatccaccatcctgtgcgaacgcgggttcatccagaaccgggcgagctatctcgacgagaaccatcacttcaactacgccgagctacgcgagaacctgtacaacccggtggtgcggaagtccacgtgcgaaatgctcaaggtcttcaccgccatacaggagaaatacccgaacatccagaacgtgatcgtcgagctgcccagagagactaacgaggacgagcagaagcggaagatcaagaagattaacgacaacaacgccaagcgcaagaaggagatcttgaaggaggctcaggcgcaaagcggcctgtccgaggaggccctcgaagagaagctgctgaagaccaaaggactctacctgaagctgatgctctggtacgagcaggaggggaagtgcgtgtacagcgggcaagagataccgctgtccgacctcctccagaataaaggcgggtacgaggtggatcacatcatccctatcagcatctccttcgacgaccggctgtgcaacaaggtcctggttcgccagcagctcaacagccagaaatccaaccaaaccccgttcgagtacatgacaacccataccgatgggcacctgagctttcacgagctgaaggagctcgtgggcaagaacaagcggttctccaaggagaagcgcgagctgcttctcgccgagatctacagcaacgacatcgagacccggaaacgcttcatcaaccggaacctggtcgacacgtcatacaccgcccgcatcgtgcttaacgccctccagcagtacaagaaggagaaccagctgagcatgaacgtgagcgtcgtgcgcggcgcgatgaccaacatcctgcgaaagaaggtgaagctcgacaaaacccgcgagaccttccaccaccacgccatcgacgccagcctgatggccgtcatccccaacatcgagttcttcaaggagcggaaggagtggctacccaaatctgccaacgaggaagtggttgaggtcgaggtctccgaggaggaaacgatgcctgagaaggagtttaaagtgaagatgcgcctcccggagagcttcatccaggacgtccagatcttgcagagaaactccttcgctaaggaggaagtgtcgggcccccagacccgcgagcggaacttaaagatcaagttcagtcaccaggtggaccagaagatgaaccgcaaggtcgccgacgacaccatatacggcacccggcaggctcagttagggaaagacaagaaggaggagacgtacgtgattggcaagatcaaggacatctacaactacgacgaatacgtgcgcttcaagaagcggtacgacaagaacaaggagagcttccttatgtaccaccacgacccccagaccttcgaaaagctggaggagatcttggcccaatatcccgagtatatcgaggacgagaaggggaaaaagaagaaggtctccccgttcgcgctttaccgcgaggagaacggccccgtaaccaaatacgccaagaagaacaatggccccgtgatcaagcagctgaagtactacgacagcaagctcaatcggaagatcgacatatcccacaagtacagcaccaaaaaccgccaggtcgtgctacagtccctgaaaccctaccgaacggacgtgtacagaaaccaggacaccggggagtacaccctcgtcggcatcgaccagaacgacgggaaattcgtgaacggccactacggcatccccaagagccggtacgaagagatcaaggccaacaacaagctgtccgagcacgacgagttcgtgttcagcttatataagaactccatggtcaaggtcatcgacgagaacggggagagcatcgtggtccgctacctcagccggtcaatgcctaaccgcaagaacaacgccgagatcaagcccgtggagaagtaccagttcgaagacggcgaggtggtcccggtgtatgggaagtgccggaagcagatgcagaccgtcttcgtcaagaagggctggacgctgctgaaggggaacaccgacattctcggcaacacctacttcgtggagaaggagagcgagaaccccaagaagatgatcgacgacaagtga

SEQ ID NO: 7484 - RNA, 3423 nt, synthetic construct
  misc_feature 1..3423: note = Cas9 variant
  source 1..3423: mol_type = other RNA
atgagagaaaacggatccgacgaacgcaggcgaaacatggacgagaaaatggattacaggatcggcctggacataggaatagcaagcgtcggatgggccgtcctccaaaacaacagcgacgacgaacccgtgaggatcgtcgatctgggcgtacgaatattcgacaccgcagaaataccaaaaaccggcgaaagcctggccgggcctcggcgcgcagccagaacaactcgccgtcgcttgcgacggcgtaagcacaggctagaccgaatcaaatggctatttgaaaatcaaggtctaattaatatcgacgacttcctaaaaaggtacaacatggcgggactcccggacgtataccaactgcgctatgaagcactcgaccgcaaactaaccgacgaggaactcgcacaagttctgctgcacatcgcaaaacatcgaggcttcagatcgacgcggaaagcagagaccgcggccaaagaaaacggcgcggtactaaaagcaacagacgaaaaccaaaagagaatgcaggaaaagggataccgcaccgtcggcgaaatgatctacctcgacgaagcgttccgcactggctgctcttggagcgaaaaaggatacatactcacaccacgcaacaaagcagaaaactaccaacacacaatgctaagagcgatgctggtcgaagaagtcaaagagatcttctcaagtcagcgccgactggggaacgagaaagcaaccgaagaactagaagaaaaatacctcgaaatcatgacctcccaaagatcattcgacctcgggccaggcatgcagcccgacggaaaacccagcccatacgccatggagggattcagcgaccgagtagggaagtgcacgttcctcggcgaccaaggagaactgagaggggccaaagggacatacacagccgaatacttcgtggcgctccagaaaatcaaccacacgaaacttgtcaatcaagacggggaaacgcggaacttcacagaagaggaacgccgcgcacttacactactgctgttcacccaaaaagaggtgaagtacgcagcagtcagaaagaaactaggcctcccagaggacatccttttctacaacctgaactacaagaaagcggcgacaaaagaggaacagcaaaaagaaaatcaaaacacagagaaagcgaaatttataggcatgccctactatcacgattacaagaaatgcctagaagaaagagtcaagtatttgaccgagaacgaggtccgcgacttattcgacgagattggaatgatcctcacatgctacaaaaacgacgacagccgaacagagcgactcgcaaaactagggctcgtgcctatagagatggaaggcctattagcatacacaccaaccaaattccagcacctgagcatgaaagcaatgcgcaacatcatccccttcctcgaaaagggtatgacgtacgacaaggcatgcgaggaagcgggctacgacttcaaggcggactcgaaaggcacaaaacaaaaactactcacaggagagaatgtgaaccaaacaataaacgaaatcaccaacccagtagtaaaacggagcgtaagccagaccgtcaaagtcataaacgcaatcatccgcacatacggcagcccacaagccattaacatcgaactagcccgcgagatgtcaaaaaccttcgaggagagacgcaagatcaaaggagacatggagaaacgacagaagaacaacgaagacgtaaagaaacaaatacaagaactcggcaagttatcccccacagggcaagacatcctaaaataccgactttggcaggaacaacagggaatctgcatgtacagcggaaagacaatccccctggaggaacttttcaaaccggggtacgacattgaccacatcctaccgtacagcatcacattcgacgattcattcagaaacaaagtgctagtaacatcccaagagaacagacaaaaaggtaacagaactccctacgaatacatgggcaacgacgaacaacgatggaacgagttcgaaacacgggtgaaaaccacgatacgagactacaagaagcaacagaaactgctcaagaaacacttttcggaagaagaaaggtcagagttcaaagaaagaaatttgacagacacgaaatatataacaacagtcatctacaacatgataaggcaaaacctagaaatggccccgctgaaccgtcccgaaaagaagaaacaagtccgagcagtaaacggcgcaataacagcgtacctgaggaaacgctggggacttccccagaaaaaccgggaaacggatacgcatcacgccatggacgcagtggtaatcgcctgctgcaccgacggcatgatacaaaagatctcgagatacaccaaagtacgtgaacgctgctactcaaagggcaccgagttcgtcgatgcagaaacgggcgaaatcttccgtccagaagactactcgcgagcagaatgggacgaaatattcggagtacacatccccaaaccatgggagacttttagagccgagctcgacgtcagaatgggagacgacccaaaaggattcctcgacacgcacagcgacgtggccctcgaactcgactaccccgagtacatctacgaaaatcttcgacccatcttcgtaagccgaatgccgaaccataaagtgactggagcagcgcacgccgacacaatccgaagtccccggcacttcaaagacgaaggcatagtcttaacaaagaccgcgctcacagacctcaaactggacaaggacggggagatcgacggatactacaatccacaaagtgacctcctactctacgaagcactcaagaaacaactcctcctgtacggcaatgacgcaaagaaagccttcgcgcaagacttccacaaacccaaagcagacggcaccgagggaccagttgtccggaaagtaaagatccaaaagaaacaaaccatgggagtcttcgtggacagcggaaacgggatagcagaaaacggcggaatggtaagaatcgacgtattccgcgtcaacgggaaatattacttcgtgccagtgtacaccgcagacgttgtgaagaaagttctgccaaaccgcgctagcacagcacacaaaccatacggggaatggaaagtaatggaagacaaagacttcctattcagcctatactcacgcgacctaatacacataaaaagcaagaaagacatacccataaaaatggtcaatgggggaatggaaggcataaaagagacctacgcatactacataggagcggacatctcagcggccaacatccaaggcatcgcgcacgacagccgatacaagttcagagggctaggcattcaaagcctggacgtactcgaaaagtgccaaatcgacgtactagggcacgtctctgtagtacgaagtgagaaaagaatgggattcagttga

SEQ ID NO: 7485 - RNA, 3423 nt, synthetic construct
  misc_feature 1..3423: note = Cas9 variant
  source 1..3423: mol_type = other RNA
atgaacggcctggtgctcgggctggacatcggcatcgccagcgtcggggtgggcatcctggagaagaactccgggaagatcgtgcacgccagctcccgcatctttcccgcggcgaccgccgacaacaacgtcgagcggcgcaagaaccggcaggcccgccggctcaaccgccggaaaaagcaccgcggcgtgcggttccaggacctgttcgaggactacggcctgctcaccgacttcagcaaggtgtccatcaacctgaacccgtaccgcctgagagtcgacgggctcaaccagcagctgacgaacgaggagctgttcatcgccctcaagaacatcgtgaagcgccggggcatcagctatctggacgacgcgtccgaggacgggggcaccgtgagctccgactacgggaaggccgtggaggaaaaccgcaagctgctcgccgagaagacccccggccagatccagctggagcggttcgagaagtacggccagctgcgcggagacttcaccgtggtggagaacggcgagaagtgccggctcatcaacgtcttcagcacgtccgcctacaagaaggaggcggagcgcatcctgcggaagcagcaggacttcaacaaccaaatcaccgacgagttcatcgaggactacctgaagatcctcaccgggaagcgcaagtactaccacggccccggcaacgagaagtcccggaccgactacgggcgctacacgacccacaaggacagtaagggcgagtacgtgacactggacaacatcttcggggtgctgatcggcaagtgcaccttctaccccaacgagtaccgcgccagcaaggcctcctacacggcacaggagttcaacctcctgaacgacctgaacaacctcaccgtcccgaccgagaccaagaagctgagcgaggagcagaagaagacgatcatcgagtacgcaaagtccgcgaagaccctgggggccagcaccctcctgaagtacatcgccaagatgatcgacacctccgtggaccagatccggggctaccgcgtggacgtcaataataagcccgagatccacacgttcgaggtgtaccggaagatgcaaagcctggagaccatcagcgtgggcgagctctcccgcaacgtcctggacgagctggcccacatcctcaccctgaacaccgagcgggaggggatcgaagaggccatcaacacgaagctgaaggacagcttctcccaggaccaggtgctcgagctggtacagttccgcaagaacaacagctccctgttcagcaagggctggcataacttttccctcaaacttatgatggagctgatccccgagctctacgagaccagcgaggagcagatgaccatcctgacccggctggggaagcagaagtccaaggagacgagcaagcgaaccaagtacatcgacgagaaggagctcaccgaggagatctacaaccccgtcgtggcgaagtccgtcaggcaggccatcaagattatcaacgaggcgaccaagaagcacggcatcttcgacaacatcgtgatagagatggcccgcgagaacaacgaagaagacgccaagaaggactacataaagcggcagaaggcgaaccaggacgagaagtacgccgcgatggagaaggccgccttccagtacaacggaaagaaggagctgccggataacatcttccacggccacaaggagctggcaacgaagattcgcctgtggcaccagcagggcgagaagtgcctctacaccggcaagagcatccccatctccgaccttatccacaaccagtacaagtacgagatcgaccacatcctgcccctcagcctgtccttcgacgacagcctgtccaacaaggtgctcgtcctggccaccgcgaaccaggagaaggggcagcggacccccttccaggccctggacagcatggacgacgcgtggtcctaccgcgagttcaagagctacgtgaaggagagcaagctcctggggaacaagaagaaggagtacctgctcactgaggaggacatctccaagatcgaggtgaagcagaagtttatcgagcgaaacctggtcgacacccgctacagctcccgtgtggtgctgaacgccctccaggacttctacaagaaccacaacttcgacaccaccatcagcgtcgtgcgcggccagttcacctcccagctgcggcgtaagtgggggctggagaagtcccgcgagacgtaccaccatcacgccgtggacgccctcatcatcgccgctagcagccagctgcggctgtggaagaagcagaacaacccgctcatcgcctacaaggagggccagttcgtcgacagccagaccggcgagatcatcagcctgaccgacgacgagtacaaggagctggtgttcaaggccccctacgaccacttcgtggacacactctccagcaagacgttcgaggactccatcctgttcagctaccaggtcgactccaagttcaaccgcaagatcagcgacgccaccatctacgccacccggaaggcgaagctggacaaggagaagaaggagtatacctacacgctcgggaagatcaaggacatctactccctgggcaccaagacccccagcaagaccgggttctacaagttcctggacctctacaacaaggacaagagccagttcctgatgttccagaaggaccgcaagacgtgggatgaggtgatcgagaagatcatggagcagtaccggcccttcaaagagtacgacaaggccggcaagctggtggacttcaacccgttcgagaagtaccgccaggagaacggccccatccggaagtactccaagaaggggaacggccccgagatcaagagcttaaagtactacgatatcctgctggggaagcacaagaacatcacccccgagggctcccgcaacaccgtcgccttactgagcctgaacccgtggcggaccgacgtgtactacaacatggagacgaagaagtacgagttcctcgggctgaagtacgccgacctgcccttcgaggagggcggcgcctacgggatctccaccgagacctacaacgagctccgcgagaaggagggcatcgggaagaacagcgagttcaagttcaccctgtacaagaacgacctgatactcatcaaggacacggaaaccaactgccagcagttcttccggttctggtcccgcaccggcaaggacaaccccaagagctttgagaaacacaagatcgagttaaagccctacgagaaggcgaagttcgagaagggggaggagctggaggtgctcggcaaggtcccgccctcctccaaccagttccagaagaacatgcagatcgagaacctgtccatctacaaggtgaagaccgacgtgctgggcaacaagcacttcatcaagaaggagggggacaagcccaagctcaagttctga

SEQ ID NO: 7486 - RNA, 3423 nt, synthetic construct
  misc_feature 1..3423: note = Cas9 variant
  source 1..3423: mol_type = other RNA
atgaacggcctggtgctcggactggacatcggcatcgctagcgtcggggtgggcatactgaagaaggacattggggagatcatccacaccaactcccgcctcttctcggccgcgacggccgactccaacatcgagcgccgcggccaccggggcgggaaacgtctgacccggcgaaagaagcaccggagcatccgcctccacgatctctttgaggacttcggcctgctgaccgactttagcaaggtgagcatcaacctcaacccctaccaactgcgggtccaggggctggacaaccagctcaccaacgaggagctgttcatcgccctgaagaacattgtgaagcgccggggcatctcctacctcgacgacgccagcgaggacgggggaaccgtgagctcggactacggcaaggccgtcgaggaaaatcgcaagctgctggcggagcaaacgccggggcaaatccagctcgaccggttcgagaagtacggccaagtgcgcggggactttaacgtggtcgagaacggcgagaagcggcggctgatcaacgtgttcaccacctccgcctacagcaaggaggcggagcggatcctgcgtaagcagcaggagttcaacaaaaagatcaccgacgagttcatcgaggactacctcacgatcctgaccggtaagcgcaagtactaccacgggcccggcaacgagaagtcccgcaccgactacggccggtacaccacgaagaaggaccccgaggggaagtatatcaccctggataacatcttcgggatcctcatcggcaagtgcaccttctaccccgacgagtaccgcgccagcaaggcgtcctacaccgcccaagagttcaacctgctgaacgacctcaacaacctgacggtgccgaccgagaccaagaagctgagcgaggagcagaagaagaccatcatcaagtacgcaaagacggccaagaccctcggcgcctccactctgctgaagtacattgcgaagctcatcggggccagcgtcgaccagatccacggctaccgcatcgaccccaacaagaagcccgagatgcacaccttcgagacgtaccggaaaatgcagtccctggagacgatcagcgtggaggagctgcctcgcaaggtcctcgacgagctggcccacatcctgaccctcaacaccgaacgggaggggatcgaggaggccatcaacgccacgctgaaggacaccttcagccaggaccaagtcctggagctcgtccagtttcgcaagaacaactccagcctgttctccaagggctggcacagcttctccttaaagctaatgatggagctgatcccggagctgtacgagaccagcgaggagcagatgaccatcctcacaagactggggaagcagaagtccaaggagaccagcaagcgcaccaagtacatcgacgagaaggagctgaccgaggagatctacaaccccgtggtcgcgaagtccgtgcggcaggccatcaagatcatcaacgaggcgacaaagaagtacggcatcttcgacaacatcgtgatcgagatggcccgcgagaacaacgaggaggacgccaagaaggagtacatcaagcggcagaaggcgaacctggacgagaagaacgcagccatggagaaggccgccttccagtacaacgggaagaaagaactacccgacaacgtcttccacgggcacaaagagctggcgaccaagatccgcctttggcaccagcagggcgagaagtgcctctacactggcaagaacatccccatcagcgacctgatccagaaccagtacaagtacgagatagaccacatcctaccgttatccctgagtttcgacgactccctgagcaacaaagtgctcgtgctggcaaccgccaaccaggagaagggccagcggacccccttccaggccctggactccatggacgacgcatggagctaccgcgagttcaagtcctacgtcaaggacagcaagctcctggggaacaagaagaaggagtatctgctcacggaggaggacatatccaagatcgaagttaagcagaagttcatcgagcgaaacctggtcgacacccgctacagcagccgggtggtgctgaacgccttacaggacttctacaaggagcaccagttcgacaccaccatatcggttgtgcgcggccagttcacgagccagctgcggcgcaagtggggccttgagaagtcccgggagacctaccaccaccacgccgtggacgccctcatcatcgccgcgagctcccaactgcgcttatggaagaagcagaacaaccccctcatcagctacacagaggggcagttcgtcgaccaggtgaccggcgagatcatctccctgagcgacgacgagtacaaggagctggttttcaaggccccctatgaccacttcgtcgacacactcaagtccaagaagttcgaggacagcatcctgttctcctaccaggtggacagtaagtacaaccgcaagatctccgacgccactatctacgccacccggaaggccaagctggacaaggagaacaaggaatacacctacacgctcgggaagatcaaggacatctacgctctgggcaccaaaagcccgtccaagaccggcttctacaagtttctggacctctataacaaggacaagagccaattcctgatgttccagaaggaccgcaagacctgggacgaggtgatcgagaagatcattgagcaataccggcccttcaaggagtacgacgagaacgggaaggaggtcgacttcaaccccttcgagaagtatcgcatcgaaaacggcccaatccggaagtactccaagaaggggaacggcccggagattaagagcttgaagtactacgacaacctcctagggaagttcgtcgacatcacgcccagcgagtccaagaaccccgtggccctgctctctctcaacccctggcgcaccgacgtctactacaacaccgagacatccaagtacgagtttctgggcctcaagtacgccgacctttgcttcgagaagggcggtgcctacggcatcagcgaggttaagtacaacaagattcgggaaaaggaggggatcggcaaggaatccgagttcaagtttacgctgtacaagaacgacttgatcctgatcaaggacaccgagaccaactgccagcagatcttccgcttctggagccggaccgggaaggacaacccgaagtccttcgagaagcacaagatagagctgaagccctacgagaaggcccgcttcgagaagggcgaggagctcgaggtgctgggcaaggtcccgcccagctccaatcagctgcagaagaacatgcagatcgagaacctcagcatctacaaggtgaagactgacgtgctggggaacaagcacttcatcaagaaggagggagaggagcccaagctgaagttctga

SEQ ID NO: 7487 - RNA, 3423 nt, synthetic construct
  misc_feature 1..3423: note = Cas9 variant
  source 1..3423: mol_type = other RNA
atggaggaaaacttccagtacagaatcgggctcgacatcggtataacctcagtaggatgggcagtgctacaaaacaacagtcaagatgagcctgtgcgtataaccgacctcggcgtacgcatattcgacgtcgcagaaaatccgaaaaacggggacgccctagccgctccacgaagggacgcacgtaccacaagaagacgccttagacgccgccggcaccgactagaacgcattaaattcctcctccaagagaacgggctcatagaaatggactccttcatggaacgatactacaaaggaaacctacccgacgtctaccaactacgctacgagggactcgatagaaaactgaaggacgaggaactagcccaagtgctcatacacatagcgaaacaccggggattccgttcgacgcgaaaagcagaaactaaaggaaaggaaggaggggccgtgctgaaagcaaccaccgaaaaccagaagatcatgcaagaaaaaggataccgaacggtcggagaaatgctgtacctagacgaggcattccacaccgaatgcctctggaacgaaaaaggatacgtactcaccccaagaaaccgaccggacgactacaaacacacaatactcaggtcgatgctcgtcgaagaagttcacgcaatcttcgcagcccagcgagcactaggaaacgaaaaagcgaccgaagaattagaaaacgcctatgtagaaataatgaccagccaacggtccttcgacatggggccaggcctacagcccgacggcaaacccagtccctacgcgatggaaggcttcggagacagggtcggcaaatgcacatttgagaaagacgaatacagagccccgaaggcaacctacacggcagaattgttcgtcgcactacagaaaatcaaccacacaaagctgatagacgagttcggcaccggacgatttttcacagaagaagaacgcaagacgataatagaccttctcctaagcggaaaagaactcaaatacgggacaatacgaaagaaactgaacatcgacccgagcctaaaattcaactcccttaactacagcgccaaaaaggaaggagaaaccgaagaagaacgagtacgcgataccgaaaaggcgaaattcgccagcatgttctggacctacgagtactcaaaatgcctaaaagacaggaacgaagaaatgaccgtcgggcaaaaagcggacctgctcgacagaatcggcgaaatcctgacagcatataaaaacgacgattcgagatcaagccgactagaggacctgggattgagccgcgaggaaatcgatggactactcgagttgagcccagcaaaataccaacgagtctcactgaaagcaatgcgaaaaatgcaaccctatctggaagacggcctcatatatgataaggcatgcgaggccgccggatacgacttcagagcgctgaacgacggaaacaagaaacacctcctaaaaggggaagagatcaacgcaatcgtcaacgacataaccaacccggtagtaaagagaagcgtgagccaaaccataaaggtgataaacgcaataatccaaaagtacgggagcccacaagcagtcaacatcgaactagccagagaaatgagcaaaaacttccaggaccgaaccaacctggagaaggaaatgaagaaaagacaacaagaaaacgagcgcgccaaacagcaaataatagaactaggaaagcaaaacccaacgggacaagacatcctcaagtaccggctctggaatgaccaaggaggctactgtctatactcagggaaaaagatcccgctagaggagctatttggcggaggctacgatatagaccacatattaccctacagtatcacgttcgacgacagctaccgaaacaaagtgctagtgaccgcccaggaaaacagacaaaagggcaaccgcaccccctacgaatacttcggtgcggacgaaaaacactgggaggattacgaggcaagggtacggctattagttcgggactacaagaaacaacagaaactactgaaaaagaacttcaccgaagaagagagaaaagagttcaaggaacgcaacctaaacgacacaaagtatatcaccagggtagtatacaacatgatacggcaaaacctagaactggaaccattcaaccacccagagaaaaagaaacaggtctgggcagtcaatggcgcagtcacgagctacctgcggaagcgatggggcctcatgcaaaaggaccgaagcacagaccgacaccatgccatggacgcagtagtaatcgcgtgctgcacagacggaatgatacacaaaataagccgctacatgcaaggacgcgaactagcatactctaggaacttcaaatttcccgacgaagaaaccggagaaatcctgaaccgcgacaacttcacaagagagcagtgggacgaaaaattcggagtcaaagtaccactcccctggaactccttccgggacgagctggatatccgactcctaaacgaagaccccaaaaatttcctgctaacgcacgcggacgtccagagagagctagactacccaggatggatgtacggagaggaagagtcgcccatcgaagaagggcgctatatcaactatatccgcccactcttcgtgagccgcatgcctaaccacaaagttacgggatccgcacacgacgcgaccatccgctccgcgcgcgactacgagacaaggggagtagtaatcacaaaagtccctctcacggacctgaaactgaacaaagacaacgaaatagaaggctactacgacaaagacagcgaccgcctgctgtaccaagcactggtacggcagctacttctacacggcaacgacgggaaaaaggcgttcgccgaagacttccacaaaccaaaagcagacggaacagagggccctgtagtaaggaaggtcaagatagagaaaaagcaaaccagcggcgtaatggtccgcggagggaccggaatcgcagcgaacggagaaatggtgcgcatcgacgtgttccgcgaaaacggcaagtattacttcgtacccgtatacaccgcagacgtagtcaggaaagtgctacccaaccgcgcagcaatgaacggaaagatagcctcagattggaaaacgatggaagacaataacttcgtgttctcactgtacagcagggacctaatacatgtgaaaaggaagaaagcaatacccacgatactaagcagcggcgcgacatttgaacaagaggagttctatgcctacttcaccggcgccgacatctccacagttagcatagcgggaatcagcaatgacaactctttcaagttccgtggcctcggcattcaaggactagaaatattcgaaaaatgccaagtcgacatattagggaacatatcagtagtcaggcacgagaacaggcaagggttccattga

SEQ ID NO: 7488 - RNA, 3426 nt, synthetic construct; identical to SEQ ID NO: 1688
  misc_feature 1..3426: note = Cas9 variant
  source 1..3426: mol_type = other RNA

SEQ ID NO: 7489 - RNA, 3429 nt, synthetic construct; identical to SEQ ID NO: 1689
  misc_feature 1..3429: note = Cas9 variant
  source 1..3429: mol_type = other RNA

SEQ ID NO: 7490 - RNA, 3435 nt, synthetic construct
  misc_feature 1..3435: note = Cas9 variant
  source 1..3435: mol_type = other RNA
atgacaagcaagcaagaaaaacacggagcgcttaccttcgggctggatatcgggatcgcatccgttggatgggccgtactcggcgaatctagaatcgtggacctcggagtcaggtgcttcgacaaagccgaaaccgcgaaggaaggagaaagcctcaacttaacaagaagaatggcaagactcctcagacgaagactacgccggcgcgcctggcgcctgacgaagctagcacggctactaaaacgagaggggcttatcgcagatgcgaacctcttcaagcataagatcgagaaaaatactccagtacccaaatcatcatggcaactcagggtcgatggactcgacagacaattaaacgcagaagaatgggcccgcgtgatctaccacctgtgcaagcaccgcggcttccactggatctcacgagcagaagaaaaagccgcagaaggcgacagcaaaggcgaaggaggaaaagtaaagcaaggactggccggcaccaaaaagctaatgcaagaaaagtcataccgcaccgcagcagagatggtccttgccgagttccccgacgcccaacggaacaaacaaggggactactccaaagcactaagtagaatactgctcggcgacgaactcaaagcactattcgaacaccagcggaagctgggtaaccccgtagctaccgaaaaactagaagccgccattctcggaaacggagacaaaaagtgcgggctattctgggcacaaaaccccgccctggccggcaacaaactcctcgaaatgctcgggcgctgcacgttcgagaaaaccggcggcgatgacgggaaaggagaataccgcgcaccaaaagcctcatttagcgcagaaaggcacgtatggctgacacacctcaacaacctaagaatcgtggtagacggcaccacacgtcccctgaacgaagcagaacgacgcgtcgcactcccgatgccataccaacaagcaggcgatctaagctacaaacaactaggtggagctttaatcaaggaaggattccttcaaaaagacggcttcaagtttgcaggactcccctacccaaccaaacaagccagcgaggaaaaagcaaaggacccggaaacatcagtgttatgcaaactaccggcctggcacaccctccggaaaaccctagagaaacacggcctagaatctgaatggcaaaaactatccaccgatgcccttgacggaaaaccacaactactagacaacatcgcatgggtgctcagcgtgtataaagatgacgacgaagtaaaaaccgagctcggaaaattaaacctaccaaacacagagaaaatgattgatgccctcctagacatacggttcgataaattctccaacctaagcctcaaagccctcagcaagatcgtacccttcatggaacaaggccaacgctacgacgaagcggtcgcaaacataccagaatacgggcaccacagtcagctccacaaagtaggcgcaggcgaacacaaataccttccccctttctacaaggaacgagacaagacgggtaggatggtattcaacgacgacatggacataccccgcaaccccgtggtgctccgcgcactcaaccaagcgcgaaaagtagtaaatgcgctaatcaaagagtacggaagcccacacgaagtacacatagaaatggcccgagacctatcgcgaccactagacgagcgtagagacatagaaaaactccaaaaagagttcggagaacggaataagaaagacaaagaacttttcgcgcaggacttcaacatcgtaggaacggtcaaaggcaaacaatttgaaaagtaccagctatacagagagcaacagggcaaatgcatctatcccagcatggacgaaaagcaaggtatatgctgctacagcctgaagccgttggacctccatcgtgtactatacgaggaaggctacgcagaaatagaccacgccctcccctacagccggtcattcgacgatagcaaaaacaaccgagtcctagtcctggccaaagaaaacagggacaaagggaacagaaccccgtttgaatacctaggggacaaagacaatagcgaaccgtggagacaattcgtcgcattcgtcgagggcaacaaggcttaccgactagcgaaaaggagcagactcctgcgcaaagactttggagacaaagaagcaaaagagttccgagaaaggaacctaaacgacacacgctacatctgcaaattcttcaaaaactatgtagaacaatatctgcaactacacgaagacagcgaggccaaacgatgcgtagtcctctccgggcagatgacgagcttcctcagagcccgatggggactggtcaaagtccgaggcgactccgaccgacaccacgccctcgatgctgccgtagtagcagcctgcagccacggcatggtgaaaagactaagcgactacagccgccgaaaagaactagagcaagtaagagaggggtttgtagacgtggacacaggggaaatcgtgaacccagcgatgttccaacaagtgcaggaacatttccccaacccctggccccactttcgcgacgaagtcaaactgagactcagcattgacgatccgaccctgctccgatcagagatggaaaaattcggcacctacacaccagaaagcctagaagcattacgacctctatttgtaagccgagcccctcaacgaaggaactctggagccgcccacaaggacacaatatacgcgcaacccaaaaggctagtcgcacaaggcggagtcacccaaaaggtggcgctctcaagcctcaccctcaaggacctagacaaattgatcgacccccaccgaaacgaaagactctacgcggcaatcagagcccgtctcgagcaacacggaggaaagggagacaaagcattccccgcttcaaaccccttacgaaaaccggactccgaaggcaacccaaccggcccaatagtccgaggagtcacgatggtcatcgacaaactcagcggcatcccaatccgaggcggaatagcgaaaaacgactccatggtaagagtagacgtattcacgaaggcgaacaaattccacctagtacccgtatacgtgcaccacagcgtgctagggcttccaaaccaagcaatcgtcgggggaaaagaagaaagcgaatggacccaaatagacgactcattcgactggcatttcagcatctatccgaacgacttgatacgcgtcacactgaaacaagagggtcggttcggatactacgccggttgtgaccgaagcacagcagccatacacctatgggcccacgatagaaaccaacaagtaggaaaggacggactaatcaggtccataggagtcaaaaccgctctcagtatagaaaaattcaacgtggacgtactcgggaaccgctaccccgccccacccgaaaagcgccgagaccttgcgtga

SEQ ID NO: 7491 - RNA, 3435 nt, synthetic construct
  misc_feature 1..3435: note = Cas9 variant
  source 1..3435: mol_type = other RNA
atgacgagcaaacaagagaacctcggggcgctcaccttcggactggacattgggatcgccagcgtcgggtgggcggtactcggcgaaaaccgaatcattgacctcggggttcgatgtttcgacaaagccgaaaccgcgaaagagggggaaagcctcaacttaacaagacgaatggctcgacttctcagacgccggctaagacgtcgtgcctggcggctaacgaagttggcaagactattaaagcgcgaaggattgatcgctgacgcaaacctcttcaagcacaagatcgagaagaacacaccagtgccaaaatcatcgtggcaactcagagtcgacggcctggaccggcaactaaacgccgaagaatgggcacgcgtgatctatcacctgtgcaaacaccgagggttccactggatatcccgagccgaagagaaggcagcagaaggagacagcaaaggcgaagggggaaaggtcaagcaaggattagccgggacgaagaaactcatgcaagaaaaatcctatcgcaccgcggctgaaatggtcttagcggagttcccagatgcccaaagaaacaagcaaggagactattcaaaagcattatccaggatcctcttaggagacgaactaaaagcactatttgaacaccagcgcaaactgggcaacccagttgccaccgaaaagctcgaagccgcaatactaggtaacggggacaagaaatgcggcctcttctgggcgcaaaaccccgcgctcgcaggaaataaactacttgaaatgctaggcagatgcaccttcgagaaaacaggaggcgacgacggaaaaggcgaatatcgagcaccgaaagccagcttcagcgcagagcggcacgtatggctaactcatctaaacaacctcagaatcgtcgtagacggcacaaccaggcctctaaacgaggctgagcgaagagtagctctcccaatgccataccagcaggccggagacctctcgtataagcaactgggcggcgcactaatcaaggaagggttcctccagaaagacggatttaagttcgccggcctaccatatcccacaaaacaggcttcggaagaaaaagcgaaagacccagaaacctcagtactttgcaaactacccgcctggcacacactacgaaagaccttggagaaacacggcctggaatccgaatggcaaaaactttcgacagatgcactagacggaaaaccccaactcctcgacaacatagcctgggtactaagcgtatataaggacgacgacgaagtaaaaacagaactgggcaaactcaacctacccaacaccgagaaaatgatcgacgcattattagacatccgattcgacaagtttagcaacttaagcctcaaagcgctgtccaaaatagtacccttcatggaacaagggcaaaggtatgatgaagctgtcgcgaatataccggaatatggacaccacagccaactgcacaaagtaggcgcaggcgaacacaaatacctaccgcccttctacaaagaacgcgacaaaacaggccgaatggtattcaacgatgacatggacattccgcgaaacccagtcgtcctgcgcgcgctcaaccaagcacgcaaggtcgtcaacgcactaatcaaagaatacggctcaccacacgaagtccacatagagatggcgcgagacctttcccgccccctagacgaaagacgcgacatcgaaaaactccagaaggagttcggagaacgaaacaagaaagacaaagaactattcgcacaggacttcaacatagtagggaccgtcaaaggaaaacaattcgaaaaatatcaactctacagagaacagcaaggtaaatgcatatacccatccatggacgagaaacagggcatatgctgttacagcctgaaaccgctagatctgcacagggtactatacgaagaggggtacgcagaaatagaccacgccctgccctactctcgcagcttcgacgacagcaagaacaaccgcgtactcgtgctcgcgaaagagaaccgagacaaaggcaaccgcacaccattcgaatacctcggcgacaaagacaactccgaaccgtggcgacaattcgtagccttcgttgaaggcaacaaagcctaccgtctagcaaaacgcagcagactcctacgcaaagacttcggggacaaagaagccaaagagttccgtgaaagaaacctcaacgacacccgatacatatgcaaattcttcaagaactacgtcgaacagtacctacaactacatgaagacagcgaggccaaacgatgcgtcgtcctctcgggccaaatgacaagtttcctaagagcccgatggggactcgtaaaggtaagaggcgactccgacagacaccacgcccttgatgcagcagtcgttgctgcctgcagccatggaatggtgaagcgattatccgactactcccgccgcaaagagctcgaacaggtcagagaaggtttcgtggacgtagacactggagagatagtaaaccccgccatgttccaacaagtccaagaacacttcccaaacccatggccgcacttccgagacgaggtcaaactccggctcagtatcgacgaccccacactcctccgctcagaaatggagaaattcggtacatacacaccagaaagcctagaagccctacgcccgctgttcgtatcacgggccccacagcgacgcaacagcggagccgctcacaaagatacaatatacgcacaaccaaaaagactcgtagcccaaggaggagtgacacaaaaggttgcactatcgtcactgacgttgaaggacctagacaagctcatagacccccatagaaacgaacgcctatacgcagcaataagagcacgtctcgagcaacatggcggaaaaggagacaaagccttcccagcgtcaaacccgctacgcaaaccggacagcgagggaaaccccacaggcccgatagtacgaggtgtaacgatggtcatcgacaagctaagcggaataccaatccgcggcggaatagcgaaaaacgactccatggtgcgtgtggatgtcttcaccaaagccaacaaattccacctagtcccagtatacgtgcaccacagcgtgctcggactaccgaaccaagcaattgtaggtggcaaagaagaatcagaatggacacaaatagacgacagcttcgactggcacttcagcatctatcccaacgacctcatccgagtaacactgaagcaagagggcagattcggttactacgccggatgcgacagatctaccgccgcaatccatctgtgggcgcacgatcgaaaccaacaggtcggcaaagatggactaatcagatcgataggggtcaaaaccgcactgtcaatagaaaaattcaacgtagacgtcctcgggaaccggtatccagcaccaccggagaaacgaagagacctcgcatga

SEQ ID NO: 7492 - RNA, 3438 nt, synthetic construct
  misc_feature 1..3438: note = Cas9 variant
  source 1..3438: mol_type = other RNA
atgaagaccatcctggggctcgacctggggaccaacagcatcggctgggccctggtgaaggagacggagaactccaacgagaagtccgagattatcaagctcggggtaagagtcaaccccctgaccgtggacgagaagaccaacttcgaggccggccggccgctgagcaccaacgcggaccgcacggccaagcggagcgcccgccggaacctccagcgttacaagctgcggcgcaagaacctgatcgacctcctgatcaagcaccggctgatcgacaaggacacgcccctcaccgaaatcgggaagaacaccacccaccagaccctggagctgcgcgcgaaggccgcgcgggagcgtatcgagctcgaggacctggcgcgggtctttctggccatcaataagaagcgcggttaccggtccagccgcaaggttaacaacgaggaggagggccaggtggtagacgggatggccgtggcgaagaagctctacgacgagaacctgacgcccggccagtacgcctacgagctgctctccaaggggaagaagtacgtgcctgacttctacagaagtgacctgcaggcggagttcgactccatctgggagtaccagaagcagttctacgccgatatcctcgacgacgaactctacaacgccctgaagggccaggggcagcagaacagccgaaagcggttcctggcgatcaagggtgtctacaccgccgagaacaagggaaagcgcgacgaggtgaagctccagcactacaagtggcggtccgaggccatcacgcagaagctgagcatcgaggaggtggcctacgttctggtggagatcaacaacgacctcaacaagagcagtgggtacctgggcgccatctccgaccgcagcaaggagctgtacttcaacaaggagaccgtgggggagaacttatggaagcagatccagaagaacccgcacacttccctgaagaaccaggtcttctaccgccaggactacctggacgagttcgaacagatctgggaaacccaggcgcagttccacccccagctcacgctggccctgaaggagcagatccgggacgtagtgatattctaccagcgcaagctcaagagccagaagggcctgctgtccttctgccagttcgagagctgggagatcgagaggaaggacgagaacggcaacgtcatactcaacaagaccacccagctgccaaagcgccaaaccgtagggcggcgcgtggcccccaaaagctccccgctgtttcaggagttcaagatctggcagaacatcaacaacctcgagatcgccaagatctcggacggtaactccaagaacaagaaggagactgaagccctaagcgacgacgaacggaaacttctgtttgaagaactgaacctgcgcgggaacctgtcccaaaaggaggtcctccagatcctgggcctgaaggacaaggagtacaagacgaacttccccgaggggctcgagggcaaccggaccaacgccgccctgttcaacatctaccagcagatcgccgagaacgagggctacggggactggaccaagaaatccgcccaggagatcaaggaggaactgaaggccgtgttcccccagatcggcatccaggcggacatcctcgacttcaacgccgagctggacgggaaggagttcgagaaccaggcgagctatcagctgtggcacctcctgtactccgccgaggaggacgacaagattaacgaggaggaccagatcatctacggcaactccgcggtgagcctgaagaaaaagctctgcgagaagttcggattcacgccagagtacgccaagtggatagccaacgtctccctgcaggacgactacggcaacctgagcaccaaggccatgcgcaagatcatcccgtaccttatcgacggcaacgactactccgaggcctgcgcgctggccgggtacaaccacagcaactccctcaccaaggaggagaacgacaatcgggagcgcctcaacaagctggagctgctccccaagaacagcctgcggaaccccgtggtcgagaagatccttaaccagatggtgaacgtggtcaaccaggtgatcgagacctacggcaagcccgacgaggttcgcatcgagctcgcccgggagctgaagaagtccgccgaggagcgcgccgagatgacgaaggggatcaatgaggcgacccggcgcaacgaggacataaagaagctgatcaccaagaacttcggcatcccgaaccccaccaagaacgacgtcgtgcggtaccggctctgggaggaactagcgcccctagcctacaaggacgtgttcacggggcgtcagatcaagaaggaggacctcttcagctccaagatcgacatcgagcacatcatacccaaggccctgctgttcgacgactctttcagcaacaaaaccctcgccttccgggagacgaacctgaagaaggccgatcgcaccgcctatggattcatcgagtcggattacaacgccacgctggacgactacatccaacgggtcgagaccctctacaacaacgccaagggcaccattagcaaggggaagcgcaacaagctgctgatggcgcagaagaaccttccggacggcttcatcgagcgggatctgcgcaactcccagtacatcgccaagaaggccaagagcatgatcgagaaggtgttcaacgacgtgaacgtcaccagcgggagcatcaccgacaggctgcgcgaggactgggacctcatcaacgtgatgaaggagctgaacttccccaagtacaaggctctgggcctcactgagatcgaggagcggtacgatatcgggcaggagaagaccaagaaggtggaggtcatcaccgactggaccaagcgcaacgaccaccggcaccacgccatggacgcgctgacggtggccttcaccaccaagtcccacgtccagtacctgaacaacctcaacaccatccacagcctgaagggggacgaggtcgacctggagctctccaagctgtacggactgaagaacacgatcaccgaggtggtgaacaagaagcgcaagttcatcccgcccatgcccaacttccgggaggaggccaagaagcacattgagaccatcctcgtcagcataaagaacaagaacaaggtgtacaccaagaacatcaacaagacgaagaaggagtccgggtaccacaccaaggagcagctgacgccccgcggccagctgcacaaagagaccgtgtatggcaagagcaaacggcccatgaacaaacccaccaagatcaacaagaacttctccctagagcaagcccagctgatcatcaacgtccaggagaaggagctggtgctccgccacctggctcagttcgacaataacccggcggttgctttcgacaccaagacactgaagaagtgccactacctcaagatggtcaacctgtga

SEQ ID NO: 7493 - RNA, 3441 nt, synthetic construct
  misc_feature 1..3441: note = Cas9 variant
  source 1..3441: mol_type = other RNA
atgagcggcaacactcacggaccccttacattcggcttcgacataggaatcgccagcgtcggctggtgcgtactcggcgaaaaccgcatagtaaatctaggagtccggtgcttcgacaaggcagaaaccgccaaagaaggcgaaagcctcaacctagcacgaagaacggccaggctcatgaggagaaggctcagaagacgagcctggagactaaccaaactggcaaggctactgaagcgagaaggactcatcgcagaagcatcacgtattcacatccccagcccagtgagcccttggagactcagggtagagggcatcgacaggagactcacggacgacgagtgggccagggtgatctaccatctatgcaaacatagaggattccactggataagccgggcggaggaacgcaaagcggaaagtgacgccaaagagggcggccgagtcaagaaagggctatcggacacccagcggcgaatgacggaaaaaggatacagaagcgctgcagaaatggtactcgcggagttccccgacgcccagcggaacaaacaaggcgactacgggaaagcattatcgcgcatactactcagcgacgaactagcattattattccgtagacaaagagaactgggcaatcccaacgcgggaaatgaactagaagccacgatactgggtaacggtaaccgcaaatccggcctcttctgggaacaaaaacccccacttgcaggcgccgacctcctcaaaatgctaggcagatgcacgttcgagaaaaacgaatatagagccccaaaagcctcattcaccgcagaaagacacgtctggctcaccagactcaacaacctacgtgtcgtagtcgacggcacaacccgcagcctagatgacgccgaacacagactggttttacccctcccgtacaaacaagccggagacttcacatacaagcaactaagaacagccctcacaaaagcaggactcctgcccgaaggattcaaattcgcaggtctaagctatccgacaggccgacagctagacgacccaaaagccaaggaccccgaaagcgaaaaattagtcagactccccgcatggcaagaactcagaaaaacactaaaagacaagaacctagagactgagtgggaaggaatggcaggagccgccaccggcggaaaccccgaactgctcgacgaaatagcgagagtcctctccgtttttaaggacggagatgaggtaacagcagaactctggaaactacccctaccaggaggcaaagcaatgatcgacgccctctcagaaatttccttcgacaaattccacgcactatcactgaaggcactacggaaaatcgtaccccacatggaatcaggcctcagatacgacgaagcgtgtgcggtcgccggctatcatcactctcagctccatgcagcgggtgcaggcgagcacaaattcctcccacccttctacagcagacgcgacaaggacggcagaatggtcttcaacgaggaactagatgtcccaaggaaccccgtcgtgctcagggcactcaaccaagcccgaaaggtactcaatgcactcgtacggacatacggaagcccgacagcggtccacatcgaaatggcacgcgacctatcccgtccactagacgaaagaaacaaagtgaaaaaggcacaagacgaatatcgcgagcgaaacgaaaaagacaaagcagccttcgcagcagagtacggcatcgcgccaaaaagcagagagttcgaaaaattccagctttatcgcgaacagcaaggaaagtgcgcctactcgctaaagtccctagatctgcaccgcgtactacacgatatcggatacgcagaagtggaccatgccctaccatacagccgaagctacgacgatagcaagaacaacaaagtactcgccctaacagaagaaaaccgtaacaaaggcaaccggacagcctacgagtatctgacttcattccccggtggcgaaaacggagaaagatggcggaacttcagcgtagccgttgaaaccaacaaagcataccgactcgcgaaacgaacacgactcctccgaaaagacttctccggacgcgccgcggaagagttccgagaacggaacctcaacgacactcgatacatatgccgatttttcaaaaacaccgtagagagattcctcaaactagacgcaaaagtaggcgccggcgacaccgccgagataagcgcgaaaagatgcgtggtactttcaggacaaacgaccgcatttctacgcgctagatggggactcctgaaggtccgagggaacagcgaccgccatcacgcgctcgacgccgcagtcgtggccgcctgctcccacggtatggtcaaacggctgggagactatagccgtacgaaagaattagcgaaggtccacgatgggttcccggacccggagacgggagaaataatcgaccccgtaatgttccaacaactccacgctcacttcccggacccgtggccgcacttccgagccgaacttgaggctcgccttaacgtggacgacacagccgatttacgagctagaatggaattgttcggcacatacgcacctgaagcgctcgaaaccctgcggccgctattcgtaagccgcgccccacaaagaagaaacagcggcgcagcacacaaagacacaatatacgcacaacccgaaagactaaaggaacaaggcggagttactcaaaaagtccccttaacctccctaaccctaaaagacctagacaaactaatagacccccaccgcaacgaaaaactctacgcggccattcgcgccagacttgaagcccacggaggcaaggccgacaaagcattccccgccggaaaccccctcagaaaacccgaccgagaaggaaaccccacgggcccagtcgtaagaacggtcacaatggtgattgacaaactctccgggatccccgttagaggcggaatagccaagaacgacaccatgctccgagtagacatattccgccacaagaaagacgggaaattccacctagtcccagtatatgtataccacgcagtagcgaaagagttcccgaaccgcgcaatagtccaggccaaagacgaagacgaatggactctaatagacgataaattcgacttttgcttcagcgcacatcccaacgacctactaaaaataacgcagaaatcgggggaaacaatcttcggatactaccgaggttgccactccggtacggcggccatcaacatagcgctacatgaccgatatgcatacgccgagaaaacaacatcactagcgttctcaaagaaaaaccccggcaaaccaataccaaacgataaactaggactgatagaagggataggtgtaaagatggccgccaatatggaaaaattccacgtagatacactggggaacatatacccggccccacccgaacaacgacgcggcctcgcttga

SEQ ID NO: 7494 - RNA, 3441 nt, synthetic construct
  misc_feature 1..3441: note = Cas9 variant
  source 1..3441: mol_type = other RNA
atggcctaccgcctaggactggatataggaataacaagtgtcggctgggcggtggtcgcgcttgaaaaggacgagagcgggttaaaacccgtcagaatccaagacctaggagtaagaatattcgacaaggcagaggacagcaaaacaggcgcgtccctggcgctccctcgacgagaggcaaggagtgcacgcaggaggacaagacgacgacggcacagactctggcgagtaaaaaggctgctggaacaacacggaatactgagcatggaacaaatagaggccctctacgcgcaacgcacatcgagccccgatgtatatgccctcagggtcgcaggcctggaccgatgcctgatagcagaggagatagcgcgcgtcctcatacacatcgcacaccgaagagggttccaaagcaacagaaaaagcgagatcaaagacagcgacgccggaaaactactcaaagccgtacaagagaacgagaacttaatgcaaagcaagggatacagaacagtagcagaaatgctagtcagcgaagcaacaaagacagacgcagaaggaaagctagtacacggcaagaaacacggttacgtgtccaacgtgagaaacaaggcaggcgagtatcggcacactgtcagcagacaagcaatcgtcgacgaggtgagaaagatattcgcagcacaacgcgcactcggaaacgacgtcatgtcagaagaactggaggactcttacttaaagatcctatgctcacaaagaaacttcgacgatgggccaggaggggatagcccatacgggcacggaagcgtatcacctgatggggtcaggcaatcaatatacgagcgaatggtcggttcgtgcacattcgaaacgggagaaaaacgagcaccgcgatcctcatactcattcgaacgcttccagctactaacaaaagtggtcaatctccgcatataccgccagcaagaggacggaggacgatacccgtgcgagcttacacagacggagagagccagggtaatagactgcgcatacgagcaaaccaagatcacttacggcaaactgcgcaaactactagacatgaaagataccgaatccttcgccggcctcacgtacggactcaacaggtcgagaaacaagacagaggatacagtattcgtcgaaatgaagttctatcacgaggtcagaaaagcgctgcaacgagcgggggtctttatacaggatctcagcatagagacattagaccaaataggatggatcctatcagtctggaaatctgacgacaacagacgaaagaagctaagcacgctaggcctatccgacaacgtaatagaggaactgctcccactgaacggaagcaaattcggacacctctcgctcaaggccatacgaaagatcctgccattcctagaagacggctatagctatgacgtcgcctgcgagctagcgggatatcaattccaagggaagacagaatacgtaaagcaacggctactgcccccactcggggaaggagaagtaaccaacccagtggtacgccgcgcgctgtcacaagccataaaagtcgtgaacgcagtcatacgcaaacacggaagcccggaatcaatacacattgagttggcgagagaactgagcaagaacctagacgaaagacgcaaaatcgagaaggcgcagaaagagaaccaaaagaacaacgaacaaataaaggacgagataagggagatactaggcagcgcgcacgtaaccgggcgggacattgtaaaatacaaattattcaagcagcaacaagagttctgcatgtatagcggagaaaaacttgacgtcacaaggctgttcgagccagggtacgcggaggtagatcatatcataccatacggaatcagcttcgatgacagttacgacaacaaagtcctcgtgaaaacagagcagaaccgacaaaaaggcaaccggacccctctcgaatacctgcgcgacaaacccgagcaaaaagcaaagtttatagccctggtagaaagcatcccactcagccagaaaaagaagaaccacctactcatggacaaacgcgcaatcgacctagagcaagagggcttccgcgaacgaaacctaagcgacacacgatatataacccgcgccctaatgaaccatatacaagcctggctcctgttcgacgaaacggccagcacccggagcaaaagagtcgtctgcgtaaacggggcggtgactgcttacatgcgagcacgctggggccttaccaaagaccgcgacgccggagacaagcaccacgccgccgacgccgtagtcgtcgcgtgcataggcgactccttaatacaaagagtcacgaaatacgacaaattcaaacgaaacgcactggcagaccggaaccgatacgtccaacaagtcagcaaatcagaaggcataacccaatacgtagacaaggagacgggcgaagtattcacatgggagagtttcgacgaacgaaaattcctgcccaacgagccactagagccgtggccctttttcagagacgagctgctagcaagactaagcgacgaccccagcaaaaacataagggccataggattactgacatactcagagacggagcaaatagatcccatcttcgtaagccgaatgccgacaagaaaagtcacgggggcagcacacaaagagacgattcggagccccaggatagtcaaggtagacgacaacaaaggaacagagatacaggtggtcgtgagcaaggtcgccctcacagagctaaaactcaccaaagatggagaaatcaaagactacttcagaccagaagacgaccctcggttatacaacacgctaagagaaagactcgtccaattcggcggcgacgcaaaggccgcattcaaggagccagtatacaagattagcaaggacggatcggtgagaacccccgtaaggaaagtcaaaatccaagagaagctgacactgggagtgccggtacacggaggtcgagggatagccgaaaacggaggcatggtccggatagatgtgtttgccaagggcggaaaatactactttgtccccatctacgtcgcagacgtgctcaagcgcgaattaccgaaccggctcgcaacagcgcacaaaccctatagcgaatggagggtagtggatgacagctatcagttcaaattctccctatacccaaacgatgctgtaatgataaagccgagcagagaagtagatataacgtataaagaccggaaagaacccgtaggctgccgaatcatgtacttcgtaagtgcaaatatagcgagcgcaagcataagcctacgaacgcacgacaactcgggtgaattggaaggactagggatacaaggcctcgaagtcttcgaaaaatacgtagtaggcccgctgggcgacacccaccccgtatacaaagaaagacggatgccgttcagagtagagcggaagatgaactga

SEQ ID NO: 7495 - RNA, 3441 nt, synthetic construct
  misc_feature 1..3441: note = Cas9 variant
  source 1..3441: mol_type = other RNA
atggcatacagacttggactggacatcggaattacaagcgtaggctgggcggtcgtcgccctagaaaaggacgagagcggtctcaagccggtacgaatacaggacctcggagtacggatatttgacaaagccgaggatagcaagactggggcgtcactagccctgccgagaagagaagccaggtcggccagaagacgcacgagaagacgaagacaccgactctggcgagtaaaaaggctccttgaacaacacggaatactatccatggagcaaatagaggcgctatacgcccaacgcaccagctcccctgacgtgtacgcactgcgggtcgccggcctcgacagatgcttaatcgcagaggagatagcacgagtactgatacacatagcccacagaagaggattccagtcgaataggaaaagcgaaatcaaggacagcgacgccggaaaactactcaaagccgtgcaggagaacgaaaacttaatgcaaagtaaaggatacaggaccgtagcggagatgctggtaagtgaagccaccaaaacagacgcggaaggcaaactcgtccacggaaagaaacacggctacgtcagtaacgttagaaacaaagcaggagaataccgccacaccgtatcgagacaggcgatcgtggacgaagtccgcaagatcttcgccgcccagagagcactcggcaatgacgtaatgagtgaggaactcgaagacagttacctaaagattctgtgtagccagcgaaacttcgacgatggaccaggaggagactcaccatacggccacggatcggtgtcaccagacggggtaaggcaatcaatctatgaaagaatggtaggatcctgcacctttgagacgggcgaaaaacgtgcaccaaggagcagctatagcttcgagcgattccaactgctaaccaaagtggtaaatctgcgcatctatagacaacaggaagacgggggccgatatccatgcgaactcacccagaccgaacgagcccgcgtaatagactgcgcatatgaacagaccaaaattacatacggaaaattgcgcaaactcctggacatgaaagacaccgagtccttcgcagggctaacatacggcctaaaccgctcccggaacaaaaccgaagatacggtattcgtcgaaatgaagttctaccacgaagtaagaaaggcactccagcgagccggggtatttatacaagacctatcaatcgagacacttgatcagatcggctggatactctcagtatggaaaagcgacgacaaccgccgaaagaagctaagcacactgggcctcagcgacaacgtaatagaggaactactccccctcaacgggagcaaattcggacatctctcgctaaaagcaatccgcaaaatcctaccgttcctagaggacggatacagctacgatgtagcctgcgaactggcgggctaccagttccagggaaaaacagagtacgtcaagcaaagacttctaccgcccctcggagagggagaagtcacaaaccccgtagtgcgccgcgcactctcacaagcgatcaaagtagtaaacgcagtcatccgaaaacacggcagcccagaatcaatacatattgagctcgcacgagaacttagcaagaatcttgacgaaagacgaaaaatagaaaaagcgcaaaaggagaaccaaaagaacaacgaacaaatcaaagacgagataagggaaattctcggttcggcacacgtgaccggaagagacatcgtgaaatacaaactcttcaaacagcagcaagagttctgcatgtacagcggtgaaaaacttgacgtaacacggctattcgaaccagggtacgcggaagtcgaccacatcataccctacggcatctcgttcgacgacagctacgacaacaaagtcctagtaaaaacggaacaaaatagacagaaggggaatcgaacacccctagagtacctccgagacaaaccagaacagaaagcaaaattcatagccctcgtagaatcaataccactctcgcaaaagaagaaaaaccacctcctcatggacaagcgagccatcgacctcgaacaagaagggttcagagaacgcaacctgagcgacacacgctacatcacacgagcgctgatgaaccacattcaagcctggctactcttcgatgaaacagcctccacccggagcaagcgagtagtatgcgtaaacggcgcggtaacagcatatatgagagcgcgctggggcttgacgaaagaccgcaacgcaggggacaagcaccacgccgctgacgcagtagtcgtagcctgcataggggattcactcatacaacgggtcaccaaatacgacaaattcaaacgcaacgcgctagcagacaggaaccgctacgtccaacaggtatccaaaagtgaaggtattacacagtacgtagacaaggaaaccggagaagtattcacctgggagagcttcgacgaaagaaagttcctgcctaacgaacccctggaaccctggcccttcttcagggacgaactcctcgcgagactctcagacgacccatcaaagaacatccgggccattggcctgctcacctattcagaaaccgagcaaatcgacccaatattcgtaagtcgaatgcccacgaggaaggtgaccggggccgcccacaaagaaaccatccgatcacccaggatcgtcaaagtagatgacaacaaagggaccgaaatccaggtagtagtcagcaaggtcgccctaactgagctgaaactcacaaaagacggcgaaatcaaagactacttcagacccgaagacgacccacgcctgtacaacacgctgagagaacggctagtccaattcgggggagacgccaaggcagccttcaaagagcccgtatacaaaatatccaaagacggctccgtccgaacgccagtacgaaaggtcaaaatccaagaaaaactaacactgggagtccctgtgcacggcgggcgagggatagccgaaaacggcggaatggtaagaatcgatgtgttcgcaaaggatggcaaatactatttcgtaccgatatacgtcgcggacgtactaaaaagggaactcccgaacaggctcgcaacagcacacaagccctacagcgagtggagggtagtagacgatagctaccaattcaagttttccctctatccaaatgacgccgtaatgatcaaaccatctagagaagtggacataacgtacaaagaccgcaaagagcccgtaggactccggctaatgtacttcgccggggcggacatatcgggagcaaccctcaccctcagaacgcacgacaactcgggagagctaaaaggcctaggcatccaaggactcgaagtcttcgaaaaatatgtagtcggaccactgggcgacacccatccagtgtacaaggaaaggagaatgccattcagagtagaacggaaaatgaactga

SEQ ID NO: 7496 - RNA, 3447 nt, synthetic construct
  misc_feature 1..3447: note = Cas9 variant
  source 1..3447: mol_type = other RNA
atgaccaaactcaaccaaccttacgggatcggcctggacattggatccaattcgataggcttcgcggtcgtcgacgcgaactcacatttactcagactaaaaggcgaaaccgctatcggcgctagactctttcgagaaggccaaagcgcggctgaccgccgcggatcacgcaccacccgccgccgactgagccgaacccgctggcgcctatccttcctacgagacttcttcgcaccccatataactaaaatagaccctgacttcttcctccgtcagaaatatagcgaaatctcccccaaagataaggaccgcttcaaatacgaaaagcggttattcaacgaccgcacagacgccgagttctacgaagcctacccgtccatgtaccacctacggctgagactaatgaccgacgcatcccaggccgacccacgagagatcttccttgctattcaccacatcctcaaatcccgcggacacttcctcaccccaggagcagccaaggacttcaatacagacaaagtcgacctagaagacatattccccgcactcaccgaggcttacgcccaagtctacccagatctggaactaacgttcgacctagcaaaagccgacgatttcaaggcaaaacttctcgacgaacaggcaaccccatcggacacgcaaaaagccctagtaaacctcttgctatccagcgacggcgaaaaagaaatcgttaaaaagcgcaagcaggtactaacagaatttgccaaggcaattaccggcttaaaaacaaaattcaacctcgcgctaggcactgaagtcgacgaagccgacgcgagcaattggcagttctccatgggacaactagacgacaaatggagcaacatcgaaacctcaatgacagaccaaggcaccgaaatcttcgaacaaatccaggagctgtaccgtgcccgcctacttaacggcatagtccccgccggcatgagtctttctcaagccaaagtcgctgactacggacaacacaacgaagatctggagctattcaaaacctacctaaagaagctaaacgatcacgaactggcaaaaaccatcagggttatatacgacaggtacatcaacggagacgacgcaaaaccattcctgcgggaagatttcgtcaaggcactaacaaaagaagtcacagcccatccaaatgaagtctcggaacagctcctaaaccgaatgggtcaagctaacttcatgctcaaacagcgtaccaaggcaaacggcgccatccccgtacaactacagcaacgggagctagatcagatcatagcaaaccaatccaaatactacgactggcttgcaaaaccaaaccccgtagaaaaacaccgagcctcgaaaccttaccaacttgacgaactcctaactttcagaataccatactacgtcggccccctcattaccccaaaggaacaagcaaaatcaggcgagaacgtcttcgcctggatggtccgcaaagacccctccggcaatataacgccctacaactttgatgagaaggtagacagagaggcttccgccaacgtcttcatacagcggatgaagacaaccgatacctacctaataggagaagacgtccttcccaaacagtcactcctctaccaaaaatacgaagtactcaacgaactaaacaacgtcagagtcaacaacgaggcactcggcacagaccaaaaacaacggcttatcagagaagtattcgaaagacactcctcagtcaccatcaaacaggtggccgacaacctggtagcgcacggcgacttcgcacaacgaccagaaatccgcggactagctgacgagaaacgcttcctaagttcactatctacctaccaccaactcaaggaaatactacatggtgccatcgacgactctacaaagctacacgacatagaaaatatcatcacctggtctacagtgtttgaggacgccgccatattcaaaaccaaactggccgaaatcgactggctggacgccgcaaccattaagaaactatcaaacatacgctatcgcggttggggtcagttctctcgcaaactcctagacggccttaaactcggcaatggacagacagtcatccaggaactcatgctcagcaaccacaaccttatgcagatcttgacagacgaaactctcaaaaccaccatggcggaactaaaccaggacaagctcaaggccgacgacattgaagatgtcatcaacgacgcctacacctcgcccagcaacaagaaagcacttcggcaagtactccgggtcgtcgaagacataaaacacgcggccaacggccaggacccgagctggctatacatcgagaccgcagacggccccggcacagccggcaaacgcacacaaagccgtcagaaacaaatccaaacagtttacgccaacgcagcacaagaactaattgacagcgccgtccgaggcgaactcgaagacaaaattgcggacaaggcctccttcactgaccggctcgtcctgtacttcatgcagggcggccgagatatctacacaggcgccccgctgaacatagaccaacttagccactacgacatagaccacatcctgccacaaagtttaatcaaagacgactcactcgataacagagtcctagtgaatgcgacgatcaaccgggagaaaaacaacgtatttacatccaccctcttcgcaagcaaaatggccgccacctggcgcaaatggcatgaagcgggcctcatctcaggccgtaagctgcggaacctaatgttaaggcctgacgaaatcgacaagttcgcccacggcttcgttgcccgccaactcgtcgaaacacgccaaatcataaaacttacagaacagatcgccgccgcccagtacccgaacaccaagatcatagcggtaaaagccggcctaagccaccaactccgagaagaactcgacttccccaaaaatagagacgtcaaccactaccaccatgccttcgacgccttcttagccgcgcgaatcggcacttacctcctcaaacgatacgccaaactagcccccttcttcacatacggggagttcgccaaagtcgacgtgaagaaatttcgcgagttcaacttcataggggccctcaaacacgcaaagaaaaacatagttgccaaagacactggggaaatcgtctgggataaagaaagagatatacaagaactcgaccgcatctacaacttcaaacgcatgcttattacgcacgaagtgtacttcgaaacggctgacctcttcaaacaaactatatacgcggccaaagattcaaaagaacgcggcggatccaaacagctaataccaaagaaacgaggctacccaacccaagtgtacggaggcatccacgggaaaatcagactcacctggcgctggctaaaactcctcagacggaagaagatgtctatcgaactctccgaacttcaactgcttaagtga

SEQ ID NO: 7497 - RNA, 3450 nt, synthetic construct; identical to SEQ ID NO: 1697
  misc_feature 1..3450: note = Cas9 variant
  source 1..3450: mol_type = other RNA

SEQ ID NO: 7498 - RNA, 3459 nt, synthetic construct
  misc_feature 1..3459: note = Cas9 variant
  source 1..3459: mol_type = other RNA
atgaacgcagaacacggcaaagaaggcctcctaataatggaagaaaacttccagtaccggatcggactcgacatcgggatcacatccgtaggatgggcagttctacaaaacaacagccaagacgaaccagtacgtatcacggacctcggagtaagaatattcgacgtcgcagaaaaccccaaaaacggggacgccctagccgcaccacgaagagacgcccggacaacgcggagacgcctgagacgccgccgacacagactcgaacggattaaattcctcctgcaggaaaacggattaatcgagatggacagcttcatggaacgctactacaaaggaaacctacccgatgtataccaactcaggtacgaaggactagacaggaaactcaaagacgaagaactggcacaggtcctcatccacatagccaaacacagaggattccgaagcacacgcaaagcggagacaaaagagaaagaaggaggagcggtcctaaaagcaacaactgaaaaccagaaaatcatgcaagaaaaagggtaccgaacagtcggagagatgctatatctcgatgaggctttccatacggagtgcctgtggaacgagaaaggatacgttctaacgccgcgcaaccggccggacgattacaaacacaccatactaaggagtatgctcgtggaggaagtacacgccatatttgccgctcagcgggcccacggcaaccaaaaagccacggagggactggaagaagcatacgtagagattatgacctcgcaacgatcctttgacatgggaccggggctgcagccagacggaaaaccaagcccatacgcaatggaaggcttcggagaccgagtcggcaaatgcacgttcgagaaggacgaatacagagcgcccaaggcaacatacacagcagagctattcgtagcactccagaaaataaaccatacaaagctgatagacgagttcggcacaggacgcttcttctccgaagaggaacgaaaaaccataatagggctgctactcagctcgaaagaactaaagtacggaaccatacgaaagaaacttaacatagatcccagcctgaaattcaacagcctgaactacagcgcaaagaaagaaggcgagacagaggaagagagggtcctcgacactgagaaggcaaaatttgcctcaatgttctggacatacgaatacagcaaatgcctcaaagaccgcacagaggaaatgcccgtgggagaaaaagccgacctattcgaccggatcggagagatactaaccgcatacaaaaacgacgatagcagatccagcagactcaaagaactgggcctgagcggcgaagaaatcgacggcctgcttgacctatccccagcaaaataccaaagggtatcgctcaaagcgatgcgcaagatgcaaccctacctcgaagacggcctcatctacgataaagcgtgcgaagccgccggctacgactttcgggcactcaatgacggaaataagaagcacctcctaaaaggagaagaaatcaacgctatagtaaatgacataactaaccccgtggtcaaacgatcggtctcccaaacaataaaggtcataaacgcgattatccaaaagtacggcagtccacaagcagtaaacatcgagctggcacgggagatgtccaagaattttcaggacagaaccaacctcgaaaaagagatgaagaagcgtcagcaggaaaacgaacgagcaaaacaacagataatcgagctaggaaagcaaaatcccaccgggcaagacatcctcaagtaccggctctggaacgaccagggcggctattgcctgtattccggcaagaaaatacccctcgaagaactcttcgacggagggtatgacattgatcacatattaccgtacagcataacgttcgatgatagctaccggaacaaagtgctagtgaccgcacaagaaaacaggcaaaaaggcaacagaacgccatacgaatacttcggagccgacgagaaacggtgggaggactacgaggcaagcgtccgactgctagtacgagactacaagaaacagcaaaaactactcaagaaaaactttacagaagaagaacgcaaagaatttaaagaaagaaacctaaacgacacaaaatacatcacccgggtcgtctacaacatgatccgtcagaacctagagcttgaaccgttcaaccacccagagaagaagaaacaagtgtgggcggtaaacggagcggtcacctcctatctacgtaaacggtgggggcttatgcaaaaagaccggagcaccgacagacaccatgccatggacgcagtagtaatagcctgctgtaccgacggcatgatccataaaataagcagatacatgcaagggcgggagctcgcttattccagaaacttcaaatttcccgacgaagagacgggcgagatactcaacagagacaacttcaccagagagcaatgggacgaaaaattcggagtcaaagtaccgctaccgtggaactcattccgagacgaactagacataagactcctcaatgaggaccccaaaaacttcctgctcactcacgccgacgtacaacgcgagctcgactacccagggtggatgtatggggaagaagaatccccgatagaagagggcaggtacataaactacataaggccactcttcgtcagccgaatgccaaaccacaaagtaacaggcagcgcacacgacgccaccatccgatcagcacgagactacgagacacgcggcgtcgtaatcacaaaagtccctctgaccgatctgaaactcaataaagataatgaaatagaaggctactatgacaaagactcagacaggctcttataccaggctttggtacgtcaactcctcctacacggaaacgacggcaagaaggcgtttgcggaagacttccacaaacccaaagcggacggaaccgagggcccagtcgtacgaaaggttaagatcgaaaagaaacaaacaagtggagtcatggtgcgaggcggaaccggaatagcagcaaacggcgaaatggtaagaatagacgtcttccgcgaaaacgggaaatactacttcgtgcccgtatacactgccgacgtagtaagaaaagtgctgcccaatagggcagcaacacacacaaaaccatatagcgaatggagggtaatggacgacgcaaacttcgtcttcagcctctactcgcgagatctaatccacgtgaaaagcaagaaagacatcaaaaccaacttagtgaacgggggcctactactccagaaagagatattcgcctactacacaggcgcagacatagcaactgcctctatcgccggattcgcaaacgattcgaacttcaaattcagggggctagggatccaaagcctagaaatatttgaaaaatgccaagtagacatactcggcaacatctcggtcgtgagacacgaaaaccggcaagagttccactga

SEQ ID NO: 7499 - RNA, 3462 nt, synthetic construct
  misc_feature 1..3462: note = Cas9 variant
  source 1..3462: mol_type = other RNA
atgaaaaacatactcggcctagacctaggcctctcatcgatcggatggagcgtaattagagaaaactccgaggagcaggagctagtggccatgggcagcagagtcgtaagcctaacggcagcggaactcagctcattcacacagggaaacggggtgtccatcaacagccaacgaacacagaaacgcactcagaggaagggatacgatagataccaactccggcgaaccctcctccgcaacaaacttgacaccctaggcatgctgccagacgacagcctttcctacctgcccaaactccagttatggggcctacgagcaaaagccgtgactcaacgcatagaactaaacgaactaggccgagtcctactacacctcaaccaaaagcgcggctacaaatcaataaaaagcgacttcagcggagacaagaaaatcacagattacgtaaaaaccgtgaagacccgttatgatgagctaaaagaaatgcgactcaccatcggcgaactcttcttccgccgactcactgagaacgccttcttccgatgcaaagaacaagtatacccgcggcaagcctacgttgaggagtttgactgtataatgaactgccaaagaaaattttacccagacatcctaacagacgaaacgatccgttgcatacgagatgaaatcatatactaccaacgcccactcaaatcatgcaagtacctcgtctcgcgatgcgagttcgaaaaacgcttctacctaaacgcagctggcaagaaaaccgaggcgggacccaaagtctcccccagaactagccccctgttccaagtatgccgcctctgggaatcaattaacaatatagtcgtcaaagaccgcagaaatgagatagtgttcattagcgccgaacaacgagccgcactcttcgatttcctcaacactcacgaaaagctcaaaggcagcgacctactcaagctactaggattaagcaaaacatacggttaccgacttggcgagcaattcaaaaccggcattcagggcaacaaaaccagggtagagatcgaacgagcattaggaaactacccggataagaaacgcctattacaattcaaccttcaggaagagtcatcaagtatggtgaacaccgagacaggtgagattataccgatgatctccctcagcttcgaacaggagcccctgtaccggctatggcacgtcctctacagtatcgacgatcgagaacagctccagagcgtactcagacaaaaattcgggatagacgacgatgaagtgctcgaacgactctccgcgatcgacctcgttaaagcgggattcggcaataaaagctccaaggcaatacgtcggatcctaccctttctccagctcgggatgaactacgcagaagcatgcgaggccgcagggtacaaccacagcaacaactacaccaaagccgaaaacgaagcacgtgcgctcctggaccgcctacccgcaataaagaagaatgagctccggcaacctgtcgtcgagaaaatcctaaatcaaatggtaaatgtggtaaacgcgctcatggaaaaatacggacgcttcgacgaaattcgggtcgagctcgcccgcgagctcaaacaatccaaagaagaaaggtcaaacacttacaaatccatcaacaaaaaccaaagagaaaacgagcaaatcgcaaaaagaatagtcgaatacggcgtccctaccagatcccgaatccaaaagtacaagatgtgggaggaaagcaaacactgctgcatttactgcggccaacccgtcgacgtcggcgacttcctccgcggcttcgacgtcgaagtagagcatataatcccaaaaagcctatacttcgacgactcatttgccaataaggtttgctcctgccgttcgtgcaacaaagagaaaaacaaccgcacagcatacgattatatgaaaagcaaaggtgaaaaagccctgagcgactacgtagaacgcgtcaacacaatgtacacgaacaaccaaatcagcaaaacgaagtggcagaacctgctcacgccggtcgacaaaatctcaatagacttcatagacagacaactaagagaaagtcagtacatcgcccggaaagcaaaggaaatactaacctccatctgctacaacgtaacagccaccagcggctccgtaacatcgttcttacgacacgtctggggctgggatactgtcctgcacgatctgaacttcgacagatacaagaaagtcggcctcaccgaagtgatagaagtgaaccaccgcggaagcgtcatccgacgagagcaaatcaaagactggagcaagcgtttcgaccacaggcatcacgcaattgacgcacttacaatagcgtgcacgaaacaggcatatatacaacgactcaacaacctccgagcggaagagggaccagacttcaacaagatgtccctagagagatacatacagagccaaccacacttctcggtcgcccaagttcgagaagcggtggatagaatcctcgtttcattccgagccggaaaaagagccgtcacgcccggtaagcgatacatccgcaaaaaccgcaaaagaatatccgtacaaagcgtcttaatccccagaggggccttaagcgaagaatccgtctacggagtcatccatgtctgggaaaaggacgaacaaggtcacgtaatacaaaaacagcgcgcggtaatgaaatatccaatcacctccataaaccgagaaatgctagacaaggaaaaagtcgtcgacaaacgcatccaccgcatactcagcggccgcctggcacaatacaacgacaacccaaaggaagcattcgcaaaacccgtttacattgacaaagaatgtcgcatacccatcagaacagtgcgctgcttcgcaaaaccagcaataaatacgttggtgccacttaaaaaggatgacaaagggaacccggtcgcttgggtaaaccccggaaacaaccaccacgtcgcaatctaccgtgacgaagacggaaaatataaagagcgcaccgtcaccttctgggaggcagtagaccgctgccgcgtcggcattcctgccatagtcacacaacccgacaccatatgggacaacatcctacagcggaacgacattagtgagaacgtcctcgaatccctgcccgacgtcaaatggcaattcgtgctatccctgcagcagaacgaaatgttcattctaggcatgaatgaagaagattaccgctacgccatggaccaacaggactacgcactactaaacaaatacctctacagggtccagaagctatccaaatccgactactccttccgctaccataccgagacatcggtagaagataagtacgacggcaaacccaacctaaaactatccatgcagatgggaaagctgaaacgcgtgtcaatcaaaagccttctcggcctaaacccacacaaagtacacataagcgttctcggagagataaaagaaatctcctga

SEQ ID NO: 7500 - RNA, 3474 nt, synthetic construct
  misc_feature 1..3474: note = Cas9 variant
  source 1..3474: mol_type = other RNA
atgaactactacaatggcttcataatcaccgaaaacgcaatgacgagtaaacaggaaaaacacggggccctgacatttgggctagacataggaatagcatccgtcggctgggccgtcctcggcgaaagccgaatagtagacctcggcgtccgatgcttcgacaaagcagagacagcaaaggagggagaaagcctaaacctcacacgtcgaatggcccggctcttacgccgaaggctccggcgccgagcatggcgactgaccaagctagcgagactactaaaaagggaaggactgatcgcagacgcaaacctattcaagcacaaaatcgagaaaaacacaccggtacccaaatcgagctggcaacttagagtcgacggccttgacagacagctaaacgccgaagagtgggcacgagtgatataccacctatgcaaacaccgcggcttccactggataagccgagccgaggaaaaagcagccgagggcgacagcaaaggggaaggcggaaaagtcaagcaaggactagctggaacaaagaaattgatgcaagagaaaagctaccggacagcagcagaaatggtcctagctgagttcccagacgcacaaagaaacaagcaaggagactacagcaaagcgctcagcagaatactcctaggcgatgaactcaaagcactattcgaacatcagcgcaaactaggaaaccctgtcgcaacagaaaaactagaagcagcaatattaggcaacggggacaagaaatgcggcctcttttgggcccaaaaccccgccctcgccggaaacaaactactagaaatgctcggacgatgcaccttcgagaaaacagggggcgatgacggcaaaggcgaatatcgcgcgcccaaagcatcctttagcgccgagcgccacgtctggctcacgcacttaaacaacctcagaatcgtcgtcgacggaacaaccagacccctcaacgaagccgaacggagagtcgcactacccatgccctaccaacaagccggagacctctcctacaagcaacttgggggagccctgatcaaagaagggttcctccaaaaggacggattcaagttcgcaggcctgccctaccccaccaagcaagcatccgaagaaaaggcgaaggaccccgagacgtcggtactatgcaaactcccggcgtggcacactctgcgcaaaacactcgaaaaacatggactagaatcggaatggcaaaaattaagcaccgacgccttggacggcaaaccgcaactgctagacaacatagcctgggtcctctcggtgtataaagacgacgacgaagttaagaccgaactagggaaattaaatctaccaaacacagaaaagatgatagacgcattgctcgacatccgattcgacaaattcagtaacctcagcctaaaagccctgagcaaaatagtaccgttcatggagcaaggccaacgatacgacgaagcagtagcgaacataccagaatacggacaccattctcaactacataaggtgggggcgggcgagcataagtacttgccacccttctacaaagagagagacaaaacgggacgaatggtattcaatgatgacatggacattccaagaaaccctgtggtccttcgcgcactcaaccaagccagaaaggtcgtaaacgccctcataaaggaatacggcagcccgcacgaagtccacattgaaatggcgcgagacctcagccgaccactggacgaacggcgagacatagaaaagctacaaaaagagttcggagaacgaaacaagaaagacaaagaactcttcgcacaagactttaacatagtaggaacagttaaagggaaacaatttgaaaaataccagctataccgcgagcaacaaggcaaatgcatctatccatcgatggacgaaaaacagggcatatgctgttactcactcaaaccactcgaccttcacagagtgctatacgaagaaggctatgccgagatagatcacgccctaccctacagcaggagcttcgatgattccaagaacaacagagtactcgtcctagcaaaggagaacagagacaaggggaaccgcacgccattcgaatacctaggggacaaagacaactcagagccctggcgccaattcgtagccttcgtcgagggaaacaaggcctaccgattagccaaacgcagtcgcctgctgcgaaaagatttcggcgataaggaagccaaagagttccgagaacgcaacctcaatgatacgcgttacatatgcaagtttttcaagaactacgtggaacaataccttcaacttcacgaagacagtgaagccaagagatgcgttgtcctaagtggacaaatgacctccttcctccgggcccgatggggtctcgtaaaagtccgaggggactcggaccggcaccacgcccttgacgccgcagtagtagcggcctgtagtcacggcatggtaaagagactaagcgactactcaagaagaaaagagctcgaacaagtgcgcgaggggttcgtcgatgtagacacgggagaaatagtgaacccggccatgttccaacaagtacaggaacacttcccgaatccgtggccgcacttccgcgatgaagtaaaattgcgcctcagcatagatgacccaacactgctacgatccgaaatggaaaagttcggaacatacacaccagagtcactagaagccctacgccccctattcgtatctagagcgccacaacgaaggaacagcggcgctgcacacaaagacacaatatatgcgcaaccaaaacgcctcgtagcccaagggggagtaacgcagaaggtcgcgttaagcagcctgaccctgaaagacctagataaactaatagacccccatcgaaacgaacgactatatgcagccataagagccaggcttgaacaacatggcgggaagggagacaaggccttcccagcctccaaccccctacgaaaaccggacagcgaaggcaaccccacaggacccatagtacgaggcgtcacgatggtgatcgacaaactgagcggaataccgatccgcgggggcatagcgaaaaatgactctatggtccgcgtcgacgtattcaccaaagccaacaagttccacctagtgccggtctacgtccaccacagcgtccttggccttccaaaccaggccatagtgggcggcaaggaagaaagcgaatggacacaaatcgatgactccttcgactggcacttctcaatctacccaaacgacctgattcgtgttacactcaagcaggaaggccgtttcggatactacgccggatgcgaccgaagcacagccgcaatacacctatgggcccacgaccgaaaccagcaagtaggcaaagacggcctaatacgcagtatcggcgtcaaaaccgcattgtcaatcgagaaattcaacgtcgacgtcctcggcaaccgataccccgcaccaccggagaaaagaagggacctagcctga

SEQ ID NO: 7501 - RNA, 3486 nt, synthetic construct
  misc_feature 1..3486: note = Cas9 variant
  source 1..3486: mol_type = other RNA
atgaagaagattctaggcctagacctaggctctgccagcatagggtgggccctcgtcgaagagaccgaacaaatgcaatacaatatcgtaagcctgggaagtcgaataatcccctataacggcaccgaaggccaggaatttgaaaaaggcaccggggaatcacgaaacagcctacgcacaaaagcgagaaccgccagaaaaggctatgaccgctaccagctccgcaggaaaaacctagagaaaatactgcttcagaacggtatgtacccaaacgaacaggtaagagccctccagaaactcgagctctggaaattgcgagcagacgcgcccaatgtccagatcagcctcccggaactggggagactcctattctggctgaaccaaaaacgaggctataaaagcagccgatccgacgccaatctagacaagaaagatacagaatacgtagcgacagtcaaatcccgccaccaaaagatcaaagacgcaggccagaccgtcggacagtacttctacggccaaatcctcgagaacgagtaccaccgcataaaagaacaagtgttcccaagggaggcctacattgaggagttcgacgcaatcgtcgcacggcaaaaggaatactacccaacaatactaaaacaagagctaatcgacaaaatccgaaacgaagtcatatacttccaacgcggcctgaaaagccagaagggcttggtctcagtatgcgagttcgaaggaagagaatttaacggccacttcggcggccccaaggtagcaccaaaaagcagtccgatcttccaactaggcaaaatatgggaaaacatcaacaacatcaaaatagcagacatcgaactgaccgcagaacaaaagctagtattcttcaactacctcaactgccacgagagaattaccgaagcgaaaatccgggaactactaaaactatcgaaagacagccggctaaacggacagctcaaaaacggactgaccggaaacaagacatactcgcaaatcgcaagttgcttcggaaataaaatcggtgagtatgagagactattcaaattcgagctcgaggtcatcgaaagtgaaaagctcgaatacacctaccaccccaaatctcacatccccgtaggcgaaaagcgacgcaaatacatcagcgaaaacgtcgagaaggaaccctactacagactctggcacaccatctactccattaaagacaaggatgaatgtcgcgcggccctcattaaaaacttcggcatagaagaagaaatcgccgagaagctcgccagcctcgatttcagcgctgggggtttcggcaacaagtgcgcaaaggtgataagaaaaatcctcccatacctcatggagggcgacaagtacaacgtcgccatggactacgccggctacaaccatagcttctcacagacgaaagacgagaacctccagcgcgtactactagactcaataaaccacctccccaaaaactcactacgacaacccatagtagagaaaattctcaaccagatgatcaacctcgtcaacgaggtcataaagcaatggggccgcccagacgaaatacgcgtcgagctggcacgcaaactaaaacagtcaaaaactgaaagaaacgatgacgacaactttatgcgcaaaagagaaagagaaaacgagataatcaaagcagacctagccaagtatggactcaaagcaacacgcaacaacgtgatcaaatggcgtctgtaccacgagatcgacgacaaagacaaaaagctaaatgcacgttgcatatactgcgggcaacccatctcgttaaccgaagccatactcggcaataatgtagacgtagagcacataatcccaaaagataaactcttcgacgatagccagtcaaacaaaacactggcccaccgaagctgcaatagcggaaaggggaacaagacagcgtacgatttcatgaaggataaaccacaattcgaagagtacgtagcccgcgttgaagaactatataaaaagcacctgatatccctaaccaagaaacgaaaattcctaatgtccgaggacaaaatcccaagcgacttcatcgaccgccagctcagagaatcacagtacatagcccgtaaatcacgagagattctgcaaaccgtatgcagaaacgtctggagcacagacggcggcgttaccgcccacctccggaaactctggggctgggacgacgtcaccatgaaccttcaaatgcccaaatacaaggggatcggcatgacagaaatcgtggagtgggaatccaatcacggaaagaaccagcacacacaggaagtcatcaaggactggtcaaagcgagacgaccaccgacaccacgcaatagacgcactggtggtggcctgtacacgacaagggtacatacaaagaataaatacactcaatagcagcgaaaccaaggacgagatgcaccgcaaagtagcgggcagcttagtagagttcaaccaaaaacacaccctcctcaacaaataccttattacagaaaaacccttcaccacatccgaagtagaagatgtggtgagcaaaattctagtgtcattcaaagccggaaagaaagcagcaacacccggaaaacgcaaagtgggaaaacggggtaacaaacaggtggtccaagacggcatcatcataccaagaggcgccctccacgccgactcggtcagtggatccatcaaacaatacgacccaacgggcaacttcgaaaaccacaacgtaataaaatacaaagtgggggtgggtaagggctatctcttcgacgggaaggacgacaagaagaaaatagacaaaaccatagactgcatagtcgacaagaagatcagagacctcataaaacaaagagcagaagaatcaaactacagcctgaaaaagatgttcgaaaccccgatcctgttcaaccagcgagcagtcttctctgtccgctgtaaaacgggcaacaaagcagtagtgcctatccgaaacggatacgtggtacccgacaacaaccaccacaccgcgatctacaaatacgacggagggctcaaggaacaatgcgtcagcctcatgcaagcgatcgaaagaaaacgatacaaccttccgatcatcatcaaaaacccgaaagaaatctacgacaagataaccgagatcgcaaacatcaaccaactactcttcgacagcttgccaaaactcgattgggagttcgtaacaacgctccaaaagaacgacatgttcatactcggcatggactacagcgcgaccgaagaggcactcgccgacggcaactaccggctcctctcggaatacctctataaggttcagaacataagcgacgggatctacaggctctgccaccacacgataactaaatttgacctgtccaaagcgaacaaaccagacaaacgattttacaatatccaatccctaaaagcctggaacacactaaacccccaaaaggttaaaataaacatactcggccagatcgaacggcagtga

SEQ ID NO: 7502 - RNA, 3501 nt, synthetic construct
  misc_feature 1..3501: note = Cas9 variant
  source 1..3501: mol_type = other RNA
atgcacgtagagattgactttccacatttctcacgcggagattcccatctagcaatgaacaaaaacgaaatcctacgggggagctcagtactgtatcgactcggcttagacctcggcagcaactccctaggctggttcgtaacccatctagaaaaacgaggcgaccgacacgaacccgtagcactcgggccaggaggagtccggatattccccgatggccgagacccgcaaagcggcacatcgaacgccgtggaccgacgcatggcacgaggggcccggaaaagacgcgaccgcttcgtcgaacgacgaaaagaactcatagcggcactaatcaaatacaatttgctgcccgacgacgcccgcgaacgcagggcactcgaagtactggacccctacgcactaagaaaaaccgcgctgaccgacacgcttccggcccaccacgtgggacgcgcactcttccacctaaaccaacggaggggattccaatccaataggaaaacggacagcaaacagagcgaagacggcgctataaaacaagccgcaagccgcctagctacagacaaaggaaacgaaacccttggagttttcttcgcggacatgcatcttcggaaatcgtacgaagaccgacagaccgccataagagcggagctagtgagactcggcaaagatcacctaacgggcaatgcccgaaagaaaatatgggccaaagtacgcaaaaggctgttcggcgacgaagtgctacccagggccgacgccccacacggcgtaagagccagagcaactatcacaggaaccaaagcgtcctacgactactaccccaccagagatatgctgcgagacgagttcaacgcgatctgggccggacagagcgcacaccacgcaacgatcactgacgaagcaagaaccgaaatcgaacacatcatcttctaccaacgaccactgaaaccggcgatcgtagggaaatgtacccttgacccagcgacaagaccgttcaaagaagacccagagggataccgcgcaccatggagccacccactcgcacaacgcttccgcatactatccgaagcccggaacctcgaaatccgcgataccggaaaaggaagccgaaggctaacgaaagaacagagcgatcttgttgtcgcggccctgctagcaaacagagaagtcaaattcgacaaactacgcacactcctaaaactccctgcagaggcacgcttcaacctcgaatccgaccgcagggcagcgcttgacggagaccaaacagccgcccgactcagcgacaaaaagggattcaataaagcctggcgcggattcccgccagagcgacaaatcgcaatcgtcgctcgcctcgaagaaacagaagacgaaaacgaactaatagcatggctagagaaagaatgcgccctcgatggtgccgccgcagcacgcgtcgccaataccaccttacccgacggacactgcaggctcggactacgagcgatcaagaaaatagtccccataatgcaggatggactcgacgaagacggcgtcgcgggggcaggataccacatcgccgccaaaagagcgggctacgaccacgccaagctcccaaccggcgagcaattaggaagactcccatactatggccaatggctacaagacgcagtagtaggaagcggggacgcaagagaccaaaaagaaaaacaatacggccaattccccaacccgacggtacatataggccttggccagctaagacgcgtagtgaacgacctaatagacaaatacggcccgcccacggaaatatcaattgagttcaccagagccctgaaactatccgaacaacaaaaagctgaaagacagagagaacaacgaagaaatcaagacaaaaacaaggcacgggcagaggaactggcgaagttcgggcgacccgccaaccccagaaacctcctaaagatgcgattgtgggaagaactagcccacgacccactcgacaggaaatgtgtctacacgggggaacaaatatctattgaacggctactttccgacgaagtggacatagaccacatcctcccggttgcaatgacactagacgatagcccagcaaataaaatcatctgcatgcgatatgcaaaccgccacaagagaaaacaaacaccatcagaggcattcggatcaagcccaactcttcaaggccaccggtacaactgggacgacattgctgcgcgtgccaccggcttaccacgaaacaaaagatggagatttgacgctaacgcaagagaagaatttgataaacgaggaggcttcctagcaagacaactaaacgaaactggctggctagcacgactagccaagcagtatctcggtgcagtcaccgacccaaaccagatctgggtcgtcccagggagactcacatccatgctacgcggcaaatggggcctgaacggtcttctgcctagcgacaactacgctggtgtccaagataaagcagaagaatttctggcaagtaccgacgacatggagttctcaggcgtcaaaaatagagcagaccacagacaccacgcgatagatggactcgtaacggcattaaccgaccgctccctactctggaaaatggccaatgcctacgacgaagaacacgaaaaattcgtaatcgaacctccatggccaacaatgcgcgacgacctaaaagcggcactcgagaaaatggtcgtaagccacaaaccagaccatggaattgagggaaaattacacgaagacagcgcgtatggcttcgtcaaacccctagacgcaaccggtctcaaagaggaggaagccggaaacctagtctacagaaaggccatcgaatccctcaacgaaaacgaagtagaccgcataagagacatacaactaagaacaatcgtcagagaccacgtaaacgtagagaaaacaaaaggagtggccctcgctgacgccctgaggcagttacaagcccccagtgacgactacccacaattcaaacacggccttcgacacgtacgcatcctcaaaaaggaaaaaggcgattaccttgtaccaatcgcaaatcgtgcgagtggagtcgcatacaaagcatacagcgccggagaaaacttctgcgtcgaggtcttcgaaaccgccggcgggaaatgggacggtgaggccgtccgtagattcgatgccaacaaaaagaacgccggccccaaaatagcacacgcgccgcagtggagagacgcaaacgaaggcgccaagctagtaatgcgcatacacaaaggcgatctcatccgcctagaccacgaggggagggcaagaataatggtcgtacaccgtcttgacgccgcagctggccgcttcaaattggccgatcataacgagacagggaacttagataaacgccatgcgactaacaacgacatcgaccctttccggtggctcatggcaagttacaacacactcaagaaactcgcagcagtcccagtcagggtagatgaattaggccgggtctggcgggtaatgcccaactga

SEQ ID NO: 7503 - RNA, 3507 nt, synthetic construct
  misc_feature 1..3507: note = Cas9 variant
  source 1..3507: mol_type = other RNA
atggcaaggccagcattccgcgcaccccggagggaacacgtcaacggatggaccccggacccacacagaataagcaaaccatttttcatactggtgagctggcaccttctctcccgcgtggtgatagactcaagtagcggctgtttcccggggacgagccgagaccacacagacaaattcgcagagtgggaatgcgccgttcaaccctaccgactcagctttgacttaggcacaaactccatcggatggggcctccttaacttagataggcaaggaaaaccaagagaaatccgggcccttggaagccgcatattcagcgacggacgagatccccaagacaaagcatcgctagcagtcgctaggagactcgcccgacaaatgcgaagaaggagagatcgatacctaacgcgcagaaccaggcttatgggagcactcgtcaggttcggattaatgccagcagacccggcagctcgaaaaagattagaggtcgcagtggacccatatctggcaagagaacgcgcaactagagagaggctagagccttttgaaataggacgggcactatttcatctaaaccaacgacgaggctacaaaccagtaagaaccgcgaccaaacctgacgaggaggcaggcaaggtcaaagaagcagtggagaggctcgaagcagctattgcagcagcaggggcgcccactctaggagcctggtttgcatggcgaaaaaccagaggagagacactaagagcgcgattagcagggaaaggaaaagaagcagcatacccattctatcccgcccgccgcatgctagaggcagagttcgacacgttatgggccgaacaggcaaggcaccatccagacctgctgaccgcagaagcaagggaaatattgagacacaggatcttccatcagcgacccttgaagccgcccccagtcggcagatgcacactataccccgacgatgggagagcaccaagggcattgccgtcagcacaaaggctgcgcctattccaagaactggctagtctaagggttatacacctagatttgagtgaacgacccctcacacccgcggaaagagacagaatagtggctttcgtacaaggaagaccaccaaaagctggaaggaaaccggggaaagtccagaaatcggtcccgtttgaaaagctgagaggacttctagaactaccacccggtacgggtttcagccttgaaagcgataaaaggccggagctgctcggggacgaaactggcgccagaatagccccggcgttcggtcccggctggacggccctacccctcgaggagcaagacgctttggtggaattactgctgacagaagcagaaccggaacgggcgatagccgcactcaccgcaaggtgggcactagacgaggcgacagccgcaaaattggcgggagccacactaccagactttcacggcaggtacggtaggcgggcagtagccgaactactgcccgtgctcgagagagaaactcgcggcgatcccgacgggagagtgcgacccatcagactagacgaagcagtcaaattgctacggggaggtaaagaccactccgacttttccagggagggggccctactcgacgccttaccctactacggcgccgtactagaacggcacgtcgccttcggcacaggaaatccagcagacccggaggaaaagcgggtaggacgggtagctaatccaacagtgcatatagcactgaaccagctaagacacctcgtaaacgcaatactcgctcgacacggtcgacccgaagaaatagtaatagagttagcacgcgacctaaaaaggagcgctgaagacagaaggcgcgaagacaaaagacaagcagacaaccagaaaagaaacgaagaaaggaagaggcttatactaagcctaggcgaacgaccaactccaaggaacctgctaaaactccgactatgggaggagcaaggaccggtagaaaaccggaggtgcccatactcgggagaaacaatcagcatgcgaatgttactcagtgagcaagtcgacatagaccacattctccccttcagcgtgagcctagacgacagcgcagccaacaaagtagtatgcctgagagaggctaaccgcataaagcgcaatcgctccccttgggaagcctttgggcacgactccgaacgttgggcagggatcctggccagagcagaagcgttaccgaaaaacaaacgatggagattcgcgcctgacgccctcgagaagctagagggagaaggcggcttaagagcacgacacctaaacgacactcgccacctcagccgcttagcagtagagtacctacgctgcgtttgccccaaggtgcgagtaagcccaggaaggctaaccgccttactcagaaggcgatggggtatcgacgcaatactcgcagaagcagacggaccaccgcccgaagtacccgcggaaaccctagacccgtccccagcagagaaaaatcgagctgaccacagacaccatgcgctagatgccgtggtaatcggttgcatagaccgatcaatggtacaaagagttcaactcgccgcagcatcggccgaacgggaagcggcagcacgagaagataacatacgtcgcgtactcgaaggcttcaaggaagaaccctgggatggattccgagcggaacttgaaaggagagcaagaaccatagtggtctcacacaggccggaacacgggataggaggagcactccataaggagacagcgtatgggcccgtagacccacccgaggaaggtttcaacctagtagtaagaaaacccatcgacggactcagcaaagacgaaataaatagcgtgagagacccaaggctgaggagagcactgatcgacagactcgcaatccgacggagggacgcaaacgatcctgccacggcgttggcaaaagcagccgaggatctagcagctcagccagcaagcagagggatccggcgcgtaagagtgctaaagaaagagagcaaccccatacgcgtcgagcacgggggaaacccaagcggaccacgcagcggagggcccttccacaaactacttctagccggcgaggtacaccacgtcgacgtcgcattaagagcagatggtcgaagatgggtaggacattgggtcacacttttcgaagcacacggcggacgaggggccgacggagccgcagcaccacccagactcggagacggggaaaggttcctgatgaggctccacaaaggcgattgccttaaactcgagcacaaaggcagagtacgagtaatgcaagtcgtgaagctcgaaccctcaagcaacagtgtagtagttgtagaaccccatcaagtaaaaaccgacagaagcaaacatgtaaagataagctgcgaccaactacgggcccgcggggcccgaagggtcaccgtagaccccctgggcagagtacgagtacacgcaccgggcgcgcgcgtgggcataggcggggatgcaggccggacagccatggaaccagcggaagacatatcgtga

SEQ ID NO: 7504 - RNA, 3513 nt, synthetic construct
  misc_feature 1..3513: note = Cas9 variant
  source 1..3513: mol_type = other RNA
atgagcaagtacaacgtgggcctggacatcgggatcgcctccgtcggctggagcatcgtggacgccgacaagaagaagatcatcgacctcgggtcccgcatcttcagctccggcaacgcggcagccaaccaggagcggcgcgggttccggggcacccgccgcctgatccgccggcgcaagaaccggctgaccgacgtgatcaactttttcggcgagaagaagttcatcgacacgaaggtcgtggacaagaatgggcacgtgcactacaagttctccgtcaacaacaccgagtctccctacgagctccgcgtgaaaggcctgagcgagatcctgaccaagcaggagctcgtgatcgccctataccacatcgtcaagcaccgggggatctcctacgacctgggcgacctcgaggacgacgggaccagcggcgtgacggactacaaaacctccatcaacatcaaccgccagctgctgaacgagaagaccgtgggccagatccagctcgagcggttaaacgagttcggcaaggtccggggccaggtggaggagaacgagaacgtgaccctgttaaacgtcttcccgagcgccgcgtacgtgaaggaggccacgcagatcctgaccaagcagagagagttctaccccgagatcaccgacgacttcatcgccaagttcatgctgttcatcacccgcaagcgggactacttcgtggggcccggcaacgagaagtcccgcactgactacggcatctacaagaaggacgggcggacccttgacaacctgttcgacgagctgatcggcatcgataagatcaacggggagaagcgcgccagcgcgtccagcctcaccgcccagatctacaacatgctgaacgacctgaacaacttaaccgtccccaacacggaggacggccggctgaccatccagaccaagaaggagatcctggaggccgccaagacaaccaacgggctgttcggcatagcccagatatgcaagatcatcggctgcaagaaggacgacatcaaggggttccgcatcgacaagtccgagaagaagatcatgcacaccctgagcggctaccgcaagttccggaaggagttagccgacgtgaacatcgaggccaacgacctcaacatcaacctggtgaacaagatcgccgacatcctgaccctcaacaccgagaaagccgagatccgcaagcagcttgacaagtccaacatggacatcagcaacgagatgaaggagatcgtcatcaacaagaacaaggagttcctggtggacgggcgggccacgtggcacagcttctcctacaagaccctcaacctgctgatcccggagctcctgaacacccccgaggagcagatgaccatcttaacgcgcctcggcctggtgaagcccaacaacaagaagtacgaggggctgaagaacatccccgcgcggagaatcacggaggagatctacaacccggtcgtggcccgggccacccgcgaggccgtcaacgtcttcaacgccatcaccaaaaaggtcgggcgggacaacatcaaggacgtcatcatcgagctcccccgcgaggacaacgaggtggacataaagaagggaatcgtgaagcggcagaagcagaacgaggtcgagaaggagacggcagacgccttagtgaagcagcacatgaccatcagcgactccgccctgatcgcccagtaccgcaagatccgggggctcagccagaaggtgcgctactggtaccagcaggacaccatctgcccctactgcggcaaaaagatcgaagccgtccaactgatcaacaacaacgactccttcgaggtggaccacatcgtgcccatcagcgtctccttcgacgacagccagaacaacaaggtgctggtgcactcacagtgcaaccaggccaaggagaagcagaccccgctggggtggctcaacaacggcgggggcttcggccagagcaaggccgactacatcgcccgggtcaagtccaacaagaactacgccaagaacaagatcgacaacctgctgaacgagacggacctcaacgacatcgcgacccagcgcgggttcatccagcggaacctgaacgacacccgctacgccagccggatcgtgctgaacgagttctactcattcttccgcagcaacaacctctccaccaaagtgaaggttgtgcgtggcaagtggaccagccagatgcggaagaagtggaacggggtgggcggcctgtccaaaacgcgcgatacctaccaccaccacgccatcgacgcctgcatcatcgcctgcttccccctgctaaaggcgttcgacaaggccattaagctgatcgacgtcgacggggagaccggcgagattctgcaggacaaaaaggccatcaagctcgcccaggaggccgagatcgtggagaaaataagcgtgatcaagaacaagaagttcgagaacatggtcaacgagatctacaacttccccctgttcaagcaggtcgagctggcgaacgacatcaccaacctcgagaaccccgtgaagttctcccaccacgtggacaagaaggccaaccgggccgtggccaaccagacgatctacggaacccgcatcaaggagaaggaggtgaccaagcggggcaagaaggagaagatccaggagcgctacaccctggggacgatcaagaacatctacgacatcgacggcttcatgaacttcaagaagctgtacgacaagatcagcaaaaacgacgacgtcaagtttctcatgcagaagaacgacccgaagacctgggagaagctgatcgacatcttcaacagctaccccgactccgaggaggtgacccaggtggacggcaaggtcaagcgggtggccgtgagccccttcaagttatactaccgcgagaacgggttcatcaccaagtactccaagcacaacgacggccccaaggtcgtgagcatcaagtactatgactccaaggtggggagccacatcgacatcacgccgaaggacgcgcggaacaaggtcatcctccagtccctgaagccctggcgcaccgacgtgtacttcaacagcatcacccagcagtacgagctgctcggcctgaagtactccgacctgaagttcaccaacggggtgtacggcatcacgcgggacgcctacgagaaactcaagcacggcgtcagcgaggacggggtgaccgcctggaagcccatctccaagaacagcgagttccgcttctccctgtaccggaacgaccgcgtgcgggtcatcgacgagaagggcgacagcatcgagctcctcttcgcctcccgcaccactagcaacgaagggtacgtggagctgaagcccatctacaaggcgaagttcgactcaaaggaggaggtgggcttttacgggctggtcagcaacggccggctcatcaagaagatgagcaagggcgggtacaagctgtacaaggtaaacacggacatcctaggcaagccgtactacgtgacgcgcgagtccgacgagcccaagctcagcctgtga

SEQ ID NO: 7505 - RNA, 3516 nt, synthetic construct
  misc_feature 1..3516: note = Cas9 variant
  source 1..3516: mol_type = other RNA
atggctaagtacagcgtgggcctggacatcgggatctctagcgtcggctgggccatcatcgacatagagaccaagcagatcgtgaacctcgggtcccgcattttccctagcggcaacgcggccgggaaccaagagcggcgcggcttccggggcattcgccggctgatccgccggcgcaagaaccggctgaccgacctcaagaagctgttgggggagacgttcttctccgaccttaagaaaattgacagcaacggctacgagtactacgacatcgacttccagatcaacgccaacccgtacgagctgcgcgtgaagggcatcactgaaaaactttccaagaaggagctcgccgtcgtgctgcaccacatcatcaagcaccggggaatcagctacgacctgggggacctcgaggacgacggcacctccggcgtgagcgactacaagaactccatcaacatcaatcgccaattactgcgggagaagaccgtcgggcagattcagctcgagcggcttatcgagttcaaccaagtgcacggccaggttaagaaggccgaggacgtcagcttactcaacgtgttcccgtccagcgcgtaccgggacgaggccaacaagatcatgatcaagcagcaggagttctactccgagatcacgaacagcttcatggagcaggtcgaccagctggtgtcccgtaagcgggactacttcatcgggcccggcaacgagaagtcccgcaccgactacggcatctacaagagcgacgggcggaccctggacaacctcttcgccgagctgatcggcaccgacaagatcaacggggagaagcgcgccagcgctagctccctgacggcccaggtatacaacctcttgaacgacctgaacaacctccacgtgagcaacaccgaagacggcaagctgaccacctcaacgaagaaggagatcatcaaggccgccaagaccaccgacggggtattcggcatcagccagatctgcaagatcatcggctgcaagaaggaggagatcaccgggttccggcaggacaagtccgagaagaaggtgatccacacgctggccggctaccggaagatccgcaaggcgctcgccaccatcaacatcgaagccaacgagctgaaccccaccgttttcgaccagatagccgacatcctgactctcaacacggagaaggccgagatccggaagcagttagacaaggtgcagctggacatcaccgacgaaatgaaggagttagtgatcgacaagaacaaggactttctggtggacgggcgcgcgacctggcacagcttctcataccagacgctgaacatgctcatcccggagcttctgaacacgagcgaggagcagatgaccatcctcacccggatgggccttatgaagtctgacaacgagaagtacagagggctgaagaagatccctgccgagaagatagccagcgagatcttcaaccccgtcgtggccaagtccacccgggaggccatcaaggtgttcaacgcgatcagcaaggagatcggcaagaacaacatcgagcacgtagtgatcgagctccctcgcgatgataacgaagaggatgagaagcggaagatccagaagctgcagaaggccaacgagacggaaaaggaggccgccgacaacctggtcaagcacaaattaggcatctccgacagcgccctgatcgcgcactaccgcaagttcaaggggctgtcccagaaggtgcggtattggtaccagcaggagacctactgcccgtactgcgggaagatcatcgaggccactcagctgatcaacaacaacgacaactttgaagtggatcacatcatccccataagcgtctcctatgacgacagccagaacaacaaggtgctcgtccactcccagtgcaaccaggccaaggagaagcagacgcccctggggtggatcaacaacggcgggggcttcggccagagcaagaacgagtacaccaaccgtgtcaagaacaacaagaagtacagcaagaacaaggtggacaacctgctaaacgaaaccgacctgaccgacatcatcactcagcggtccttcatccagcgcaacctgaacgacacgcggtacgccgcgcgcaccgtgctcgacgagttctacagcttcttcaagtccaacgacctgcccaccaaggtcaaggtggttcggggaaagtggaccagccagatgcgccggaagtggaacaacgtcggtgggctccgcaagacccgggatacgcaccaccaccacgccatcgacgcctccatcatcgccagcttcccgctcctgcgcgccttcgaccgcgcgatcaagctgatcgacgtggacaaggagacaggcgagattgtgcagtacggcaaggcctccctcaacggggacgtcatcgaggagaagtccgtgatccaggcccccatcatcaagaacgagaagttcgagaagctggtggatgagatctacaacttccccctgttcaagcaggtagagctcgccaacaacatcgagaatccagagaacccggtgaagttcagccaccacgtggacaagaaagccaaccggaccgtcgcgaaccagaccatctacagcacgcgcatcaagaagaccgagaagatcgtgcggaaaaaggtgaccgccaaagaagaggaatacgtcatcggcacgatcaaggacatctacgacgtgacaaacttcgagaaattcaagaagctgtacgacgaatccagcaagaaggacgacatcaagttcctgatgcagaagaacgaccctaagacctgggagaagctcgttgagatcatgaacacctaccccgattacgaggagatctcccagctggacgggaaggtcaaacgagtgaaggtaagccccttcaagctgtacttccgggagaacggcttcatcaccaagtacgccaagcacaacaacgggccgaaggtcgtgtcaatcaagtactacgacagcaaactcggcaatcatatcgacatcacgcccgtaaacgccaacaacaaggtaattctgcagtccctgaagccctggcgcaccgacgtgtattacaacaacgagacccagcagtacgagctcctgggcctgaaatacagcgacctcaagttcaccaagggagtgtacggcatcacgcgggaggcctacgaaaagctgaaatacgggtacaccgacggcgtccccgcgtggaaacccatctctaaggagtccgagttcaagttcagcctgtaccgcaacgaccgggtgcgcatcatcaacgaggccggggagaagatcgacctcctgtttggctcccggaacgagaccagcgagggctacgtagagatgaagcccatcttcaagacgaacttcgacgacgccgaggaggcctctttctacgggaagacgagcaataagcgcctgatcaagaaaatggcccggaagggctaccagatctacaaggtcaacaccgacatcctagggaacctgtactacacggccaaggagtccaacgaacccaagctggacctgtga

SEQ ID NO: 7506 - RNA, 3519 nt, synthetic construct
  misc_feature 1..3519: note = Cas9 variant
  source 1..3519: mol_type = other RNA
atgcgcaagccctacagcatcggcctcgacatcgggaccaactccgtggggtgggccgtcatcaccgacgactacaaggtcccgagcaagaagatgcggatccaagggacgaccgaccgcacttccatcaagaagaacctcataggcgccctgctgttcgacaacggggagaccgcggaggccacgcggctgaagcgcaccacccggcgtcggtacacccgccggaagtaccgcatcaaagagctgcagaagatcttcagctccgagatgaacgagctggacatcgccttcttcccccggctcagcgagtccttcctggtgagcgacgacaaggagttcgagaaccaccccatcttcggcaatctgaaggacgaaatcacgtaccacaacgactaccccaccatctaccacctccgccagaccttggccgactccgaccagaaggctgacctgcggctcatctacctggcgctggcccacatcatcaagttccgcggccacttcctcattgaggggaacctcgacagcgagaacaccgacgtccacgtgctgttcctcaacctggtgaacatctacaacaacctgttcgaggaggacatcgtcgagacggcctccatcgacgccgagaagatcctcaccagcaagacatccaagagccggcgccttgagaacctgatcgcggagatcccgaaccagaagcgaaacatgctgttcgggaacttagtgtccctggccctcgggctgacccccaacttcaagacgaacttcgagctgctcgaggacgccaagctgcagatcagcaaggactcctatgaggaggacctggacaacctcctggcccagatcggcgaccagtacgctgacctgttcatcgcggccaaaaagctcagcgacgctatcctgctgtccgacatcatcaccgtgaagggcgccagcaccaaggcgcccctcagcgcctccatggtccagcgctacgaggagcaccagcaagacctggccctgctcaagaacctggtgaagaagcagatccccgagaagtacaaggagatcttcgacaacaaggagaagaacggctatgccggctacatcgatgggaagaccagccaggaggagttctacaagtatatcaagccgatcctgctcaaactcgacggcacggagaagctgatctccaagctcgagcgggaggatttcctgcgcaagcagaggaccttcgacaacgggagcatcccccaccagatccacctgaacgagttaaaggccattatccgccgccaggagaagttctaccccttcctcaaggagaaccagaagaagatcgagaagctgttcaccttcaagatcccctactacgtgggcccgctggccaatggccagtccagcttcgcgtggctcaagcggcagtccaacgagtcaatcaccccctggaacttcgaggaggtcgtcgaccaggaggcctccgcccgcgccttcatcgagcggatgacgaacttcgacacctacctgcccgaggagaaggtgttacccaagcacagtccgctctacgagatgttcatggtctacaacgagctgaccaaggtgaagtaccagaccgaggggatgaagcgccccgtgttcctgtctagcgaggacaaggaggagatcgtcaacctcctgttcaagaaggagcggaaggtcacggtgaagcagctgaaggaggaatacttctccaagatgaaatgcttccacactgtcaccatcctcggcgtggaggaccgcttcaacgccagcctggggacctaccacgacctgctcaaaatcttcaaggacaaggcgttcctggacgacgaggcgaaccaggacatcctggaggagatcgtgtggacgctcaccctgttcgaggaccaggccatgatcgagcgacgcctggtcaagtacgccgacgtgttcgagaagtccgtcctcaagaagctcaagaagcggcactacaccggctgggggcgcctgagccagaagctcatcaacggcatcaaggacaagcagaccggcaagacgatcctggggttcctgaaggacgacggggtggcgaaccggaacttcatgcagctcatcaacgactccagcctggacttcgccaagatcatcaagaacgagcaggagaagaccatcaagaacgagtccctggaggagaccatcgccaacctcgccgggagccccgccatcaagaagggcatcctgcagagcatcaagatcgtcgacgagatcgttaagatcatgggtcagaaccccgacaacatcgttatcgagatggcgcgcgagaaccagtccaccatgcagggcatcaagaacagccggcagcgcctgcggaagctcgaggaggtacacaagaacaccggttccaagatcctgaaggagtacaacgtcagcaacacacagctgcagtccgaccgcctctacctgtacctgctccaggacgggaaagacatgtacaccggcaaggagctggactacgacaacctgagccagtacgacatcgaccacatcattccgcagtccttcatcaaggacaacagcatcgacaacaccgtgctcaccacgcaggcctccaaccggggcaagagcgacaacgtgcccaacatcgagaccgtcaacaagatgaagtccttctggtacaagcagctcaagagcggggccatctcccagcgcaagttcgaccacctgaccaaggccgagcgaggggccctcagcgacttcgacaaggcgggcttcatcaagcgccagctggtggagacccgccagatcaccaagcacgtggctcagatcctggactcccggttcaactcgaacctcaccgaggattccaagagcaaccgcaatgtcaagatcatcaccctcaagagcaagatggtgtccgacttccggaaggacttcggcttctacaagctgcgcgaggtgaacgactaccaccacgcccaggacgcctacctgaacgccgtcgtggggaccgcgctgctgaagaagtaccccaagctcgaggccgagttcgtgtacggagactacaagcactacgacctggccaagctgatgatccagcctgacagctccctcgggaaggccacgacccggatgtttttctacagcaacctgatgaacttcttcaagaaggagatcaagctggcggacgacaccatcttcacccgcccgcagatcgaggtcaacacggaaaccggcgagatcgtgtgggacaaggtgaaggacatgcagaccatccggaaggtcatgtcctacccccaggtgaacatcgtgatgaagaccgaggtccagacgggcgggttcagcaaggagtccatctggcccaagggtgacagcgacaagctcatcgcccgcaagaagtcctgggaccccaagaagtacgggggcttcgactcaccgatcatcgcctacagcgtgcttgtggtcgccaagaactgcaagcggaagaacagcaagaccaagaactaccagcggacctgcgggaacaagaacaacggcactcggtga

SEQ ID NO: 7507 - RNA, 3522 nt, synthetic construct
  misc_feature 1..3522: note = Cas9 variant
  source 1..3522: mol_type = other RNA
atgaggccaatcgaaccttggatactaggactagatattggaacagattcgttgggctgggcagtgttctcttgcgaagagaagggcccaccaaccgcaaaagaattactcggaggaggagtcagactattcgacagcggtagagatgcgaaagaccacacatcacggcaggccgaacgtggagcattccgacgagcacgcaggcaaacccgcacctggccatggcgaagagaccgactgatagcactgtttcaagcagcaggcctaacgccccctgcagccgaaaccagacaaatagcgctcgccctacgacgagaagcagttagtcgcccacttgccccagacgccctctgggcagccctactccacctggcgcaccaccgaggattccgctcaaaccgaatcgacaaaagagaacgagcagcagccaaagcactcgccaaagcaaaacctgcgaaagcgaccgccaaagcaacagcaccagcaaaagaagcagacgacgaagcagggttctgggaaggggccgaagcagcgctcaggcaacgcatggcagcctcaggagcgccaactgtcggagccctactcgcagacgacctagaccgcggccagcccgtccgaatgcgctataaccaatcggaccgcgatggagtagtggcccccaccagggcgctaatcgcagaagaactcgcggaaatagtcgcaagacaatcctcagcttatccaggcctggattggccggcagtaacccgactcgtcctagaccaaagacccctccgatccaagggcgccggcccgtgcgccttcttgccgggagaagacagagcactcagagcacttccaactgtccaagacttcataatccgccaaacgctggcaaacctgcgactaccctccacctcagccgatgaaccccgacccctaacggacgaagaacacgcgaaagccctagccctactctcaacagcacgcttcgtagaatggccagcactacgacgagccctaggcctcaaaagaggcgtaaaattcaccgcagaaacagaaagaaacggggcaaagcaagcagcacgcggcacagcagggaacctaacggaagcaatattagccccactcatcccggggtggtccggatgggacctagaccgcaaagatcgggtattcagtgacctatgggccgcgcgccaagatcgaagcgcactgttagcattaatcggagacccacgaggcccaacaagggtcacagaagacgaaacggccgaagccgtcgcagacgcaatccaaatcgtactacccaccggccgagccagcctatccgccaaagcagcccgggccatagcccaagcaatggcccccggaataggatacgacgaagccgtcaccctcgccctagggctccaccactcacatagaccgcggcaagagcgcctagcacggctaccatactacgctgcagcactccccgatgtaggcctcgacggggatccagtaggacctccacccgcagaagacgatggcgcagccgccgaagcatattacggccgcattggcaacatcagcgtccacattgcccttaacgaaacaagaaaaatagtcaacgcgctactgcaccggcatggcccaatactaaggctagtcatggtagaaacgacccgcgaactgaaagcaggagcagacgaacggaaacggatgatagcagaacaagccgagcgcgaacgtgaaaatgcagaaatagacgtcgaactccgaaagagtgaccgttggatggccaacgcaagagaacgaaggcaacgcgtaagactcgcacgcagacagaacaatttatgcccatacacgagcacacctatcggacacgccgatctactaggcgatgcatacgacatagaccacgtcatacccctcgccagaggaggacgcgactcactggacaatatggtgctatgccaaagcgacgcaaataaaactaaaggcgacaaaacgccctgggaggcattccacgacaagccaggctggatcgcacaacgcgacgatttcctcgcacgcctagacccccaaacagccaaggcccttgcatggcgctttgccgacgatgcaggagagagagtggcaagaaagagcgcagaagacgaagatcagggctttctaccacgacaactaacggatacaggatacatagcaagagtcgctctccgatacctgagtctagtaacaaacgaaccaaacgcagtcgtagccacgaatggcagactaaccggtctcctccgattagcctgggacataacgccgggaccagcgccccgggacctcctacctacgccacgcgacgcattaagagacgatacagctgcgcgacggttcctcgacggacttacaccgccacccctggctaaagcagtcgagggcgccgtccaggcacgactagccgccctagggagaagtcgggtagcagacgccggactagcggacgcactaggcctaacgctagcaagcctcggcggcggcggcaaaaatcgagccgaccatcgacaccacttcatcgacgccgccatgatagccgtaaccactagaggactcataaatcaaataaatcaagcgtccggcgccggacggatcctagacctaaggaagtggccccgcacaaatttcgaacccccatacccaacgttcagagcagaagtcatgaaacaatgggaccatatacacccaagtattcgaccagcacaccgcgacggaggatccctacacgcagccaccgtcttcggcgttaggaacagaccagacgcacgagtactcgtccaaagaaaaccagttgaaaaactgttcttagacgcaaatgcaaagccactcccggccgacaaaattgccgaaatcatagacggattcgcatccccgagaatggcaaaacgattcaaagccctcctagccagataccaagccgcacatccagaagtacctccagcactggcagccttagcggtcgctcgtgacccagccttcggacccagaggcatgacagcaaacacagtaatagccgggagatcagacggagacggcgaagacgccggactaataacgcccttcagagcaaaccccaaagcagcagtacgtaccatgggaaacgcagtatacgaagtatgggaaatacaggtcaaaggccgaccccgctggacccacagagtactcacacgcttcgacagaacacagccagcaccccctccgccacccgagaacgccaggctagtaatgcgactccgacgaggagacctagtgtactggcccctagagtccggcgaccgcctattcttagtaaagaaaatggcggtggacggacgcctcgcactgtggcccgcccggctcgctaccggcaaagcaaccgccttatacgcccaactatcatgccctaacatcaacctaaacggagaccaaggctattgcgtgcagagcgccgagggaatacgcaaagaaaagattcgaaccactagctgcaccgcactaggaagactacgcctgtctaagaaagcaacatga

SEQ ID NO: 7508 - RNA, 3525 nt, synthetic construct; identical to SEQ ID NO: 1708
  misc_feature 1..3525: note = Cas9 variant
  source 1..3525: mol_type = other RNA

SEQ ID NO: 7509 - RNA, 3528 nt, synthetic construct
  misc_feature 1..3528: note = Cas9 variant
  source 1..3528: mol_type = other RNA
atggaggagatgaagcagaccggccgcaagaacgaggcccccaagctgaccgacctcaactaccggatcggactggacatcggcatcgcctcagtggggtgggccgtcctggagaacaactcccacgacgagccgttccgcatcatcgacttaggcgtacggatattcgacacggccgagcagcccaagaccggggccagcctagccctgccccgccgggaggcccgctccgcgaggcgccggatacgccgacgccgggaccgcatcgagcggataaagaagctgttccaggccgagggccttatcaacatcgacgagttcgaggcccgctacaagatcgctggccttagcgacgtgtacaagctccggtacgaggggctggaccgcaagctgaccgacgacgagctggcgcaggtcctgctgcacatcgccaagcaccgcggcttcaagtccaccagcaaggccgaggaggccgagaacgagaacgacgccgcgaagaagaaggaggccggggccctcaagaaaggtatcagtaacaacaagaagctaatggaggagaaggggtaccgcacggtgggcgaaatgatgtacctggacgagaacttccggaccgactgcccctggaacgagaacggctacatcctcaccccgcgcaacaagagcggggattacaaacacaccgtgctgcgcgacatgctggtcgacgaggtgagggagatcttcaagtcccagcgcagcctcggcaacatccacgcctcagaggagctggagaacgcctacctggacatcatgctgtcccagcggtccttcgacatggggcccggggcgcccagcaagtacgccatggaaggcttcgaagatcgcgtggggctgtgcacgttcgagggcaagaatggggagaagcgtgccgccaaggccgcgtacacctccgagctgttcgtggccctcgagaagatcaaccacaccaaaatcgtcagcgacgacggcgccacccgcttccttacgacctatgagcggaagtccatcatcgagctgatgcacaagcagcagaccgtgaagtacgccgccgtccgcaaggcgatcgggctcgccgaggaggacaagttttacaacctgaattacagccccaaggccggctccaagaagtccccggaggacacggacttcgtgaagctggagaactaccacaaaatccggaaagctctcggcgaggacatcgtgagcgagcacctccccgcggagaagatcaaactgtacgacagcatcgctacgatccttaccctgttcaagaatgacgactcacgcatcaagcggttcatcgagctgggtatcggagaggagtgcttcgacgggttactgtccctgagcccatccaaatttcataacctctcgttagtcgccatgggcaaaattatccccttcctgctcgacgggaacacctacgacaaggcctgcgagctggccggctacgactttaaagctgacaacaagggcgagaagtccgtgctgctcaaggggaagaacatcaccgacatggtaaacgacatcacgaacccggtcgtccgacggagcgtgtcccagaccatcaaggtcatcaatgccatcatactggagtacggcagcccccaggccgtgaacatcgagttagcccgcgagatgtccaagaacttcgacgagcgccgcaagctcaagagcgacatggagtcccgggagaaggaaaacaacaacgtgatcaagcgcgtcaaggagtacaaacttaaccccaccgggcaggacatagtgaagttccggctgtgggaggagcaggaccgccgctgcctgtacagcggcgaaaagatcgacatcaatgacctcttctcccgggatggcgggtacgacgtcgaccacatcctgccctacagcatcacctttgacgacacgtaccgaaacaaggtgctggtcaaggcatccgagaaccggcagaagggcaaccgcaccccctacgagtacttcatggcagagaaagacgacgacgaatggaacgtctatgagaccctcgtgcggaacaccgttaaggactacaagaaggtcctgaagctactcaagaagcacatcacggaggacgagaagtccgagtttcgcgagcggaacctaaccgacactaagtacattactcgcatcatctacaacatgatccggcaaaacctggtgctcaagccctacctgagcctggagaaggagcgcaagaaacaggtgatggccgtgaacgggagtatcacgcactacctcagcaagaggtgggggttggagtccaaggatcgccggaccgacacccaccacgcccaggacgccgtcgtgatcgcctgcaccacggatgggatgatcaacaagattagcaggtactccaaggggcgggagctgctatacagccgcggcttcaagttcgttgacgaggaaaccggtgagatcctgtcccgggacaacttcacacgcgaggagtgggacgagaagtatggcgtgaaaatccccatcccctgggagcacttccgggacgagctggacatccgcatgagccggtacaacgggaccggcgacgacagtatcgacaagaccacgccgcgcgacttcatcctcagccaccgagatgcgcacaagtggatcaactaccccgagtggatgttcgtggaggggcggcccggccgccggggcgtcctggacggcatcttcgtgtcccgcatgcccaagcacaaagtgagcggccaggcccacgaggagaccgtccggtccgccaagtactacaacgacgggggcagcgtgttcgagtccgggggctacgtggtcaccaagaagtcgatccaggacatcaagttaaaggacggcgagatcaaggagttcttcaacccggacagcgaccgcctcctgtacaacgccctggtggaccggctcaacaagttcgagaacgaccccaagaaggcgttcgctgagcccttctataagcccaaggccgacgggacccagggccccatcgtgaaaaagatcaaggttttcgagaagcagagctccggggtcttcgtgcgcgacggcaaggggatcgccgccaacggcgcgatggtccggatcgacgtgttctgcgaggaggacaagggcaagaagaagtactacttcgttcctatctacacggcagacgtcgtgaagaagaagctgcccgaccgcgccgccaccgccaacaagctgatcagcgagtggcgagtgatgaaggaggagaacttcatcttcagcttgtactcccgcgacctgatctacatcgaaagcgacaagggggtccaggtaaaggacatcgacggcaagatctccaagccggtgaacctcttcgcgtactacctcggggccgataccagcaccgcctccatctctggcaagctccacgactccagcgccaacttccggagtatcgggatccagggcctgcgccggttcgacaagtgtcaggtcgacgtgctcggcaacatcagcttcgtgaacaaggagaagcgcatgcccttcaactga

SEQ ID NO: 7510 - RNA, 3531 nt, synthetic construct
  misc_feature 1..3531: note = Cas9 variant
  source 1..3531: mol_type = other RNA
atgaacaaggtccaggaggactgctacaagaagatcaaggagaagctggccgaccgcgagtaccggatcggcctcgacctgggggtcggcagcatagggtacgcggtggtgtccctgaagggcgacatgcccgaggacgtgatcctcgcggggagccgcatcttcaagtccagcatcggcgccgccgagcggcgccacttccgggcccagcggaacacccaccggcaccaccgcgagcggatgcgctacctatggaagctgctcgccgagaagaacctggcgttgcagctcccggagaacctgtccaagaaggagaacttcaccgacttcgacaccagccgcaagcgcttccccatcgaggtgctgcggaacgacccctacatcctccgctacaaggccctggacgagaagctgtccctcttccagctgggctacgccctgtaccacatcgctaaccaccgggggaccgcgagcgtgcggtccttcctcgaggacgacgaagccaaggtgaaggagaacaaggagaccgccaagctagccaaaaacaccaagaagataatgtacgagaagaagtaccggacgttcggcgaatacctgtaccgcgaacggatcgagaagttcagacagaacgaacgaatgaaggtgaccaataaaaacgagaacaaggagttcgctgtgacccgcgacatcatcgaaaaggaggtcgagatgatcctcggggcgcagaaacgctacaataccgccgtgctggccgacgactacatagagcgtatcaagaaagccatcttctacgagacggagaagctgatccccgagccggagtactgcccctacttcaaggacgacaagcgcctcccccggagccacaagctcaacgagtaccgccgcatctacgaggccctgaacaacacccgctactacatccccgagatcgaggagaagaccggcgagatcctctcccggaaggagaaagagcagttaagcaaggaggagaaggagaagctgttcaacttccttctgaagaacaaggaactgaccgaggcgaaggtgaagaaactcctgaacctgtccgaaatggccaaggtccagttgcaggggagagacaaaaagaaccagaagatcaagggctacgctctgatcacgctcgagagcctcccgttctggtcaaagctgcccgaacaacagcaggacgagttcctgtacgactggaacaagctccccgatgagaagctgaaggaccgcctgcgcaactactacaagctcaccgatgacgagatcgacgagaccttccagaacatcgtgctgcccagcaactacgccccgctgggcaagaaggccatggagatcctcctggagtacataaagaacgggctgagctacatcgaggcgctggacaaggccgccgacgagaacaagataaaagtggagaagcacgagatcaacgatctcctgccctactacggcaagatcctgcaggagagcacccagatgcctatcgggaaagccttctccaagcagttcgccgcgaagaactacaagaagccggacatcaataagaacgagcaggagttcggccggatcgccaacccggtcgtgcaccagacgttgaacgagttgcgcaagctgatcaacgaaatcatcacggtgttcggcaagaagcccctcgagatcagcctcgagaccagccgggagctgaagaagtcccagaaggagcgcgagctcatcgccaagcagcaggacatcgacgaggagaagaggaagaagatctggaagacctacatcgagccacacctccagcagatcaagagccgctccgacaagctgaagaagctgtttgtcttcgagttgtgggaggaccagaagcacaactgccccttttgcctggagaagatcaacgttgacgacatctacagccgcggggtggacaaggagcacctcttcccgctgaagaagtccgaagacgacagcgagaacaacctggtcatcgctcacaacaagtgcaacgcgaggaaggcagagcgggcccccttcgacgccttcggacacgagtccatctggaacgacatattcagcaacgccgagaagaacctcccccgcaagttatggaggtttcggcaggggtccttcgagaagttcctagagaaacccccgatgctcaagcgcttcgaaacggacaacagctacatctccaagattagcgcgcggtatctggcctgcctgttcgacaagcccagtaagatcttctgcgtgaagcccttcctcaccgcccagctgcgcatcgcctggcagctggacgaaatcatgatccgcctggccgagaacatcattttggacagtgaaaaagactcctttaacaagggcgggctgcagaagaagaagcgcatcgacaaccggcaccacgcgctcgacgccgtggtcatcgcttacgcatcgcgcggctaccacaacttcctgaaccgggtgcacgccaagggctacaagatcaactacgacgagaagacctggctgtccgagaccctccggccaccgggaaacaagaacctggaggacttcaagagcggaatcatcaacgtcatgatcaacgcgaacatctccatcaagcacgaccacaacaacaaggggcagctggtcaagagcaaggcctataagctctactacagcgaaatcggcaaatacatcatcacgaccctgaagtccgtgagcgagatcctgttcaagcagaaggaaaaaccccaggacaccctccggcgcgccctgtgcaagttcgaggatcgtctgtccgatatcaaggacaagaaactccgcaagaagctggaggacaacatcaccatctacaagagcatcgagaacgagtccgccctgagcaaggcgaagcaggagctcgaggagttcgacctgaaggcaaagaaggaggggaagaagggctacgagaagatcacggacatcctgatctacaagaaggcctgctccatgcacggcgggaagtacatacacgtgaagaaccggatcgaaaacaaatttttcgccctcaaggaacccaccgagatcgaaaccggcttcgggtatgacacggccgacaacttatccctggacctctaccacgataacaacggcaagctgtgcggggaggtgatccggaagatcgactttaacagaaaccgcgtgccgaactacaagaaggagggctacatactcctcgagcggatctaccagggcgacacactggaggtcgacatctccgatgacaagatctcacttaagaataaggtggggtccgcccccgacaagcggaccttcgtgaaggtcctcaccttcaccgagagcgaccggtatctgaagaacaagcgcgaccagatccagatcttcttctgcaacctgctcaagtccacgctgaagcacgacgacagctccaagcacgacgacagcttctacgtgtccagcatgcagaagtacaatgtgcgcaaagtcatcctgaccagcctcggcatcatcaagtaccgctcgaagatcctgaagaacaaggagatctga

SEQ ID NO: 7511 - RNA, 3531 nt, synthetic construct; identical to SEQ ID NO: 1711
  misc_feature 1..3531: note = Cas9 variant
  source 1..3531: mol_type = other RNA

SEQ ID NO: 7512 - RNA, 3534 nt, synthetic construct; identical to SEQ ID NO: 1712
  misc_feature 1..3534: note = Cas9 variant
  source 1..3534: mol_type = other RNA

SEQ ID NO: 7513 - RNA, 3540 nt, synthetic construct
  misc_feature 1..3540: note = Cas9 variant
  source 1..3540: mol_type = other RNA
atgtcaaagaaagttagcagacgctacgaagaacaagcccaggaaatctgccagagacttggcagccgaccctactcgataggactcgacctgggcgtaggcagtataggtgtcgcagtcgcagcctacgaccccattaagaaacaaccctccgacctagtcttcgtatcaagtcgaatctttatcccctccaccggcgccgccgagcgacgccagaaaaggggccaaaggaactctctcagacaccgagcaaaccggctcaaattcctgtggaaactgctagcagaacgaaacctcatgttatcgtattccgaacaagacgtcccggacccggcacgcctccgcttcgaagatgcagtcgttagagccaacccatacgagctaagactgaaaggcctcaacgaacaactcacactgagtgaactcggttacgcactgtaccacatagcaaaccacagaggctccagcagtgtccgaacatttttagatgaagagaaaagctcagacgacaagaaactagaagaacaacaagccatgaccgaacaactagccaaagaaaaaggaatctcaacattcatcgaagtcctcacggcgttcaacacaaacggactgataggataccgcaacagtgagagcgtcaaaagcaaaggtgtaccggtcccaacccgggacatcatatccaacgagatagacgtactgttacaaacccaaaagcaattttaccaagagatactgagtgacgagtactgcgatcgaatagtatccgcaatcctattcgaaaacgagaaaatcgtccctgaagcaggatgctgcccctacttcccggacgaaaagaaactcccccgctgtcatttcctgaacgaagaacgcaggctctgggaagccatcaacaacgcgcggattaaaatgccaatgcaagaaggagcagcaaaacgataccagagcgcgagcttctccgacgaacaacgccacatcctattccacatcgcacgtagcgggacagacataacgccgaagctagtacagaaagaatttcccgcactaaaaacatccataatcgtattgcaaggcaaagaaaaagccatccagaaaatcgcagggttccgattccgacggctagaagaaaagagcttctggaaaagactaagcgaggaacaaaaagacgacttcttctcagcgtggaccaacacgcccgatgacaaacgcctctccaaatacctaatgaaacatctcctcctaacagagaacgaagtggtcgatgccctaaaaacagtttcactaatcggagactacggacccatcggcaagaccgcaacgcaactgctaatgaaacatctagaagacgggctaacctacactgaagccctggaacgaggtatggaaaccggagagttccaagaactgtcagtctgggaacagcaatcccttctgccatactatggacagatactcacaggctcaactcaggccctaatggggaagtactggcacagcgccttcaaagaaaagcgggatagcgagggcttctttaaaccaaacaccaacagcgatgaagaaaaatacggcagaatcgccaacccggtagtgcaccagacgctaaacgaactccggaaactgatgaacgaactgataacaatcctcggagcgaaaccacaagaaataaccgtcgaactcgcccgagaactaaaagttggcgccgagaaacgcgaagacatcataaaacaacaaacgaaacaggaaaaagaggcggtactggcctatagcaagtactgtgaaccaaacaacctggacaaaagatacatcgagagattcaggctcctcgaagaccaagcattcgtatgtccctattgcctagaacacatctccgttgcagacatagcagccggccgggcagacgtggatcatatattcccccgcgacgacaccgctgacaactcatacgggaacaaggtggttgcacaccgacaatgcaatgacataaaaggaaagcgcacgccgtacgccgccttctccaatacatcggcctggggcccaatcatgcactacctggacgaaaccccgggaatgtggaggaaaaggcgcaaattcgagacgaacgaagaggaatatgcaaaatacctccaatctaaaggattcgtgtctcgcttcgaaagcgacaactcctacatagcaaaggccgcgaaggaatacctcaggtgcctattcaacccaaataacgtcaccgcagtcggatcgctcaaaggtatggaaacctcaatactacggaaagcctggaaccttcagggaatcgacgatctgctcggctcccgacactggagcaaagacgccgacacatcaccaacaatgcgtaaaaaccgcgatgacaaccgacaccacggactcgacgctatagtagcactatactgcagccggtccctagtccaaatgatcaacacaatgagcgagcagggtaaacgcgcagtagaaatagaagccatgatcccaatcccaggatacgccagtgaacccaacctatccttcgaagcacaaagagaacttttccgaaagaaaatccttgagttcatggacctacacgcattcgtgagcatgaaaacggacaacgacgcgaacggggcactactcaaagacacagtatactccatccttggtgcagacacccagggagaagacctggtcttcgtcgtgaaaaagaaaatcaaagacataggagtcaaaataggcgactacgaggaagtggccagcgcaatccggggccgaatcaccgacaaacaacccaaatggtaccccatggaaatgaaggacaaaatcgaacagctacaatcgaaaaacgaagccgctctccaaaaatacaaagaatcgctcgtccaagccgcggcagtactcgaagagagcaaccgcaaactcatagaatcggggaaaaagccgatacaactcagcgagaaaacaatcagcaagaaagcgctcgagctagtcggcggttactattacctaatatcaaacaacaagcgtactaaaacatttgtggtcaaggaaccctcgaacgaggtgaaaggattcgcattcgacacaggatcgaacctatgcctggacttctaccacgacgcacagggaaagctctgcggagaaatcatccgaaaaatacaagctatgaatcccagctacaaacccgcatacatgaagcagggctattcgctgtacgtccgtctataccaaggcgacgtctgcgagctcagagcctcggacctgaccgaagcagaaagcaacctcgccaaaacaacgcacgtccgcctaccaaacgcaaaaccgggacggaccttcgttataataatcacgttcacagaaatgggctccggataccagatttacttcagcaacttggcgaaatccaagaaaggacaagacaccagcttcacactaacaacaatcaagaactacgatgtcagaaaagttcaactcagcagcgcaggactcgtccgatacgtctcaccactcctcgtcgacaaaatcgaaaaggatgaagttgcactctgtggggaatga

SEQ ID NO: 7514 - RNA, 3567 nt, synthetic construct
  misc_feature 1..3567: note = Cas9 variant
  source 1..3567: mol_type = other RNA
atgaagtacatactgggcctcgacatcggggtgagctccgtcggcatcgccgtgatcagcgaagagaaccagaagaagaccatcgagaacctggccgtgcgcatcgttcccgaggacccggacttccacgggaaattctactccggcaacaccgcgtcaaagaacctggagcggacggccaagcgcgggaatcggaagaataaccagcgcttcaaggcccggcgcgacaagctctaccagtccctgaaggagaacaacatgttccccaccagcaacctgttcgacctctccgccgtggagctgtacggcctgagagccaaggcggtgagcgagcaggtctccctccaagagctgggcaggatcctgatcctcctgaaccagcggcgcgggttcctgagcaaccggaagtccgtgagcgaggagaactccaccgagtacaaggagcgcatcgccggcctcgagaaggccctggggaacaagaccatcggccagaagctgtacagcgagctccaggagaacaacaacgttttcgaggtcctgctgcgggagcgcacgtaccagcggtccagctacaccgaggagttcgaccgcatctgggacgagcagaagaagtactacctcatcctgaccgggtccagcaacgaggatgacaacaagggcaccctgtacgacctcatccgaaaccgcatcatctactaccagcggcccctgaagtcccagaagggcctgatcagcgagtgcctcttcgagaagcaccacaaggccgtggccaagagctccccctacttcgagctgttcagaatctggcagaagatcaacgacctgtcgtggaagacgccgaacggggagctgttcaagcccaccgacgagcagaagcagaagctgaaaaacgcgctgtggaacggcgacaacctcaatccgaagcacaagctgaccgtgtccaagatcaaggagatcctggggtacaccagccgggagaagatctacctcaactttacggagctggatggctcccgcacctacagcatcctgcgcaacgccctcatcgaagccggcatcgagaagcccgagcagtacctgttcttcaacatggagaccaacgacgagaagggcgggctgttcgagctctggcacatcacctactccctgccgatcgagaaggaggtcatcaacgccctgaagaaccggttcgggttcgacaagaaacaggcggagatcatcgcccggcgggtgggctacagctccgactacgggagcctctccacgcgcgccatccggaagctgctggtgcacctcgagaagggcctgggctacaccgacgcctgcgacaacatcgggtacgaccacagcggctacaagaccaagatcgacctgcagcccaagttaaagcagctcaagcgcaacgagctgcgaaaccccgtcgtggagcagatcctgaaccaggtggtcaacgccgtgaacctcatcatcgagaagtacgggaagatagacgaaatccgcgtggagctggcgcgggagctgcgcaataacgccaagacccggaaaaacatctccctcctgaacagcaagaacaagaagaacaacgacatcatccgcaagaagctgcaggaggaatacggcttcaagttcgtcaacgggcgggacgtgacgcgctacatcctctgggaggagaactccaaggagtgcctgtactgcaacaagaccatcaacggcagcgacatgttgaccggcaacgccgacatcgagcacatcctccccaagtcccggagcttcaacaacgccatgaacaactacatcatcactcaccgcaagtgcaactccgacaaggggcagaagacggcctacgacttcatgagcagcaagggcgaggtgatcctgcagcagtacatcgagaaggtcaacgacctgtacaaggacgggaagggctccatcagcaagaccaagttcgagaatctcctgtgcaagggggaggacatcccgtccgacttcgtggagcggatgaagaaggacagccagtacatcgcgaaggaggccgtcaagatgttaaagactgtgtgccccaacgtgtacaccacgaccggccaggtcaccgacttcctccgtgaggagtggaagctgaagaacctgctccaggagctgaccttcgagaagtacaaggccatcggccaggtgaaggagaagatcataaagacgaataacggccagaccaagacattcaaggtgatcgccgactggtccaagcgggacgaccaccgccaccacgccatcgacgcgctgatctgcgccctcaccgaccaaaagatcatcttcaagctgaacaacctgaacaagatctaccagtacgagcgcaacgccctcagccagaaggagattgaggagattgaggagttcctggagggcaagttctccattaaggagttcagcgcccagcaggggaacatcatcgagtgctccatccccaacatccggaaggatgcgcagaagcacctggagaacatcctcatcagcttcaagaaggagaactccaaagtcctgacgatgaaccgcaaccagcccaagaactgcaaggagcagatcacctgggtgccgcgggcccgcctacacgaggacaccatcatgggccgggttaagcgcatccccgagaagaaaatgaagctcaacgacaaggtcagcttcgagcagatcaagatgatcgtgaaccccgagatcaaggagatcctgttataccggctcgccaaattcggcgacaaccccaaggtggccttcgccaccaaggcgctgaagaaggagccgatcttctaccgcgagaatgagctgaaggaagtctccatctacgaatgggtgaacaccaaacgggtggccctcaatgagaacatcacggacagccagatcgagaagatcatcgaccaggcctccaagcgcgccgtcaaagagagactgaacgggggcaagatcaaggaggtgttcaagaacctgaccgagaaccccatccagctcaagaacgggatgatcctgaagaacgtgaccgtcaccgacgagtcgaaggtggagaagatccgcaacggcttcgccatcacggggaagaaccaccacgcgctggtgtacaaggacgaaaacggcaagtacaacgacaaggtcgtgtccttttgggaggcggtggccatcggcctccgtaacgtcaccgagtacgggaatccctaccccatcatcaaccgcaaccataacgacgagctgggcgagttctacttcagcatgcagatcaacgacctgttcgtgttcgacctcaagcacagcgagaacccgcaggaggagaacgagatcaacttcttcgacgttgagaaccggaagcagatctccgacaagctgttccgcgtccagaagatgagcaagaagtccaacgggcagttcgtgagcgacttccggcaccacctggagacctcggtgatccgcaacgacatgatcctcaagaacatcacctggataagcatctccaagaacagcgacctggagcggctgacgaagatccgcgtcaaccacctaggagagatcatcaaggtgggggagtga

SEQ ID NO: 7515 - RNA, 3585 nt, synthetic construct; identical to SEQ ID NO: 1715
  misc_feature 1..3585: note = Cas9 variant
  source 1..3585: mol_type = other RNA

SEQ ID NO: 7516 - RNA, 3588 nt, synthetic construct
  misc_feature 1..3588: note = Cas9 variant
  source 1..3588: mol_type = other RNA
atgcaaaagaatatcaatacgaagcagaaccacatctatatcaagcaggcacaaaagatcaaggaaaagctgggcgacaagccctaccgcatcgggctcgacctgggcgtggggtccatcggcttcgcaatcgtaagtatggaagagaacgacggtaacgtgctgctacctaaagagatcataatggtgggcagccggatctttaaggccagtgctggcgctgccgaccgcaagctgagccgggggcagcgcaacaaccaccgccacacccgcgagagaatgcgctacctctggaaggtcctcgccgagcagaagctagcgctgcccgtgccggccgacttggaccggaaggaaaattcatcggagggcgagacgtccgccaaacgcttcctgggggacgtgctgcagaaggatatctatgagctccgggtcaagagcctggatgagcgcctgtccctccaggagctgggctacgtgctctaccatatcgccgggcaccggggcagcagcgcgatccgcaccttcgaaaacgacagcgaggaggcccaaaaggagaacaccgagaacaagaagatcgcaggcaacatcaagcggctaatggccaagaaaaactaccgcacatacggggagtatctgtacaaggagttcttcgagaacaaggaaaaacacaagcgggagaagatctcgaatgccgcgaacaaccataagttcagccccacgcgagacttagtgatcaaggaggcagaggctatcctcaagaaacaagcgggcaaagacgggttccacaaggagctcacggaagagtacatcgagaaacttactaaggccatagggtacgagtccgagaagctaatcccggagagcggcttttgcccctacttaaaggacgaaaagcggctgcccgcgtctcacaagttgaacgaggagagacggttatgggagaccctaaacaacgcacgctacagcgacccgatcgtcgacatcgtgacgggggagatcactggctactacgagaagcagttcaccaaggagcagaagcaaaaactcttcgactacctgttaactgggtccgagctcacgcctgcccagaccaaaaagttgttgggtttgaagaacaccaacttcgaagacatcatcttgcaaggtcgtgacaagaaggctcaaaagatcaagggctacaagctgatcaaactcgaatccatgcccttttgggctcggctatccgaagcgcagcaggattccttcttgtacgactggaactcttgccccgacgagaagctcctcaccgagaagctgtccaacgaataccacctcacggaggaggagatcgacaatgctttcaacgagatagtgctatcctctagctacgctcccctgggcaagtccgcaatgttgattatcctggagaagatcaagaatgacctgagctataccgaggccgttgaggaggccctgaaagaggggaagctcaccaaggaaaagcaggccattaaagaccgcctgccatactacggggccgtgctgcaggagtccacccaaaagattatagccaaggggttcagcccacagttcaaggacaagggctacaagacgccccatacgaacaagtacgagctcgagtacgggagaatcgcgaaccccgtagtccatcagacactgaacgaactgcgcaagctggtgaacgaaataattgacatcctgggcaagaagccgtgcgagatcggcctcgagaccgcccgggaactcaagaagtccgccgaagaccgcagtaagctgtcacgggagcaaaatgacaacgagagcaaccgcaaccggatttatgagatctatatcagaccccagcagcaagtgataataacgcggcgcgagaaccctcggaactacatcctaaagtttgagcttctggaggagcagaaatcccagtgccccttttgcgggggccaaatcagcccgaatgacatcatcaacaaccaggccgatattgagcacctgtttcccatagccgagtccgaggacaacgggcggaacaacttggtgatctcccactccgcgtgcaacgcggacaaggccaagaggagcccctgggccgcattcgcgagcgccgctaaggactctaagtacgactacaacaggattttatcaaacgtgaaggagaacatcccccacaaggcctggaggttcaaccagggcgccttcgagaagttcatcgagaacaaaccgatggcggcccgcttcaagacagacaactcctacatctctaaggtggcccacaagtacctggcctgcctcttcgagaagcccaacatcatctgcgtcaaagggtctctcaccgcgcagctgcgtatggcctggggcctccaaggcctgatgatcccgttcgctaaacagctgatcaccgagaaggagagcgagtcctttaacaaggacgtcaatagcaacaagaagataagactcgacaaccgccaccatgccctggacgccatcgtgatcgcatacgcttcccgggggtatggcaacctgctcaacaaaatggctgggaaagactacaaaataaactacagcgagcgcaactggctatccaaaatcttactgcccccaaacaacatcgtctgggagaatattgacgcagaccttgagtccttcgagtccagcgtgaagacagctctgaaaaacgcgttcatctcggtcaagcacgaccactctgacaatggagagttagtcaaaggcactatgtacaagatcttttattccgaacgggggtataccctgaccacctacaagaagttgagcgccctcaagctgactgacccccagaagaagaagacccccaaggacttcctcgagaccgccctcctgaagttcaagggacgcgaaagcgaaatgaagaacgagaaaatcaagagcgccatagaaaacaacaagagactgttcgatgtcatccaggacaacctcgagaaagcaaagaagctgctggaggaggagaatgagaagtcaaaggcggaggggaagaaggagaagaacatcaacgacgctagcatctaccaaaaggccattagcctctcaggcgacaagtacgttcagctttcgaagaaggagccggggaagttcttcgcaatcagcaagccaacgccaaccaccaccggctacgggtacgataccggggacagcctgtgcgtggacctctactacgacaacaagggcaaactatgtggggaaatcatccgcaaaatcgacgcccaacagaagaatcccctgaagtacaaggaacagggcttcaccttgttcgagcgaatctacgggggcgacatcctggaagtagacttcgacatccactccgacaagaacagcttccgcaacaatacgggctccgcccctgagaaccgggtgttcattaaggtggggaccttcactgagatcacgaacaataacatccagatatggtttggcaacatcatcaaaagcaccggaggccaagacgactccttcaccatcaacagcatgcagcagtacaatccccgcaagctgattctctccagctgcggattcataaagtaccgttcccccatcttgaagaataaggaaggctga

SEQ ID NO: 7517 - RNA, 3594 nt, synthetic construct
  misc_feature 1..3594: note = Cas9 variant
  source 1..3594: mol_type = other RNA
atgagcaagcatgtcctcggcttagacctgggggtcggaagcatcggttggtgcctaatagccctagacgaacaagaccaaccagctgagattttggggatgggatcaaggatcgtgccgttaaccaccgacgacctcaacgagttctcacaaggtaaagcgatctcgaaaaaccaaaaacggacgacccaacgcactataagaaaagggttggacagataccaactgagacgaaaagtcctcagcgaaaaacttgcgggccacgggatgctcccagacaaggacttaatgcaactgccggtcctcgatctatgggaactcagagcacgagccgcctcgccgggagaaaaattgagcctacccgaaatcggccgcgtcctctatcatattaaccagaagcgtggctacaaacacgccaaatcggacgaagcagaagaagtcaccaagagaggcaaagaacaagggtacgtcgccaccgtaaaaggccgatacgcggaactccaacgcgaaggagcgaccgtaggacaacacttcgcctgcaaacttaaagaacaccgccaagaatcccccagcgggggcttcttctacaactacaggatcaaagaccaagtatacccccgcgaagcatatatagaagagttcgaccgaataatggaagtccaaagcgtattttacccagaggtactcactcccgcattcatccaagagctacgggacaaagtgatattcttccaacgccccctaaaatcctgcaaaggcctggtatcattctgcgagttcgaaaagcaagaacgggtagtgcagctgaaaagggtcaaccgcgagggaaaagaagaactccaagaacgcaaaataaccatcggccccaaggtagcacctaagtcgagccccattgctcagctctgcaaattgtgggagtcaatccacaacatacgcatatactacccggacggaaaggaacggcccatcacactcgaagagaaaagaaaactactcgcatacctacaaacgcacgacaaactgacctttaccgcactcaagaaagagctaaaaatctcagacaaggagcggctctggtgcgacaagctcctcaaaggcggcataaaaggggacacaaccagggtactgctcagaaaagccctagccggttacaaaagatacgaaccgcttctgagaatggacctcgaactccgcgacttccaagaaatcgtcagcggcaaacgtctcatcagacccatagtcgacgaatcctacttatcccaaccactctatagactttggcacattctatactccatcgaggagcgggaggcaatgcggcgagcactaatagaccaactgggcttcctcgaagaggacctggacggcggactcctggacaagctgtaccaaatagacttcgccaaacagggatacagcaacaaatctgccaaattcatatgcaaactgctcccacatctccaagggggtcatggatattcacaggcatgcgaactcgcaggcaagcgccacagcgcggggagcctgacaaaagaagaactggaagaaaggcccctactagaacacatacctctactccaatgcaacgaactacgccaacccatcgttgagaaaatactcaaccaaatgatcaatctagtcaacgcactccgacaaaaatacggctcaatagatgaagtgcgggtcgaactagccagggaacttaaaatgtcacgcgaagaaagagaagaaacctcaaaaaggatccgatcccgcgagaaggaaaacaaggagatcgcagaacgaataaaggaatacgaactatacccaaccaaatccagaatccaaaaataccgcctctggcaagaagcaggggaacaatgtctgtactgcggcaggagtatagacgtggtccagttcctccgcggcgacggtgtagaaattgaacacattatccccaagtccatcctatacgacgacagcagcgccaacaaaacatgcgcctgcagccgctgtaacaaagacaaagggaatagaacagcctacgagtatatcctagcagaaggacgagaggccgaatacctagaccgcctcgaaacactcttccacgacgggaaactcagttactccaaacgccggcgccttcaatggaagaaagccgacatcccagtcgacttcattgaacgtcaactacgactcactcaatacatcgcccgccaagcgcaagaaattctacgccaggggatccgccgcgtaggcgcctccgaaggcagcgtaacggcaaaactgcgacacctgtggggatacgacgacattctgagagagcttaatttcgagcgctaccaatcaatgggcgagaccgagatagtcagccaagaagaaaaagacggcagcataaccaaaagcgaaagaatcaaagactggtcaaagagaaaagaccacaggcaccatgcgattgatgctctggtcgtcgcctgcacacgccaaggctacatacaacgcctaaactccctaaactccgaagaggacagcctacaaatgcaagaagactcaaaacaaatgcgagaaaagatgggaggtcagaaacggcctacagccgacaagcactccatcctggaaaattggctgatcctacaaccgcacttctcccaccaggaggtcaaatccaaagtggctgaaatcctagtctccttcaggccgggaaaacgcacagtatcaacaggtagaaacacatacctgcgctcaggcaagaaagttacacaaagcggcgtgctcataccacgaggaccactatccgaggaaagcctctacggacaaatactaagaaacggggaaccgacatacgtcaagaaagtcgcgctcgaaagcctcagcgaggcacaaatcgaacagatcgtggacccaaaactcagacgcgaaatggtcgcccgcacccaaccatcagaaggagcgaaactcaacccaaaactactgctagccacaccattctactctgacgcagcagggacgcaaagagtccgctcagtacgcgtagcaatagaaaacgggaaaaactcaatcgtacccctacgctacaatgaatccggaaaagcaataaccttcgtcaacccgggaaataaccaccacgtcgggatataccggacatcagagggtaaactggtcgaaagctgcgtaacattctggcaagcggtagaccgcgtccgctacggcatccccacaatcatccggaaaccaagagaagtcctggaccagctactccttcgcgatgacatcccggaagccctcctagcgcacctaccagcgagcgactgggagttcgtcgaatatctacaagccaacgaaatgttcctcatcggcctcaccgacgaagaaatacaaactgcactagcggaaagcgacctgttaaccctatcgaaccacctctaccgcgtacagaaaatgagtagcgaatactacgtcttccggtaccacctagagaccgaagtcgcagacaacaaaaacaacacaggaatcatcccaaaattttaccgactacgggggcccaacgacacctacctgaaagccaacccacgcaaagtcaaggtgaacctcttaggagaaatctccttgccatga

SEQ ID NO: 7518 - RNA, 3615 nt, synthetic construct; identical to SEQ ID NO: 1718
  misc_feature 1..3615: note = Cas9 variant
  source 1..3615: mol_type = other RNA

SEQ ID NO: 7519 - RNA, 3630 nt, synthetic construct; identical to SEQ ID NO: 1719
  misc_feature 1..3630: note = Cas9 variant
  source 1..3630: mol_type = other RNA

SEQ ID NO: 7520 - RNA, 3633 nt, synthetic construct
  misc_feature 1..3633: note = Cas9 variant
  source 1..3633: mol_type = other RNA
atgcgcaccatcctgggcctcgacctggggaccaacagcatcggctgggccgtgatcaactccgtcatcaaggagcagacggagcggatctggatcgagatggccggaagccgcatcatccccatggacgcggccatcctgggggacttcgacaaggggaactccatcagccagaccgccgagcggacccgcttccggggcgttcgccggctccgcgagcggcagctgctgcgccgggagcgcctccacaaggtgctgaagatcctgggcttcctcccggagcactacctgaaggggatcgacttcgagaagcacaccggcaagttcctgtccgggagcgaacccaagctcccctgggtcaaagaccggtggggcaagtactccttcctgttccagacggccttcaacgagatgctggccgatttcgcgaagcaccagcccagcctcgtgttcgacgggaagaagatcccgtacgactggaccgtgtactacctgcgaaagaaggccctgaccgagatgatctccaaggaggagctcgcctggatcctgctgaacttcaaccagaagcggggctactaccagttacgcggggaagaggaggaggataacgccggcaagagcgtcgagttctacgcgctgaaagtgctgtccgtggaggccaccgacgagaagaaggggcgggacatctggtacaacgtccacctcgagaatgggtgggtgtaccgccggagctccaacgtgcccctggactgggagggccgcgtcaaggagttcatcgtgacgaccgacctgaaccccgacggcacccccaagctcgacaagtacggggaggtgaagcggagcttccgcgccccgaaggaagacgactggatgctgatcaagaagcgcaccgaggcggacatcacgggcacccacaagaccatcgggtcctacatctacgacgccctgctccaggagcctcagcagaagatcatcggaaagctggtcaagaccgtggagcggaagttctacaaggaggagctgaacttcatcctccagaagcagtgcgcgttccacgccgagctgcaggaccgcgacctgtacatgcggtgcatcgaggccctctaccccgggaacgaggtgcagcggaggaacatcgccaaccgcgacttcatctacctgctgatcgacgacgtcctcttctaccagcggcccctgaagacgaagaagtccctgatcgccaactgcccgtacgaggagaacgagtacgtgaaccgcaagaccggcgagatcaagaccgcgcccctcaagtgcatcgccaagagccaccccctgttccaggagttccggctgtggtacttcctcagcaacattcgcgtgtatcagaaggagcgggaggtcaacggcacactgcacctggacgtggacgtgacgaccgagttcctcaagaccgaggacgactacgtcgccctgttcgactggctgaactcccgcaaggagattgaccagaaggccttcctgcggtaccccgccttcgggctcaaaaaggagatcaacaactaccgctggaactacgtggaggacaagttctacccgtgcaacgagacccgccacgcgatcctgagccgcctggagaaggccggcatcgggatcgacttcctcagcgacgagaaggagacggccctgtggcacatcctgtactctgtcagcgacaagcaggagatcgagaaggccctcgccaccttcgcggtaaagaacgggctgaacgagtccttcgtggaggtcttcaagaagttcccgcccttcaagagcgagtacggggcctactcagccaaggccatcaagaaactgcttcccctgatgcggtgcggcaagtactgggacatgtcgctgatcgacggtaccaccaaggagcgcatcgagcggatcatcgcgggggagtgcgacgagtccatcggcgccaaggttagggagaaggcgatgaacctcagcgacatctcatgcttcaagcgcctgcccctgtggctcgcctgctacgtggtctacaaccggcacagcgaggacaaagagatcacgaagtgggagacccccgccgacatcgacgcgtacctggccgcgttcaagcagcactccctgcgcaaccccatcgtggaacaggtgatcaccgagaccctccgggtggtgcgcgacatctggaagcaggtcgggaagatcgacgagatccggatcgagctcggccgcgagatgaagaaccccgccgacaagcggaagcgaatgacgacccagatcctggagaacgagaacgccaacctccggatcaaggcgctgctggccgagttcgtgaaccccgaatacggggtggagaacgtgcgcccctacagcccctcccagcaggagatcctccggatctacgaagacgccgtgctgaagggcgaggagcagatacccgaggacatcgacgtgatcctgaagaagttcaacaccagcaagctcccgaccaagtccgaatttctgcgctacaagctgtggctcgagcagaagtaccggagcccctacacgggcgagctgatccccctggccaagctgttcaccgccgcctacgagatcgagcacgtgatcccgcagtcccgctacttcgacgacagcttctccaacaaggtcatctgcgaaagcgccgtgaataagctcaaggacaaccagttagggtacgagttcatcaagaaccaccacggtcagaaggtggaagtcgggttcggcaagaccgtggagatcttcagcgtggactcctacgagcggttcgtcaaggagcagtacgccaagagcggcatcaagatgaagaagctcctgatggacgatatccctgagcagttcatcgagcgccagctgaacgactcccggtatatctctaaggtggtgaaagggctcctgtccaatatcgtcagagagaagaacgatagcggcgagtacgagccagaggccgtgtccaagaacatcctggtgtgcaccgggagcgtcaccgaccggctcaagaaggactggggcatgaacgacgtgtggaactccatcgtgagcccccgtttcgagcggctgaacgcgctgacggagacccagtgcttcgggcactgggagaacaaggacggcaagaaggtcttccagaccgccgtgccgctcgagtaccagaagggcttctccaagaagcgcatcgaccaccgccaccacgccatggacgccatcgtgatagcctgcgcgacccggaaccacgtcaattacctgaacaacgagagcgcctcccgcaacgccaagatcagccggtacgacctgcagcgcctcctgtgcgacaagtcccgcggggacggcaacggaaattaccggtggatcatcaagaagccctggacgaccttcacccaggacgcccgggaggccctgagcggcatcatcgtgtccctcaagcagaacctgcgcatcatcaacaagaccacgaacatctaccagcacttcgacgcgaacgggacccgggtgtacgagaagcagaagatcggagacagctgggccatccgcaagcccatgcacaaggacaccgtcttcggcgccgtaaacctgcggaaggccctaatcccccagcactacaacctgaccctgttcatcagctcctga

SEQ ID NO: 7521 - RNA, 3642 nt, synthetic construct
  misc_feature 1..3642: note = Cas9 variant
  source 1..3642: mol_type = other RNA
atggagaaaagactgggcatcgacgtaggaaccaactcgctaggatgggcgatcgtagaagtggacgacgaaggctgcacgctattagacagaggcgtcgacatatttcaggaaggcgtggcgcgcgagaaaaaccaagaaaagccagccgtacaagaccggacggacgcacgcgcactaaggcgccactactttcgcagaaggctccgcaaaatcgcactcctacgagtgctcgtgcgccacgacttatgtccagccctaagcgaggaacaactcaacgcgtggcaagggaaaggtatctatccactcgatgacgcgttcataagatggcagcgcacggacgacaacgccgacagaaacccatacagagaccgcttccgctgcctaacggaagaactcgacctagcatgccgcgaagaaaggtacgtgctcgggcgagcactatatcacctgtgccaacgacgaggctttctaagcaacaggaaagacgccggaaacgaagcagaagagggaaaagtgaaacaagaaataaagacactatcagcagacatggccgccgcgggctgcgagtacctcggagaatatttctaccgcctataccagaggaaagaaaagataagaaaacactacaccgcacgaaacgagcactacctagcagagttcagagcaatctgcagaaagcaaagactcgacgaagaactacgtcaagcgctcgaaaaagcgatattttaccaacgccctctcaagagccagaaagggctggtcggcaagtgcacgttcgaaaaggataagagccgctgccccgtgagccatccacgcttcgaagagttccgaatgctacagttcatcaacaacgtcagagttaccggcccgggcgacgcagaacccagacccctgagccccgaagaggtcgaaatcgtgcgcccgctattcctcaggaagtccaaaccacatttcgacttcgaagacatcgcaaagaaaattgcaggcaaggggaactacgcatgcaggggagagctactgcaggccccctacagattcaactgcgctgggaagtcaaccgttaccggatcaccggtctccgccttattcgcttcagtattcggggacgactggcagcgcgagatctgctcgttgtacacactcggggccggcaaaaacgaggaacaaatactcaacgacgtctggcacgtcctattcgcattcgaagacgaagaacggctacaggcctggttacaggaaaaactacaactaagcgcagacgacgccaaaacactagcagcattcagactgccccaaggatacgcaagcctcagcctaaacgtaatcaacaagatactaccatacctcagaagaggataccggtacgatgaagcggtattcttcgcaaaccttggtaaagtactacccgcggaagtctacgcggaccctgcgcgaagaagggaagtcgaacaaggaatttccgcacagatggatgacctcggggacggagaaaagacccggaaggaggagagaataagagattacctaagacgatactggggcgtcgaagaaaagcgactagaaaggctctatcacccgagcatgatagaagcctacccaagcgcatcacctaatggacaaggactgctacagctcggaagcccacgcataccagcagtcagaaacccaatggccatgagagctctattccgcctacgggtgctcctaaacgaactgctacgggaaggaaaaatagacaggggcaccaaaataaacatcgaacttgcacgcgaactaaacgacgccaacaagcggaaagccatcgaacgatatcaaagagaacgggaagccgaaaacaggaaatatgccgaagaaatacgacagcagtacgtagaggctacaggccactcaatagaacccagcgaggaagacatcctaaaatacagattgtgggtagaacaggggcattgcagcctgtacactgggaagacaatcggtattagcgagttcctcggcgacggacgccgatacgacatagagcacacagtaccgcgcagccgcggaggcgaggacgcgcagtacaacaagacactctgcgaagaagagttcaacagagacataaaaagagacaagctaccatccgagctagcgaaccacacagcaatattagcctgcgtcgaaagctgcggctggttcgagcgaatagaaggactcgagcacagagtgtggggagcagacagacgagcaaaaagcgccacaaccaaaagcgcgaaggacttcgcaatacaagaccgacactactggagaatgcacctcgactactggcgaagaaaatgcgaagcgttcacgatgactgaagtccccgaaggattcagcaaccgacagggcgtagacgtcggcataataggacgatatgccagactatacctccagaccgtattcgaccgggtctacacagtcaaaggagcgactaccgcagcgttccgaagaatgtgggggctacaggaggaatacgcagctaaggaacgagtcaaccatgtacaccactgtatagatgcgattacaatagcttgcataggctcgcgagagtacgcgttatgggcccaatacgtgcgccaggacgaactgtatcgctggggcgaagccgataagccacgatgcggaaaaccgtggcccacattcaccgaagacgtcagagcaacagccgacgagctactcattagccaccacacgccagataatatgcccaaacaatcgcgaaagcggctaagagtaaggggcaaagtgcagcggaacgacaggggcgaggtaaaatacatgcagggcgacacagcccgcggagcccttcaccaacaaacattctacggcgcgatcgagcgcgatggggaaataagatacgtagtaaggaaatcgctggaccaactactaccagcagacgttgagaaaattgtagacgaggccgtccgacaaaaggtaagagaagccgtcgaggcgtatggcttcaaggaggcgacagacccgacgaaacacacagtatggatgaacgaagagaagcaaattccaatcagaaaagtgcgaatattaacgggcgtgaaaaacccgatcctactcaaaccccacagagacgtatccgtaaaagaatacaagcggtactaccatgtcgtaaacgacggaaattactgtatggcaatatacgaaggaagagaccgccagggccgactaaaaagaacattcgaaatcgtgaacaaacttgaagcagcaagatactttaaacgctcagcagaccgtgagagccgaccagacctggtaccactgagcgatgtgaatggctacagcctaaagtacctcttaaagaccgggacgatggtcctcttctacgagaactcgccggacgagctctacgaatgctcagtaggcgaactagcaaaacgactgtacaaggtcgtagggatggcgcaagatgggcgcgtacaatttctatttcaccaagaagcgagagatcagaaagcggttacggcagaatgcggcatgggcatatcggtgttcgacgcaagacacccagcaccgaaactgcgtatacgcgtatccaacttcaaaatgttcgtagagggctatgacttcgaactaacagtgaccggagaagtcaaattcaagagatga

SEQ ID NO: 7522 - RNA, 3642 nt, synthetic construct
  misc_feature 1..3642: note = Cas9 variant
  source 1..3642: mol_type = other RNA
atggaaaagcgactaggcatagacgtgggcaccaacagcttaggatgggccatcgtagaagtggacgacgaggggtgcacactcctggacagaggggtcgacatattccaggaaggggtagcacgcgagaaaaaccaagaaaaaccggcagtacaagaccgcaccgacgcaagagcattaagaaggcactacttcaggcgcagactgagaaaaatcgcactcttacgcgtgctcgtccgacacgacttatgcccagcactgagcgaggagcagctaaatgcgtggcagggaaaaggaatatacccgttagacgacgcattcatacgttggcaacggacagacgacaacgcagacagaaacccatatagggatagattcagatgcctgacagaggaactagacctggcctgtcgcgaggaacgatacgtgctcgggcgagcgctataccacctttgccaacgcaggggatttctctcgaacaggaaagatgcaggaaacgaggcagaggaaggcaaggtcaaacaagaaatcaaaacactcagcgcagatatggcggccgccgggtgcgagtatctgggagagtacttctacagactgtaccagcgcaaggaaaagatacggaagcattatacggcaaggaatgaacactacctagccgagttcagggcgatatgccgcaaacaaagacttgacgaagaactacgacaggcgctcgaaaaagcgatattttaccagcgacccctgaaaagccagaaaggattagtaggcaaatgcacattcgaaaaagacaaaagcagatgtccagtaagtcacccgagatttgaagagttccgaatgctccaatttataaacaacgtccgtgtgacgggaccgggcgacgcggaaccgagacccctgtcaccagaagaagtagaaatagtccgaccactgtttctgagaaaatcaaaactacacttcgacttcgaagacatcgcaaagaaaatagcgggcaaaggaaactatgcatgcagaggagagctcctccaagcaccctaccgattcaactgcgccggaaaatcgactgtgaccggctcccccgtatcagcactgtttgcgtcagtgttcggagacgactggcaacgagaaatatgcagcctgtacacgctcggcgccggaaagaacgaggaacaaatcctgaacgacgtgtggcacgtactgttcgcgtttgaggacgaggaacggctccaaacatggctccaagaaaaactgcagctctctgcagatgacgcgaagacactagcggcgttccgcctgccacaggggtacgcaagtctcagcctgaacgtcatcaacaaaatactcccctaccttaggagaggatacaggtacgacgaagctgtctttttcgcaaacctggggaaagtccttcccgcagaggtatacgcggacccagcaaggagaagagaggtagaacaaggaattagcgcgcaaatggacgacctcggggacggcgaacaaacgcggaaagaagaaaggatacgagactatctccgacgatattggggtgtggaagaaaagagattagaaagactctatcacccatccatgattgaggcctacccatccgcgagccccaacggccagggactcctacaactagggtcaccgcgcatcccagcggtacgaaacccaatggccatgagggcgcttttcaggctaagagtgctccttaacgaactcctgagagaaggaaaaatagacaggggaacaaaaataaacattgaactggccagggaactaaacgacgcaaacaaacgaaaagcaatcgaacgataccaaagggaaagagaagcagagaacagaaagtatgccgaagaaatacggcagcagtacgtagaggcgacagggcactcgatagaaccaagtgaggaagacatcctgaaatacagactgtgggtagaacaaggacactgctcattgtatacaggtaaaacaataggaatctccgagttcctaggggacggtagacgctacgacatagaacataccgtgccaaggtcacgaggcggagaagatgcacaatacaacaaaacactttgcgaagaagagttcaatagggacatcaaaagggacaaactaccaagcgaattggcaaaccatacagcgatcttagcatgtgtagagagctgcggctggtttgaaaggatagagggacttgaacaccgggtctggggcgcggacaggcgcgccaagtcagcgacaacgaaatccgcgaaggacttcgcaatacaagacaggcactactggaggatgcacctagactactggagaagaaagtgcgaagccttcacgatgacggaagtaccagaaggcttcagcaaccggcaaggcgtcgacgtcggaataataggcagatatgcacgactctacctgcagacggtcttcgacagggtgtacacagtcaaaggagccacgacagcggcattcaggcggatgtggggactccaagaagaatacgcagcaaaagagagagtaaaccacgtgcatcactgcatagacgcgattacaatcgcatgcatcggatcacgagagtacgcgctgtgggcacagtacgtccgacaggatgagctatacagacggggcgaggccgacaaacccaggtgtgggaaaccctggccaacgtttacagaagacgtcagggccaccgccgacgagctgttaataagccaccacacacccgacaacatgcccaaacaaagtcggaagagactacgcgtaagagggaaggtccaaagaaacgaccgcggcgaagtaaaatacatgcaaggagacactgccagaggagcccttcaccaacaaaccttctacggcgcgatcgagagagatggagaaatccggtacgttgttaggaaatctctagaccaactgctccccgcggacgtcgagaaaatagtggacgaagcggtccgccaaaaagtccgggaggccgtagaagcatatggatttaaagaggcgacggaccccacaaagcatacggtctggatgaacgaagaaaaacagatccctatccgaaaagttcgaatactcacaggggtcaaaaaccccatacttctaaaaccgcacagggacgtaagcgtcaaagagtacaaacgatactaccacgtagtgaacgacggcaactactgcatggcgatttacgaagggagggaccggcaaggccggctgaaacgaacgttcgaaatagtgaataaactggaggcagcaagatacttcaagcgatcagcggacagagagagtcggcccgacctcgtcccattaagcgacgtaaacggatacagtttaaaataccttcttaaaacgggcaccatggtcctattctacgaaaactcgccagatgaactctatgaatgctcggtcggagaactagccaaacggctctacaaagtggttggcatggcacaagacgggagggtgcagttcctgtttcaccaggaggcacgagaccagaaagccgtaacggcagaatgcggaatgggcattagcgtgttcgacgcacggcacccagcacccaaactgcgaatacgagtaagcaacttcaaaatgttcgtagagggctacgacttcgaactcaccgtaacaggtgaagtgaaatttaagcgatga

SEQ ID NO: 7523 - RNA, 3651 nt, synthetic construct
  misc_feature 1..3651: note = Cas9 variant
  source 1..3651: mol_type = other RNA
atgaccaagatcttgggcatcgacaccggaacgaacagcctcggctgggccatcgtggacaagaccgccgacaattacaacctgctggacaagggggttaatatcttccaggagggcgtgaagatcgagaaggggatcgagtcaagcaaggcggccgagcgcaccgagcaccgggccacccgcgtgagatactaccgcatcaagctgcggaagatccgcctgctgcggatcctctccgacaaccacctgtgcccgccactgagccaggaggaactatctacgtggcgcctgaaaaaggtctaccccaagaacgagctgttcatgcaatggcagcggaccgacgacgacaccgagaagacgccctatgcttaccgccacaagtgcatacacgagaaactcgacctgagtgatgtgacggaccggtacatcctggggcgcgcgttctaccacatcatccagcgacgcggcttcctctcaaaccggaaggagcaaggtggggaggatagcgggaaggtgaaggaaggaatctccacccttacccatgagatgaacgaggcggggtacgagtacctgggcgactacttctacgcactctacaacaagggcgaaaagatccgcaagcactacaccgcccggaacgagcacttcctgagcgagttcaaggccatatgcgagaaacaggatctggagaaggagctcggatccgaggtcgtgcgcaacatcgagaaggccatctttgaccaacggccactcaagtcccaaaaaggacaggtcgggaagtgtgtcttcgagaaaaacaagacaaagtgcccgtccagccatcccatgtacgaggagttccgcatgctgacctttatcaacaacattaaaatcaagacacccaacgacgacgtgctccggcccctgaacactggggagcgggagaagatcatgccgctgttcttccgaaagtccaaaaagcagttcgacttcgaggacatcacgaagaagctcgcacccaagaaaatgtacggcttctacaagaaagaggaggatgccgagatgcccttcttgtttaactatccgatggacaccagcgtgtccgggtgcccggttaccgccgccctgaaggacgttttcggcgacgactggatcacggcgatctgcgagacgtacaccctcggggagggcaagagcagattcgatatcgtgaacgacatctggcacgccctgtacttctactccgacaaggacaagctggccgagttcgccatcaaccgcctacagctgtcagaggacgaagccaagatcttctcagaaatctccctgccagcggactacgccagcttatccttaaaggccatctgcaagatcctgccctacctccggcgcgggctgatctacagccacgcggtattcctgggcaacctctgcgaggtgatgccgaaatacgaatggtccatcaaggagatgcgagagaccatcatcgacaacattatcatggagatggacaaatgcgacaccaaggacaagcgcacgttcgaggtgtgcatcaaggattacctgaaggggcagtacaacgtcagtgataactccctgaagaaactctaccatccgagcatgatcgagacctacccccgggtccaatacaccaatgagcatggggtgtatcagctgggcagcccccgcatcgactccgtccggaaccccatggccatgcgcagtatgttccgcctgcgcaagctcgtgaaccggcttctcgtggagggcaagattgatcagaacaccgaggtccacatcgagttcgcgcgggagttaaacgacgcaaacaagagaaacgcgatagctttattcgtgaaggaaaaccagagcgctaacgatgaagctcgcaagcaaatcatcacgctgttcaagaaggaaaccggcaccgacattgaaccgaccgataaggacatcctgaaatacgtgctctgggaggagcagaaccacatctgcctgtacacggggaagcagatacggatctccgacttcatcggcgccaacccaaaatttgacatagagcacaccatcccccgtagcgtgggcggggactctaccaaaatgaacctgaccctttgcgacagtcggttcaaccgagaagtgaagaagaccaaactgcccgtagagctaccgaatcacgacgagataatggagcgcatcaaggagtggaagaagaactacgagttgctggatatccagatccgcaagaacaagaagctgtccaagggtgctaccaccaaggagcagaaggacactatcatccgcaagcggcacctcctggagttgcgccgagactactggcgcgggaagtacgagcgattcaccatggagagcgtgcccgagggcttctccaggcggcagggcacggacatctcggtgattagcaaatacgcccgcctctacctgaagtccctgttcaacagggtctataccgtgaagggcatcgcaaccagcgacttccgcaagatttggggcatccaggacatctattccaagaaggagcggatcaaccacgtgcaccactgtatcgacgccatagtcatagcctgcatcggcctcgacgaatacaacaagctgggtgcctactaccacgacgaggagaataacaagtggtatggtatgagcaaggcctccttcaagaagccctgggcgaccttcgtggaagatatcaaaaagatccaggacgagatcctggtgtatcactacactccggacaacatgcctaagcaaggcagacgacgcataaagatcgacgggaaaaagatcctctgtaagggggacgccgcccggggcagcctccacaacgacacctactacggggcaattgagaatgacggcgcagtcaagtacgtcaagagaatcgacttagcgtccttagaagagaaggacgtcaagaacatcgtcgatgacaccgtgcgtagcatcatcgaggccgccatcaaggagaagggcttcaaagacgctatggcttcgaccatctggatgaacgaggagaaacgcgttcccattaagaaggtccggtgcttcacgcccagcataaccaagcctctgaacatccgcaagcagcgcgacgtatccataaaagagtacaagcaacaataccacgtggcgaatgacagcaactatcttctcgccctctacatcggcacagacaacaagggcaaggagaagcgggagttcgagatcgtcaatatcctacaggccgcccaatactaccggacctctaacgacaaagaagtagtggaccggcacatcgttcccatcaaaagcgagcatgactaccccttcgcgtacacgctcaaaataggtaccatggttctcctgtacgagaagagtcccaacgaggtatgggacgccaccatcaaggagcggaaccgacgcctctataaggtcacgggccttagcacgatgcggatgaaggggcgcaacggcgagtatgcctacgctaccgtaaaactgatccacaatgaggaagcccggccgtccaaggatatcaaggcgaagaacggggagtacgagcagggcgaggagttccgccctgccatcatcatgctccacactcagctgaacgccctggtacaaggctatgacttcgagattaacgaactgggagagatccggcgcttgcggtga

SEQ ID NO: 7524 - RNA, 3654 nt, synthetic construct
  misc_feature 1..3654: note = Cas9 variant
  source 1..3654: mol_type = other RNA
atggagaagcaacgcatcctgggtctcgaccccgggaccaacagcctgggctgggccgtactagacttcgacaactccaagcaggagtacaacctcgtccggaagggggaggtgattttcgaggagggcgtgggcaagagcgagcgcggggagttctccaaggccgcgtaccgtaccttctataagagcacgcgcaagcactacttccggcgccggctgcgcaagattgaggtcctgaaggtgctcgtgaagtacgacttctgcccgtacctgtccgacgacctgctcaagcagtggcacgagaagaagatctaccccgccgtcaaggagttcatggactggcagcggaccagcgacgccgagggcaagaacccctactacgaccgccattgctgcctgaacgagaagctggacctctccctcaagagcgaccggtacatactggggcgcgccctgtaccacctgacccagcggcgcggcttcaagtccaaccggctgatccagaacaacgacgagaacgaggaggggaaggtcaagaagggcataagcgagctctccaccgagatgcaggaggccaactgcaactacctgggggactacttctacaagctgtacacggagaaaggcaacaccgtgcagatccgcaagcggtacaccgaccgcgagaagcactacaagaacgagttcaacgcgatctgcgagaagcaggagctcaacgagaccatcgtcaaggagctggacaaggccattttcttccagagaaaactgaagccccagcgccacggcgtggggaaatgcacgttcgagccgaacaaccggcgctgcgccatcagccatcccgacttcgagcgcttccggatgctctgcttcatcaataacatcaagatcaagacacccttcgaggagaacctgcgccccctgaacaacgaggagaaggccctcatcgaaccgctgttctacagaaagtccatcaagaacttcgacttcgaggagatcgcgaagaagctggccggcaagaacaactactgctacatcaaggacgacagctccaagcagtacaagttcaactaccgcatgagccagggggcctccacgtgccagaccatcgccaagctcaagagcatctttggcgaggagtggaagaacggcatcgccgagacgtacaccaaccggcgcaagaaggaggggctgaagaagcaggcggagatggtggacgacatctggaacgtcctgtactccgtgagcgagtgcgacgtgctcaaggacttcgccatcaacaagctgcagctggacgagaagacagccgacaacttcagcaagaccaagctcgcccagggcttcgccacgctgtccctgaaggcgatccggaagatcctccccttcctggagcaggggttcggctacaccgaggccgtcttcctggccaacattcccaccgtggtggggaaggagtactggaacaacgaggacatccgcaacgacatcatggaggagatcaagaccatcttctaccataacacgctcaagaccaacgatagccacaacaccatcctgttctgcatcaaggacatcctgtccaacaacttcgacctcgcccccggcgccatcgacaagctgtaccatccgagcatgatcaacgtttacaaggacgtgatccccaacgaggacggcatcctccagctcgggtcccccaagatcgacgcggtgaaaaaccccatggccatgcggagcctgcacatcatccgaaaggtcgtgaacgagctgctgcgggagggcatcatcaactccgacaccgaggtgcgcatagagtacgcccgggagctcaacgacgccaacaagcgccacgccatcgcggactggcagaagaagcagtacgggaagcaccagaagtatcggaaggagatcaaggaactgttcaaggccgagacgggcttcgagatcgagccgaacgagaccgacatcctgaagttcgagctctgggaggagcagaaccacatctgcctgtacaccgggcaggagatcggcatcagcgagttcgtcggcgagaatcccaagtacgacatcgagcacaccttccctcgctccctcgggggcgacagcacgaagatgaacatgaccctgtgcgagaacaagttcaaccgggagaacaagcagaagaaactgccctccgagctggccaaccacagcgagatcctcgagcgcattgacgactggaagaagaagatctacatcctgcagaagaagtacgactccatccggacccacaacgggatggacaaggagaacaaggacaagaagatcgtgagccgccataagatcaagctggagctggactactggaagggcaagtacaaccgcttcaccatgacggagatcccggaggggttctcccggcgccagggcatgggcatcgggctgatcagccggtacgcgggcctgtacctcaagaccatcttccacaagaaggacaacccccagaagtccaacgtctacatcgtgaaggggagcatcaccgcggagttccgccggatctggaacatccaggatgactacgagaagaaatgccgcgacaaccacatccaccactgcatcgacgccattgtggtcgggtgcataggcaagcgggagtacgacctgatggcccagttctaccgagacgaggagaagtatcggtgggagaagaagaagaagcccttcttcaagaagccctgggagaccttcacgcaggacatgctgagcctcaaggacgaggtgctgaccgtgcacttcaacccgtccaacttcactaagaaggcccataagaaggtcttcacccccaaggggatcttcgtcgctcagggcgactgcgcgcgcgtgaagctgcacaaggggagctacttcggcgccatcgaacagaagggggagatcaagtacgtcatgcggaaggagctctccgccctgaagatcgaggacatcaagaacatcgtggacgccgtggtcaaggaaaaggtgctggccgtggtcaagaagaagggcttcaagcaggcgatggccgaacccatctacatgaatgaggacaagagaatcctcatcaagaaggtgcggctgttcgtgagccaggccaatccactgatcgtcaagaagcaccgcgacctctcctctaaggagtacaagcagaactactacgtggataacgagggcaacctgatgatcgccatgtacgagggggtgaagaagaacggcaagatcgaccgggagatcaccgtcgttaacaacctggaggccgcgaagttcttccgccagtcccagaagaacaacgccgagaagcaactcatcagccacctgtccccgaagaacgggtaccccctgaagacggtgctcacacagaagcagctggtcctgatgtacgaggacagccccaaggagatcaagctccgggacaccaagaacatggtaaaacgcctgtaccaggtgttcggaatcgagaaagacgggcgggtcaagctgaagttccatcaggaggcccgctccgagggactcaacatcaacagcgccgcgttcaagatccaggacaccccggagtccctgtaccggcacaccaagagcaacctgaaggtgctcgtgaacggtgtcgacttcaagatcaacatactgggggagatctccctgatttga

SEQ ID NO: 7525 - RNA, 3654 nt, synthetic construct
  misc_feature 1..3654: note = Cas9 variant
  source 1..3654: mol_type = other RNA
atggagaagcagcgcatcctgggcctcgaccccgggaccaacagcctgggctgggccgtgctggacttcgacaactccaagcaggagtacaacctcgtccggaaaggggaggtgatcttcgaggaaggcgtgggcaagagcgagcgcggggagttctccaaggcagcgtaccggaccttctacaagagcacgcgcaagcactacttccggcgccggctgcgcaagatcgaggtcctgaaggtgctcgtgaagtacgacttctgcccgtacctgtccgacgacttactcaagcagtggcacgagaagaagatctaccccgccgtcaaggagttcatggactggcagcggacgagcgacgcagaaggcaagaacccctactacgaccgccactgctgcctgaacgaaaagctggacctctccctcaagagcgaccggtacgtgctggggcgcgccctgtaccatctgacccagcggcgcggcttcaagtccaaccggctgatccagaacaacgacgaaaacgaggaggggaaggtgaagaagggcatcagcgagctctccaccgagatgcaggaggccaactgcaactacctgggggactacttctacaagctatacacggagaaaggcaacaccgtccagatccgcaagagatacaccgaccgcgagaaacactacaagaacgagttcaacgcgatctgtgagaagcaggagctcaacgagaccatcgtgaaggagctggacaaggccattttcttccagcggaagctgaagccccagcgccacggcgtgggaaagtgcacgttcgagccgaacaaccggcgctgcgccatcagccaccccgatttcgagcgtttccggatgctctgcttcatcaataacatcaagatcaagacccccttcgaggagaacctgcgcccgctgaacaacgaggagaaggccctcatcgagccgctgttttaccggaagtccatcaagaacttcgacttcgaggagatagcgaagaagctggccggcaagaacaactactgctatattaaggacgactcctccaagcagtacaagttcaactaccgcatgagccagggcgcctccacgtgccagaccatcgccaagctcaagagcatcttcggcgaggagtggaagaacggcatcgccgagacctacaccaaccggcgcaagaaggaggggctgaaaaaccaggcggagatggtcgacgacatctggaacgtgctgtactccgtgagcgagtgcgatgtcctcaaggacttcgccatcaacaagctgcagctggacgagaagaccgccgacaacttcagcaagaccaagctagcccagggattcgccacgctgtccctgaaggcgatccggaagatcctccccttcctggagcaggggttcggctacaccgaggccgtgttcctggccaacatccccaccgtggtcgggaaggagtactggaacaacgaggacatccgcaacgacatcatggaggagatcaagactatcttctaccacaacacgctcaagaccaacgacagccacaacaccattctgttctgcatcaaggacatcctgtccaacaactttgacctcgcccccggcgccatcgacaagctgtaccacccgagcatgataaacgtgtacaaggacgtgatccccaacgaggacggcatcctgcagctcgggtcccccaagatcgacgcggtcaagaaccccatggccatgcggagcctacacataatccgcaaggtggtgaacgagctgctgcgggagggtatcatcaactccgacactgaggtccgcatcgagtacgcccgggagctcaacgacgccaacaagcgccacgccatcgcggactggcagaagaagcagtacgggaagcaccagaagtaccggaaggagatcaaggagctgttcaaggccgagacgggcttcgagatcgagccgaacgagaccgacatcctgaagttcgagctctgggaggagcagaaccacatctgcctgtacaccgggcaggagatcggcatcagcgagttcgtgggcgagaaccccaagtacgacatcgaacacaccatcccccgctccctcgggggagacagcacgaagatgaacatgaccctgtgcgagaacaagttcaaccgggagaacaagcagaagaagctgccctccgagctggccaaccacagcgagatcctcgagcgcatcgacgactggaagaagaagatctatatactgcagaagaagtacgactccatccggacacacaacgggatggacaaggagaacaaggacaagaagatcgtcagccgccacaagatcaagctggagctcgactactggaagggcaagtacaaccgcttcaccatgaccgagatcccggaggggttctcccggcgccagggcatgggcatcgggctgatcagccggtacgccggcctttacctcaagaccatcttccacaagaaggacaacccccagaagagtaacgtgtacatcgtgaaggggagcatcaccgcggagttccgccggatttggaacatccaggacgactacgagaagaagtgccgcgacaaccacatccaccactgcatcgacgccatcgtcgtgggctgcatcggcaaacgggagtacgacctgatggcccagttctaccgcgacgaggaaaagtaccggtgggagaagaagaagaagcccttcttcaagaagccctgggagaccttcacgcaggacatgctgtccctcaaggatgaggtgctgaccgtccacttcaacccgagcaatttcaccaagaaggcccacaagaaggtgttcacccctaaggggatcttcgtggcccagggcgactgcgcgcgcgtcaagctgcacaaggggagctacttcggcgctatcgagcagaagggggagatcaagtacgtgatgcggaagaagctctccgccttaaagatcgaggacatcgagcacatcgtggacgccgtcgtgaaggagaaggtgctggccgtcgtgaagaagaagggcttcaaacaggcgatggccgaacccatctacatgaacgaggacaagcgcatcctcatcaagaaggtgcggctgttcgtcagccagaccaaccccctgatcgtgaagaagcaccgggacctctccagcaaggagtataagcagaactactacgtggacaacgagggcaacctgatgatcgccatgtacgagggggtcaagaagaacggcaagatcgaccgggagataacggtggtgaataacctggaagccgccaagttcttccgccagtcccagaagaacaacgcggagaagcagctcatcagccacctgtccccaaagaacgggtaccccctgaagaccgtcctcacccagaagcagctggtgctgatgtatgaggacagccccaaggagatcaagctccgggacaccaagaatatggtaaagcgcctgtaccaggtcttcggcatcgagaaggacgggcgggtggagctgaagttccaccaggaggcccgctccgagggcttgaacaagaacagcgccgccttcaagatacaggacacgccggagtccctgtaccggcacaccaagagcaacctgaaggtgctcgtcaacggcgtggacttcaagatcaacatcctgggggagatctccctgatctga

SEQ ID NO: 7526 - RNA, 3654 nt, synthetic construct; identical to SEQ ID NO: 1726
  misc_feature 1..3654: note = Cas9 variant
  source 1..3654: mol_type = other RNA

SEQ ID NO: 7527 - RNA, 3657 nt, synthetic construct
  misc_feature 1..3657: note = Cas9 variant
  source 1..3657: mol_type = other RNA
atgaacaagcgcatcctgggcctcgatacgggtaccaacagcctaggctgggccgtggtcgactgggacgagcacgcccagtcctacgagctgatcaagtacggggacgtaatcttccaggaaggcgtgaaaatcgagaaggggatcgagagctcaaaggcggccgagcggagcggctacaaggccatccgcaagcagtacttccgacgccggctccgcaagatccaggtcctcaaggtgctggtcaagtaccacctctgcccatacctgtccgacgacgatctgcgccagtggcacctccagaagcagtaccccaagtcagacgagctgatgctttggcagcgcacgtccgacgaggagggcaagaacccgtactacgaccggcaccgctgcctccacgagaagctggaccttaccgtcgaggccgaccggtacaccctcgggcgcgccctgtaccacttgacccaacggcgcggcttcctctccaacaggctggacacgtccgcggacaacaaggaggacggggtggttaagtcagggatttcccagctgagcaccgagatggaggaggccgggtgtgaatatttgggcgactatttctacaagctgtaccacgagcagggcaacaaggtgcgcatccggcaacgctacaccgaccggaagaagcactaccagcacgagttcgacgccatctgcgagaagcaggagctgtccagcgagctcatcgaggacctgcagcgcgccatcttcttccagttgccgctcaagagccagcgccacggggtgggccgctgcaccttcgagcgcgggaagccccggtgcgcggacagccacccggactacgaggagttccgcatgctgtgcttcgtgaacaacatccaggtcaagggcccccacgacttagagttgcggcccctaacgtacgaggagcgcgagaagatagagcacctgttcttccggaagtcaaaacccaacttcgacttcgaggatatcgccaaagagctggccgggaagaagaattacgcctggatccacgacaaagaggagcgcgcctacaagttcaactaccgcatgacccagggggtgccgggctgccccaccaccgcgcagctcaagagcatcttcggggacgactggaagacgggcatcgccgagacctacacccttatccagaagaagaacggatccaagtcactgcaggagatggtggatgacgtctggaacgtcctgtactcattctcctctgtggagaaactaaaggagttcgcccaccacaagctccagctggacgaagagaacgccgagaagttcgccaagatcaagctgtcccactccttcgcggcgctctccctgaaggccatccgcaagttcctgcccttcctgcggaagggcatgtactacacccacgccagcttcttcgccaacatccccacgatcgtcggcaaggagatctggaacaacgagcagtcccgcaagtacatcatggagaacgtgggggagctggtgttcaactaccagccgaagcaccgggacgttcagggcaccatcgagatgcttatcaaggacttcctcgcgaacaacttcgagctgcccgccggggccacggacaagctgtaccaccccagcatgatagagacctacccccacgccctgcgcaacgagttcggcatcctccaactgggttccccgcggacgaacgccatccgcaaccccatggcgatgcggagcctgcacgtgctccgtcgggtggtcaaccagctgctgaaggagtctatcatcgacgaaaacaccgaggtgcacgtcgagtacgcccgcgagctcaatgacgccaacaaacggcgcgccatagcggaccgccagaaagagcaggacaagcagcacaagaaatatggcgacgagattcggaagctgtacaaggaagagaccggcaaggacatcgaacccacccagacggacgtgctaaagttccagctctgggaggagcagaaccactactgcctgtacaccggggagcagatcggcatcaccgatttcatcgggagcaaccccaagttcgacatcgagcacaccatcccgcagtcggtgggcggggacagcacgcagatgaacctgaccctctgcgacaaccgctttaaccgggaggtcaagaaggccaagctgcccaccgagctggcgaaccacgaggagatcctaacccgcatcgagccctggaagaacaagtacgagcagctggtgaaggagcgggacaagcagcgcaccttcgccggcatggacaaagccgtgaaggacatccggatacagaagcgccataagctgcagatggagattgactattggcggggcaagtatgagcgcttcaccatgaccgaggtcccggagggtttctcccggcgccagggcaccggcatcggcctcatcagtcggtacgcgggcctatacctgaagtccctcttccaccaggcagacagccggaacaagagtaacgtctacgtggtcaagggagtcgcaacggccgagttccggaaaatgtggggcctgcagagcgagtacgagaaaaagtgccgcgacaaccacagccaccactgtatggatgcaatcaccatcgcgtgcatcgggaagcgggagtacgacctgatggccgagtattaccacatggaggagaccttccgccagggccggggttcaaaaccgaagttctcgaagccctgggccaccttcaccgaggacgttttaaacatttacaagaacctgctggtcgtgcacgatacgcccaacaacatgcccaagcacaccaagaagtacgtccagacttccaagggcaaggtcctcgcccagggcgacaccgcccgcgggagcctgcacctggacacgtactacggcgctatcgagcgggacggggagatccgctacgtggtgcgccggccgctctccagcttcaccaaccccaaggagctggagaacatcgtagacgagaccgtgaagcgcacgatcaaggaggccatcgccgacaagaacttcaaacaggccatcgcggagcccatttacatgaacgaggacaagggcatactgattaagaaggtacggtgcttcgccaactccgtcaagcagcccatcaacattcgccagcaccgggacctcagcaagaaggagtacaagcagcagtaccacgtgatgaacgagaacaactatctgcttgccatctacgaggggctcgtgaagaacaaggtggtgcgcgagttcgagatcgtgtcctacatcgaggccgccaagtactacaaacggagccaggaccgcaacatcttctccagcatcgtccccacgcactccaccaagtacggcctgcccctgaagaccaagctcctgatgggccaacaggtgctaatgttcgaggagaaccccgacgagatccaggtggacaacacgaaggacctcgtgaagcggctgtacaaggtggtggggatcgagaaggatggccgcatcaaattcaagcaccaccaggaagcgcggaaggaggggctgactatctacagcaccccgtataagaacaacgacgactacgtccccatcttccgccagtccatcaagaacatcaacatcctcgtggacggcattgacttcaacatcgacatcctggggaaggtgaccctgaaggagtga

SEQ ID NO: 7528 - RNA, 3657 nt, synthetic construct
  misc_feature 1..3657: note = Cas9 variant
  source 1..3657: mol_type = other RNA
atgaacaagcgcatcctgggcctcgacaccgggaccaacagcctgggctgggccgtggtcgactgggacgagcacgcccagtcctacgagctgatcaagtacggggatgtgatcttccaggagggcgtgaagatcgagaaggggatcgagagctccaaggcggctgagcggagcggctacaaggccatccgcaagcagtacttccggcgccgactcagaaagatccaggtcctgaaggtgctggtgaagtaccacctctgcccctacctgtcagacgatgacctgcggcagtggcacctccagaagcagtaccccaagagcgacgagctaatgctgtggcagcgcacgtccgatgaggagggcaagaacccctactacgaccggcacagatgcctccacgagaagctggacctgaccgtcgaggccgaccggtacaccctcgggagggccctgtaccacctgacccagcggcgcggctttctcagcaaccggctggacacgtcagcggacaacaaggaggacggggtggtcaagagcggcatctcccagctgtccaccgagatggaggaggccgggtgcgagtacctcggcgactacttctacaagctgtacgacgcccagggcaacaaggtgcgcatccggcaacgctacaccgaccggaacaagcactaccagcacgagttcgacgccatctgcgagaagcaagagctgtcctcagagctgatcgaggacctgcaacgcgcgatcttcttccagctgcccctcaagtcccagcggcacggggtaggccgctgcaccttcgagcgcgggaaaccccggtgcgccgacagccacccggactacgaggagttccgcatgctgtgcttcgtgaacaacatccaggtcaagggcccccacgacctggaactccggcccctgacgtacgaagaacgcgagaagatcgagcccctgttcttccggaagtccaagccgaacttcgacttcgaggacatcgccaaggccttggccggcaagaagaactacgcgtggatccacgacaaggaggagcgcgcttataagtttaattaccggatgacccagggggtgcccggctgccccactatcgcccagctcaagagcatcttcggggacgactggaagaccggcatcgccgagacgtacacactgatccagaaaaagaacgggtccaagagcctgcaggagatggtggacgacgtctggaacgtgctgtacagcttctccagcgtggagaagctgaaggagttcgcccaccacaagctccagctggacgaggagtccgcggagaagttcgccaagatcaaactgtctcactcctttgccgccctcagcctgaaagccatccggaagttcctacccttcctccggaagggcatgtactacacccacgcgtccttcttcgccaacatcccgaccatcgtcggcaaggagatctggaacaaggagcagaaccgcaagtacatcatggagaacgtgggggagctggtgttcaactaccagcccaagcaccgggaggtccagggcacgatcgagatgctgatcaaggacttcctcgccaacaacttcgagctgcccgccggggccaccgacaagctgtaccaccccagcatgatcgagacttacccgaacgcgcagcgcaacgagttcggcatcctgcagctcgggtccccgcggaccaacgccatccgcaaccccatggccatgcggagcctgcacatcctgcgccgcgtggtgaaccagctcctgaaggagtccatcatcgacgagaacacggaggtccacgtggagtacgcccgcgagctgaacgacgcgaacaagcggcgcgccatcgccgaccgccagaaggagcaggacaagcagcacaagaagtacggcgacgagatccggaaactctacaaggaggaaaccggcaaggacatcgagcccacccagaccgacgtgctgaagttccagctgtgggaggaacagaaccaccactgcttgtacacgggggagcagatcggcatcaccgacttcatcgggagcaacccgaagttcgacatcgagcacaccatcccccagtccgtgggcggggacagcacccagatgaacctgacgctgtgcgacaaccgcttcaaccgggaggtgaagaaggccaagctccccaccgagctggccaaccacgaggagatcctgacccgcatcgagccctggaagaataagtacgagcagctcgtcaaggagagggacaagcagcgcaccttcgcgggcatggacaaagccgtgaaggacatccggattcagaagcgccacaagctgcagatggagatcgactactggcggggcaagtacgagcgattcacgatgaccgaggtgccggaggggttctcccggcgccagggcaccgggatcggcctgataagccggtacgcaggcctctacctgaagtccctcttccaccaggccgacagccgcaacaagtccaacgtctacgtggtgaagggggtcgccaccgcggagttccggaagatgtggggcctccagagcgagtacgagaagaagtgccgcgacaaccacagccaccactgcatggacgccatcacgatcgcctgcatcgggaagcgggagtatgacctgatggccgagtactaccgcatggaggagaccttcaagcagggccgggggtccaagcccaagttcagcaagccctgggccaccttcaccgaggacgtgttaaacatctacaagaacctccttgtggttcacgacacccccaacaacatgcccaagcacacgaagaaatacgtgcagacctccatcggcaaggtgctggcgcagggcgacaccgcccgcgggagcctccacctggacacctactacggcgccatcgagcgggacggggagatccgctacgtcgtgcgccggcccctgtccagtttcacgaagcccgaggagctcgagaacatcgtggacgagaccgtcaagcgcaccatcaaggaggccatcgcggacaagaacttcaagcaggccatcgccgagccgatctacatgaacgaggagaagggcatcctgatcaagaaggtgcggtgtttcgcgaagtccgtcaagcagcccatcaacatccgccagcaccgggacctgagcaagaaggagtacaagcagcagtaccacgtcatgaacgagaacaactacctcctggccatctacgaagggctggtgaagaacaaggtggtccgcgagttcgagatcgtgtcctacatcgaagcggccaagtactacaagcggagccaggaccgcaacatcttctccagcatcgtgcctacccactccacgaagtacggcctccccctgaagaccaagctgctcatgggccagctggtcctgatgttcgaggagaacccggacgagatccaggtggacaacaccaaggacctcgtgaagcggctgtacaaggtcgtggggatcgagaaagatggccgcatcaagttcaaataccaccaagaggcccggaaggaggggctgcccatcttcagcaccccctacaagaacaacgacgactacgcccccatcttccgccagtccatcaacaacatcaacatcctcgtggacggcatcgacttcacgatcgacatcctggggaaggtcaccctgaaggagtga

SEQ ID NO: 7529 - RNA, 3657 nt, synthetic construct
  misc_feature 1..3657: note = Cas9 variant
  source 1..3657: mol_type = other RNA
atgaacaaacgcatactcggactcgacaccgggaccaacagcctaggatgggccgtcgtggactgggacgaacacgctcaatcctacgagtttatcaaatacggagacgttatcttccaagaaggtgtaaagatagaaaaaggaatcgaatcatcaaaggccgccgagcgctcaggctacaaggccatacgcaaacaatacttcagacgccgcctccgcaaaattcaggtcctcaaagtgctagtaaaataccacctatgtccgtacctcagcgacgacgacttgcgccaatggcacttacagaaacaataccccaagagcgatgaacttatgctatggcaacgcacatcggataagaaaggcaaaaacccgtactacgacagacacaggtgcctccacgaaaaactagacctaaccgtagaggccgatcgctataccctaggacgtgccctctaccacctcacacaacgccgcggctttcttagcaaccgcctagacacgagcgccgacaacaaagaggacggggtcgtcaaaagcgggatatcacagctaagcactgaaatggaagaagccggatgcgaatatctcggcgactatttctacaagctatacgacgaacaaggcaataaagtccgaatccggcaacgttataccgaccgcaacaaacactatcagcacgagttcgacgcaatatgtgaaaagcaagaactcagctccgaactcatcgaagatctacaaagagcaatcttcttccaactgcccctgaaaagccaacgccacggggtaggccgctgcaccttcgaacgcggtaaacccagatgcgcggattcgcaccccgactacgaagaatttcgcatgctctgcttcgtaaacaacatccaagtcaagggcccacatgacctggaactgcgccccctcacctacgaagaacgcgagaaaatagaacccctcttcttcaggaaatcaaaaccaaatttcgactttgaagacatagctaaggccctggcaggcaagaaaaattacgcatggatacacgacaaagaagaacgcgcctacaagttcaactacagaatgacccaaggagtcccaggctgcccgaccactgcccaactcaaatccatattcggcgacgactggaaaacagggatagcagaaacgtacacactaatccaaaagaaaaacggatccaaatccctccaagaaatggaagacgacgtttggaacgtgctctacagcttttcgtccgtagagaaacttaaagagttcgcgcaccataagctgcaactcgacgaagaaagcgccgaaaaattcgccaaaataaagctaagccactccttcgcggccctatcgctcaaagccatccgaaaattcctacccttcctccgaaaaggcatgtactatacccacgcctcattctttgccaacatacccacaatcgtgggcaaagaaatctggaacaacgaacagaaccgcaaatatatcatggaaaacgtcggcgagctagtgtttaactatcagccaaaacacagagaagtccaagggaccatcgagatgcttatcaaagacttcctcgccaacaacttcgaactacccgcaggagcaacagacaaactgtaccacccgtccatgatcgaaacctacccccacgcacagcggaacgagttcggcatcctacagctcggaagccctcgcacaaacgccatcagaaaccccatggcgatgcgctccctacacatcctgcgccgcgtcgtcaaccagctgctaaaagaatcaatcatagacgaaaacacagaagtgcacgtagaatacgcacgcgagctcaacgatgccaataaacggcgcgccatcgcaggatggcaaaaggagcaagacaaacaacacaagaaatacgtagacgaaatacgcaaactctacaaagaggaaaccggcaaagacatagaaccgacacagaccgatgtcctgaaattccaactatgggaggagcaggaccaccactgcctatacacaggcgagcaaataggcatcaccgacttcataggcagtaaccccaaattcgacatagaacacacgataccacaatcagtcggcggcgactccacccaaatgaacctcacactctgcgataaccggttcaaccgcgaaataaagaaagccaaactcccagcacagctctcgaaccacgaggagatcctggcaagaatcgaaccctggaaaaacaaatacgagcagaagataaaagagcgggacaaacaacgcacgttcgcaggcatggacaaggcggtcaaagacctccgtatccaaaagagacataaactccagatggatattgactactggcggggaaaatacgaacgattcacaatgaccgaggttcccgaagggttttcacgtcggcaaggaacaggcatcggactcatctcccggtacgctggactctacctaaaatcactgttccaccaggcagacagcagaaacaaatcaaacgtctacgtggtcaaaggtgtggccaccgcggagttccggaaaatgtggggactgcagagcgaatatgaaaagaaatgccgcgacaaccattcccaccattgtatggacgcaatcaccatagcctgcatcggcaaaagggaatacgacctgatggcagagtactaccgcatggaagaaaccttccggcaagggcgcgggtccaaacctaaattcagcaaaccatgggcaaccttcaccgaagacgtcctaaacatctacaaaaacctcctcgtagtccatgacactccaaacaacatgcccaaacacactaagaaatacgtccaaacatccaaagggaaagtgctagcccaaggagacaccgcccgcggatccctacacctcgacacatactacggcgccatcgaacgcgacggcgagataaggtatgtcgtacgccgaccactaagcagcttcacaaagcccaaagaactcgaaaacattgtcgacgaaaccgttaagagaacaatcaaagaggccatcgcagacaaaaacttcaaacaagccatagctgaacccatctatatgaatgaagacaaggggatactcatcaagaaagtgcgatgcttcgcaaaaagcgtaaaacaaccgatcaacataagacaacacagagacttatccaagaaagaatacaaacaacaataccacgtggtgaacgaaaacaactacatgctagtaatatacgaaggactcgtcaaaaacaaagtagtaagagagttcgaaatagtaagctacatcgaagcggccaaatattacaaacgctcccaagaccgcaacatcttctcgtctatagtacccacacacagcgcgaagtatggactccccctaaaaacaaaactgctcatgggccaactggtactaatgttcgaggaaaatccagacgaaatacaagtcgacaacactaaggacctggtcaagagactatataaagtggtaggcattaagaaagacggccgagtaaaattcaaattccaccaggaagcacgcaaggacggactcctcatcttctccacgccctacaaaaacaacaacggctatgtcccaatattccgacactcaaagaaaaatataaacatcctcgtcgacggcaaagacttcacaatagatatactcggtaaggttaccctaaaagaatga

SEQ ID NO: 7530 - RNA, 3660 nt, synthetic construct
  misc_feature 1..3660: note = Cas9 variant
  source 1..3660: mol_type = other RNA
atgaaggaggaggtgcgcggtaagaatagaagccagacctgggccatcctggccaagttcttcgtctggtccgagaaggagagcgtgtggaacgagaaggaggcgcgcaccgaggagcgggtgaaagagtataagctcgtcgggctgaagcgcgacacgaagggcaacgagctgaagctcgagaactatcggtggcgcgtgcaggcactgtccgagcagctgaaccccgagatcgtggccatcgtcctccaggagatcaacgggcagatcagcgcctccagcggctatctgggcgccatctccgatcggagcaagcagctgtacttcaaccgccagaccgtgggccagtacctcatgtctgagctggagaaggacccgaacgtgagcctgcggaacagagtcttctaccggcaggactacctcgacgagttcgaccgcatctgggagaagcaggcggagttccacgaggagctgaccgtggagctgaagaaggagatccgggacatcatcatcttctaccagcgccggctcaagtcccagaagggcctgatcagcttctgcgagtttgagaagcgcgaggtggtcgtggaagaggacggtcggaagaagaataagaccgtgggctgccgcgtcatcccccggtcccaccccctgttccaggagttcaagatctggcagacgctcaacgacatcgaggtgttcgcctgggacaagcagagcaagcgcaagaaggcagacaagtccagcatcctgttcgacaactccgaggacgccctactcgtggaggggaagaggttcctgtaccaggaagagaaggagctgctcgcgaaggagctgttcgttaaggagagcatgaagaaggccgaggtgctgaagctcctatttgagaactaccaggagctggacctcaacttcaagcagatcgacggcaatcacacggggttcgcgctgttctccgcctacagcaagatgatcgagaagtacggctacgagcccgtggacttcaagcgcagcgccgacgagatcatcgagaagctggagaccatcttcaccaacctcggctggaatacggagctgctgtccatcgacctctccaaggaggacaaggagctggagcgccagtcctacttccggctctggcacctcctgtacagcttcgagggggacaacaccccgaccggcaacgggaagctgctcgagaagatcatgcagctgtgcgacgtcgagaaggagtacgcggtggagctggccaacgtgtccttccaggaggactacggcagcctctccgccaaggccatcaagaagatactgccctacctgaaggagggcaaccagtacgacgtcgcctgcgactacgcggggtaccgccacagccgatccagcctcaccaaggacgagatcgagaacaagatcctgaaggacaagctggagatcctgcccaaaaactccctccgcaaccccgtggtcgagaagatcctgaaccagatggtgaacctgatcaacaccctcatcgacacctacggcaagccggacgagatccgggtggagctggccagggagctgaagaaaaacgccaaggagcgggaggaactcaccaagagcatcgcccgcaacacccgggaacacgacgagatccgccagcttctgcggacggagttcgggatgatgaacgtctcccgcaacgacatcatccggtacaagctctacgaggagcttaaggacaacggctacaagaccctgtatagcaacgagtacatcccccgcgagaagatcttctccaaggagatcgatatcgagcacgtgatcccccaggcccgcctcttcgacgacagcctgtccaacaagaccctggagtaccgggcgatcaacattgagaaggggaacaagaccgcgtacgacttcgtgaaggagaagtacggcaacgacggcctcgagaagttcctgaaccggtgcgagacgctgttcaaggacaagcgcaccaagctccggaagctgaagatggaggagaaggacatccccgaggggttcatcgaccgcgacctgcgcaacacccaatacatcagcaagaaggccttcgccatgctcaacgagatctcccggcgcgtcgtggccaccacgggcagcatcaccgacaagctgcgggaggactggcagctggtggacctcatgaaggagcttaacctgccgaagtacgagaagctcgggatggtcgagatgttcgaggacaaggacggccgcaagatcaagaagattaccgactggaccaagcggaacgaccaccgccaccacgcggtggacgccctgacggtggccttcaccaaggacgtcttcatccagttctacaacaacaagaacgccgcgtggatgcccgccagcaaggagcacgccaacatcaccgggatcaaggcccggtacttcgagaacgggaaggccctggcacccatgcccctcgcccagttccgcgccgaggccaagcgtcacctggagaacctgctcgtgtccatcaaggccaagaacaaggtgatcactagcaatgttaaccgcacgaagaacaagaacggcgagaaccggaagctgcagcagaccccgcgcgggcaactgcacctcgagaccgtgtacggctcccaccggcagtacgctaccaagatcgagaaggtgaacgccgccttcgacgtcacgaagatcgccaccgtgagcaagctggcctaccgcaacgcgcttctcaagcggctggaggcctttgggaacgaccccaagaaggccttcaccggcaagaacactttagagaagaaccccctctacctggacgagaaccagaccgagatggtgcccgaaaaggtccagacggtagagttcgagaccgtgtacaccatccgcaagccgatcgaccccaacctgtccatcgacaaggtcgtggacgtgaagataaggagcgtcctcgagaagcgcctgaaggagtacgggggcgacgccaagaaggctttcgtgaacctggacgagaacccaatctggctcaacgaggccaagggcatctccatcaagcgggtgagcatccgcgggatctccaacgcacagagcctgcacgagaagaaggacaaggatggcaacctgatcctcgggaaggagggacggaagatccccgtcgacttcgtgaacaccggcaacaaccaccacgtggccatctacaagaagccggtcctggacaaggtgggccaggtggtccttgacgaggaggggaaccccaagtacgaactcgatgaggtggtggtctccttcttcgacgcagtgactcgcgcgaacctggggcagcccatcatcgacaaagactaccgccggagcgaaggctggcaattcctgttctccatgaagcagaacgagtacttcgtgttccccaacgacaagaccgggttcaacccgaaggaagtcgacctcctgaaccccgagaactacgcgctgatcagccccaacctcttccgagtccagaagttcgcctacaagaactatgtgttccggcaccacctggagaccaccatcaaggacacgtcatcaacactgaagggaatcacctggaccgacttccgctccagcaagggcctcgacaagatcgtcaaggtgcgggtggaccacatcggccagatcgttagcatcggcgagtactga

SEQ ID NO: 7531 - RNA, 3663 nt, synthetic construct
  misc_feature 1..3663: note = Cas9 variant
  source 1..3663: mol_type = other RNA
atgaaacgcatcctgggcctcgacctgggaagcgcctcaatcggctgggccctgatcgaggaggacgagaaggggatccggatcatcgcgctcggctcgcggatcatcccctacaacgggaccgagggtcaggacttcgccaagggcgccggggagtcccgaaatagcctacgcacccaggcccggacgacccgcaaggggtacgaccggtaccaactgcgccggaaatacctcatcaacgtgctggagaagaatctgatgatgccgtccgaggatctccgcaagatgcccaagatgaacctgtggcagctgcggagcaaggccgtcaccgagtacatctcccgccaagagctcgggcggctgcttctctggctgaatcagaaacgaggctacaagagctcccggagtgacgcgaacctggataagaaagacacggactatgtgaaggaagtcaagtcacgcttcgacaagatcaaggagaagaaccagacgatcggtcagtacttctacgaaagcctccagtgcgacgagtacttccgggtcaaggagaacgtgttcccccgcgaggcctacatcgccgagttcgacgccatttgctcccggcaaaaggaccacctgggcctgagcgaggagctcatcgccgagatccgaaacgagatcatctactaccagcggccgctgaagtcccagaagggccttgtgagcgtctacgacttcgaggggaagtggatgaatcagaacggcaaggagctgttcattgggccgaaggtggcccataaatcaagccccctcttccagctggccaagatctgggagtccgtcaacaacataaagctctctacgaagtatggcgataccatcgagctgaccctggaggaaaagaagcagctcgtagagttcctggacaacaacgagaagctgacgaccgccgccctcttcaagatcctacgtaaggacaagaaggagtacatcctgcccaagcagctcgagaagggcctgcagggcaacatcaccaagtgcaaaatcgcggacatcttgggcagcaagtacaaccagttactgcagctgaacctcgagaagcaagaggtggggaccccctgctacctgtacacgaaatccaccggagaagtgctgggggaaaagccgttacagtacatcgacaaaagcgtcgaaaaggaactgttctaccagctgtggcacaccatctactccatttctgacgaggacgagtgctgcaaggccctgcaaaagcgcttcgacatcgacgctgagaccgccggccggttagccaagatcgacttctccaagtatggcttcggaaacaagagcgcaaaggctatccgtaagattctgccctaccttatggagggcgacaagtatagcgacgccatgtgctacgccgggtacaaccacagcaactccctcacgaaggaggaaaaccacgaacggaagctgaacgacaagttaaagctcctgaccaagaacagtctgcgccagcccatcgtggagaagatcatgaaccagatgatccagctagtgaacacaatcatcgacaagtacggcaagccagacgaaatccggctggagctggcacgggaacttaaacagtccaaggaggagcggaacgatgcggacaaagccatgagcaagcgccagcgggagaacaaggaggccgaaaagaaactggaggagcacgggatccgcgccacccataacaacatcttgaagtaccgcctcttcgaggagatgggagaaaagaagcacgaggccatctgcatctactgcggcaacccgatcagttttagcgcggccatgaacggggacgaggtcgacgtggagcacatcatccctcggtccaagctgttcgacgacagccagtccaacaagacgttagcccacagaaagtgtaacgccaacaagaacgatatgactgcgtatgattttatgaagaccaagagcaaacaggacttcgacaagtacgtggagcgcgtaaaccagctctacgccgaccgaatcatctcccgcagcaaatacaacaagctgctgatgagcgaggacgacattccctccaacttcatcgaccggcagctccgcgaaagccagtacatcgccacgaaggcccgggaaatcctgcagacgatctgctacaacgtttggtccaccagcggcaccgtgaccgccgagctgcgccacctctgggggtgggacgacatcacaatgaacttacaaatgcccaaatacaaggagctgggcctcaccgagatggtcgagtggacctccgatcacggaaagaacgtgcactcgaaggaggttatcaagggctggacgaagcgcgacgaccaccggcaccatgcgatcgacgccctaacgattgcctgcaccaagcaaggcttcatccaacgcttcaacaccctgtccagctctaagacccgggacgacatgcagaaggagctcgagaagtgcagcattcagttccgcgagaagcggtccctgctagagaagtacatcatcagccagcgcccgatatccgtgagcgacgtggccgaggccgtatctcggattctcatttctttcaaagcggggaagaaagtggccaccataggcaagcgcaaggtaaaggggaaagtcgtgcagcagggcatcgtggtcccccggggcgccctgtccgaggggagcgtatatggcaagattcgaactatcgtccggaagatgcccgtgaagtacctgttcgaaaaccccgacctgatctttaagccgtacatcaaggctctagtgaaggagcgcctggccgagttcgacaacgacaataagcaggcattggccagcctgaagaagaaccccgtgtatctggacaaggagaagactaagctcctagagtacgggacctgcttcaaagacgagtacgtcaaaaagtacgacgtcaaccccaacttcaccaagatcgccgacgtgatcgacggcaaggtcaagcagatcctggaggaccggctctctaagttcgggggcaaacccaaggaggccttcaaggacgtggtgaaggacggcaaaacgctgaagtggtacgaggacgaggggctagagcgccctatccgaagcgtccgctgcctcaccggcttgtccgcggtggtgcccgtcaagaaggacgagaacggtatggacataggcttcgtgaagcccggcaacaaccaccacgtggccatctacgtcggcgccgacggcaaggggcaggagcacgtgtgcaccttctggaatgcagtggagcggaaaaagtacgggctgcccatcatcatcaaggacgcgaacgaggtctgggacaagatcaccatggcgggggacgacgtgtaccctcagagcttcttatccctgttgcctaagcccgactggacgttaaagctgagcatgcagcagaacgagatgttcattctgggcatggaggaggacgaggtaaagttcgctatagagtccaaggactacaaactcctgagcgaccacctgtaccgcgtccagaagctctccagctccgactataacttcatccaccacctggagaccgacgtgcagaagaagaccatgacctatcgggtgcgcagcctgtccggtctcttcgccttgcggccgttcaaggtccggatcgactgcctggggaacatcatccccagctga

SEQ ID NO: 7532 - RNA, 3669 nt, synthetic construct
  misc_feature 1..3669: note = Cas9 variant
  source 1..3669: mol_type = other RNA
atgaagaagcgcatcctgggcctcgatagcgggactaactccctgggctgggccgtggtagaccgggacgagaacaatcagtacagcctgatcaaatacggggacctcatatttgaggagggcgtgaagatcgagaagggggtggagtccagcaaggctgcggaacgcacatcccaccgggctctgcgcaaactttacttccggcgacgactccgcaagatcgaggtcctgaaggtgctggtgaagtacaacctctgcccccaggtcagcgaggaggagctgcacctgtggcacacgcgaaagctctaccctcagaataaggacctgctgcagtggcagcgcaccgacgagaaggccgggaaaaacccctacatctaccggtaccgctgcttgcacgaggagttggacatgtccgtgagcgccaaccggatgactgtgggccgcgccatgtaccacctggcgcagcggcgcgggttcctctccaacagactggacaacgaggaggacgagaaccaaatcggcgcggttaagtgcgggataagcaacctcaccgaggagatccagtcctctggctgcaagtacctcggggagtacttctataagctgtacaacgagcacggcaacacggtgcgcctgcggacccgctacacatcccgggagttccactacaagaaggagttctacgccatctgcgagaaacagaagctcgacaagaaacttatcgaggagctggccagcgcgctctacttccagcgccccctgaagtcccagcgccacaccgtgggtcggtgcacgttcgagcccaataagccgcgctgcgccgacagccaccccgcctacgaggagttccggatgctgtccttcatcaacacaatcaaggtacaggggccctacgacaccgagctccgtgtgctaaacaccgaggagcgagatagcatcacgaagctgttctgccgcaagagcaagcccaacttcgacttcgaggacatcgccaaagagctcgccggccgtaacaattactgctacatcggtgacgtggttgacaaagcgtacaagttcaactatcgcatgagccagggcgtgagcggctgcccgaccaccacgtacctgatcaacgtgttcgggcaggactggcagaccggcatcgccgagtcctaccaggcgatcgacaccaaactggggcaaaagtcagtcgacgccatgatcgacgatgtttggaacgtgctctactccttcagctccaaggataagttacgggacttcggccgcaagaagctgcagctcggggacaaggaggccgacaccttcgcaaacataaagctgacccacaagttcgccagcctgtccctcaaggccatccggaagatcaacatcttcctgcgcatgggcctagtctacagccacgccgtgacgctcgccaatatccccaccatcgtgggcaccgacatctggcagcggaagaggaacttcatcctggcggagttactccccctgatcgagaacttcaaccctaaggagacaaagctgcaggaaacgctggacttctgcgtcaaggacttcctccagaacaactttgaactgaagaacggggctgtggacaagctgtatcacccgtccatgatcgaggcttatcccgacgccggcctcaactccaacgggatcctgcagctgggcagcccacggaccaacgccatccgcaaccctatggcgatgcggagcctccacgagatccgcaaggtcatcaaccagctgctgaaggataaaatcatcaaccaggacaccgaaatccacgtggaatacgcccgagagttgaacgacgccaacaagcggaaagctatctctatctggcagaagtcccaggagaagctgcacaaaaagtacgtagaggaaatcaccaacctgtacaaggaggagacggggaaggcgatcgtcccgaccgacaccgacatcctaaagttcaagctgtgggaagaacagaaccacatctgcctttacaccggccagcagatcggcatcgccgagttcctcggcgccacgcccaagtacgacatcgagcacaccatcccccagagcgtgggcggtgacagcaccgatatgaacctgaccctgtgcgactcccgcttcaaccgggagatcaagaaggcacagctccccacccagctgggcaatcacgcggacatcctggtgcgcatcgctgggtggaaaaacagctacgagaagctaagcaaggacatcgatcgaatacggacccacagcggcatggccaaggacatcaaagatcggctgatccagaagcgccacctcctgaagctagagcgcgactactggcgcggcaagtacgagcggttcaccatgaacgagatcccggagggttttagccgacggcagggcgtcgggatcggcctgatctccaagtacgcgggcttgtacctcaaaagcctgttccacgacaagaacgagaggaacaaggggcacgtgttcgtggtcaagggcaccaccacggctgagttccggaagatgtggggacttcagaacgagtacgagaaaaagtcccgcaacaaccacgtgcaccactgcatcgacgccatcaccattgcatgcatcggaaagcacgagtacgctcaaatggcccagtactaccacgacgaggccgaatacctgtaccatcacggaatcaagccaatcttccccaagccctggaagaccttcaccgaggacctgctcgacttagagcattccctgttcgtcgtccaccactccccgaacaacatggcaaagcaggcgcgaaagcgcatcatcacgtctaccggccagcactgggcccagggcgattccgcccacgggagcttgcacaacgatacgtattacggcgccatcgagcgggacggcgagatcaagtacgtggtgcgccgggcggtgtccagcttcgaacagatgtccgacgtcgacagcatcgtggacgacgtcgtgaaggaaaccgtgcgcaaagcacttgagggcaaaaacttcaaggaggccgtcaacgctcccatatacatgaacaaggagaagggggtgctgatcaagaaggtgcggtgctacgccaagtcaattaagaaaccgatcgacatccgcacgcaccgcgactcatccagcaaggagtataagcggaagttccatgtctccaatgacatcaactacctcatcgcgatatacgagggcaccgtgaagggcaaggtgaagcgcgacttcgaggtggtaaagaacatcgaggccgccaacttctttaaacggtcccaggaccggcgggactatcccaccatcgtgccggagaagtccatcaagcacgggttccccctgaagaccacgctgaccaacggtacaatggttatcctctacgaagagaacaaggaggagatcgactttaccaagaaggaggatatctgtcgccggctttacaagctcgtgggcatgagcagcatgatcgtttccggctgcgagtacggggtcctctcactgcgccaccaccaggaggcccggccctccaaggacatcaagtcaaagaacggcgccttcaagaacggcgaggcgctgcgcccggctatcactatgctccacacccagttcaatgccctggtggaaaacatcgacttcaacatcgacgtgaccgggaatatagagctaatctga

SEQ ID NO: 7533 - RNA, 3669 nt, synthetic construct
  misc_feature 1..3669: note = Cas9 variant
  source 1..3669: mol_type = other RNA
atgaagaagcgaatcctggggctcgatagcggaaccaattcactgggctgggccgtggtcgaccgggacgagaataaccagtacagcctgatcaaatacggggatctcattttcgaagagggcgtaaaaatagagaagggggtggagtccagcaaggcggccgagcgcacctcccaccgggccctgcgcaagctgtacttccggaggcggctcaggaagatcgaagtcctgaaggtccttgtgaagtacaacctttgcccccaggtcagcgaggaggagctgcacctgtggcacacgcggaagctctacccgcagaacaaggacctgctgcagtggcagcgcacagacgagaaggagggaaagaacccctacatctacagataccgctgcctgcatgaggagctggacatgtccgtgtcggccaaccggatgaccgtgggccgcgccatgtaccacctggcgcagcggagagggttcttgtccaaccggctggacaacgaggaggacgagaaccagataggagcggtcaagtgcggaatcagcaacctaactgaggagatccagtccagcggctgcaagtacctgggggagtacttctacaaactttacaacgaacatggcaacacggtgcgcctacggactcgctacacctcccgggagttccactacaagaaggagttctacgccatatgcgagaagcagaagctcgacaagaagctgattgaagaactggccagcgccctctacttccagcgccccctgaagtcccagcgccacaccgtgggccggtgcacgttcgagcccaacaagccgcgctgtgcggacagccatcccgcctatgaggagttccggatgctgtccttcatcaacaccatcaaggtccaggggccttacgacaccgagctccgcgtgctgaacactgaggagcgggacagcataactaagctgttctgccgcaagtccaagcccaatttcgacttcgaggacatcgccaaggaacttgccggccggaataactattgctatatcggggacgtggtagacaaggcatacaagttcaactaccgcatgagccagggcgtaagcggctgcccgaccacaacctacctgatcaacgtgttcgggcaggactggcagacgggcatagctgagtcctaccaggcaatcgacacaaagctcgggcagaagtccgtcgatgccatgatcgacgacgtgtggaacgtgctctactcctttagctccaaggacaagctgcgggacttcggccgcaagaagctccagctcggtgacaaggaggccgataccttcgccaacatcaagctgacccacaaattcgcgagcctgtccctcaaggctatccggaagatcaacatcttcctgcggatgggcctggtctacagccacgccgtgacgctcgccaacatacccacgatcgttggtaccgacatctggcagcggaagcgaaacttcattctggccgagctgctccccctaatcgagaatttcaaccctaaggagaccaaactgcaggaaacgctagacttctgcgtcaaagacttcctccagaacaacttcgagctgaagaacggcgcagttgacaaactgtaccatccgtccatgatcgaggcctaccccgatgccggcctcaacagcaacgggatactgcagctgggcagcccccgtaccaacgccatccgcaaccccatggccatgcggagcctccatgagatccgcaaggtcataaaccagctgctgaaggacaagatcatcaatcaggacaccgagatccacgtggagtacgcgcgggagctcaacgacgctaacaagcgcaaggccatcagcatttggcagaagtcccaggagaagctgcacaagaagtacgtggaggagatcaccaacctgtacaaggaggagacggggaaggccatcgtcccgaccgacaccgatatcctcaagttcaagctgtgggaggagcaaaaccacatctgcctatacaccggccagcagatcggcatcgcagagttcctcggggcgacgcccaagtacgatatcgagcacaccattccccagagcgttggtggggacagcaccgacatgaacctgaccctgtgcgactcccgcttcaaccgggagatcaagaaggcacagttgcctacgcagctgggcaaccacgccgatatcctggtgcgcatcgcggggtggaagaactcttatgagaagctctccaaagatatcgaccgcatccgcacccatagcggcatggcgaaggatatcaaagaccggctcatccagaagcgccatctcctgaagctggaacgggactactggcgcggaaagtacgagcggttcaccatgaacgagatcccagaggggttcagtcgccgccaaggcgtagggatcggcctgatctccaagtacgccggcctctaccttaagagcctgttccatgataagaacgagcgcaacaaggggcacgttttcgtggtcaagggcaccaccacggccgagttccgtaagatgtgggggctgcagaacgagtacgagaagaagtcccgcaacaaccacgtacatcattgcatcgacgctatcacgatcgcttgcatcggcaaacacgaatacgcgcagatggcccagtactatcacgatgaggcggagtacctgtatcatcacgggatcaagcctatcttccccaagccctggaagaccttcaccgaggacctgctcgacttagagcacagcctgttcgtggtccaccactccccaaacaacatggcaaagcaagcccggaagcgcattatcacgagcaccggccagcactgggcgcagggcgactccgcccacgggagtctccacaatgacacctactacggcgccatcgaacgggatggggagatcaagtacgtggtgagacgcgcagtctcgtcattcgagcagatgtccgacgtggacagcatcgtggacgacgtcgtgaaggagaccgtgcgcaaagcgctcgagggcaagaacttcaaggaggccgtcaacgcccccatctacatgaacaaagagaaaggggtgctaattaagaaggtgcggtgctacgccaaatccatcaagaagcccatcgacatccggacacaccgcgacagcagttcaaaggagtacaagcggaagttccatgtctccaacgacataaactacctcattgccatttacgagggcaccgtgaagggcaaggtgaagcgcgacttcgaggtcgtgaagaatatcgaagcggccaacttcttcaagaggagccaggaccgccgggattacccgaccatcgtgccggagaagtccatcaagcacgggtttcccctgaagaccacgctgaccaacggaaccatggtcatcctctacgaggaaaacaaagaggagatcgacttcaccaagaaagaggacatctgccggcggctgtacaagctggtggggatgtccagcatgatcgtgtccggctgcgagtacggagtcttaagcctgcgccaccaccaggaggcccggccctccaaggacatcaagagcaagaacggcgccttcaagaacggcgaggccctgcggccagcgatcacgatgctccacacccagttcaacgccctcgtagagaacatagacttcaacatcgacgtgaccgggaacattgagctgatctga

SEQ ID NO: 7534 - RNA, 3678 nt, synthetic construct
  misc_feature 1..3678: note = Cas9 variant
  source 1..3678: mol_type = other RNA
atgagcaagcgcatcctgggtatcgacgtggggacaaacagcctcggctgggcggtcgtcgatcggacggactgcgacaactacacgctggtcaaacgcggggacgttatcttccaggagggcgttaacatcgagaaagggaacatcgaaaagtcccgggcgagcgagcgcaccgggcacaggagcacaagaaagcactacttccggcgcaggatgctaaagataaaggtgcttgaaatcttggtcgagcaccagctgtgcccctacctcagccacgaggaactgcaccagtggatgacacgtaaggtatacccaaccaacgaagacttcagactgtggctccgcacgaacgacgcgaacgaccaaaacccctaccacgacagacacgtgtgcctccacgagcgcctggacctcaggctgcaggagaaccgctataggcttggccgcgcactctaccacctggcccaacggagaggtttcttgagcaaccggctcgaacagaactccaagaccgacgagaccggcgccgtcaagagcgatatatcccaactgaacgaagagatgaagaaagccggaagccagtacctgggcgactacttttactggctctaccaggagtacggcaaccaagtgacactccgcatcaggtataccgatcggaaacagcactaccagaaggagttcgaagcgatctgccagaggcagcaactgtccgacgatctggtagacaagctgaggagggctatttacttccagcggtctctgaagtcccagcgcgccggagtcggcaagtgcacattcgagcccgacaagccccggtgcgccctctcccacccgaggtacgaggagttccggatgctgtccttcctgaacaacgtcaaagtgaaggggcccagcgatgactcgctccgccccctgagcccaagtgagaaagagaaaattaagccgttgttcctccgcaagagcaaggctaacttcgactttgaggacatcgcgaaagccatcgcgggcaaggggaagtacgcctgcatccgggataaagagggcgcgcagaagccttaccagttcaactatgccctgtcgcagggcgtctccggctgccctgtgactgccaaattaatcgccgtattcggcgaatcctgggagcgtaacctcgtcaacgcctatagatcacgaaacgacatgcgcaagagcgatgaggagatcgtgaacgaggtgtggaacgtcctgtattccttttcttccaaggagaagctcagggcatggggtatggaaaaactcggcctggatgaggcctgcgccggtgagtttgccgacatcactctgcccacagcattcgcggccctgagtctgaaggccgtgaacaaaatactacctttcctcagacagggcttcatctactcccacgccgtgatgctagccaacatcccctacattatcggtatggacagatggaacgagccccgccagcgtcagttcatcatggacaacttacaggagctcctggacaatttcaccgcgagcgacaaagccctgcagcaaacgttagacttctgtattaaggatttcttactgaacaactacgagctggcccctgggaaggccgaccgactctaccacccgtccatgatcgagacgtaccccgatgcaaaggccgacggccaagggatctatcagctgggctccccagccaccaatgcgatccgcaacccaatggccatgcgctccctccacatcctcagaagagtggttaaccagttacttaaggagaagaccatagacagcgagacagaggtacacatcgagtatgcgagggaactcaacgacgctaaccggcgttgggcaatcaaccagtggcagcggaagcaggagacacagcgcaaggattacgccgagaagatccggaaagtatacgcggacgagtttgaaaaggttatcgagccgacccaggaagagttgctcaagtaccagctctgggaggagcagcagcacctctgtctgtataccggggagcagattggccttaccgacttcatcggccctaaccccagatacgatatagagcacacgatcccccagtcgatgggcggtgacagcactcggatgaacctgaccctctgcgaacgcacctacaaccggacggtcaaggggaacagaatgccgtcgcaactggcggaacacgagagcatcttgacccggatcaagccctggaaggacaagtacgaggagctgaccgtgaagatcaataaactacgcacacaccccggtatggacaaggcctccaaagacaatattatccgcaagcgccacctcctagagctagaacgcgattactggttccagaagtaccagcgcttcacgatgacggaggtgcccgaggggttcagcctgcgccaaggaactggcatcgggctgatcggaaagtacgccgggctgtttcttaagtcactgttccaccacgtcaaggagcgaaatcgcaaacaagtctacgtaatcaagggcccgatcaccgccgaatttcggcgcctctggggcctacagaacctctacgagcaaaaatctcgggataaccatgcccaccactgcatcgacgcgatcgtgatcgcatgcattaatcctgccgagtacgctcgcatggcaagctactaccggcaggaagaggacttcaggctcaacaaggggaataagcccgtgtttccgaagccctggacgaccttcactcaggaccttcaggccctggaagccgagctcttagtggtacacgaaacccgcaacaacctgacgaagaaggcccgcaagcgagtgcgcacgaagggcgggaacgtgctctccgaaagcgactccgcccggggcagccttcacaacgacacctactacggagcaatccagaaggacggcgtcatccgctacgtggtccgtaaggcattatcctccctctccgagaaagacgtcaaagacattgtggacaaaacggtcagagagaaggtgcaggccgccatccaggaaaagggtgccaaagaggcgctggccgggacgatctacatgaacgaggaaaagggcatcacaatcaagaaagtccggtgcttcaccaagatcgccagcccactggccatccgacgccatagggacgcgtccgctaaagagtataagcgaccttactacgtgaccaacgagtctaactacgtcatggggatctacgagggctgcataaaagagaagactaagcgggagttcatcctcgtgaacaatctggaggcagtgagacagctgaaggccgcgagaaaacagggggtcgtctcaagcatcctgccgcccgtatccgcaaaatcacaatttcccctgaagtaccgcctttacacgggcaccttggtcctgctttacgagaactcccccgaggagatcgacttcaccaatcaggtggacatctgcaagagattgtacaaggtgaccgggcttagcagcatgacggtaacaggaaaccagtacgggacgatccagctgcgctaccaccaagaagcccggcaagccaaggatctcaaggctcaaaacggggcctacaaggagggtgaggaacaccgccccgctatcatgatgctgcatacccaattcaaggccctggtggaggggacggacttccggatgaacatcctcggcgagatcgagcccctgcgcaagtga

SEQ ID NO: 7535 - RNA, 3690 nt, synthetic construct
  misc_feature 1..3690: note = Cas9 variant
  source 1..3690: mol_type = other RNA
atgggcgaccgtaagtacaacctggggctcgacatcggcacctcttccatcgggttcgccgcagtggacgagaacaaccagcccatccgggtcaagggcaagaccgcgatcggtgtgcgcctgttcgaggagggcaagacggccgcagaccggcgcggcttccggaccacccgccggcgcctgagccggcgccggtggcgcatcaacctcctgaacgagatcttcgacgcccacctggcggaggtggacccgaccttcctcgcgcggctgaaggagtcgaaccgcagcaacctggaccccaagaagtctttccaggggagtctcctgttccccgagcggaaggactaccagttctacgaggagtacccaacgatctaccacctccgcaaggcactgatggagaaggaccggaagttcgacatccgcgaaatctacctagccgtccaccacatcatcaagtaccggggcaacttcctgaacggtacccccatgagatcattcaaggtggagaacatcgagctcaacaccctgttcgaccaactgaaccagctctacgccgagatcgtcccagataacgagctggcgttcgacttagcgcaggtcgccgacgtgaaggacgtgttaagctccaccacgatctacaagatggacaagaagaagcagctggtcaagatgatgctgctccccgccagcaacaaggccctgcagtccgagaacaagaagatagtgacccagtttgtgaacgcgatcctgaactataagttcaagctcgacgttctgctccaggtggagaccgacgccgactggagcctgaagctgaacgacgagggcgccgacgataagctggaggagttcaccggggacctcgacgagaaccggctggagatcatcgacctgctccagcgcctacacaattggttctccctgaatgagatcacgaaggacgggaatagcctctccgccgccatggtggagaagtacgagaaccaccatcaccacctgggcctcctcaagaaggtcatcgagaaccaccctgacgcgaagaaggcaaaggccctgaaggagacctacaccgcctacgtagggaagaccgacgacaagacgcagaaccaggacgacttctacaaggccgtcgagaagaaccttgacgacagcccggatgcgaagggcatcaaacgcctcatccagctggaccagttcatgcccaagcagcggacagggcagaacggcgccatcccccaccagctgcaccagcaggagctcgaccagatcatcgagaagcagtccaagtactacccgtttctggcagagccgaaccccaacgtcaagcggagaaaggacgccccctacaaacttgacgagctgatcgcgttcaagatcccctactacgtgggcccgctcgtgacccccgaggagcaggcgcagaacaaggagaacgtcttcgcctggatgaaacgtaaggccgccgggcccatcaccccctggaatttcgacgagaaggtggaccggatggagagcgcgaaccgcttcatccggcgcatgacgaccaaggacacctacctgtttggcgaagacgtgctgccggccgagtccatgatctaccagaagttcgtcgtgctcaacgagctgaacaacctgaagatcaacgggcggcacctcagcctgaaggacaagcaggacgtctacaacgacctgttcaagcaacagaagaccgtgagcatcaaagccctccagaactactacgtgactaagaagaaggccgctactgcccccaccgtcggcgggctggctgaccccaagaagttcctgtcaagcctctccacctacatcgacttcaagaacatgttcggcgagcgcgtaaacgacccccagttccaggaggacctcgagcaaatcgtggagtggagcacgatcttcgaggaccggggcatcttcaaggccaaactgcaagccctcgggtggctttccgagaagcagattcaacagctggtcgccaagcgctacaagggctgggggaggctctcaaagaagctgctgaccggcctcaagaacgcggaggggtactccatcctggacgaaatgtggcgcagcactgagaacttcatgcagatccaatcccggccggagttcgccgctctgatccagcaggccaacgagaagcagttcgagggcaacgaccccgacaatgtgtgggagaacatagagaacatcctcggcgacgcctacaccagcccccagaacaagaaggcgatccgccaggtggtaaaggttgtgcaggacatcgagaaggcggtcggtaatccgccagagaagatcgcgatcgagttcacgcgggaggccgcagccaacccccaacgcacccagtcccggctgcgcaccctggagaagttgtacgagagcgccgaggaggtggtggatgcaggcctgaccgccgagctggcggagttcaaggagaacaagcacgttctatccgataagtactacctgtacttcacgcagctggggcgcgatgtgtacaccggcgacacgatcagcctcgacaagctaaacgactacgacgtcgaccacatcctgccccagtcattcatcaaggacgactcgctcgacaaccgggtcctaaccatacgcgccgtgaataacgggaagtccgacaacgtgccggccaagatgtttggcaagaagatgggctcattttggcggcacctcctcgacaacggaatgatctccaagagaaaatacaacaacctgatcaccgatcccgacaacatctccaagtacgcccagaagggcttcatcaaccggcagctggttgagacgagccaagtgataaagctcaccgccaacatcctgaacgggatctacgacaaggacacagagatcatcgaggtgcccgcgaagatgaactcccagatgaggaagatgttcgacctggtcaaggtgcgggaggtgaacgactaccaccacgccttcgacgcctatctcacgatcttcattggcaactacctgtacaagtgctaccccaaattacgcccgtacttcgtctacgacaacttcaagaagttcggcaacaaggaggacatcgggcacaagcggtttaacttcctcggcaagatcgagcgcgagaagaaggtggtggccccagagacgggggagattctgtggagtaacgtcgcccccaacgagaccatcaagcagatcaaaaaggtgtacaactacaagttcatgatcgtgtcccgggagatcaccacccgccgggcggagctgttcaaccagacagtctaccctaagaattaccgcggcaagctcatccctattaaggaggaccggcccaccgacctgtacgggggctatagcggcaacaccgatgcctacctggcaatcgtggccctcgaggacaagaagaaggggaagtacttcaaagtggtcggcatccccacccgcgccgccgccaagctggagaagctgaagcagcaggactcccagcagtacctccaggccctgcacgaggtgatcgcgccccaattcaccaagagtacgaagaaggggatcaagaagaccgagttcgagatcgtgctggacaaagtccactaccggcagctcgtgcaggacgggccggtgaagatgatgctggggtccagcacctacaagtacaacgccaagcagctggtcctgtccgaaaaggcactgtga

SEQ ID NO: 7536 - RNA, 3696 nt, synthetic construct
  misc_feature 1..3696: note = Cas9 variant
  source 1..3696: mol_type = other RNA
atgatcacaagaatcctcgggctagacactggcaccaactctctagcctgggcagtggtcgaccgagacgccaacggcaactacaccctagttaaacgcggagatgtgatattcaccgaaggagtaaaaatcgagaaaggaatcgaatcatctaaagctgcagaacgaactgcccacaaagccctccgagtgcactactcacgaagaagactccacaaaatagacaccctcaaagtcctagtggaactagacctctgcccctacctaagcaacgagcaactaaatttgtggaaagcgaagaaaacgtaccccctcaccgacgattttatgctctggcagcgcagtggcagcgctgaagaaaacaacccgtactactgccgacacagatgcctaactcaaaagctagacctcacagaccaatcccaacgctttctccttggccgggcgttctaccacctggcccagcgccggggcttcctgtcaaatagactcgatacctccgcagactcggacgagtccggaaaagtaaaaagcggtatagccgaactgtccgtggagatggagaaagcagggtgcgagttcctcggggaatacttctatcagttatacaaacagcacggaaacaccattaaactccgaagccgctacacagaccgcgaggaacactacaaaaaggagtttctcgcaatatgcgaaaagcaagaactcgaccccaaatgggtggaagccctccaacgcgccatctacttccaacgaccactaaaatctcaacgaaaaggcgtgggcaaatgtacattcgagcccaagaaaccacggtgcgcagagagccacccagactacgaagcattccgaatgctttgtttcctgaacaacgtcaaaatacaaacccctaacgacacaagcctgcgcccactaaatgaagacgagcgcgagaaaatttggccactcttcttccgcaaaagcaaacccaacttcgacttcgaagacatcgcgaaggcattagcggggaaaaacaactacgcatggtacaaggacgcaggagaaaaaccctttaagttcaactaccgcatgcaacagggggtatcaggatgtcccgtaacagcccaactaatcgatatcttcggctcagactggcagacagccatcgcggaaacatacacagccgtcgaaaagaaaaacgggaccaagaccatcgacgaaatggcagacgacgtatggaacgtgctatacagcttcagctcaaaagacaaactaaaggccttcgcgaccgagaaactacaactcgacgaagccagtgcaactaaattcgccaacgcgaaattaccacatggcttcgccagcctctcgttgaaagcaatacgcaacatcttaccattccttaggcagggcttcatctacgcccacgcagtccacctagccaaaatccccgacatagtcaccaaagccgtctggaacgacgcagacaagcgagaaatgatcctaagcggcctcatggaaatcatcgaaaactacaaccccaaagaccgaggcgtagaaggaaccatcgacttttgcataaagtctcacctccaagacgtaatagacctcagaccaggcgccgccgacgcactctatcacccaagcatgatcgaaacctacccagacgccaaactaaacaaaatgggcgtgttccaactaggcagcccacgaaccaacgccatccgcaaccccatggccatgcgatctctccacatcctacgaagcgtcgtaaaccaactactccgtgacggaataatcgatcgtaacactgaagtgcacgtcgaatacgctcgcgaactaaacgacgcaaacaagaggaaggccatcgccgattaccaacgcgaacaagaaaagaaacgcaaacagtaccgagacgatatcatagccctatacaagtcagaatgccacaaagaaatagaacccacagataccgacatcctcaaattccagctttgggaggagcaagatcacctgtgcctctacaccggcactcaaatcggtatctgcgactttctcggcgacaatcccaaattcgacatcgaacacaccgtccctcgctccgtagggggcgactcaacccaaatgaacctgaccctatgcgacgcaacctttaaccgtcaagtaaaaggagcccaactccccagccaactatccaaccacgccgacatcctcgtccgcatcgaccactggaaatccaaatgcgaagacctccgaaagcaacttgacaaaatacgaacctacggcggcatggaaaaggccatgaaagaccgcctcatacaaaaacgccaccgactgaagatggacctcgactattggcaagggaaatactcgcgattcactatgacagaagtcccagaaggattcagccgaagacagggggcaggcataggcctcgtctcgaaatacgcgggcctcttcctaaaaagcctctttcacaacgagcaaaaccctaacaagtccaacgtatacgtagttaagggggtcacaacagccgagttcagacgcatgtgggggctccaaggggaatacgaaaagaaatcccgactcaaccactgccatcattgcatcgacgcaataacgatcgcctgcataggaaaagccgaatatgataaaatggcccaatactatcatgacgaagaactgttccaatggcggggcaccaccacgaaaccccacttcaacaagccctggcccacgttcaccgaggacgtactcgcaatagaacagagcctcctagtaaaacaccttacaaaagacaacatgcccaaacaggctaagaaacgggtgcgcacagcaacaggaaaatacctcgcgcaaggagacacagcgcgaggcagtctacacaaagacacctactacggcgcaattgagcaagacggggaaatccgatacgtcctacgaaaacccctaaataaattcgagaacgaggccgaactagaaaagatcgtagaccaggctgtgaaagagaaaataaaagaagccatagccggcaaaaactttaaaacagcaatcaccgagccaatcttcatgaataaagaaaaaggcatacggattaacaaagtcaggtactacgtcaaagcgcaagaacgcctcaaaatccgacaacaacgagatctgtccagcaaagaatacaaacaattcttctgcgtcgagaatgaatccaactacttgctcgccatctacgaaggagaactcaaaggcaagaaagaacgcgacttctgcgtcgttaataacctggagtcagccgcatgcctaaaacgatccaataaaggcaaagcagccccgctcgttccagaacgcagcgaagagagaaatctaccactacttgcagtcctaaaacgaggaacccaagtactcttctatgagaacagcccagaggaaatcctgttcgacaacccgcaagacttagtgcgaaggctttataaagtcactggaataaatacgaagaaagacgtcaagaacggaaagacatacctatacggcaacatcgaactacgtttccaccaaaatgcacagaagaaagacgacgtgaagatgcaaagcggggtgtacaagaacaatgaagttctccgccaaggcatagtcctctcacacaagcaattcaaagccctagttgagggcgtcgacttcgagttcaacgtactaggagaaatcaaaaagaaagaaagacacgcctga

SEQ ID NO: 7537 - RNA, 3699 nt, synthetic construct
  misc_feature 1..3699: note = Cas9 variant
  source 1..3699: mol_type = other RNA
atgaccaaaacccggatcctcggcctcgacacggggaccaacagcctgggctgggccatcgttgaccgggacgaggtctccgggcagtacgagctggtggaccgcggcgacctcatcttcaccgagggggtgaagatcgagaaaggcatcgagagctccaaggccagcgagcggacccagcaccgcgcgttacggaagcagtacttccgccggcggctgcggaagatcgaggtcctccgcgtgctgacgttctaccacctgtgcccgcccgtgtccgaggaggagctccacctgtggcacgtcaagaagatctacccggtggagaaccacgagttcatgatctggcagcggaccaacgacaacgagggcaagaacccctactactaccgacacatctgcttacacaccaagctcaacctgaccctgatgaaggaccggtacattctcgggcgcgccctgtaccacctgagccagcggcgcgggttcctctccaaccggcttgaccagagccaggacgaggacgacaaggggacggtgaagaccggcatctccagcctgtcaaaggacatgaacgatgccgggtgcacctacctcggcgactacttctacaaactgtacagcgagaacggcaacagggtccgtatccgcaaccactacaccgcccggaacgagcactacctggccgagtttgaagcgatctgccaggtgcagaagctcgagcccgagctggtggaggccctgcgccgcgcgatcttcttccagcggccgctcaagtcccagcgcaagggggtcggcaagtgcacgttcgagccccggaagccccgctgcgccgacagccaccccgactacgaggagttccggaagctgtgctttatcaacaacatcaagatccagacctccgacgacgacaccatgcgcccgctcaacaaggaggagcggcagcgcatcaacagtctcttctacagggtgtccaaggcgaacttctacttcgaggagatcgccaagctgcttgggggccgcaacaactactgctacttcaaggacgaggtgcagaaggacttcaagttcaattaccggatgagccagtccgtcagcggctgccccaccacggcccagctgcgcaacatcttcggggaggactggaagaccggcatcgccgagacctaccagcacagcgccaagaaggacgggtccctgaagactgtggacgagatggcggacgacatctggaacgtgctgtacagcttctccagcaaggattgcctctacaacttcgccgtcaacaagctgcagctggaggaggacaaggccaagaagttctccaagatcaagctcagccatggcttcgcctccatcagcctgaacgccatccacaagatccttccctttctccggatggggatgatctactcccacgctgtcctgttcgccaatatccccacaatcgtaggcatggacgtctggaacgacgagagcaagcgccagcacatcatgaccgagctgtccgacctggtgttcaactacgacccgaagaaccgggaggtggaaggcaccatcgagatgtgcatcaaggacttcctgctgaacaactacgacctccccgccggggccgtctgccgcctgtaccacccaagcatgatcgacacctaccccgacgccaaggcgaacaagtacggcgtgctgcagctggggtccccggccacgaacgccatccggaaccccatggccatgcgcagcctccacgagttacggcacgtcgtgaatctgctcctgcgcaagggcaagatcgaccagaacaccgaggtgcacgtcgagtacgcccgcgagctgaacgacgcgaacaagcggaaggccatcgccgacagacagcgggagctcgacaagctgcacaaaaagtaccacgacgacatcatcaccctgtacaaggaggagaccgggaaggatatcaaccccacgcaggccgacatcctcaagttccaactgtgggaggaacaggagcacgtgtgcctgtacaccggccgccagatcggcatctccaagttcctcgggcccgacccggagttcgacatcgagcacaccgtgccccggagcgtcggcggggactccacccagatgaacatgacgctgtgcgaccgccggttcaaccgcgacgtgaagaaggcgatgctgcctagccagctccccaattaccaggagatcctgccgcggatcgagaagtggaagaagaagtacgagaagctgacgaaggacatcgaccactgcatcacccactccggcatgaccaaggaagccaaggacagcatcatccagaagcgccaccggctcactctggagcacgactactggcgcaacaaatacagccggttcaccatgaccgaggtgcccgaggggttctcccgccggcagggcgccggcatcgggctggtcagcaagtacgccggcctcttcctgaagtctctgttccacgaccccaccgaccgccggcgcagccacgtgtacgtggttaaggggaccacgaccgccgagttccggaagatgtggggactccagtccgaatacgagaagaagtcccgcgacaaccacgtgcaccactgcgtggacgcgatcaccatcgcctgcatcggcaagaacgagtacaacaagatggccagcttctaccacgacgaggaggccttcgagcgtggggagtgcgagaagccccacttcgacaagccgtggcccaccttcacgcaggacgtcctcggcctggagaagcggctcatcgtggtgcacagcacccaggacaacatgcccaagcacgccaagaagtacgtccgtaccccgcgggggaagttcatcgcgaagggcgactgcgcccgcgggtccctgcacctggacacctattacggcgccatcaagcacaaggacgacacggagccccggtacgtgctccgccgggagctgagctccttcgacagcgtgaacgacctggacatcatcgtcgacgacgccgttcgcgagaagatcaaggaggccgtgaagggcaaatccgggaaggcgttcaaggaggccctcgccaatgtctatatgaacaaggagaaggacatccggatcaagaaggtgcgctgctacgtgcccagcgtcaagcggcccatcgacatccgccaccagcgggacatgtcccgcttcgactacaagcggcagttccacgtggccaacgacggcaactacatgatggcgatctacgagggggtggtcaagggcaagctgaagcgcgacttcgagctggtgaagaacatcgaggccgccagctacttcaaggtgtcccaggacaacgagagcttcagctccatcgtcccggagaagtccagcaacgggttccccctgaaggccgtgctgaagatcggcacccacgtgctgctctacgagaacaccgccagcgagattgacttctccgaccccgtcgatctgacccggcgtctgtacaaggtggtgggcctcagctccgcgatcatcaacaactgcagctacggtttcatcacgctgagattccaccaggaggcccgccaggccaagaacctgaagctcaccaagggcgtcttcaagaacgttgataattaccgcggggccatcatcctgtaccacacgcagctgaaggccctcgtggagggctacgacttcgacatcaacatcctgggggagatcacctccaaacagtga

SEQ ID NO: 7538 - RNA, 3705 nt, synthetic construct
  misc_feature 1..3705: note = Cas9 variant
  source 1..3705: mol_type = other RNA
atgcccaacttctggtccatcttcacagaaaacctccagacctacctcatgaaaacccgcatactaggcctcgatacgggaactaacagcctcggatgggccgtcgtcgaccgagatgagaacaaccaatacacacccatctgccggggcgacttaatattcacagaaggcgtcaagcaagaaaaaggcatcgagttctccctcgcagccgaacgaacaagctaccgagcctcccgacggcactatttccgcagacgcctacggaaggtggaagttctaaaggtactggtaaaacacaaactctgtcccccgttgtcagacgaagcactcaacaggtggcacacaaagaaggaataccctcttgatgaagacttcatactctggcagcgcaccaatgaagcagacaacaagaacccctaccacgaccgccacatctgccttcaccggaaactaaatctgaaagacagccaaacggatcgatacaccctcggccgcgcgctctaccacctgacgcaacgccgagggttcctcagcaatcgcctagaccaaaacgaagaggcagaggaaacaggaaaggtcaaaagcgccataagtgagctgagcaaagaaatgaaagaagcgggctgcgagttcctaggcgactacttctatctcctatatcgtactgaaggcaaccgcgtccggatacgcagtagatacacggaccgcgagaaacactacctccaagagttcaaggaaatatgccgagtacaggaactggacgaagaccttgcaaaagccctcgagaaaaccatcttcttccaaagacccctcaaaagccagaggcagggagtcggcaaatgcacgatggaaaaaggtcactcccgctgcgcggtcagccacccgttatatgaagaatatcgccttctttgctacctgaacaatatacgtataaaaacaccctccgacgaccgactccgcccactgaacgcggaagaacgagagaaaatcacgcccctattctacaaagagaaaaacttcgatttcgagaaaatcgcaaagaaactagccggcaaaacacccttcgggtggatccgagacgccgaagactggccataccaattcaactaccgcatgacacaagaagccccggcctgcccgacgaccgcccaactgataaaagtcttcggagaagactggaaagccgccctagctgaaacttacaccatgtcggccaaacaagatggcacactcaaaacagaagacgagatttgcacagatatctggaacgtcctgtactcattctcaagcaaagaaaagctcaaggagttcggtctcaaaaagctccagctcgacgaagtccaagccaaggccttctcggaaatacgactcacccgcgacttcgcttccctaagcctaaaagctatccgtaaaatcctattcttcctcagaaccggcgaagactactctaaggcaatattcctggccaatataccaacaatcgtaggcgaagaaatatggaacgacattgaacgccgatccaggctcctatataaagtcgacctggccttacgaccccaggaagaacgcgacgcagaagaacaccggacaatcgcagagcgtatcaaggcggccgtcgcagccgaagtaccagacgcaccaatagacctactgtaccacccaagcatgatagaagcgtacccagacgcaaagcggaacgagagattcgactgctaccaactaggctcccccaaaacaaacgcagtacgtaaccccatggccatgaggtcactgcacatggtgagaaaagtcataaaccacctacttcgtaaacacattatagacgagaaaacagaaatacacatcgaatacgcacgagaactcaatgacgcaaataagcgccaagcaatcgccgattggcaacgtgaactcagcaaacgccacaccgcctacgcacagaatataagacagctgtacaaagcagaaaccggcctcgtcatagagcccaccaaggcagacatactcaaatatcaactatgggaggagcaacaacacgtctgcttgtacaccggcaagaaaataggaatcgcagacttcctaggagcaaacccaaaattcgatatcgagcacactataccccgcagccgcggcggcgacagcacacaagaaaacctcaccctatgcgagtccaaattcaatcgggacatcaaacgggataaactacctacagaactggcgaactatgaagaaatactcgccagaatagagcattggaagaaacaatgctacgcactaaaactgaaacgcgacggaataaggactcatagcggtctcgagaaaagcatcaaagacagtagaatccgcagacgccacctggtcggtctcgaatacggctacctaaaaggtaaatacgacagattcaccatgaaagaagtccccgaaggattcagccgacggcaaggcgcaggcatagggctgatcagcaaatacgcaggcctattcctgaaatcactattcaaggaccctaaaaaccccaaccggtccaacgtctacgtggtcaaaggagcaatcaccgcggagttccgaaaactgtggggactacaacaagcggacgaagccaaatcacgagaaaaccacacccaccactgcatcgacgcgtatacgattgcatgtatcggaccctgcgaatatgcagcactggcagcctactaccgatccgacgaagagttcaagtacggtcgacgcagagaaaaaccccagttcgaaaagccatggcctaccttcacggaggacctcttaaaactccaagaggaactccttatcgtacaccagacaaccgacaaactaggaaaaagggatcgccgcaaagtcaaaacaccccgaggcaaattcctgaccgggggagacagcgcaagggggcgcctacatcaagaaacgtattacggtgcaataaactacgatggcaacataaaatacgtcgtccggaagccattagactcactcacagaaaaagaccttgacaaaatagtcgacgagacagtaatgggcatcgtgaaaggcgcagtagaagccaaaggatccctgaaagaagccttagcagacgggatttacatgaataaagaaaaaggcatacttatcaaacgagtacgcatattctccgatgtttcagaacccatcaacctcaagcaactgcgtgacgtgagcaccaaagaatacaaaagacatatacacctccgcaaagacgaaaactatctctttgcgatctatgaaggcatcgacaagaagaaaaacaagaaacaaaccgaaaccgccaccgtagactatcttgacgcagcaaagttctacaaggacagcaagcgacgcgacaaagccaactcattggtcggcgattacagcaagaaaaataaactaccactcaaatgtatcctgaagaaacgtcaaatggtcctattctatgaacacagcccggaagaaatcagattcaaagacaagaaagacctgtcgcgccgcctctacatagtcaccagcatcgcgaaggacggccgtgtgaaattcctacaccaccaagcagccacagccaccggtatccaatcctcccccagcccattcacaaacgacggcgaacaccaaccctactaccgtctaagcgcatcaaacatcaaagtcctagtagccgggatagactttgatatcaacatcctgggagagataacaccaaaactatga

SEQ ID NO: 7539 - RNA, 3711 nt, synthetic construct; identical to SEQ ID NO: 1739
  misc_feature 1..3711: note = Cas9 variant
  source 1..3711: mol_type = other RNA

SEQ ID NO: 7540 - RNA, 3717 nt, synthetic construct; identical to SEQ ID NO: 1740
  misc_feature 1..3717: note = Cas9 variant
  source 1..3717: mol_type = other RNA

SEQ ID NO: 7541 - RNA, 3720 nt, synthetic construct; identical to SEQ ID NO: 1741
  misc_feature 1..3720: note = Cas9 variant
  source 1..3720: mol_type = other RNA

SEQ ID NO: 7542 - RNA, 3738 nt, synthetic construct; identical to SEQ ID NO: 1742
  misc_feature 1..3738: note = Cas9 variant
  source 1..3738: mol_type = other RNA

SEQ ID NO: 7543 - RNA, 3741 nt, synthetic construct
  misc_feature 1..3741: note = Cas9 variant
  source 1..3741: mol_type = other RNA
atgcgcctggtgtacctcgcactggcccacatgatcaagttccggggccacttcctgtacgagggggacctcaaggcggagaacaccgacgtccaggccctgttcaaggacttcgtggaggagtacgataaaaccatcgaggagagccacctgtccgagatcacggtggacgccctcagcatcctgaccgagaaggtctccaagagctcccgcctcgagaacctcatcgctcactaccccaccgagaagaagaacaccctgttcggcaacctgatcgccctcagcctggggctgcaggcgaacttcaagacgaacttccagctttccgaggacgccaagctgcagttcagcaaggacacctacgaggaggacttagaggggctcctgggcgaggtgggcgacgagtacgccgacctcttcgtgtccgccaagaacctctacgacgcgatcctgctgagcggcatccttaccgttgacgacaactccaccaaggccccgctgagcgcctccatggtgaagcggtacaaggagcacaaggaggagctggccgccttcaagcgcttcatcaaggagaagctccccaagaagtacgaggagatcttcaaggacgacacgaagaacgggtacgcgggctacgtgggggccgacaagaagctgcggaagcgcagcggcaagctggccaccgaggaggagttctacaagtacgtcaaggggatcctcaacaaggtggagggcgccgactacttcctggacaagatcgaccgagaggacttcctgcgcaagcagcggaccttcgacaacggctccataccccaccagatccacctccaggagatgcacgccatcctgagacggcagggggagcactaccccttcctgaaagagaaccaggacaagatcgagaagatcctcaccttcaggatcccgtactacgtggggcccctggcgcggaaggggagccgcttcgcctgggcagagtacaaggccgacgagaagatcacgccatggaacttcgacgacatcctggacaaggagaagtccgccgagaagttcatcactcggatgaccctcaacgacctgtacctgccggaggagaaggtcctcccgaagcacagccccctgtacgagaccttcacggtgtacaacgagctgaccaaggtgaagtacgtcaacgagcagggcgaggcgaagttcttcgacaccaacatgaagcaggagatattcgaccacgtgttcaaggagaaccgcaaggtgaccaaggacaagctcctgaactacctgaacaaggagttcgaggagttccggatcgtgaacctcacgggcctggacaaggagaacaaggccttcaacgcgtccctggggacctaccacgacctgcgcaagatcctcgacaagagcttcctggacgacaaggtgaacgagaagatcatcgaggatatcatccagaccctgaccctcttcgaggaccgggagatgatccgccagcggctgcagaagtacagcgacatcttcacgacccagcagctgaaggagctcgagcgtcgccactacaccgggtgggggcggctgtcctacaagctgatcaacggcatccgcaacaaggagaacaagaagaccatcctcgactacctgatcgacgacgggtacgcgaaccggaacttcatgcagctgatcaacgacgacgccctcagcttcaaggaggagatcgcgcgcgcccagatcatcggcgacgtggacgacatcgccaatgtcgtgcacgatctgcccggctcccccgccatcaagaaggggatactgcagagcgtgaagatcgtcgacgagctcgtgaaggtcatgggccacaacccgaccaacatcatcatcgagatggcgcgggagaaccagaccaccgacaaggggcgccggaactcccagcaaagactgaagctgctccaggactcgctgaagaacctggacaaccccgtgaacatcaagaacgtggagaaccagcagctccagaacgaccggctgttcctgtactacatccagaacggcaaggacatgtacaccggggagacattagacatcaacaacctgtcccagtacgacatcgaccacatcatcccccaggccttcatcaaggacaacagcctggacaaccgcgtcctcacccggtccgacaagaaccgcggcaagagcgacgacgtgccctccatcgaggtggtccacgagatgaagagtttctggagcaagctgctgagcgtgaagctcatcacccagcggaagttcgacaatctgaccaaggccgagcgcggcggactgacggagaacgacaaggccggtttcatcaagcggcagctcgtggagacccgccagatcaccaagcacgtcgcccaggtgctggacgcgcggttcaacgccaagcacgacgagaacaagaaggtgatccgcgacgtcaagatcatcaccctgaagtccaacctcgtgagccagttccggaaggacttcaagttctacaaggtgcgcgagatcaacgactaccaccacgcccacgacgcctacctcaacgcagtcatcgggaccgcgctgctcaagaagtacccgaagctggcctccgaatttgtgtacggcgagttcaagaagtacgacgtgaggaagttcatcgccaagagcgacaaggagatcgggaaggccacggccaagtacttcttctactccaacctgatgaacttcttcaagaaggaggtcaagttcgcggacggcaccgtggtggagcggcccgacatagagaccagcgaggacggcgagatcgcctggaacaagcagaccgacttcaagattgtccgcaaggtgttaagctacccccaggtgaacatcgttaagaagacggaggtgcagacccacgggctggacagaggcaagccccgcggactgttcaacgccaatccgtcccccaagcccaagcccgacagctccgagaacctcgtgggcatcaagcggaacctggaccctaagaagtacggcgggtatgccggcatcagcaactcctacgcggtcctggtgaaggccatcatcgagaagggggttaagaagaaggagaccatggtcctcgagttccagggcatcagcatcctggaccgcatcaccttcgagaaagacaagcgggccttcctgctcgggaagggctacaaggacattaagaaaatcatcgagctgcccaagtactccctgttcgagctcaaggacggcagccgccggatgctggcctccatcctgagcacgaacaacaagcgcggagagatccataagggaaacgaactgtttgtgccacagaagttcaccaccctcctgtaccacgccaagcggatcaacaacccgatcaacaaagaccacatcgagtacgtgaagaagcaccgcgacgatttcaaagagctcctgaactacgtcctggagttcaacgagaagtatgtgggagcgaccaagaacggcgagcggctcaaggaggccgtggccgacttcgactccaagagcaacgaggagatctgcacgtccttcctgggggccgtcaacagcaagaacgccggcctgttcgagctcacctccctgggcagcgcgtccgacttcgagttcctgggggtgaagatcccgcgctaccgggactacacccccagctctctcctgaaggacagcattctgatccaccagagcatcaccggcttatacgagacgcgcatcgatctgtccaagctgggggaggactga

SEQ ID NO: 7544 - RNA, 3747 nt, synthetic construct
  misc_feature 1..3747: note = Cas9 variant
  source 1..3747: mol_type = other RNA
atgaagaagatcctgggcctcgacctggggagcgcctccatcggctgggccgtgatcaccgagaacgtcgagaacgggatcaccaagtgcgacatcctgggcatggggagccgcatcatcccctacgagggcacggagggcaaagacttcaccaaggggaccggcgagtcccggaacagcctccgcaccaaggcgaagaccgcccggaaggggtacgaccgctatcagctgcggcgcaagtacctggttgacaccctcattaagaaccagatgtaccctgacgaggccaccagaaacctgcccaagatgaagctgtgggagctccgcgacaaggccgtgcactcccccgtcagcctgatggagctgggcaggttacttctgtggctcaaccagaagcgcgggtacaagtccagccggtccgacgccaacctgggcaagaaggacaccgagtacgtggcgacggtcaagtcgcgccacgagaagatgaaggagctggacgtgaccatcggccagtacttctaccgggagctctccgccaacgagttcttcaaggtgaaggagaacatattcccccgcgaggcctacatcgaggagttcgacgccatctgcaagacccagcagatcgcgcacccgatgatcctgcggagcgagctgatcgacaagatccgcaacgaagtgatctactaccagcggcccctcaagtcccagaaggggttagtcagcgtgtgcgagttcgagggcttctggcgcatcgggaaggacggcaaagagtacttcgtgggccccaaggtcgcccccaaatccagcccactgttccagctcgccaagatgtgggagaacatcaacaacatcaagatcgggtcccggaccggcgaggacctaaagctgacgaccgagcagaagtgggccatcttccaacacctcgacaacaacgagaagctgacccccaccgatctgctcaaaatcctgaacctgaagaaggaaaactgctacgtgaacaagcagatggggaagggcctcaacgggaacatcactaagcacgccatcctgcagtgcctgggcggcagcgacaagtacgagaacctcctgaagctggagctcaagatggtggatggggacaaggaaggctatctatatgaccgcaagaccggggaggtcctgaactccaagatgatcaagttcatcgaccccatggtggagcaggagcccttctaccagctctggcacatcatctacagcatccacgaccaggaggagtgctcgcgggtgctgcaggcgaagttcgacatcgagcagccgatcgccgacaagctggccgccatcgacttctccaagcacgccttcggcagcaagtccgcgaaggtcatccgcaagatcctcccctacctgatggacggggacggctacagcgaagccatgtcctacgccggctacgaccacagcaactcccagaccaaggaggagaacctgcagcgcaagctcctggacctgctgaagcccatccccaagaacagcctccgacagccgatcgtggagaagatcctgaaccagatggtgaacgtcgtgaacgccatcatcgagaaatacgggaaccccgacgagatccgcgtggagctggcccgcgagctcaagcagtccaaggaggagcgcaatgacgcggacaaggccatgagcaagcgccagcgcgagaacgacgcaatcaccaagcggctggaggagttcggcctgcgcgccacgcggaacaacatcatcaagtggcgcctctacgaggagatcgacaaccaggagaagaagctgaacgccatgtgcgtctactgcgggcagcccatctccctgaccgaggcgctccggggtaacgacgtggacatcgagcacataatcccgaaaagcaagctgttcgacgactcgcagagcaacaagaccctggcccaccgccactgcaacaagaacaagaacgacctcaccgcctacgactttatgaaggggaagccggaggccgtcttcaacgagtacgtggagcgggtgaaccttctgtacgacaaccacatcatccgcaaggcgaagcgggacaagctcctgatgacggagtccaagatcccggacaacttcatcgaccgccagctgcgggagagccagtacatcgccaagaaggcccgcgagattctccagaccatctgccacgacgtctggtccaccagcggcaccgtgacggccgagctgcggcacctgtggggctgggacgacgtgaccatgaacctccagatggccaagtaccgcgagctggggctgacccaccaagtcgagtgggagtccgagcacggcaagaacaagcacgagaaggaggtgatcacggactggacgaagcgcgacgaccaccggcaccacgcggtggacgccctcaccatcgcctgcaccaagcaggggttcatccagagattcaacaccctgagcgccgccaagacgcgggaggacatgatgttcgacatcgagcagcgcagccacgagttcaaggagaagcggtccctgctcgagaagtacatcatcagcgagcagcccctgaaggtcgacgaggtggagaaggcggtgtccaacatcctgatcagcttcaagtccggcaagaaggtcgccgtgtggggcacccggaagatcgggaagcggggcagtaagaaggtgatccagaaaaagatcatcgtccctcgcgggtccctcagcgaggagtccgtgtacggcaagatcaagaagcaggaagagaaggactacaagtacctgttcgagaacccgcagctgatcttcaaccccaccatcaaggccaaagtggaggagcggctcctgatgttcgatggggacgtgaagaaggcaatcaccagcctgaagaagatccccatctacctcgacaacaacaaaaccgtggtgctggagaaggccatctgtctgaaggacgagttcgtcatcaagtactccgtggacatcaacttcaacaaggtggacaaggtcgtggaccccaagatcaaggagatcctgcagaaccgcctgaagaagttcggcggcaaggagaaggaggcgttcaaggacgtgcagctggaggacaagatgattatcaagtggtacgaggacgaggggttggagcggccgatcaagagcgtccgctgcttcacgggcctgtccgccgtggtgcccgtcaagaaggacgagaacgggaacgacatcggcttcgtcaagcccgggaacaaccaccacatcgccatctacaccgataccgaggagaacaagcagcagcacgtgtgcaccttctggcacgccgtcgagagaaagaagtacgacatccccgtgatcatcaagaacacgaacgaggtgtgggacaagatccagagccagcccgacggaacctaccccgactccttcctggagatgctgccccctcccaacctcaacctgctcgtcaacatgcagcagaacgagatgttcatcctgggcaccaccacggaggacatcaagctggctatcgacaagcgcgactacaagatcatcggggacaagctctaccggctgcagaagatgagcatcaagccctccagcggtcagatcgacatcgtgttccgccaccacctggagacccaactcatcgacgacgagaacagcaagaaatccaagcggttctacaacgtgcagagcctgggggccctgttcgccctcaacccctttaaggtccgcatcgacaatctgggcaacctggtgaaagagaagtga

SEQ ID NO: 7545 - RNA, 3762 nt, synthetic construct
  misc_feature 1..3762: note = Cas9 variant
  source 1..3762: mol_type = other RNA
atgaaggcccgcggcaacttcctgcaccaggacacccccgggctcaccgccgcgaacgccaacatgggcgacgccgtggagaagctgtgcgtcgccctggaggactggtgcacgctgcggaacctggagtgtaacatccgaaagaaccagaaaaacatccagaatctgctcgaagggaagaccgtggaggtgagcgccgagaatgcgctgaaagagtccttcgacagctcccgggccagccgcaaggacaaagcgaccatcttgtccacctggatcgccatccagccgggcgagtacctcgacgcgaagcaggccaaggacgccagcaaagagatcgccaacgtcctgttcggtctgcagggcaatatgaaaaagatcttcatcgagttcgaggaggaccagaagatccggcttgacaacgacgagcaggtcgaggccttctactccctctgccccgacgacggcgtggccctgtttgagagcttccagtccatctacagtgcctacatcttgatggggattctcaagaacgcgaacggagggtccatcagctcttgcaaggtggctgcctacgaccaatacaaagaggatttaaagctcctgaaagaccttgtgcgcgagttcgcgagcgagaagtacgatgagttcttccgaggcgacatcttcgactcgagcaaggggttccgggcccggaactacaaccccgccacggcaaagggctataccaagtacaactccgtgcgcggcgctagctacgacgacttcaagaaggaggttgaaaagatcttcaaggggacggtggcggaggaagacatcaggtacgtggatatgatgcaacgtttcgctgagggcaccttcctccggcgcctcaagacaagcgacaacggtagcatcccctaccagctgcatctcgaggagatggacgccatcgtcgagaatcagaagcagttctacccgtttctggaaagcgagaaggagaaacttgagtccctcgtaaccttccgcatcagctactacgttggccccctgacccagaagaacgcccgcttagataaccacaacaacgcccggttcgcgtggtcccagcgcaaggagggcaaggaacacgcccgggtctacccatggaattgggaggaagtgatcgaccgcaagcagtcggccgccaagttcatggagcggctcaccgggacgtgcacctacatcctcgacgagcccgtgctaccgcgctgctccctcttgtacgaggagtactgtctactcaatgagctcaacggcagcaagtggcgtgatatgggcggggactggcaccggttcgactacgagacccgcatggagatcatcgagaacctgttcaagaagaagaagggttccgtcaagtacgcggctgtggaagattggctcaagtgcgagaagcataagagctgcgccgaggtgaagggcggccagggggagaccggcttcgagtcgaagctctcttcctacgtcttcttcaaggaggtgctacacgtggatgagatcgacgaggccgacatcccaatgatcgaggagctcatctggtggaacaccctcttcgaggaccgatccatcctgaaggaatccatagaggacaagtacggggacaggctcacggatgaccagatcaaggccatctgcaagaaaaggttcaccggctggggtcgcctgagcaaggagctgctctgcggcatcaagacccacacggacaacggcccttactcgataatggacgtgctgcgggaggggaaccccaacaacaacgcgcgcagcgaaaccatggttttcatggagatcctaagggacgacaaattcggcttcgacaagctgattgaggaggagaacatgcgcagggtctccgaggtggacaacttcgacgtgaacgaccttccggggagccccgccgtccgccggaccgtgaaccaggccaagcgcatagtggacgaaatcgtcggcattgccggttgcgagccgcagaacatcttcatcgaggtgacccgggacgaggacggccgcaacaaaggccgtcgcacgaagcggcgctacgacaatatcaagaacgcaatagcagcgcttaagaaggagcagaaagagtatttcaataaggacgtgtccgacagcctgaacaaaaccaaccccagcgacttagacaacgagcgcttagccctgtacttcatgcagaacgggaagtgcatgtactgcggcaaagacctcgacatcaagcagctggacaagtaccaagtcgaccacatcctgccgcagtcatacgtgaaggacgacagcttcgagaacaaggcactcgtgcacatggaggataaccaacggaaatccgccagcatgctgttggatgattccatcatccgcaagatgaagccctattgggaggcgctccgggccgccggcctgatcggtgaaaagaagttcaagaacttaactcgtgtccgggtcagcgacaaggaactcggagggttcatcgcccgccagatggtggagaccagtcagagcatgaagttaacgagtttagtcctcgagaagacctaccccaacaccaacgtgcgacccgtgaaggcgggcttcagcagcgacctgcgcaagcgtctagacctcatcaagtgccgcgagatcaacgactaccaccacgcccacgacgcctatctggcctgcgagatcgggcaattcatcactatgcggcacaacaagctgtacgagaacccgattagctactcacacgctgtcaaggacttcatcgcgaagagagccaagtatgccaacgatcatggcacccccatgagcacctacgggatgcccggctcgtcgtccttcgtgatctctagcttcctaaccagcggcttcgacgaggagactggggagatcttcaaggacgcgtggagcgcggaggtggcggccgtaagaatccgagagtccttaaaccggaaggactgctacataagccgcatgcccgaggagacgtccggcgccttctggaaggagacactgatcagcccgagggacccctccctcgggaaaaacctgagcctgcccatcaagaaggggctggacccccgcaagtacggcggctacaacgagcagaagttcgcctactttttcgtgtacgaggccgtgaagatcaagaaaaagggcgaagtcaaggaatatgtgttcgcggccgtgccggtccaggtggccgccatcgtggcgcgggaccccaacgccctgaccgggttcgccaagaaggacgcggaggcccgcaagatcaagttcctgcggatcattcgcgagaaagtctacaagtaccagctaatcgaggtgaacggcgagcgcctgtacatcactgggctgaagtccgtacggaacgcgcgccagatcgctctcagccaggacatgaccacggtcttcctgaaggccattaacgacaaagacgtggccgaggacgagctgaagtcgctgttcgaggagatcgtgcaacggtaccgcctctgcgcgaaccggcttggaaaccagttgaagatcttcagcctatccgacagcttcaacagtgccaacagcgaaagcaagaagcgagccctggtcagcctcgtggccatcatcgacgcgaagacaaacaagatcgacttgtccgggatcggcagcggcaaggccgtggggaacatgcggctgagcttctccaaggagatgagcaacagcaagaaccacttcgcgttcattgaccagagcgttaccggcatgttcgagcgtaaaacctatctctga

SEQ ID NO: 7546 - RNA, 3777 nt, synthetic construct; identical to SEQ ID NO: 1746
  misc_feature 1..3777: note = Cas9 variant
  source 1..3777: mol_type = other RNA

SEQ ID NO: 7547 - RNA, 3780 nt, synthetic construct; identical to SEQ ID NO: 1747
  misc_feature 1..3780: note = Cas9 variant
  source 1..3780: mol_type = other RNA

SEQ ID NO: 7548 - RNA, 3792 nt, synthetic construct
  misc_feature 1..3792: note = Cas9 variant
  source 1..3792: mol_type = other RNA
atgcacaagaacaaccccgacatccgcgagctgttcctggccatccaccacatcctgaagtaccggggccacttcctgttcgccgggcagcagtttaagggcagcgagatcaaggacaacatccgcgagctcctgcagtacaactccctgaacatcaagatcgacatcaccgacgagctcatcaacaacatcgcggagatcctgctgaagaagaagaacagcaccgacaagatcatcgagtttaagaagctgttcgccgacgagaagcagttaatcgaggccctgcggctcgccctggggaacaagacgcagctggccaagctgttcgatatcgaggcgtacaaggagctggacatctccattaagaccatcagcttcaaggagaagatctacgaggacgtgcgctccaactacgaagagatcctgggcgagtacatcatcgtcctcgacaccgccaagctgatctacgacgccatcatcctgagcgagatcaagatcaagaacatgaccatctccgagagcaaagtgatttcctacgagaagcacgggaaggacctcaaacagctgaagcagttgatcaaggaggacagcaagctctccaagaaggagaagcggcagctgttcgagaacatcttcgtgaaggaggacgagaaggaggccaactacgtcaactacatcggcaagaacaacgtgggaagctccaagagctcctgcagctacgaggacttcaagaagtccctgatcaaggagctcaaatactgcgaggagagcaagctgaagcaggacatcctggcggagctagagctggagacgttcctgccgcgccagcggaccaaggacaactcggtgatcccctaccagatccacaaggaggagctcgagaagatcctgaacaacgccgtccagtaccaccccttcctgaacaacaccgacgagtacgggatcagcatcaaggagaagatcatccagctcctggagtttcgcatcccctactacgtgggcagcctgaacacctcccacaaggtggggaacggcgggttcagctggtccgtccggaataagggctacgagcgcacggccgtgaccccgtggaacttcaacaaggtgatcaacaaggaggagagcgccaagaacttcatcgaaaacctcaccaaccagtgcacctacctgctgtacgaggacgtcctccccaagcactccctgctgtacagcgagtttacgctcctgaacgagctcaattcaatcaactacggcgggaagcggctgaccgtggagcaccgcaacctgatcatcgagcggttcttcaaacagagcgctcccaaggcgaccggcaaggagctgaagaagtttctgatgtccgagggggtgatcgacggcaaggacgagctcagcggcttcgacatctccatcaaaaacgacctcaagagctaccgcgacttcaagaaaatcctgggggagaagttcgactccgagaaggtcgagaaaatgatccggtggatcaccctcttcggcgagagcaagcagctgctggtggacaagatcaccaaggagtacggggacatctactccagcgaggagatcaagaagatctccggccttacctacaaggactgggggcgcctgagcgaaaagctgctcaccgagatcgtgtccagccagctgtacgacgaaagcacgggagagtgcttcaacatcatcaacgcaatgcggaacaacacgctcctcttcatcgagctgctgggcaccaactatgactacttcgagaagatcaacacatacaacggaaaactccgcaaggagatcaccgagatcacgccccacatcctggacgacttgtacgtctccccggccgtgaagcggagcatctggcaggtcgtgcgcatcgtggaggagctcaaaaaggtcatcggcagcgagcccaagcggatcttcgtcgagaccacccgcagcaacaaggagaagaagggggacgacggacgcaaggactcccggaagaaagccctgctggagctatacaagaaaatcaaaacctctgacatcgccgagctggagaaggctctggggcacacggtggacttcgacaagaagaagcaggacctcaccgacatcgacaacaacaagctgaaggcccgcaagctgtacctctactacacccagctgggccggtgcctgtacaccggcaaggccatcgacctcaacaacttattcgggtccaacagcgagtacgacatcgaccacatctacccccagtccaagacgaaggacggcagctggaacaacctggtcctagtgaacaagaccgagaactccaagaagtccaacgggctgatctctgagagcatccagcgcaagaacaagcacttctggcggttcctgaaggccaagaacctcatctccgaggagaagtacaagcgcctgacccggaccgaggacttcacggacggcgaactgagcgggttcatcgcccgccagctcatcgagacctcccagagcgtgaaggtcgtgagcaagattctgcagaacctgaaccccaccaccgagctctgcttctccaaggcggagaacgtgagcgacttccggcaggagttcggtaaaatcaaggtcggcaagcgcaagaacctaaccgaggaggagcagaagaaggcaaaggaggggcagctgatcaaggtgcgggatctcaacgacctgcaccacgccaaggacgcttacctgaacatcgtggtcggcaacgtgtaccacatcaaattcacgcgcaacccgaagaacttcatccggaagaacttcaagaacagggagtacaccctcaacaccctgttctactccgacaaggtggagcggaacggagaggtcgcctgggagaagggcaagaccgaggagatcgtgagctccgtgatgtgcaacaacctgatcaacgtcacgcgccggacaagcgagcagaaaggcgcgctctacgaggccaccatctacaaggccaacgccgcgaaggaggggtcctactaccccgtgaagaccaacaacaagaacctgaagaacgtgacgcgctacggcgggttcaccagcatcaagatcgcctactactccatcttcaagtacgacatccggaataaagacaaggtcaaggagaacatcaagattatccccatccccatctacattagccagaacatcaagaccgacctggacctcatcaacttcgccgagaagcagattaagctgaagaagggcgagaacatcgagaacctgcagctcatctacaaaaagctgaacatcggggccctggtgaaaatcgaccactacccgtactacatcggcggcaagaccgacgacaacttctacgttgacggggccgtccaggtgctcctgtccagcgacatcgagcgctacctgaaggaagtggtgaagttcgtgaacttccagcgcgagaacaaggaggcgaaggtgtccaaggagcacatcagcctcgaggagaacatcaagctgtacaacacgctggtctgcaagatggccaccaagatcttcacccacaagaagaacaacaaatacaacgacctcactcaggacaaggccaagaacacgttcaacaagctgagcctggaggagcagtgcaaagtgctcctggagatcctgaacctcctgaccaacaagaagaccaccttcgacctgagcctcatcaacgagaagacgtcccgggtgaagtgcggcttcaacctgctgaaccagaagcagttcagcatcatcgagcagtcggtcaccgggctctacgagaaggagatcaagatcatcgaggactga

SEQ ID NO: 7549 - RNA, 3795 nt, synthetic construct
  misc_feature 1..3795: note = Cas9 variant
  source 1..3795: mol_type = other RNA
atgaagaacgtcctgggcctcgatttaggaaccaacagcatcggatgggccctgattgaggtcgacgagaacaacctccccatccgcatcatcgcgatggggtcccggatcatccctctcagcacctccgacaaggaggagttccagcgcggcctgagcatcacgaagaaccagtcccggaccgtgagccgcacccagcggaaggggtacgaccgcaagcagctcaagaagtccgacctgaagaaaatcttgaacaagtacaacatcttccccagcgaggagctcctgcgcttgccaatgctcgacctgtggaagctgcgctccgactctgcgaaccccgacgagaacatctctgccgagcagctcgggcggatcctgtacatgctgaaccagaagcgcggctacaaaagcgcccggtccgaggccaacgcagacaaaaaggacagcgactacgtgcaggcggtcaaggggcgctacgatcagctcaaggaccggaagcagaccatcggccagtacttctacgacgagctgtacaacgccaacgccaacaactcctacttccgcatcaaggaggaggtgtacccgcgggaggcctacatcgaggagtttgacacgatcatcagcgcacagagggaaaagcacgacttcctgaccgatgaggtggtccaccagctccggaacgagatcatctacttccagcgcaagctgaaaagccagaagggactggtgagcatctgcgagttcgagggcttcgagaaaaccgtgttcgacaaggagaagaacaagaacaaggttgtgttcgtggggcccaaggtcgcccccaagacctctcccctcttccagctgtgccggatctgggaggtggtgaacacgatcactctgaagatcaagaacccggagggctccaagtacaagtggggcgagaagatccccgacatcaaggagaaggagatcctcgccgactacctgttcaagaacgagagcctgtccttcagcaagctcctggaaatcctggagctcaaaaaggagaacgtctacgtgaacaagcaaatcctgaaggggatcaagggcaacgagacctactcggccctgcactcgatcctcggggacaacgaactgctgaacttcgacgtgtctatcatgaccagcaaccagacagccctcctggtcgaccgcaagaccggcgagatcctagaggagcgggcgggcctcgagctggacgcctccctggagaaggagccgctctaccaactgtggcacacaatctactctctgaaggacctcgacgagtgcaagaacgctctgatcaagcgcttcgacttcgatgacgagaccgcggagaagctgtcccgcatcgacttcaacaagcaggccttcggcaacaagagcaacaagtccatgcggaagatcctccccttcctcatggagggctacgactacagccagtccagctccctggcggggtacaaccacagcaactccctcacgaagaacgagcgcgaacagcagatcaccctcgaccggctggagctgctcccgaagaacagcctgcgccagcccatcgtggaaaagatcctgaaccagatgatcaacgtggtcaacgccatcctcgacgagtacggcaagccctccgagatccgggtggagctagcgcgcgaactgaagcagagcaaggacgagagaaacgagaccgacctgcagaactcgaagaacaagaaactgaacgacgagatcgggaagcgcctggaggagctcggcctgcccgtgaccaagcggtacatccagaagtacaagttcatcttccccagtctgagcaagaatctcaaggaggccaaggtcaacaatcagtgcatctactgcggtgagacgtttaacctgaccgaggccctgtcgggggatgcgtacgacgtggaccacatcgtccccaaggccctcctgttcgacgacagccagaccaacaaggtgctggttcaccgcaagtgcaacagcactaagacgaaccagaccgcctacgactatatagccaccaagggcgacgagcacctcaagctgtacagcgagcggctggacgactggttcgagcgcgggatcatctcctacagcaagatgcagcggctcaaagtctcccacaaggagtacctggagcgcaaaaagctgggcaaggagaccgagacggacaagaagctctgggagaacttcatcgaccggcagctgcgcgacacccagtacatcagccggaagtcccgcgagattctgcagaagatctgcaatgacgtgaagaccaccgagggcggggtgacggccaagctccggaatctgtggggctgggacgacgtcctgatgaacctccaaatgcccaagtacaaggagctggggcagaccatcaccaaggaatggaccagcgagcacggcaagcgcaagcaccagaaggaagagatcgacaactggacgaagcgcgacgaccaccggcaccacgcgatcgatgccctggtgatcgcctgcaccaagcaggggttcatccagcgcatcaacactctaaactccagcgacaccaaggaccttatgatcaaggaggtggaggaggccaagatagagttcaacgagaagaccacgctgctggagaagtacctgaagacccagaagcccttctccacccaagaagtcatgaaggaggcggacaagatcctggtgagcttcaaggccggcaagaaggtggcgaccatcacgaagttcaaggccaccgggaagaacaaggagaccggcgtgatcgtgccgcgaggcgccctccacgagcagtccgtgtacgggaagatcaaggtaatcgagaaggacaagcccctgaagtacctgctcgagaacagcgacaagatcgtgaacccccgcatcaagaacctgatcgagattaagctgagcgagaacaagaacgaccccaagaaggctctcctggccctgaagaagatcccgatcttcctcgacgaggagcagtccatcaccctggagaaagccagctgctacaacgacgccacggtgctgaagtacaaactccagaacctgaaggccgcgcaagtcgacgacatcgtggacgagaaggtgaagaagatcgtcagagagaggctgtcccaattcggcaacaaggagaaggaagccttcaaggataccctctggttcaacgaggagaagaagatccccatcattaccgtgcggctgttcgcccgccctgacgccaacaacctgcagaccatcaagaaagacgagaatgggaacggcatcggattcgtggtcacggggaacaaccaccacatcgccatatacgaggacaaggacaacaagcccgtgcagcacagctgcaccttctggcacgcggtggagcggaagaagtacaatatcccggcagtcatccgcgacagtagcgaggtgtggaacgacctcctgcggaaggagctacccgagtccttcctcaacaagctgcccgccgacaacctgaatctcaaattcagcatgcagcaaaacgagatgttcatcttaggcctgtcacaggacgagttcgtgaaggccatcgcgaacaacgacaagtccctcctgagtaagcacctatatctcgtctggagcatctccgagaacaattactggttccgccaccacctggagaccaagaacagcgacctgaagaagaccgacggggtgaaggagtcaaagcggctctacaacatccgcagcctgggatccctgttcagcctcaacccgatcaaggttcgactgaactacctgggggagatcaccaagatcggcgagtga

SEQ ID NO: 7550 - RNA, 3801 nt, synthetic construct
  misc_feature 1..3801: note = Cas9 variant
  source 1..3801: mol_type = other RNA
atggccaagtacatcctgggcctcgacctggggaccaatagcatcggctgggccctgatcgaggtggacgagaacaacatacccatccgcatcatcgtcatggggtcccggatcatcccgctcagctccaacgaccgcgaggagtttcagcggggcctgtctatcaccaagaaccagaaccgtacgatctcccggacccagcgcaaaggttacgatcggaagcaactgaagcgcaacgacctgaacaaggtgctgaacaagtacaatatcttccccagcaagatgctgcttaacctacccatgctggacctctggaagctgagatccgacagcgcgaatagtaacaaggacatcagcgcggagcagctgggcagaatcctctatatgctgaaccagaagcggggctacaagtccgtgcgcagcgaggccaactccgacaagaaagacaccgactatgttcaggccgtgaagggacggtacgcgcagcttaaggaccgcaaccagaccatcggccagtacttctacgaggagctctacaacgcgaacgtgaacaatagctacttcaagatcaaggaggaggtctacccccgggaggcttacatcgaggagttcgacacgatcatcaactcccagaagaccaagcacgagttcctgaccgaccaattcgtgcaccagctgcgcaacgaaatcatctacttccagcggaagctcaaaagccagaaggggctaatctccatctgcgagttcgagggcttcgagaagaccgtgttcgacaaggagaagaataagcacaagatcgtcttcgtggggccgaaggtggcgccccgtagcgcgccccttttccagctctgcagagtctgggaggtgatcaacacgatatccatcaaggtgaagaaccccgagggcagcaagtacaagtggggcgaacgcatcccgagcatcaaggagaaggagattctggccgactacctgttcaagaacgaggtcctctcattcaccaagctgctggagatcctcggtttgaacaagaacgacgtgtacgtgaacaagcagatcctgaagggcatcaaggggaacgagacctacgccaccctctacaacatcctgggggagaacgagttcttaaacttcgacgtcagcatcatcccctccaaccacactagcatgctagtggacaagaagaccggcgagatcttggaggagcgggccgggctggagctcgacgtgtccctggagaagcagccgttctaccagctgtggcacaccatctacagcttaaaggacctggacgagtgcaaaaacgccctgatcaaacgcttcgacttcgacgacgagaccgccgagaacctctcccgcatcgacttcaacaaacaggccttcggcaacaaatccaacaagtccatgcggaagatcctgccgttcctgatggaaggttacgactacagccagtcctgcagcctcgccggctacaaccactccaacagcctgaccaaggacgagcgcgagcagcaagtcacccttgaccggctggagctcctgccgaagaactccctacgccagcccatcgtggagaagatcctcaaccagatgatcaaccttgtgaacgccattctggaccagtacggggagctgagcgagatccgggtcgagctggcccgcgagctgaagcagtccaaggacgagcggaacgacgctgacctccaaaacaccaagaataagaaactgaacgacgagatcggcaagcgcctggcggagctcggcctgcccatcaccaagcggtacatccagaagtacaagttcatcttcccctcgttatccaagaacctcaaggacgcccacgtgaacaaccagtgcatctactgcggggaaacgttcaacctgagcgaggccctgagcggcgacgcatacgacgtcgaccacatcgtgccgaaagccctcctgttcgacgactcccagaccaacaaggtgctggtccaccgcaagtgcaacagcaccaagaccaaccagacggcgtacgactacatctccaccaagggtgacgagcaggtacggatctacttcgagcgcgtggacgactggtttaagagcggcattatctcctactcgaagatgcagcggctcaaggtgagtcacaaggagtacctggagcgcaagaagatcgggaaggaaaccgagaccgacaagaagctgtgggagaacttcatcgacagacaactccgcgacacgcaatacatcagccggaagtcccgcgagatcctgcaaaaggtgtgcaacaacgtcactaccaccgagggcggcgtcaccgccaagctgcggaacctctgggggtgggacgacgtgctgatgaacctgcagatgcccaagtaccgcgagctcggccagaccgtgatcaaggagtggaccagcgagcacgggaagcgcaagcatcagaaggaggaggtcgagaactggaccaagcgggacgaccaccgccaccacgccatcgacgccttggtgatcgcctgcacgaagcagggtttcatccaacggatcaacaccctaaactccagcgacaccaaggatctcatgctgaaggaggtggaggaggcgaaggtcaagttctccgagaagaccaccctgctcgagaagtacctgcgcacgcaggagcccttctcaacccaggaggtgatgcgggaggccgacaaggtgctggtttcattcaaggctggcaagaaagttgccaccatcacaaagttcaaggcgatcgggaagaacaaagacagcggcgttatcgtcccccgcggggccctccacgagcagtccgtgtacggcaagattaaggtgatcgagaaggacaagccgctgaagtacctgttcgagaacagcgaccgcatcgtcgaccccaaggtgaagaagctcgtggaggtccgcctgagcgagaacgagaacaactccaagacggccataagcactctaaagaaggcccccatcttcctcaacgaggagaaaacagaagtactggagaaggcctcatgctacaacgacgcgaccgtgctgaagtacaagctccaaagcatcaaggcctcccaagccgacgacatcgtggacgagcgggtgaagttcctggtaaaggagcgcctggcccagttcggcaacaaggagaaggaggccttcaaggacattctctggttcaacgaggagaagcagatccccataatcagcgtccggctgttcgcgcgcccggacgccaacaacctccaggtgatcaagaaggacgagaacggcaagtccatcggcttcgtgctgacggggaacaaccatcacatcgccatctacgaggataaggacaacaagctgatccagcacagctgcaccttctggcacgccgtcgagcggaagaagtacaacatccccgtggtgatcaagaactccagcgacgtctggtcccagctgctcgacaagcagctgcccgagagcctgctcaacaagctgcccaccgacaagctgaacctcaaattctccatgcagcaaaacgagatgttcatcctgggcctgtctcagaaggagtttgacgaggccataaagaacaaccacaagtctttcctcagcaagtacctgtacttggtatggtccatcagcaacaacgactactatttccgccaccacctcgagaccaagaacacggagctgaagaatatatcgaccgcgaaggagagcaagcggtacttccgcttcaagagcgtgggggccctggtcggcaccaacccgatcaaaatccggctcaatcacctgggggagatcaacaaggtgggcgagtactga

SEQ ID NO: 7551 - RNA, 3807 nt, synthetic construct
  misc_feature 1..3807: note = Cas9 variant
  source 1..3807: mol_type = other RNA
atgaccaagaacatcctgggcctcgacctggggaccaacagcatcggctgggccctgatcgaggtggacgagaacaacacgcccatccgcatcatcgcgatgggatcccggatcatcccgctctcgacctccgacaaggaggagttccagcgcggcctgtctatcaccaagaaccagtcccggacagtgagccgcacgcagcggaaggggtacgaccgcaagcagctgaagaagtccgaccttaagaagatcctaaacaagtacaacatcttccccagcgaggagctgctcaagctgcccatgctggacctctggaagctgcggtccgacagcgcgaaccctaacgagaacatctccgccgagcagctgggccgcatcctctacatgctgaaccagaagcggggctacaaatccgcccgctccgaggccaacgccgacaagaaggacaccgactacgtgcaggcggtgaaggggcggtacgcccagctgaaagagcgcaaccagaccatcggccagtacttctacgaggagctctacaacgccaacaccaacaacagctacttccggatcaaggaggaggtctacccgcgcgaggcctacacggaagagttcgacaccatcatcaacgcgcagaagaacaagcacgatttcctgactgacgaggtggtgcaccagctgcggaacgagatcatctacttccagcgcaagctcaagtcccagaaggggctggtcagcatctgcgagttcgagggcttcgagaagaccgtgttcgacaaggagaagaacaaggataaggtggtcttcgtggggcccaaggtggcccccaagacgagccccttgttccagctctgccggatctgggaggtcgtgaacaccatctccctgaagatcaagaacccggagggctccaagtacaagtggggcgagaagatccccaacctgaaggagaagcagatcctcgccgactacctgttcaagaacgacagcctgagcttcaccaagctcctggagatcctggacctcaacaagaacgacgtgtacgtcaacaagcagatcctgaaggggatcaagggcaatgagaccttctccacgctgcacaccgtgctcggcgacaacgagctgctgaacttcgacgtgagcatcatcccctccaaccacaccagcatgctcgtcgacaagaagaccggcgagatcctggaggagcgcgccggcctggagctcgacgcctccctggagaaggagcccctctaccagctctggcacacgatctacagcctgaaggacctagacgagtgcaagaacgcactcatcaagcggttcgggttcgacgacgagaccgccgagaagctctcccacatcgacttcaacaagcaagccttcggcaacaagagcaacaagtccatgcgcaagatcctgcccttcctgatggaggggtacgactacagccagagttgcagcctcgccggctacaaccactccaacagcctaaccaaggacgagcgggagcagcagatcaccctggaccgtctcgagctgctgtccaagaacagcctccgccagcccatcgtggagaagatcctgaaccaaatgatcaacgtggtcaacgccatcctggagcagtacgggaagctctccgagatccgggtggagctggcgcgcgagctgaagcagagcaaggacgagaggaacgacgccgacctccagaactccaagaacaagaagctgaacgaggagataggcaagcgcctggccgaactcggcctgcccgtgacgaagcggtacatccagaagtacaagttcatctttcccagcctgagcaagaacctcaaggacgcccacgtcaacaaccagtgcatctactgcggggagaccttcaacctgaccgaggccctgtccggcgacgcgttcgacgtggaccacatcgtcccgaaggccctcctgttcgacgacagccagaccaacaaggtgctggtgcaccgcaagtgcaactccacgaagactaaccagaccgcctacgattacatcgggaccaagggagaggagcaggtccgggtgtacagcgagcgcatcgacgattggttcaaacgggggatcatctcctacagcaagatgcagcgcctcaaggtgtcccacaaggagtacctggaacggaagaagctgggcaaggagacggagaccgacaagaagctctgggagaacttcatcgaccgccagctgcgagacacccagtacatcagccgcaaggcccgggagatcctgcagaaggtctgcaacaacgtgacgacgaccgagggtggggtaaccgccaagctccgcaacctgtggggctgggacgacgtcctgatgaatttgcagatgcccaagtacaaggagctggggcagaccgtgatcaaggagtggaccagcgagcacggcaagcggaagcaccagaaggaggagatcgagaactggacgaagcgcgacgaccaccggcaccacgcgatcgacgccctggtggtcgcctgcaccaagcaggggttcatccagcgcatcaacaccctcaacagctccgacacaaaggacctgatgcagcgcgagatcaaggaagccaagaagctgttaggcgagaactacaacgagaaggagttcgagaacgacaacgagttcgtgaagaaccacaaggagcgactgagccagctggacgactacctccgcctgcagaagccggtgaagttcgacacgaagtacgtcgagcaggaggcggacaaggtgctggtgtccttcaaggccggcaagaaggtggcgaccatcaccaagttcaaggccaccgggaagaacaaggacacgggcgtgatcgtgccccgcggggccctccacgaggcgggcctgtacggtatccggaccatctacagcaagggcgggatcgccgagaagcacatcatcaaaaagtacaaggtcggggtgtccgcccaggaccacatcttcaccggcaaggaaacctacagcgtgaagaaggacaagaacgggaacgaaaaggtcgacgacaagatcaagatcgtgctggactccatcgtggacaacaaggtcaaggaggtggtgctcaaccggctgaaccgcggcttcaacaatgaggaggactaccggatcgacgtcaagaaggccctgaacaacttcaagaacctcgacgaggacccgctgtggtacaacgagagcaagggcatcaagatcctgagcatcaagctcaagacggggctgaaggactccgtggtgcccctgcgcctcaacgagaagaacgaggtcatcaccctcgtgaagaccggcaacaaccaccacatcgccatctacgaggacaacgacgggaagctgatccagtacagctgcaccttctggcacgcggtggagcgtaagaagtacaacatccccacggtcattaagaactctagcgaggtgtggaaccaggtgctcgacaagaagctgcccgagtcgttcctgaaccgcctcccggccgacaagctgaacctgaagttcagcatgcagcagaacgagatgttcatcctcggccttctggaggaggagttcgacaaggccatcaaggacaacgacaagtccctcctgagcaagtacctgtacctcgtctggtccatcgccgagggggactactggttccggcaccacctggagaccaagaacaccgagctgaagaagaccaacggcgccaaggagagtaagcgctacttccggctctccacgaagggcctgattgacctgaaccccgtgaaggtccgcctaaaccacctgggggagatcaccaagatcggcgagtactga

SEQ ID NO: 7552 - RNA, 3810 nt, synthetic construct; identical to SEQ ID NO: 1752
  misc_feature 1..3810: note = Cas9 variant
  source 1..3810: mol_type = other RNA

SEQ ID NO: 7553 - RNA, 3810 nt, synthetic construct
  misc_feature 1..3810: note = Cas9 variant
  source 1..3810: mol_type = other RNA
atgaacaacagcatcaagtccaagcccgaggtgaccatcggcctggacctcggggtcggcagcgtggggtgggccatcgtggacaacgagaccaacatcatccaccacctgggctcccgcctgttcagccaggccaagaccgcggaggaccggcgctccttccgcggggtccggcggctcatccgccggcgcaagtacaagctgaagcggttcgtgaacctgatctggaagtacaacagctacttcggcttcaagaacaaggaggacatcctcaacaactaccaggagcagcagaagctgcacaacaccgtgctgaacctcaagtccgaggccctgaacgccaagatcgaccctaaggcgctgagctggatcctccacgactacctgaagaaccgcggccacttctacgaggacaaccgggacttcaacgtctaccccaccaaggagctggccaagtacttcgacaagtacgggtactacaagggcatcatcgactccaaggaggacaacgacaacaagctcgaggaggagctgaccaagtacaagttcagcaacaagcactggctggaggaggtgaagaaggtgctctccaaccagacggggctgcccgagaagttcaaggaggagtacgagagccttttctcctatgtccgcaactactctgagggccccgggtccatcaacagcgtgtccccgtacggcatctaccatctcgacgagaaggagggcaaggtggtccagaagtacaacaatatctgggacaagaccatcgggaagtgcaacatcttccccgacgagtaccgggcgcccaagaacagccccatcgccatgatcttcaacgagatcaatgagctgtccaccatccgcagctatagcatctatctgaccggctggttcattaaccaggagttcaagaaggcctacctcaacaagctgctggacctcctgatcaagacgaacggggagaagccgatcgacgcccgacagttcaagaagctgcgcgaggaaaccatcgcggagtccatcggcaaggagaccctcaaagacgtggagaacgaggagaagctggagaaggaggaccacaagtggaagctgaagggcctcaagctgaacaccaacgggaagatccagtacaacgatctgtcgtccctcgccaagttcgttcataaactgaagcagcacctgaagctcgacttcctgctggaggaccagtacgccacgctcgacaagatcaacttcctgcagagcctgttcgtctacctcggcaagcacctccggtacaacaaccgcgttgactccgccaacctgaaggagttcagcgactccaaccggctgttcgagcgcgtgctgcaggagcagaaggacgggctgttcaagttgttcgagcagaccgacaaggacgacgagaagatcctcgcccagacccacagcctgtccaccaaggcgatgctgctcgccatcacccggatgaccaatctggacaacgacgaggacaaccagaagaacaacgacaagggctggaacttcgaggccatcaagaacttcgaccagaagttcatcgacatcaccaagaccaacaacaacctgagcctcaagcaggacaagcgctaccttgacgaccgcttcatcaacgacgccatcctgtcccccggggtcaagcgcatcctccgcgaggccacgaaggtcttcaacgcgatcctgaagcagttcagccaggagtacgacgtgaccaaggtcgtgatcgagctggcccgggagctctccgaggagaaggagctggagaacaacaagaactacaagaagctgatcaagaagaacagcgacaagatctccgagggcctcaaggccctggacatcgccgaagacaagatcgaggacatcctcaagagccccaccaagtcctacaaggtgctgctgtggctgcagcaggaccacatcgacccctacagccagaaggagatcgctttcgaggacatcctcaccaagacggagaagaccgagatcgaccacatcatcccgtactcgatcagcttcgacgacagctccagcaacaagctgctggtcctcgcggagtccaaccaggccaagagcaaccagaccccctacgagttcatcacgtccggtaacgccgggatcaagtgggaggactacgaggcctactgccgcaaattcaaggacggcgacacgagcctgctggactccacccagcggagcaagaaattcgccaagatgatgaaaaccgacacctccagcaaatacgacatcgggttcctcgcgcgcaacctgaacgacactagatacgccaccatagtgttccgcgacgccctgaaggactacgccaacaaccacctcgtcgaggacaagcccatgtttaaggtggtgtgcatcaacggcggggtcacctccttcctgcggaagaacttcgacaagagctggtacgcgaagaaggaccgcgacaagaacatccatcacgccgtagacgcctccatcatcagcatcttctccaacaagaccaagacgctgttcgaccaactcacccagttcgccgactacaagctgttcaagaacaccgacggctcctggaagaaaatcgaccccaaaaccggagtggtcaccgaggtgacggacgagaactggaagcagatccgggtgcgcaaccaggtctccaagatagccgaggagatcgacaagtgtatccaggacagcaacatcgagcggaaggcgcgttacagccggaagatagagaacaagaccaacatctccctgttcaacgacaccgtgtacagcgcgaagaaggtggggtacgacgaccagatcaagcgcaagaacctcaagaccctggacatcgacgagtccgtcgaggagaataagaacagcaaggtgaagaaacagttcgtgtaccggaagctggtcaacgtgtccctcctgaacaacgacaagctggccgacctcttcgccgagaaggaggacatcctgatgtaccgcgccaacccgtgggtgatcaacctcgcggagcagatcttcaacgagtacacggagaaccggaagatcaagagccagaacgtcttcggcaagtacatgctcgacctgaccaaagagttccccgagaagttctccgaggccttcgtcaagagcatgctgcgcaacaagaccgccatcatctacaacgtggagaagaaggtggtgcaccgcatcaagcggctcaaaatcctgtccagcgagctaaaggagaataaactttccaacgtgatcatccgcagcaagaacgagtccgggaccaagctgagctatcaggacaccataaactccgtcgccctgatgatcatgcggagcatcgaccccaccgccaagaagcagtacatccgcgtgcccctcaacaccctgaacctgcacctcggcgaccacgacttcgacctgcacaacatcgacgcgtacctgaagaagcctaagttcgtgaagtacctcaaggccaacgagatcggggacgagtacaagccctggcgggtcttaatctccggcagcctgctcatccacaagcgcgacaagaagctcatgtacatttccagcttccagaacctgaacgacctcatcgagatcaagaacctgatcgagacagaatacaaggagaacgtggacagcgaccccaagaagaagaagaaggcctcccaaatcctgagaagtctctccacgatcctgaacgactacatcctgctcgacgccaaggacaatttcgacatcctgggcctgagcaagaaccgcattgacgagatcctcaactccaagctggacctggacaagatcgcgaagtga

SEQ ID NO: 7554 - RNA, 3822 nt, synthetic construct
  misc_feature 1..3822: note = Cas9 variant
  source 1..3822: mol_type = other RNA
atgaagaagatcctaggcctagacttagggaccaacagcatcggctgggccctgatcgaggtggatgagaacaacttccccatacgcatcatcgccatggggtcccggatcatcccgctcagctccaacgacaaggacgaatttcagcgaggtctgagcatcaccaagaaccagtcccggacggtcagccgcacccagcggaaggggtacgaccgcaagcagctgaagaagtccgacgacttcaagtacagcctccggcgcatcctgaacaagtacaacatcttcccctccgaggagctgctcaagctgcccatgctggacctctggaagctgcgcagcgacgcggtgaacccgaacgagaacatctccgccgagcagctgggccgcatcctctacatgctgaatcagaagcggggctacaagagcgcccgctccgaggccaacgccgacaagaaggacaccgactacgtgctggcggtgaaggggcggtacgcacagctcaaggaccgcaaccaaaccattggtcagtacttctacgaggagctgcacaacgccaagacaaccaacagctacttccggaccaaggaggaggtgtacccgcgcgaggcgtacatcgaggagttcgacaccatcatcaacgcgcagaagtccaagcacgacttcctgactgacgaagtggtccaccagcttcggaacgagatcatatactttcagcgcaagctcaagagccagaaggggttagtgtccatctgcgagttcgaaggcttcgagaagaccatcttcgacaaggagaaggacaagaataaggtggtcttcgtcgggcccaaggtggcccccaagaccagccccctgttccagctgtgccggatttgggaggtcgtgaacaccatcacgctgaaaatcaagaacccggagggctccaagtataaatggggcgagaagatccctaacatcaaggagaaggaggccctcgccgactatctgttcaagaatgagaccctgagcttcaacaagctcctggacatcctggagctcaagaaggagaacgtgtacgtcaacaagcagatcatcaaggggatcaagggcaacgagacctacagcgccctgcaccgcatcctgggggacaacgagctcctgaagttcgacgtgtccatcatccccagcaaccacacctccatgctggtggacaagaagacgggcgagatcctcgaggagcgggcgggcctggagctggacgtcagcctcgagaaagagcccctgtaccagctgtggcacaccatctactccattaaggacctcgacgagtgcaagaacgccctgatcaagcgcttcgggttcgacgacgagatcgccgagaagctaagccacctcgacttcaacaagcaggccttcggcaacaagtccaacaagagcatgcgcaagatcctgccgttcctgatggaagggtacaactattcccagagctgcaccctggccggctacaaccactccaacagcctcaccaaggacgagcgggagcagcaggtcacgctcgacaaactggagctcctgcccaaaaactccctgcgccagcctatcgtggagaagatcctcaaccagatgatcaacgtggtgaacgcgatcttagaggagtacgggaagcccagcgagatccggatcgagctggcccgcgagctcaagcaatccaaggacgagcggcacgacgccgacctgcagaacagcaagaacaagaaacttaacgaggagatcggcaagcgcctcaccgagctgggcctgccggtgaccaagagatacatccagaagtacaagttcatcttcccctccctcagcaagtccctaaaggacgcccaggtcaacaaccagtgcatctactgcggggagaccttcaacctgacggaggctctcagcggcgacgcgtacgacgtggaccacatcgtccccaagagcctgctgttcgacgactcccagaccaacaaggtgctcgtgcaccgcaagtgcaacagcaccaagaccaaccagacggcctacgactacatcgcctccaagggggaggaggaggtccagatctacagcgcccgggtggacgactggttcaagcgcggcatcatctcttacagcaagatgcagcggttgaaggtgtcccacaaggagtacctggagcgcaagtcactcaacaaggagaccgagaccgacaagaagctgtgggagaacttcatcgaccggcagctgcgcgacacccagtacatctcccgcaagagcaaggagatcctccagaaggtctgcaacaacgtgacgaccaccgagggcggggtgaccgccaagctgcgggacctgtggggctgggacgacatcctcatgaacctgcagatgcccaagtacaaggagctgcggcaaacggtcatcaaggagtggacctccgagcacgggaagcgcaaacaccagaaggaggagatcgagaactggaccaagcgggacgaccaccgccaccacgcgatcgacgccctcgttatcgcctgtaccaagcagggcttcatccagcgcatcaataccctgaacagctccgagacgaaggacctcatgcagcaggagatcaacgaggccaagaagctcctgggggagaactacaaggacaaggagttcgagaacagcaacgagctggtgaagaaccacaagggccggctctccaaactggacgactacctgcgcctccaaaagccgatcaagttcaacaccaagtacgtcgagaaggaggcggacaagatcctgatcagcttcaaggccgggaagaaggtggccaccatcacaaagttcaaggccacgggcaagaacaaggacaccggcgtgatcgtcccccgcggggccctgcacgaggcgggcctctacggggtgcggaccatctacagcaagggcggcatcgccgagaagcacatcatcaagaagtacaaggtgggggttagcgcccaggaccacatcttcaccggcaaggagagctactccgtgaagaaggacaagaacgggaacgagaaggtggacgacaagatcaaagtcgtgctggacagcatcgtggactccaaggtcaaggagatcgtgctgaaccggctcaacttcggcttcagcgacggggaggactacaagaacaacgtgaagaaggccctgaataacttcaagaacctggacgagtaccccctctggtacaacgagaacaagggcatcaagatcctgtccatcaagctgaagacgggcctcaaggacagcgtcgtgcccctgcgcctgaacgagtccaacgaggtgatcaccctcgtcaagaccggtaacaaccaccacatcgctatctacgaggacaagaacagcaagccggtgcagcactcctgcaccttctggcacgcggtggagcggaagaagtataacatccccgccgtcatcaagaagtccagcgacgtgtggaaccagctgctggacaaggagctccccgagagcttcctgaacaacctgcccgaggacaacctcaacctgaagttctccatgcagcagaacgagatgttcgtgctgggcctcagccaggaggagttcaaggaggccatagagaacaacgacaagtccctgctgtcaaagtacctctacctggtctggtccgtgagcgagaacaactactggttccgccaccacctggagacgaagaactccgacctcaagaagaccgagggggccaaggagagcaagcggctatacaacatccgcagcgtatccagcctgttctccctcaacccggtcaaggtgcggctgaaccacctgggcgagatcaccaagatcggggagtactga

SEQ ID NO: 7555 - RNA, 3825 nt, synthetic construct
  misc_feature 1..3825: note = Cas9 variant
  source 1..3825: mol_type = other RNA
atgaccaagcacatcctgggcctcgacctggggaccaacagcatcggctgggccatcatccaggttgacaacaacaacaacgtccccatccagatcatcgccatggggtcccgcatcatcccactggacagcaacgaccgggaccaattccagaagggccaagcgatctccaagaacaaggaccgcactaccgcccggacacagcgcaaggggtacgaccggaagcagctcaagaagtccgacgacttcaagtacagcctgaagaagatcctggagaagctcgacatcttccccaccgaggagctgatgaagctgcccacgctcgatctgtggaagctgcgcagcgacgccgtgtccaacatcgaggacatcacccccaagcagctcggccggatcctgtacatgctgaaccaaaagcgcggctacaagagcgcccgatccgaggccaacgcggacaagaaggacaccgactatgtggccgaggtcaaggggcgctacacccagctcaaggataagggccagacgctggggcagtacttctacaaggagctgagcgacgccaaccagaataacacctactaccgggtgaaggagaaggtgtacccgcgcgaggcctacatcgaggagttcgacgcgatcatcaacgtccagaagtccaagcacagctttctcaccgacgaggtgatccactccctgcggaacgagatcatctactaccagcgcaaactcaagagccagaagggcctggtgtccatctgcgagttcgaggggttcgagaccacgtacttcgataagaagacccagcaggacaagaccatcttcaccggccccaaggtcgcgccccggacgagccccctgttccagttctgcaagatctgggaggtggtgaacaacatctccctgaagaccaagaacccggagggctcgaagtacaagtggtccgaccgcatccccacaatcgaggagaagcagaccatcgccaactacctccaggagaacgagaacctgagcttcatcgagctgctcaagatactgcagctgaagaaggagcaggtctacgccaacaagcagatcctcaagggtatccagggcaacacgaccttctccgccatccacaagatcatcgggaactccgagcacctgaagttcgacatcgagaccatccccagcaagcacttcgccgtgctggtggacaagaagaccggcgaaatcctcgatgagcgggactccctggagctgaacagcgccctcgagcaggagcccttctaccagctgtggcatactatctactccatcaaggacctggacgagtgcaagaaggccctcatcaagcgcttcaatttcgaggaggagatcgccgagaagctgagcaagatcgacttcaacaagcaggccttcgggaacaagtccaacaaggcgatgcgtaagatgctgccgtacctcatgttggggtacaaccagagcgaggccgagtccttcgcaggctacaatcgccggctgaccaaggaggagaagtccaagaacgtcagcgacgagcccctacagctgctggccaagaacagcctccgccagcccgtggtggagaagatcctgaaccagatgatcaacgtcgtgaacgccatcatcgagaagtacgggaagcccgaggagatccgcgtggagctggcgcgggagctgaagcagtccaaggacgagcgcgaggacgccgacaaacagaacggcttcaacaagaagctcaatgagctggtcgccaccaagctgaccgagctcgggctgccgacgaccaagcactacatccagaagtacaagttcatcttcccagccaaggacaagaactggaaggaggcccaggtggcgaaccagtgcatctactgcggcgacaccttcaacttgaccgaggccctcagcggcgacaacttcgacgtggatcacatcgtccccaaagccctgctgttcgacgactcccaggccaacaaggtgctcgtccaccggagctgcaactccacgaaaaccaacaacaccgcgtacgactatatcaccaagaaagggagccaggccctgaacgactacgtggcccgcgtggacgactggttcaagcgcggcatcatatcctacggtaagatgcagcgccttaaagtcagcttcgaggagtaccaggagcggaagaagatcggcaaggagacggaggccgacaagcgcatctgggagaacttcatcgaccggcagctccgcgagaccgcctacatcgcgaaaaaggccaaggagattctggagaaggtgtgccacaacgtgaccagcaccgaggggaacgtcaccgccaagctgcggcagctctggggctgggacaacgtgctgatgaacctgcagctccccaagtacaaggagctggagaagaagacgaagcagaccttcacccaactgaaggagtggacctccgaccacggcaaccgcaagcaccagaaggaggagataatcaactggacgaagcgggacgaccaccgccaccacgccatcgacgcgctcgtgattgcgtgcacccagcaggggttcatccagcggatcaacaccctgagctccagcgacgtcaaggacgagatgaagaaggagctggaggaggacaaaaccgtgtacaacgagcgcctcacgctgctggagaactacctcctggagaagaaaccgttctccaccgaggagatcgagaaggaggccgacaagatcctggtgagcttcaaggccggcaagaaggtcgccacactctccaagtacaaggccaccgggatcaacgagatcaagggcgtgctggtgccccgggggcccctgcacgagcagagcgtctacggcaagatcaaggtgatcgagaaggacaaacccctcaaatacctgttcgagaactccgacaagatcgtgaacccgctgatcaagcacctcgtgaagacgcgcctgctggagaatgagaacaacgcgcaggccgccctcgtgaccctgaagaacaagcccatcctgctcaacaacaagcagaccgagatcctggagaaggccagctgctacaacgaggcgaccgtgctgaagtacaagctccagtccctgaaggccagccagatcgacgacatcgtcgacgagaagatcaagttcctgatcaaggagcgcctctccaagttcgggaacaaggaaaaggaggccttcaaggacatcctgtggttcaacgagaagaagcagatccccatcaccagcatccgtctgttcgcccgccccgatgccaacaacctccaggtgatcaagaagcacgaaaaggggaagaacatcggcttcgtgctgtccgggaataaccaccacatcgcgatctacgaggacaagaacaacaagctgatccagcacatctgcgacttctggcacgccgtcgaacggaagcgcaataacatcccggtgctcattgaggataccagcaccatctggaaccacctgatcaacgaggacttctccgagagcttcctgaacaagctccccaacgacagcctgaagctgaagttcagcctccagcagaacgagatgttcatcctgggcctgcccaaggagcagagcgaggaggccatcaagagcaacaacaagagcctcctgtccaagcacctgtacctcgtgtggagcatcaccgacggtgactacttcttccggcatcatctggagacgaagaacaccgagttaaagaagatcgacggctccaaggaaagcaagcgctacttgcggctgtccaccaagagcctggtcgatctcaacccgattaaggtgcgcctgaaccacctgggcgagatcaccaagatcggggagtga

SEQ ID NO: 7556 - RNA, 3846 nt, synthetic construct
  misc_feature 1..3846: note = Cas9 variant
  source 1..3846: mol_type = other RNA
atggaagacgactcacaacacgacatcagagaaatctacctcgccatacaccacatggtcaaatacagaggcaatttcctagtcgagggaaccctcgaaagcagtaacgctttcaaagaagacgaattgctcaaactcctgggacgaatcacgcgatacgaaatgagcgagggggaacaaaattcagacatagaacaagacgacgagaataaattagtggcacccgcaaatggacagcttgccgacgcgctttgtgctacgcgggggagccgcagcatgagagtagacaacgccctcgaagccttatccgcggtaaacgacctatcccgggagcaacgggcgatcgtcaaagcaatcttcgcaggcctagaaggtaacaagctagacctagctaaaatctttgtcagtaaagagtttagctcggaaaataaaaagatcctagggatctacttcaacaaaagcgactacgaagaaaaatgcgtgcagatagtcgactccggactactcgacgacgaagaaagagagttcctggaccgcatgcagggccagtacaacgccatcgcactgaaacagctactcggaaggagcacctccgtaagcgacagcaaatgcgcttcctatgacgcgcacagagccaactggaacctgatcaaactccaattacggacaaaagaaaatgagaaagacatcaacgaaaactacgggattctcgtcggatggaagattgattccggccaaagaaaatccgtcagaggagaaagtgcatacgagaacatgcggaagaaagcgaacgtgttcttcaagaaaatgatagaaacgagcgacctatcggaaacagacaaaaacaggctaatccatgatatcgaagaggacaaactattcccgatccagcgagattctgacaacggggtaatcccgcaccaactccaccagaacgagttaaagcaaatcattaagaaacaagggaaatactaccctttccttttggacgcgtttgaaaaggacggcaaacagataaacaagatagagggcttgctagcgttcagggtaccgtacttcgtgggacccctagtcgtacccgaagacctacaaaagagcgacaattccgaaaaccattggatggtgagaaagaagaaaggggagataaccccctggaacttcgacgaaatggtcgacaaagatgccagtggcagaaaatttatagagcgactcgtaggcaccgactcgtacctcctcggagaaccaacgctgcctaaaaactccctactataccaggaatacgaagtccttaacgaactcaacaacgttcgactaagcgtcaggaccggcaaccactggaatgacaagcgcagaatgagactcggaagagaagaaaagaccctgctctgccagcgccttttcatgaaaggacaaactgtgaccaaacgcacagccgaaaacctactccgcaaggagtacggccgcacttacgagctatcgggactaagtgacgaatcaaaattcacgtccagcctatcgacatatggcaaaatgtgcaggattttcggcgaaaagtatgttaacgaacaccgagacctcatggaaaagatcgtcgaactgcaaacggtattcgaagacaaagagacgttgctccaccagctgcgacaactcgaaggcataagcgaggcagactgcgcgctccttgttaacacccactacacaggatggggcagactatcaagaaaactcctaaccacaaaggcgggcgaatgcaaaattagcgacgacttcgcaccgcgaaaacattccatcatcgaaatcatgcgcgccgaagatagaaacctgatggaaatcataacagacaaacagctgggcttcagcgactggatagagcaggaaaacctgggagccgaaaacggcagctcgctgatggaagtagtcgacgacctacgggtcagcccaaaagtaaaacggggcatcatccagagcatccgcctcatcgatgacatctccaaagcggtcggcaaacgccccagccgaattttcctcgaactcgcagacgacatacaaccatcaggccggaccatcagccgcaaaagccgactgcaagacctctaccgaaacgctaacctcggaaaagagttcaaaggaatagccgacgaactcaacgcctgctcagacaaagacctccaagacgaccgactcttcctctattacacccaactcgggaaagatatgtatacaggggaagaactcgacctagaccgcctatcctctgcatacgacatcgatcacataataccacaggcagtaacgcagaatgattcgatcgacaaccgcgtcctagtcgcacgcgcagagaacgcgcgcaagacagacagcttcacctacatgccccagatcgctgaccgaatgcgaaacttttggcagatcctgctggacaacggactaattagtagagtcaaattcgaaagactaacaagacaaaacgagttcagtgaaagagaaaaagaacgattcgtacaaagatcccttgtagaaacacgacaaatcatgaagaacgttgccaccctcatgcggcaaagatacggcaactcggcagcagtaatagggctgaacgcggaactaacaaaagaaatgcaccgctacctcggcttcagccataaaaaccgagacatcaatgactatcaccacgcccaggacgcactctgcgtagggatagccggccagttcgcagccaaccgagggttcttcgccgacggggaggtctccgacggggcccaaaactcatacaaccaatacttacgggattacctgcgcggttaccgagaaaaactatcggccgaggaccgcaaacagggccgcgcattcgggttcatagtcggaagcatgcgcagccaggacgaacagaaacgggtgaaccccaggaccggggaagttgtctggagcgaggaagataaagactacctaagaaaagtgatgaactatcgaaagatgctcgtaacacaaaaagtaggcgacgacttcggagccctctacgacgaaacacgctacgcagcaaccgaccccaaggggataaagggaataccgttcgacggcgccaagcaagacactagcctgtacgggggattctcatcggcaaaacccgcctacgcagtattaatcgagagcaaagggaagaccaggctagtgaacgtaacaatgcaggagtattctctgctcggcgacagaccatccgatgacgaactcagaaaagtacttgccaaaaagaagtctgaatacgcaaaagccaatatcctgctgcgccacgtccccaagatgcaactcatacggtacggcggaggactaatggtaatcaaatccgccggcgaactaaataatgcgcaacaactgtggctaccgtacgaagagtactgctacttcgatgacctgtcccaaggcaaaggctccctagagaaagacgatctcaagaaactcctggattccatcctcggatctgtccagtgcctctacccctggcaccgcttcaccgaggaagaactagcggacctccacgtcgcattcgacaaattaccagaggacgaaaagaaaaatgtcataaccggcattgtctcggccttacacgcagacgccaaaaccgctaatcttagcatcgtcggaatgacagggtcatggcgccgtatgaataacaaatccggatacacattcagcgacgaagacgagttcatcttccaatccccctccggactattcgagaaaagggttacggtgggggaactaaaacggaaagcaaagaaagaagtcaactcgaaataccgaaccaacgagaaaagactgcccacgctatcaggggcctcacaaccatga

SEQ ID NO: 7557 - RNA, 3861 nt, synthetic construct
  misc_feature 1..3861: note = Cas9 variant
  source 1..3861: mol_type = other RNA
atgaccaagaacatactgggcctcgacctggggaccaacagcatcggctgggccttgatcgaggtggacgaaaacaacacgcccatccggatcattgccatggggtcccggatcatcccgctcagcacttcggacaaggaagaatttcagcgcggcttgagcatcaccaaaaaccagtcccgaaccgtcagccgcacgcagcggaaggggtacgaccgcaagcagctgaagaagtccgacctcaaaaagatcctgaacaagtacaacatcttcccaagcgaggagctgctcaagctccccatgctggatctctggaagttaagatccgacagcgcgaaccccaacgaaaacatttcagccgagcagctgggccgcatcctctacatgctcaaccagaagcgaggctataagagcgctcgctccgaggccaatgccgacaaaaaggacaccgactacgtgcaggcggtgaaggggcggtacgcccagctgaaggagcgcaaccagaccatcggccagtacttctacgaggagctctataacgccaacaccaacaacagctacttccggatcaaggaggaggtctacccgcgcgaggcctacacggaagagttcgacaccatcatcaacgcgcagaaaaacaagcacgacttcctgaccgacgaagtggtccatcagctgcggaacgagatcatctactttcagcgcaagctcaagtcccagaaggggcttgtcagcatttgcgagttcgagggctttgagaagaccgttttcgataaagagaagaacaaggacaaggtggtcttcgtagggtcgaaggtggcccccaagacgagccccctgttccagctctgccggatctgggaggtcgtgaacaccatcagtctgaagatcaagaacccagagggaagcaagtacaagtggggcgagaagacccctaacctgaaggagaaggaaatcttggccgactacctgttcaaaaacgacagcctgtccttcaccaagctcctggagatcctggacctgaacaagaatgacgtgtacgtcaacaagcagatactgaaggggatcaagggcaatgagacgttcagcgccctacacaccgtgttgggggataacgagctgctgaacttcgatgtgtccatcatcccgagcaaccacacctccatgctcgtcgacaagaagaccggcgagatcctggaggagcgcgccggcctagagctcgacgcgagcctggagaaggagcccttataccagctctggcacacgatctattccctgaaggttctagacgagtgcaagaacgccctcatcaaaaggttcgggtttgacgacgagaccgcagagaagctgtcgcacattgacttcaacaagcaggcattcggcaacaagtcgaacaagagcatgcgcaagatcctgcccttcctgatggaggggtacgactactcccagagctgctctctagccgggtacaaccacagcaactccctaacaaaggacgagcgggagcaacagatcacgctggaccgcctcgagctactatctaaaaactcccttcgccagccgatcgtagagaagatcctgaaccagatgatcaacgtcgtgaacgcgatcctggagcagtacggcaagctcagcgagatcagagtcgagctggctcgcgagctgaagcagtccaaggacgagcggaacgacgccgacttgcagaactcaaagaacaaaaagctgaacgaggagatcggcaagcgtctggccgagctcggcctgcccgtcacgaagcggtacatccaaaaatacaagttcatcttcccaagcctgtccaagaacctcaaggacgcccacgtgaacaatcagtgcatctactgcggggagaccttcaacctgaccgaggcgctgtctggcgacgcgttcgacgtcgaccacatcgtgcccaaggccctcctgttcgacgattcgcagaccaacaaggtgctggtccatcgcaagtgcaacagcacgaagaccaaccagaccgcttacgactacatcgggaccaagggagaggaacaggtccggatttactccgagcgcgtggacgactggttcaagcgggggatcatctcgtactccaagatgcagcgcctgaaggtgagccacaaggagtacctggagcggaagaagctgggcaaggagacggagaccgacaagaagctctgggagaatttcatcgaccgccagctgcgggacacccagtacatctctcgcaaggcccgtgagatcctgcaaaaggtgtgcaacaacgtcaccactaccgaaggcgggatcaccgcgaaactccgcaacctgtgggggtgggacgacgtgctaatgaacctccagatgccaaagtacaaggagctggggcagaccgtaatcaaggaatggacgagcgagcatggcaagcggaagcaccagaaggaggagatcgagaactggacgaagcgcgacgaccaccggcaccacgccatcgacgctctggttgtcgcctgtaccaagcaggggttcatccaacgcattaacaccctcaactccagcgataccaaggacctgatgcagcgcgagatcaaggaagcaaagaagctactcggcgagaactacaacgagaaggagttcgaaaacgacaacgagttcgttaagaaccacaaggagcgtttgtcccagctggacgactacctccgcctgcagaagcccgtgaagttcgacacgaagtacgtcgagcaggaagccgacaaggtgctggtgagcttcaaggccggaaagaaggtcgccaccataaccaagttcaaagccaccgggaagaacaaggacacgggcgtgatagtcctccgcggggcgctccacgagcaatccgtctacggcaagatcaaggtgattgagaaggataagcccctgaagtacctcttcgagaacagcaagaaaatcgtcaaccccaagattaaggtccttgtagaggagcggctggccgagaacgagaataactcaaagctcagcttaagtaccctgaaaaagaacccgatcttcctcaacgaggagaagacagagattctggagaaggccagctgctacaacgacgccaccgtgctgaagtacaagctccagtccctgaaggcctcacaggcggacgacatcgtagacgaccgggttaagttcctggtgaaagagcgcctcgcccagttcggcaacaaggagaaggaggccttcaaagacacactgtggctgaacgaggagaagcagattcccattataaccgtccgcttgtttgcccggcccgacgccaacaacttacaggcgatcaagaaggacaagaacgggcgggacatcggctttgtgctgacgggtaacaaccaccacatcgccatctacgaggacaaggacaacaagctcgtgcagcatagctgcaccttctggcacgccgtcgagcgcaagaaaaacaacgtccccgccgtgataaagaactccagcgacgtctggaaccagcttctagataaagagctccccgagtccttcctgaacaagctgcccatcgacaagctcaagctgaagttcagcctgcagcagaacgaaatgttcgtgctcggcctgctgcaggaggacttcgaggcggccatagaaaacaacgataaaacgctcctgtccaaacacctctacctcgtgtggagcattaccgacggggactacttcttccggcaccacctggagaccaaaaacaccgagctgaagaagacggagggtgccaaggagtccaaacgctacttccggctctcgaccaagggcctgatcgacctgaaccccgtcaaggtgcgcctcaaccacctgggggagatcaccaagatcggcgagtattga

SEQ ID NO: 7558 - RNA, 3864 nt, synthetic construct
  misc_feature 1..3864: note = Cas9 variant
  source 1..3864: mol_type = other RNA
atgaagaccgtgctgggcctcgacttagggaccaacagcatcggctgggccctgatcgagctcgacgagaacaacatccccatccgcatcgtcgccatggggtcccggatcatcccgctgagcacttccgacaaggaggagttccagcgcggcctgagcatcaccaagaaccagtcccggaccgtgagccggacccagcggaaggggtacgaccggaagcagctcaaaaagtcctacctgaagaagatcctgaacaagtacaacatcttccccagcgacgagctcctgaagctgcccatgttagacctctggaagctgcggtccgatagcgcgaatcccaacgagaacatctccgccgagcagctcggccgcatcctgtacatgctgaaccagaagcggggctacaagagcgcccgcagcgaggccaacgccgacaagaaggacacggactatatccaggccgtgaaggggcgatacgcccagctcaaggaccgcaaccagaccatcggccagtatttctacggggagctgaacgacgccaacgagaacaacagctacttccgcatcaaggaggaggtctacccgcgcgaggcctacaccgaggagttcgacaccatcatcaacgcgcagaaggacaagcacgacttcctgacggacgaggtgatccaccagctccggaacgagatcatctacttccagcgcaagctgaagtcccagaagggcctggtatccatctgcgagttcgaaggttttgagaagaccgtcttcgataaggagaagaacaaggacaaggtggtgttcgtcggccccaaggtggcccccaagaccagccccctcttccagctgtgccggatctgggaggtcgtcaacaccatcacgctgaagatcaagaacccggagggcagcaagtacaagtggggcgagaagatccccgacgtgaaggagaaggagatcctggccgactatctgttcaagaacgagtccctgagcttcaccaagctcctggagatcctgaagctcaacaagaacaacgtgtacttcaacaagcagatcctgaaggggatcaaggggaacgagacctacagcatcctgcactccatcttaggcgacagcgagctgctgaacttcgacgtctccatcatccccagcaaccacacctctatgctcatcgacaaaaagacgggcgagatcctggaggagcgcgccgggctggagctcgacaccagcctggagaaggagcccctgaaccagctctggcacaccatctattccatcaaggacctggacgagtgtaagagcgccctgatcaagcggttcggcttcgacgacgagacggcggacaagctctcccgcatcgacttcaacaagcaggccttcgggaacaagagcaacaagagcatgcggaagatcctgccattcctgatggagggctacgactacagccagtcctgtagcctggccgggtacaaccactccaacagcttcacgaaggacgagcgcgagcagcagatcacccttgataagctggagctgctccccaagaactccctgcgccagcccatcgtagagaagatcctgaaccagatgatcaacgtggtcaacgccatcctcgagcggtacggcaagcccagcgagattcgcgtggaactggctcgtgagctgaagcagtccaaggacgagcgcaacgacaccgacctccagaacagcaagaacaagaagctgaacgaggagatcggcaagcggctggcggagcttgggctgccgctgaccaagcgctacatccagaagtacaagttcatcttccccagcctctccaagaacctgaaggacgcccacgtgaacaaccagtgcatctactgcggcgagacgttcaatctgaccgaggccctcagcggggacgccttcgacgtcgaccacatcgtgcccaaggccctgctgttcgacgactcccagaccaacaaggtgctcgtccaccggaagtgcaacagcaccaagacaaaccagaccgcgtacgactacatcgccactaagggcgacgagcaagtccgcgtgtactccgagcgtgtggacgactggttcaaacgcgggatcatcagctactccaagatgcagcggctgaaagtaagccacaaggagtacctggagcgcaagaagctcggcaaggagaccgagacggacaagaagctgtgggagaacttcatcgaccggcagttgcgcgacacccagtacatctcccggaagtcccgcgagatcctccagaaggtctgcaacaacgtggccaccaccgagggcggggtgacggccaagctgcggaacctgtggggctgggacgacgtcctcatgaacctgcagatgcccaagtacaaggaactgggtcagaccgtggtgaaggagtggacctccgagcacggcaagcgcaagcaccagaaggaggagatcgagaactggacaaagcgggacgaccaccgccaccacgccatcgacgcgctcgtcgttgcctgcaccaagcaggggttcatccagagaatcaacacgctgaacagctccgagaccaaggacctgatgcagcaggagatcaaggaggccaagaagctcctgggcgagaactacaatgagaaggagttcgagaacaacaacgagagcgtgaagaaccacaaagagcggctgtcccaactcgacgactacttgcgcctgcagaagccggtcaaattcgacaccaagtacgtggagcaggaggccgacaaggtgctcgtgagcttcaagtccggcaagaaggtggcgaccatcacgaagttcaaggccaccgggaagaacaaggacaccggcgtgatcgtcccccgcggggccctgcacgagcagaacgtgtacggcaagatcaaggtgatcgagaaggacaagagcctgaagtacctcttcgagaacagcgaaaagatcgtcaacccgaaaatcaagaacatcgtggagatcatcctgtccgagaacgagaacaactcaaagatggccctgtccaccctgaagaagaaccccatcttcctgaacgaggagaagacggacctgctcgagaaggccagctgctacgagtacgtgaccgtccggaagtacccgctgaacacaatcaaggcgtcccaggccgacgacatcgtggacgagcgggtgaagttcctggtcaaggagcgcctcacccagttcggcaacaaggagaaggaggccttcaaggacacgctgtggtttaacgaggagaagcagatccccatcatcaccgtgcggctgttcgcccgccctgacgcgaacaacctacaggcgatcaagaaggacgagagcgggaaggaaatcgggttcgtggtcatggggaacaaccaccacatcgccatctacgaggacaaggacggcaagctagtgcagcactcctgcaccttctggcacgccgtggagcggaagaaatacaacatcagtaccgtcatcaagaactccagcgacgcctggaaccagttcctggacaacgagctccccgaaccgttcctgaacaagctgcccgccgacaacctcaacctgaagttctccctgcagcagaacgagatgttcatcctcgggctgagccaggaggagttcgacaaggcgctgaagtccaacgacaagagcctcctgtccaagcacctgtacctcgtgtggagcatctccgagaacaactactggttccggcaccacctggagacgaagaacagcgacctgaagaagaccaacggcgtgaaggagtccaagcggctctacaatatccgcagcctgggcagcctgttctccctcaaccccatcaagatccggctgaaccacctgggggagatcaccaagatcggcgagtatagctga

SEQ ID NO: 7559 - RNA, 3867 nt, synthetic construct
  misc_feature 1..3867: note = Cas9 variant
  source 1..3867: mol_type = other RNA
atgcgtctgttcgaggagggccacaccgcggaggaccggcgcctcaagcgcaccgcccgccgacgcatcagccgtcgccggaaccgcctgcggtacctgcaagcgttcttcgaggaggccatgacggacctcgacgagaacttcttcgcccgcttacaggagtctttcctggtgcccgaggacaagaagtggcaccggcatccgatcttcgccaagctcgaggacgaggtcgcctaccacgagacctaccccaccatctaccacctccgcaagaagctggcggacagctccgagcaggccgacctccggctgatctacctggccctcgcacacatcgtgaagtatcgcgggcacttcctgatcgagggcaagctgagtaccgagaacacgtccgtgaaggaccagttccagcagttcatggtcatctacaaccaaaccttcgtgaacggggagagccggctcgtgtccgcgcccctgcccgagagcgtcctgatcgaggaggagctcaccgagaaggcctcgcgcaccaagaagtccgagaaggtgttacagcagttcccgcaggagaaagctaatggcctgtttgggcagttcctcaagctgatggtgggcaacaaagccgacttcaagaaggtcttcggcctggaggaggaggccaagatcacgtacgcgagcgaaagctatgaggaggaccttgaggggatcctggccaaggtgggcgacgagtactccgacgtgttcctggcggcaaagaacgtctacgacgccgtggagctcagcaccatcctggctgactccgacaagaagtcccacgccaagctgagcagctccatgatcgtgcggttcaccgagcaccaggaggacctcaagaagttcaaacgcttcatacgggagaactgccccgacgagtacgacaacctgttcaagaatgagcagaaggacgggtacgccggctatatcgcccatgccgggaaggtcagccagctgaaattctaccaatacgttaaaaagataatccaggacatcgcgggcgccgagtacttcctcgagaagatcgcccaagagaacttcctgcgcaagcagcgcaccttcgacaacggggtgatcccccaccagatccatctggccgagctccaggccatcatccatcggcaggcggcctactaccccttcctgaaggagaaccaagagaagatcgagcagctggtcacgttccgcatcccgtattacgtagggcccttaagcaaaggcgacgcctccaccttcgcctggctgaagcggcagagcgaagaacccatccgcccctggaacctgcaggagaccgtggacctcgaccagtccgcgaccgccttcatcgagcggatgacgaacttcgacacctatctcccgagcgagaaggtccttcctaagcactccctcctgtacgagaagttcatggtgttcaacgaactcaccaagatcagctacactgacgaccgcggtatcaaggccaacttctccggcaaggaaaaggagaagatcttcgactacctatttaaaacgcggcgcaaggtgaagaagaaggatattatccagttctaccggaatgagtacaacaccgagatagtcacccttagcggactggaagaggaccagtttaacgcctccttcagcacctaccaggacctgctcaagtgcgggctgacgcgcgccgagctggaccaccccgacaacgcggagaagctcgaggatatcatcaagatcctgaccatcttcgaggaccgtcagcgcatccggacccagttgtccacctttaaaggtcagttcagcgccgaggtgttgaagaagctggaacgcaagcactacacggggtggggccggttatccaagaaactcatcaatgggatctacgacaaggaatccggcaagaccatcctggactaccttgttaaggacgacggtgtgtccaagcactacaaccgcaattttatgcagctcatcaacgactctcaactttccttcaagaacgcaatccagaaggcccagagctccgagcacgaggagacgctaagcgagaccgtgaacgaactcgccgggagccccgcgatcaagaagggcatctaccagtccctgaagatcgtcgacgagctggtggccatcatggggtacgccccgaagcggattgtggtcgagatggcccgcgaaaatcagacgaccagcaccggcaagcggcgctccatccagcgcctcaagatcgtggaaaaggccatggcggaaatcgggagcaacctgctgaaggagcagcccaccacgaacgagcagttacgggacacccgcctgttcctgtactacatgcagaacggcaaggatatgtacaccggcgacgagctctccctgcaccggctgagtcactacgacatcgaccacatcatcccccagtccttcatgaaagacgacagcctcgacaacctggtgcttgtcggatccaccgagaaccgcggcaagagcgacgacgtaccatccaaggaggtggtcaaggacatgaaagcctactgggagaagctctacgccgccgggctgatcagccagcgaaagttccagaggctgaccaaaggcgagcagggcgggctcacgctggaggataaggcgcacttcatccagcggcagctggtggaaacacgccagatcaccaagaacgtggccggaatcctcgaccaacggtacaacgccaagtccaaggagaagaaggtccagatcatcaccctaaaggccagcctgacgtcccagttccggagcatcttcgggctctacaaggtgcgggaggtgaacgactaccaccatgggcaggacgcctacctgaactgcgtcgttgcaaccaccctgctcaaggtgtacccgaatctggcccccgagttcgtctacggggaatacccaaagttccagacgttcaaggagaataaggccacggccaaggcaatcatctacaccaacctgctccgcttcttcacagaggacgagccccggttcaccaaggacggcgagatcctgtggtccaacagctatctgaagacgatcaagaaggagctcaactaccaccagatgaatatcgtgaagaaggtggaggtccagaagggcgggttcagcaaggagtccatcaagccgaagggcccctccaacaaactcatccccgtgaagaacgggctggacccccagaagtacggcgggttcgactcccccgtggtagcgtacaccgtcctcttcacccacgagaagggcaagaagcccctgatcaagcaggagatcctgggcataaccataatggagaagacgaggttcgagcagaaccccatcctcttccttgaggagaaggggttcctgcggccgcgcgtgctcatgaagctgcccaagtacaccctgtacgagttccccgagggccggcgccggctccttgcgagcgccaaggaagcccagaaggggaaccagatggtgctgcccgagcacctcctgaccctgctctaccacgccaagcagtgcctgctgccgaatcagtccgagagtctcgcgtacgtggagcagcaccagcccgagttccaggaaatcctggagcgcgtggttgacttcgccgaggtgcacaccctcgccaagtcgaaggtgcagcaaatcgttaagctgttcgaggcgaaccagacggcagacgtgaaggagatcgccgccagcttcatccagcttatgcagttcaacgccatgggcgccccctccaccttcaagttcttccagaaggacatcgagcgggcgcgctacaccagcataaaggagatcttcgacgccacaatcatctatcagtcccccacggggctgtacgagaccaggcggaaggtggtcgactga

SEQ ID NO: 7560 - RNA, 3903 nt, synthetic construct
  misc_feature 1..3903: note = Cas9 variant
  source 1..3903: mol_type = other RNA
atgtggggcgttagcctgttcgaggccgggaagaccgccgcggagcgccggggctaccgctccacccggcgccggctcaaccaccgcaagttccggctgcgcctgctcgaggacatgttcgagaaggagattctgtccaaggatccctccttcttcatcaggctgaaggaggccttccttagccctaaagacgagcagaagcagttcaagggaaatatactattcaacgacaaggactacacggacgccgactactacgagcagtacaagaccatctaccacctccgctatgacctcatctcccagcaccggcagttcgacattcgcgaggtctacctggccatacaccacctgatcaagtaccggggccacttcatctacgaggaccagactttcaccacggacgggaaccagctccagcaccatatcaaggccatcatcaccatgatcaacagcaccctgaaccgcataatcatccccgagaccatcgacatcaacgtgttcgagaagatcctgctcgaccggatgatgaaccgctccagcaaggtgaagttcctgatagagctgacgggcgaggacaagcaggacaagcccttactgaaggagctgtttaacctcatagtgggcctgaaggcaaagcccgcctccatcttcgagcaggagaacctggccaccatcgtggagaccatgaacatgagcaccgaacaggttcagttagacttactgacgctcgccgacgtcctggcggacgaggagtacgacctgctcctgaccgcccagaagatctactccgctataatcctggacgagagcatggacggttacgaatacttcgccgaggccaagaaagagtcctaccggaagcaccaggaggagctcgtactggtgaagaagatgttaaagagcaacgcgatcaccaacgatgaacgcgccaagttcgagtacttctacaccgactacatcggcgccaagtccagcaactatgaggagtccaagaacatcaagaagggcctgagtgccgcctacggcaagtactccaaggaggagcgcctgtttaagcacatcgaactgctcctggcaaaagagaacgtcctgacgaccgtggagcacgccctcttagagaagaacatcaccttcgccagcctgctcccgctgcagcgcagctcccggaacgccgtgatcccctaccaggtccacgaaaaggaattggtagccatcctcgagaatcaggcgacctactaccccttcctactggaacagaaggacaacatccacaagctgctgacgttccgcatcccctactacgtggggccgctggccgaccagaaggacagcgagtttgcctggatggtccgcaagcaggccggcaagatcacccccttcaacttcgaggagatggtggacatcgacgcctccagcgaggcgttcatcaagcggatgaccaacaaatgcacctacctgatccacgaggacgtgatccccaagcactccttcagctacgccaagttcgaggtcctcaacgagctgaacaagatccgcttggatggcaagcccatcgacatcccgctcaaaaagcggatcttcgaggggctgttcctggagaaaacgaaggtgacccagacctccctcaagaagtggctggccgagcacgagcacatgaccgtgagcgtagtgcaaggcacacagaaggagaccgagttcgctactagcctgcaggcgttccaccgcttcgtgaagattttcgaccgggagaccgtcagcaaccctgccaacgaggaaatgttcgagaagatcatctactggtccacagtgttcgaggacaagaagatcatgcgccggaagctcagcgagtacccccagttaaccgagcagcagcaggtccagctggcccaggtgcggttccgggggtggggccggctcagccagcggctgatcaaccgaatcaagacccccgtgagcggcgacgaggaccacaagttatccataaacgaaatcctctggcagaccaacgaaaacttcatgcagatcatccggaacaaggattacctgtttaagaagatcatcgaggagcagttcgagaacgagacggccttgctcaacaagcagcgcatcgatgaactggccgcgagcccggccaacaagaaggggatctggcaggccatcaagatcgtcaaagagctggagaaggtgctccagcagcccgccgagaacatctttatcgagttcgcccggtccgacgaggagagcaagcgctccacgccccgggacaagttcatcgagaaggcgtacgcccagctgaagaaggagaccgacaccttcaacctggaacacctcaaggagctgaagcagcgcagcaaacagctgtcttcccagcggctgttcctgtacttcatccagaacgggaagtgcatgtacagcggggaacacctagacatcgagcgcctggactcctacgaggtggaccacatcctgccccagagctacatcaaggacaactccatcgagaacctggccctcgtcaagaaggtggaaaaccagcgcaagaaggacagcctgctcctcaactccagcatcatcaaccagaattactccaggtgggagcagctgaagaacgccggcctgatcggtgagaagaagttccgcaacctcacccggaccaagattaccgaccgcgacaaggaaggcttcatcgcccggcagttggtggagacccgccagatcaccaagcacgtcacgcagctgctccagcaggagtacaaggacaccacgaaggtgttcgcaatcaaagccaccctcgtgagcggcctgcggcgcaagttcgagttcatcaagaaccggaacgtcaacgactaccaccatgcccaggacgccttcctcgtggcgtttctggggacgaacatcacctccaactacccgaagatcgagatggagtacctgttcaagggctaccagcactacctaaacgaggtgggcaagagcgctgccaagcccaagttcaccttcattgtcgagaacctgtccaagcagcagtataacagcaccacgggggaggtgaagtggaaccccgaggtagatattgccaagctgaagcgcatcctcaacttcaagcagtgcaacatcgttcggaaggtggaggagcagtccggggcactgttcaaggagaccatctaccccgtggaggaatcctccagcaagactatcccgctgaagaagcacctcgacaccgcgatctacggcggctatacggccgtcaactacgccagctacgcactaatccagttcaagaaggggcgcaagctgaagcgggagatcatcggcatcccccttgccgtgcagacccgcatcgacaactccgagaccagcctgcaggcgtacatcgccgagcagatcaagtccgaggtggagatcctgaacgggcggatcctcaagtaccagctgatcagcaacaacgggaaccgcctgtacatcgccgggccctccgagcggcacaacgcccgccagctcatcgtcagcgacgaggccgcaaaggttatctggctgatatccacaaagcaggccgacgaggccatgttcctgaagtactaccggctcgaacacctggaggccgtgttcgaggagttaatccgcaagcaggcggccgactatcagatcttcgagaagctcatcaagaaaattgaggtcaacaaagtgtacttctacagctgcacgtacaacgagaaggtgaaggtcatcgaggagctgctgaagatcacccaggccaacgccacgaacggcgacctcaagctgctgaagatgtccaaccgggagggcagactcggtagcgtgagcgtggccctggacttcaagatcatcaaccagtcggtcaccggcctgtatcagtccatcgaggactacaacaactga

SEQ ID NO: 7561 - RNA, 3930 nt, synthetic construct
  misc_feature 1..3930: note = Cas9 variant
  source 1..3930: mol_type = other RNA
atgggttccgttggcttcgccggaatagacaatcaatacaacctggtgaggacaaaaggtaaaaacgtaatcggagtacgactattcgacgaagcggatagcgcagccgaacgtagaggccatcgcaccaaccgccgacgcctccaaagaagacgctggcgattgagactactggacgacatattcgcgaagcccctacaagcagtcgacccaaacttcctggcgcgcctaaaatactcgtacgtaaataagaaagaccaaggtcagcaggaccactactacgggggctacgtattcggaagcacagcagcagaccaagcctatcaccaagcatacccaacaatataccaccttcgcaaaagactcatggaagacgaccaaaaacatgatctacgtgaagtgtacctcgcaatccaccacatcgttaaataccgagggaacttcctaaaccctcaatcgtcactggacatcgatcaacagttcgatgtaactgacttcgcccaagcactcgcacgcttcgcagaccaccaagcactgtcctgggcactagaagcacccatcagatttcttgaagccgaactcgccaccggactctccaactcagcaagagtagacgccgcgatagaggctttctcattcgacacaaaggtagacagggccgcgatcaaggaaatgctcaaaggtctctcgggcaaccagatcgacttcacaaaactgttcgtgaatgtcgacagcgccgattgggaccaagaggaacgcaagcaatggaagatgaagctatccgaagaagacttcgacgaacaagcgctacccatccttgagaggctcagccaagacgaaacagagttcttcttagccatcaagcgggcctacgacggtatcgcacttatgcgcttcctaggagacgaacagtcactatccagcgccatgataaaagcgtacgaagaccacagaagagatctaaccttcctcaaaacccaggttcgaactccccaaaaccgccaagccctgagcgagggctatacgaactacctttcggttgatgacaagaaacacaaaagaggagcgaaagaattagcccaactcatagaagcgtccgatgcgtcagaacaagacaaagccaccatgctcgaccggatcgcaaacgaccaattcgcacctaaacagcgcaccaaagccaacggattaattccataccagctacatctcgcagagttaaagaaaatcctcgcgaaacaagggcaatactatccattcctactggacacattcgcaaaacaaggccagtcagtaaataaaattgaagaacttgtccaatttagagttccctactacgtgggccccatggtgccaaaaagcgaaacagctggcaacgccgaaaaccactgggtcgagaaaaacgacggccaaacgaaagtcagcgtcaccccgtggaatttcgaccaagtgttcaacagagaccgcgcagccaaatcattcattgatcggctaaccgggaccgatacctatctaatcggggaacccactctaccgcgtcactccctaacgtatgaaacgttcaccgtgctaaacgagctcaacaacatacgtatcgacgggaaaaggctccccgtcgagaccaagcaggcaatcgtcgaggatttgttcaagaaataccggctcgtgaccaagaaaaggcttcaagactacttcgcgtcattcggcaaacgagaagtagaactcacgggtctcgctgacgagagcaggttcacaagttccctgaccagctaccacgacttgcaaggtctgctgggcacagatttcataacaaacccacagaaccacagcttactggagaaaatagtcgaaattcaaacagtcttcgaagacagcgacattgcagaacgcgaactcggcaagctaggacttgaacaaaaactcataccccgactcgccaagaaacactacacaggctggggaaacctctcacgcaaactcctggacacctccttcatccatgacccagaaagacccgaagaacccgttagtattatggacctactttacacaacaaacaaaaacttcatggaaatactgcacgactccgaatacggggttgaagaatggctaaaatcccaaaacatgatcgacgaccaaaaagacatccaaatgcgaatcgacgaactaacaacatcccccgccaacaaacggggcataaaacaagccttcaacgtgctagacgacataacccaagccatgggagaagaacctgcttacgtctatctggagttcgcaagagaaaaacaggcttctcgccggaccgtatcccggaagaaacgcctcgagactctctataaaaacgcggccctcaaaacagagtttaaagcaatcaaagaagcactcgccgaagaaagcgacgaccgcatgcaagacgaccgactttacctctactacgcacagcttggtcgagacatgtacaccggccaatccatctctatagaccaactatcgtcacactacgacatcgaccacatcgtgccccgcgcattcatcaaggacgacagtctagaaaacaaagtcctcgtcaacaggaccgacaacgcacgaaaaacagatagcgccaccttcacagccgacgtaaaagccaaagcattcccgctttggcagcaactcaaaaagctcggcctaattagcgccaagaaatttcgcctattaactcgtacaggggacttcacggaaatggagcgcgaacggttcatcgcccgccagctagtggagacccgacaaatcatcaaaaatgtggccgcactcatcgaaggccacttctcacaaacccaagccgttgcaatccgagcggaagtaaccggcgaactccgccaacttacccaaattaaaaaggacagagacataaacgactaccatcacgcccaagatgccctcctcgtggcaaccgccggaacctacctacaccgacacttccccaaacgcgacgcccgattcatctacaacgagttcgactactacacgcaacactggctcaaaaatcaaggagaaaaccggcgacgccacccctacagcttcgtcgtgggaaccatgagcaaaggcaacgaggactggacccccgacaacctaaactacctccgcaaagtaatgcaatacaaaaccatgctaatgacacgaaaaccagtcggacccgaaggcgcgctctacaaagaaacgctcatcgccgcagaccccaagaaaagacttgtcggcgcctcaaaagaacgacaagacccaaccatatacggaggctacaccaaagaaagctccgcctacatgtcactggtgcgcgctggcgggaaaaatcaattggtaaaaataccagtccgaatcgcaaacgagattcacagcggccaacgaaagctcgacgactacgtgcaagcgaaggtgaaaaagttcgaacgcatcctactcccaaaaatctccctaggccaactggtagaagacgaaggccaacgattctacctcgcgaccaacgaaatgaaacacaacgcaaagcagctatggctagatcagaaagtggtcaccacctacaaaaggctaacagccgagagcccggttgaagactttctcactgtcttcgacgcactcactagctcagccaccatacaccacttcaaattctaccagcgggatctcgaacttctacgtgacaaccgggcaggcttccaggacctggcaaaagccacacagctcaaggtactcaaggacgtactttacgaactccacgacaacgcaggctggagagaccccataaaacaatactttaaagaaataggcctcaaggttcgtatgtggactaaactgcaaaaagaaggcggaattaaactcacagaccaagcagaactgatctaccaatccccatcgggactattcgagaaacggagacgggtacaagacctactatga

SEQ ID NO: 7562 - RNA, 3939 nt, synthetic construct
  misc_feature 1..3939: note = Cas9 variant
  source 1..3939: mol_type = other RNA
atgcagaacggcttcctggggatcacggtgagctcggagcaggtcggctgggccgtgaccaaccccaagtacgagctcgagcgcgccagccggaaagacctgtggggcgtgcgcctgttcgacaaggcggagacggccgaggaccggcgcatgttccggaccaaccgccggctcaaccagcgcaagaagaaccggatccactacctgcgggacatcttccacgaggaggtcaaccagaaggacccgaacttctttcagcagctggacgagtccaacttctgcgaggacgaccggaccgtggagtttaacttcgacaccaacctctacaagaaccagttccccacggtgtaccacctccgcaagtacctgatggagaccaaggacaagcccgacatccggctcgtctacctggccttcagcaagttcatgaagaaccgcgggcacttcctatacaaggggaacctcggcgaggtgatggacttcgagaactccatgaagggcttctgcgagagcctggagaagttcaacatcgacttccccaccctgtccgacgagcaggtcaaggaggtgcgggacatcctctgcgaccacaagatcgccaagaccgtgaagaagaagaacatcatcactatcaccaaggtcaagagcaagacggccaaggcgtggatcgggctgttctgcggctgctccgtgccggtgaaggtgctgttccaggacatcgacgaggagatcgtaaccgaccccgagaagatcagcttcgaggacgcctcctacgacgactacatcgccaacatcgagaagggggtgggcatctactacgaggccatcgtgagcgcgaagatgctgttcgactggtccatcatgaacgagatcctgggggaccaccagctgctcagcgacgccatgatcgccgagtacaacaagcaccacgacgacttaaagcgcctgcagaagatcatcaaaggcacgggctcccgggagctctaccaggacatcttcataaacgacgtcagcgggaactacgtgtgctacgtgggtcacgccaagaccatgtccagcgccgaccagaagcagttctacaccttcttaaagaaccgcctgaagaacgtcaacgggatctccagcgaggacgcggagtggatcgacaccgagatcaagaacggcacgctcctgcccaagcagaccaagcgggacaacagcgtgattccccaccagctgcagctccgcgagttcgagctgatcctggacaacatgcaggagatgtacccgttcctcaaggagaaccgggagaagctgctgaagattttcaacttcgtgatcccctactacgtcggccccctcaagggggtggtccgcaagggcgagtctacaaactggatggtgcccaagaaggacggggtgatccacccgtggaacttcgacgagatggtcgacaaggaggccagcgccgagtgcttcatctcccgcatgaccggcaactgcagctacctgttcaatgagaaggtgctgcccaagaactccctcctgtacgagactttcgaggtgctgaacgagctcaaccccctgaagatcaacggggagcccatcagcgtcgagctgaagcagcggatatacgagcagctgttcctgaccggcaagaaggtgaccaagaagtccctgaccaaatacctcatcaagaacggctacgacgaggacatcgagctgagcgggatcgacaacgagttccactccaacttaaagagccacatcgacttcgaggactacgacaacctgagcgacgaggaggtggagcgcatcatcctccggataacggtcttcgaggacaagcagctgctgaaggactacctcaaccgcgagttcgtgaagctcagcgaagacgagcggaagcagatctgctccttaagctacaagggctgggggaacctctccgagatgttgctgaacggcatcaccgtgaccgacagcaacggggtcgaggtgtccgtgatggacatgctctggaacaccaacctgaacctgatgcagattctctctaagaagtacggctacaaggcggaaatcgagcgctacaacaaagagcacgagaaaaacatctacaaccgggaggacctgatggactacctgaacatcccgccagcccagcgccggaaggtcaatcagctcatcacgatcgtgaagtccctgaagaagcgctgcggcgtgcccaacaagatcttcttcaaggtcagccgggagcaccaggatgaccccaagcgcaccagctccagaaaggagcagctgaagtacctctacaagagcctgaagtccgaggacgagaagcacctgatgaaggagctcgacgagctgaacgggcacgagctgagcaacgacaaggtgtacctctatttcctgcagaagggccgctgcatctactccgggaagaagctgaacctcagccggctgcgcaagtccaactaccagaacgacatcgactacatctacccgctgagcgcggtcaacgaccgttccatgaacaacaaggtcctcaccggcatccaagagaaccgcgccgacaagtacacttacttccccgtggaccccgagatccagaagaagatgaaggggttctggatggagctggtgctgcaaggcttcatgagcaaggagaagtacttccggctctcccgcgagaacgacttcagcgaaaacgagctggtctccttcatcgagagggagatcagtgacaaccagcagtccggcagaatgatcgccagcgtactgcagtactacttccccgagtccaagatcgtgttcgtcaaggagaagctcatcagcagcttcaagcgcgacttccacctgatctccagctacgggcacaaccacctccaggccgccaaggacgcgtacatcacgatcgtcgtgggcaacgtctaccacaccaagttcaccatggacccggccatctacttcaagaaccacaagcggaaggactacgacctcaaccgcctgtttctggagaacatctcccgggacgggcagatcgcctgggagagcggcccctacggctccattcagaccgtacgcaaggagtacgcccagaaccacatcgccgtgacgaagcgggtcgtggaggtgaagggcggcctcttcaagcagatgcccctgaagaaggggcacggggagtaccccctgaagaccaacgacccgcgcttcgggaacatcgcgcagtacggcggctacaccaacgtcaccgggagctacttcgtgctcgtggagtccatggagaagggcaagaagcggatcagcctggaatacgtccccgtgtacctgcacgagaggctcgaggacgaccccgggcacaagctgctgaaggagtacctcgtggaccaccggaagctgaatcacccgaagatcctgctcgccaaggtccgcaagaactccctgctgaagatcgacggcttctactaccggctcaacgggcgcagcggcaacgcgctgatcctgaccaacgccgtggagctcatcatggacgactggcaaacgaagaccgcgaacaagatttccggctacatgaagcggcgcgctatcgataagaaggcccgggtgtaccagaacgagttccacatccaggagctggaacagctgtacgacttctacctcgacaagctggaaaacggggtctacaagaaccgtaagaacaaccaggccgagctgatccacaacgagaaggagcagttcatggagctcaagaccgaggaccagtgcgtgctgttgaccgagataaagaagctgttcgtgtgcagccctatgcaggccgacctgacgctgatcggcgggtccaagcacacaggcatgatagcgatgagctccaacgtcaccaaggccgatttcagcatcatcgccgaggaccccctcgggctgcggaacaaggttatctactcccacatgggcgagaagtga

SEQ ID NO: 7563 - RNA, 3939 nt, synthetic construct; identical to SEQ ID NO: 1763
  misc_feature 1..3939: note = Cas9 variant
  source 1..3939: mol_type = other RNA

SEQ ID NO: 7564 - RNA, 3942 nt, synthetic construct
  misc_feature 1..3942: note = Cas9 variant
  source 1..3942: mol_type = other RNA
atgcactacctggacgagatcttcgcgccccacctccaggaggtggacgagaacttcctgcgccggctgaagcagagcaacatccacccggaggaccccgccaagaaccaggccttcatcggcaagctcctgttccccgaccttctcaagaagaacgaacgcgggtaccccaccctgatcaagatgcgggacgagttgccagtcgagcagagagcccattaccccgtgaccaacatttacaagttacgggaagccatgatcaacgaggaccgccagttcgacctgcgggaggtgtatctggccgtccaccacatcatgaaataccgcggccactttcttaacaacgcctccgtggacaagttcaaggtggggcggatcgacttctacaagagcttcaacgtacttaatgaggcgtacgaggagctgcagaacggcgagggctccttcacgatcgagcccagcaaggtggagaagatcggccagctcctgctggataccaaaatgcgcaagctcaatcggcaaaaggccgtggccaaactgctggaggtcaaggtggccgacaaagaggagaccaagcgcaacaagcaaatcgcgaccgccatgtccaagctcgtgttaggctacaaggccgacttcgccacagtcgccatggcgaacggcaacgagtggaagatcgaccttagctccgagaccagcgaggacgagatcgagaagttccgggaggagctctctgacgcccagaacgacatcctgaccgagatcaccagcctgttctcccagataatgctcaacgagattgtgcccaatggcatgagcatctccgaaagcatgatggaccgctactggacgcacgagcggcagctggccgaggtgaaagagtatctggccacccagccggcctccgcgcgcaaggagttcgaccaggtctacaacaagtacatcgggcaagcccccaaggagcggggcttcgacctcgagaaggggctgaagaagatcctgagcaagaaggagaactggaaggagatcgacgagctcctgaaggccggcgatttcctgcccaagcagcgcacctccgccaacggcgtgatcccccaccagatgcaccagcaggagcttgatcggatcatcgagaaacaggccaagtactatccttggctggcgaccgagaaccccgccacgggggagcgagaccggcaccaggccaagtacgagctcgaccagctcgtcagctttcgaatcccctactacgtaggccctctggtgaccccggaggtgcagaaggccacctccggggccaagttcgcgtgggccaagcgtaaggaagacggcgagatcaccccctggaacctgtgggacaagatcgaccgggccgagagcgccgaggcgttcatcaagcggatgacggtaaaggacacctacttattgaacgaggacgtgctgcccgccaacagcctcctgtaccagaagtacaatgtgctgaacgagctcaacaatgtccgcgtgaacggccgccggctgtcagtaggcatcaagcaggacatctacaccgagttgttcaagaagaagaagaccgtaaaggtgagcgacgttgccagtctggtgatggccaaaacgcgcggcgtgaacaagcccagcgtcgaggggctctccgacccgaagaagttcaacagcaacctggccacctacctggacctcaaatccatcgtgggcgacaaggtggatgacaaccggtaccagaccgacctggagaacatcatcgagtggagaagcgtcttcgaggacggggagatcttcgcggataaacttaccgaggtggagtggctcactgaccagcagcggtccgccctggtgaagaagcgctacaagggctggggccggctgagcaagaagctcctgaccgggattgtcgacgagaacggccagcgcataatcgacctgatgtggaacaccgaccagaacttcatgcagatcgtgaaccagcccgtgttcaaggagcagatcgaccagctcaaccagaaggccatcacaaacgatgggatgacgctgcgggaatgggtcgagtccgtgctggacggcgcctacacctcgccccaaaacaagaaggccatctggcaggtcgtgcgcgtagttgaggacatcgtcaaggcggtggggaatgcgcccaagtccatttcaatcgagttcgcacggaacgaaggcaacaagggcgagatcacccgatcccggcgcacccagctccagaagctgttcgaggaccaggcccacgagctggtgaaggatacgagcctcaccgaggagctggaaaaggctccggacttgtccgaccggtactacctctacttcacccaaggcggcaaggacatgtacaccggggaccccatcaacttcgatgagatcagcacgaagtacgacatcgaccacatcctgccccagtccttcgtcaaggacgacagcctggacaaccgtgtgctcgtttcaagggcagagaacaacaagaagtccgaccgggtccccgccaagctgtacgccgccaagatgaagccgtactggaaccagcttctcaagcaaggcctgattacccagcgcaagttcgagaacctgaccatggacgtggaccagaacatcaaatatcggagcctcgggttcgtgaagcgccagctggtcgaaacccgccaggtgatcaagctgaccgcaaacatcctcggctccatgtaccaggaggccggcacagacatcatcgagacccgggccgggctgaccaagcagctacgggaggagttcgacctccccaaggtccgcgaggtgaacgactaccatcacgctgttgacgcctacctgaccacgttcgcgggccagtacctgaaccggcgctaccccaagctccggagcttcttcgtgtacggggagtacatgaagttcaagcacggctccgatctgaagctgcgcaacttcaacttcttccacgagctcatggagggcgacaagagccaggggaaggtcgtggaccagcagaccggcgagctgatcaccacccgggacgaggtagccaagtccttcgaccgcctgttaaacatgaagtacatgctggtcagcaaggaggttcacgaccggtccgaccagctctatggggccacgatcgtgaccgccaaggagagcggcaagctcacctccccgatcgagatcaagaagaagcgccccgtcgacctgtacggtgcctataccaacggcacgagcgcgttcatgaccatcatcaagttcaccggcaacaagcccaagtacaaggtgatcggggttcccaccacgtccgccgtgggcttaaagcgggtggggaagccgggctccgagtcgtacaaccaggagctccaccgcatcatcaagagcaaccccaaggtgaagaaggactttgagattgtcgtgccccatgtgtcctacagtcagctgatcgtcgacgacgactgcaagttcaccctggccagcgacacctaccagcaccccgccacccagcttgtactgtccaaggagtcgatggagatcatcgcagacgacttcaaattcgttaaggagaacacggcgaccgccgacgagcagctggtgcgggttttcgacgagattgtgaaccagatgaaccactacttcaccatattcgaccaacgctccaaccggcagaaggtgaccaaggcccgcgacaagttcgtgagcctcccgacggagtccgagtacgagggggccaaaaagacccaggtcggcaagaccgaggtgatcacaaacctgctgatgggcctccacgcgaacagcgcccagggggacttaaaggtactgggcttgtccacgttcgggttcttccagagctccggcgggctgaacctgagcgaggacgccatgatcgtctaccagtcccccaccggcctcttcgagcgccggatctgcctgaaggacatctga

SEQ ID NO: 7565 - RNA, 3942 nt, synthetic construct; identical to SEQ ID NO: 1765
  misc_feature 1..3942: note = Cas9 variant
  source 1..3942: mol_type = other RNA

SEQ ID NO: 7566 - RNA, 3945 nt, synthetic construct
  misc_feature 1..3945: note = Cas9 variant
  source 1..3945: mol_type = other RNA
atgctgaagaaggactacagcatcggcctcgatatcgggaccaactccgtgggccacgctgtcgtgaccgacgactacaaggttcccacgaagaagatgaaggtcttcggggacaccagcaagaagaccatcaagaagaacatgctgggggtgctcctcttcaacgagggacagacagcggcggacaccagactgaagcggggcgcccgccggcgatacacccggcgcaagaaccggctgcgctacctccaggagatcttcgccccggccctagccaaggtggaccccaacttcttctatcggcttgaggagtccagcctcgtcgcggaggacaagaagtacgatgtgtacccgatcttcggcaagcgcgaggaggagctgctataccacgacacccacaagaccatctaccacctccggtccgagctagccaataacgaccgccccgccgacctgcggctcgtgtacctggcactggcgcacattatcaagtaccgcgggaacttcctcctggagggcgagatcgacctgcggactacagatatcaacaaggtcttcgccgagttcagcgagaccctcaacgagaactccgacgagaacctggggaagctggacgttgccgacatatttaaggacaacaccttcagcaagacgaagaagtccgaggagctcctgaagctgagcggcgccaagaaaaaccagctcgcccaccagctgttcaagatgatggtggggaacatgggctccttcaagaaggtactgggcaccgacgaggagcacaagctcagctttgggaaagacacctacgaggacgacctgaacgacctgctcgcggaggccggggaccagtacctggacatcttcgtggccgccaagaaggtgtacgacgccgcgatcctggcctccatcctcgacgtcaaggacacccagacgaagaccgttttcagccaggccatgatcgagcgctacgaggagcaccagaaggacctgatcgaactgaaaagggtgttcaagaagtacctcccggaaaagtgccacgacttcttctccgagccaaagatctcggggtacgctggctacatcgacggcaaggtttccgaggaggacttctataagtacacgaagaagaccctgaaggggatccccgagacggaggagatcctgcagaagatcgacgccaacaactacctccgcaagcaacggaccttcgacaacggcgcaatcccccaccaggtgcacctgaaggagctggtggccatcgtcgagaaccaagggaagtactacccgttcctccgcgagaacaaggacaagttcgagaagatccttaacttccggatcccctactacgtgggccccctggcccgcgggaatagcaagttcgcctggctcacccgcgccggagagggcaagatcaccccctacaacttcgacgaaatgatcgacaaggagaccagcgcggaagacttcatcaagcggatgacaatcaacgacctgtacctgccgaccgagcccgtgctgcccaagcacagcctcctgtatgagaggtacaccatcttcaacgagctggccggtgtgcggtacgtgacggagaatggcgaggcgaagtacttcgacgcccagaccaagcgcagcatcttcgagctgttcaagttggaccgtaaggtctccgagaagatggttatcaagcacttaaaggtggtcatgcccgcgatccgcatacaggccctcaaggggctggacaacggcaagttcaacgccagctacgggacctataaggacctggtggatatgggcgtggccccggagctcttgaacgatgaggttaactccgaaaagtgggaggacatcatcaagaccttgacgatcttcgagggcaggaagctcatcaagcgccggctggagaactaccgcgacttcctgggggaggacatcctccggaagctgagccgcaaaaagtacaccggctggggacggctgagcgccaagctcctggacggcatctacgacaagaagacccacaaaaccatcctggactgcctcatgacggaggactacagccagaacttcatgcaactgatcaacgacgacacctactccttcaaggagaccatcaagaacgcccaggtgatcgagaaggaggaaaccctggccaagaccgtgcaggagctccccgggtcacccgccatcaagaagggcatcctgcagtccctggagatcgtcgacgagatcatcaaggtgatggggtacaagcccaagtccatcgtggttgagatggcccgcgagacgcagaagactcacgggacccggaagcgggaggaccgggtgcagcagatcgtgaaaaacctcaaggacgcaaacgagctgccgaagaagctgccctccaacgcggagctatcggacgagcgcaagtacctgtactgcctgcagaatggccgcgacatgtacaccggggcgcccctcgactatgaccacctccagttctacgacgtcgaccacatcatcccccagtccttcctgaaggacgacagcatcgaaaacaaggtgctgacgatcaagaaagagaacgtgcgcaagaccaacggcctgccgtccgaggccgtcatccagaagatgggcagcttctggaagaagctgctcgacgccggtgccatgaccaataagaagtacgacaacttgcgccggaacctgcacggcgggctcaacgagaagctgaaggagcgcttcatcgagcggcagctggtggagacccgccagatcacgaagtacgtggcgcagctcctggaccagcggctgaactacgacggcaacggggtggagctcgacgaaaagatcgccatcgtgaccctgaaggcccagctggcctcccaattccgaagcgagttcaagctccggaaggtgcgcgcgctgaacaacctgcaccacgcccacgacgcctacctcaacgccgttgtggccaacctgatcatggcgaagtaccccgaattggagcccgagttcgtgtacggcaagtaccggaagaccaagttcaagggcctcgggaaggccaccgccaagaacacgctgtacgccaacgtcctttacttcctcaaggagaacgaggtgtaccccttctgggacaaggccagggacctgccgacgatcaagcggtacctgtatcgagcccaggtgaacaaggtccggaaggcggagcgccagacgggcgggttctccgacgagatgctcgtgcccaaaagtgacagcggcaagctgctgccacggaaggagggcctcgacccggtcaagtacggcggctatgccaaggcagtcgagtcctacgccgtgctcatcaccgcggacgaagtgaagaaggggaagacgaaaaaggtcaagaccctggtgaacatccccatcattgacagcaagaagtacgaggccgaccccacagcctacctcgcctcccgcggctacaccaacgtgacgaacagcttcatcctgcctaagtactccctgctcgaggacccggaggggaggcgccggtacctggcgagcttcaaggagttccagaaggccaacgagctgatcctcccgcagcacctggtcgagctactgtactgggtgaacgccaaggatggcgagcagaagctggaggaccataaagccgagttcaaggagctgttcgacaagatcatggagttcgccgacaagtacgtggtcgcgcccaagaactctgagaagatccgccgcctctacgaggagaatcaggacgccacccccatggagctggggaagaactttgtggagctgctccgctacaccgccgacggggccgccagcgacttcaagttcttcggcgagaacatcccgcgcaagcggtacaactccgcgggtagcctgctgaacggcactctcatctaccaatccaagacggggctgtacgagacccgaatcgacctgggcaagctctga

SEQ ID NO: 7567 - RNA, 3948 nt, synthetic construct
  misc_feature 1..3948: note = Cas9 variant
  source 1..3948: mol_type = other RNA
atgggctacagcgtggggctggacatcggcaccgggtccgtcggctgggttgtgacaaacgaggacgggaagctcgcccgcgccaagggcaagaacctgatcggcgtccggctgttcaagacggcggagcccgccgccgacaggcggaccaaccgcaccacccggcgccggctcagccgccggaagtggcgcctgcggctgctcgatgagctgttcgccaacgagctggggaagatcgactccaacttcctcacgcgcttgaagtacagctacgtgcatccgaaggacgacgccaaccgggcgaactactacggcgggtacctgttcccaacccaggaggagaccaaaaagttccacgccaagtaccccacgatctaccacctccgcctggccctgatgacggagtcccggcagttcgacctccgggagatctacctggccatgcaccagatcgtcaagtaccgggggcacttccttaactcacagtccaagatgaccatcgggaacacctataacccccaggacctccagaccgcgatggagaactacgccgaggccaagggcctgagcatcgagctgaagcagccggaggagatggtcgccatcctcacgggcgaggccgggttcggcctgtccaagaaagctaaggccgagaagctgctcaacaacttcttcttcgacaccaaggaggagaaggccactgtgcaagccattctggccgggatcgtgggcaacaccatcgacttcacgaaggtcttcaaccgccagctgaccggcgacaccctcaaggcgtggaagctgaagctggacagcgagaccttcgacgtggactccgagcccatcctcagcgacctggatgacgacgagacggagctgttcttcgccatccggcaggccttcgacgggttcaccctcatgaacctgctgggcgaccagacttccatcagcgccgccatggtggagcgctacacccagcaccacgacgacctcctgacggtcaagcaggtcgcgaagaagcaggggctgtcccacaaggagttcagcaacatctactccgccttcctcaaggacgacaccgacaagggcatgaagaagctgctggaggagagcaacctctccaccgaggacgtgaacgggatccaactgcggatggacagccacgacttcctgccccagcagcgcaccaaggccaacagcgtgatcccccaccagctccacctcgccgagctggaggccatcatcgagaaccagggccagtactacccgttcctgctggagacgttcgaaaaggagggcaccgcggccaacaagatcgccgagctgctgaagttccgcatcccctactacgtggggcccatggtgaccaagaaggacgtcgagaacgccggcggggacgcgaccaaccactgggtgacccggaacgagggctacgagaagtccgccgtgaccgcctggaacttcgaccaggtcttcaaccgagaccaggccgccctcgacttcatccaacggctgaccgggaccgacacgtacctgatcggcgagcccaccctcccgcagaacagcctgaaataccagatgttcaccgtgctgaacgagctcaacaatgtgaaggtcaacggccgccggatcgacaaccagaccaagcacgacttgatccaggacctgttcaagtccaagaaaaccgtgagcctcaaggcgttccaggattactaccagtcccagggcaagagcgacatccaggtcgtggggctggccgacaagacgaagttcaactccaacctgagcacctacatcgacctctccaagactttcagcgccgaggagatggagaacccacagaaccaggacctgctggagcagatcgtggagatccagaccgtcttcgaggactccaagatcgccgagcgcgaactcagcaagctggagctgacgcccgaacaggtcaccaagctcgccaagacccactacactgggtggggcaacctatccaacaagctgctcacgaccccgatagtggacgtgagcggaaagaaggtttccatcctggaccagctggcgaagaccagcaagaacttcatgtccatcatcagcaacgagcagtacggcgtgcaggactggatcaaggagcagaacaccacggagaccaccggcaccctcgaggacaagctggccgacctgacgacctccccggccaataagcgggggatcaagcaggccttcaacgtcctattcgacatccagaaggccatgaagtccgaacccgaccgcgtgtacctggagttcgctcgggagacccagaccagcgtgcgcacgatgagccggtacaactacctgaagggcctctaccagagcaagtccctggacgccgaggccaagaacctgaagaaggagctcgccgagaccgaccagaagaagttcgacaacgaccgcctgtatctctacttccagcagcaggggaaggacatgtacaccggccagcccatcaacatcgacaagctcagctccgactacgacatcgaccacataatcccccaggcgttcaccaaggacgacagcatcgacaaccgggtcctggtgtcccgcccggagaacgcccgcaagagcgactccgggacgtacaccacggaggtgcaggccgccgccagcgggctgtggaagaccctcgtccagtccggcttcatcagccggaaaaagtacgaccggctgacgcacgcgggggactactccgaaggccagaagaccgggttcatcgctcgccagctggtggagacccggcagatcatcaaaaacgtggccgccctaatcgagagcgagttcgaccagacgcaagctgtcgcgatccgcgccgaaatcactggcgacatgcgacggctggtggccatcaagaaacaccgcgagatcaactccttccaccacgccttcgacgccctgctcatcaccgcggccggccagtacatgcagaagcggtaccccgaccgcgacagcaacaacgtgtacaacgagttcgaccggtataccaacgactacctgaagaagctgcgggagtccagcagcaaggacgaggtccggaaactgaagcccttcgggttcatcgtgggcaccatggccaaggggaacgaggactggacgaccgagcagaccgagtacctgcgccacatcatgaacttcaagaacatcctgaccacctacaagacggggcccgaccgggggccgctctccaaggagaccatctacgccgtggaccccaaggcgaagctgatcggcaccaacaagcaccgccaggacgtcagcctgtacggcgggtacacttacccctacagtgcctatatgacgctcgtgcgggccaacggcaaaaaccagctggtgaaggtcagccgctccgccgccagcctgatgaagtccgggcagctcaaactggaggactacgtgcagcagcagcccgaggtgaagaagttcgagaagatcctgctcgagcacctcccgctgggccagctggtcgacaacgacgggaagctgatgtacctgaccagctacgagttctaccacaacgcgaagcagctctggctgtccaccgagaacgccgacctgatcagctccctcagcatcgactccgacgaccagaagctgatcaaggccttcgacatcctgaccgccgacagcgtgatcgagcggttccccttctacgagatcgacctcaagaagctgatcgagcttcgcgacaagttcgtgctcatcgacaacaagctggacgtcctgcgggtagtgctcaaggccctgcagctggactccgcgcagcagaagccgctcaagctgatagacaaggccgccacggactggaagaactaccgccaggccggcggcatcaagctgagcgacaacgccgagatcatctaccagtccaccaccgggatcttcgagaagcggatcaagatcagcgatctcctgtga

SEQ ID NO: 7568 - RNA, 3951 nt, synthetic construct
  misc_feature 1..3951: note = Cas9 variant
  source 1..3951: mol_type = other RNA
atgctgcaaaagaactacacgatcggcctcgacatcgggaccaacagcgtaggctatgccgtgatcaacgacaactacaaagtccccgccaaaaagatgaaggtgctggggaacacggacaagaagaccatcaagaagaacctgatgggcgtcctcctgttcgacgcgggggagacggccgccaccacccgcctaaagcggggaacccgacggcggtacacccggcgccggaaccgcctccgctacctgcaggaaatcttagggccggagctggccaaggtggacgccaacttcctccaccgcctggcggagagtagcctcgtgactgaggacaaggagttttccgcctacccaatattcggagaccgggaggaggagctgctgtaccacaagacatacaagaccatctatcacctccgcagcgccctggccaacaaggacgagaaggcggacctgcggctcatatacctggccctggcccacatcatcaagtaccgcggcaacttcctcatcgagggggagatcgagctgtccgacaccgatatcgacaaggtgtacgccgacttctgccggagcttcaatgagctgttcgacaccgaggtgctccaggagatcgaggtggaggctatcttcaaagacaagacgctgtccaagactaagaaagcggaggaactggtcaaggtgagcggcgtgaagaagaaccaggttgcccaccagttcttgaagatgatggtggggaacaccgtgaacttcaagaaggtcttcaacctgaccgaggaccagaagctgtcattcggcacggacagctacgaagatgagttaaatgacctgctggccaagtccgacgaccgttatctcgacgtgttcgtggccgccaagaaggtctacgacacggcgattctggccaacatcctgaacaccaaaaattcggtggccaccaagacgatcttctcccagagcatgatcgagcggttcaaggaccaccagaaggacctcaaggagctgaagcagctgttcaagacctatctccccgagaagtacccggatttcttcggcaactccaaggaggacgggtacgccggctacatcgaggggaagaccaacgaggagaaattctacacccacacgaagaagatcttaaagaacatcccgcaggcggcgagcgtgctggctcagatcgacgtcggcaactacttgcggaagcagagaacctttgacaacggcgtgatccctcaccagatacagctgaaagagctgctcgccatcatcgagaaccaggggaaatactatcccttcctgctggagaacaaggagaagattgccaagatcctcaccttccgcatcccctactacgtgggcccgctggcccgggggaactcaagattcgcgtggctgaagagagtcggcaaggagaagatcacccccttcaactttgagaacgtggtagacctggagagctcagccgagcggttcatcgagcgtatgacgctcaacgatctgtacctgcccgaggagaaggtgctccccaagcacagtatgttatacgagaagtttagcatattcaacgagctggccggcatccggtacattaccgacaacggcgagatgaagttcctggacgcgcaaaccaagcagtccatcttcgagctgttcaagcaggagcgcaccgtgaaggagaagaaggtcctggacctcctgaagacgctgatgccgtctgagcgggtggtggcgatcaagggcatcgacaacgggaagttcaacgcctcctttggcacctaccacgacttgagcaagatggggttcaagaccgagaaaatagcctccgaaagcaatcaggcgcgctgggaggagatcatcaagaccctgacgatcttcgaggaccggaagctgatcaagtcccgcctcagaaagtacgacgacttcctgaacgagaaggagattggcgccctgtccaaacgcaagtacaccgggtggggccggctctccgctaagttaatcgacggcatctacgacaagaagacccaccaaactatcctggacttcttgatgaatgaggactacaaccaaaacttcatgcagctgatcagcaacgacaactactccttcaaaaagatcatcgaggacagccaggtcatcaaggaggaggggagcctgaccgaggtgatccaggagctccccggcagccccgccatcaagaaggggatcctacagtcgatcgagatagtagacgaacttgtcaaggtgatgggcgggaacccgaagaaaatcgtggtcgagatggcgcgcgagacgcagaagacccacggcactacccggcgcgaggcccggatcaaggagatcatcaagaacctcaataagctgaagctgaacgagcttccgaaggacctacccagcaatgaggagttgtccgatgagaaggtgtacctctactgcctgcagaacggccgcgacatgtacacgggggctcccctggacctcgacaacctgagccagtacgaggtggaccacatcatcccccaatcattcctgaaagacgactccatcgagaacaaggtcctcaccgccaagatcgagaacagccggaaaacgaatggcctgccgtcagtagagatcgcgaagaagatgggagccttttggcgcagcctcctcaaggtgggcgccatctccgagaagaagtacaggaacctgcgccgcagtctgcacggcgggatgaccgagaagctcaaagaaacgtttgtaaagcggcagctggtggagacccgccagattaccaagtacgtggcacagatcctgaactcgcgcttcaacgaagagaaaaacgaggacaaggtcgcaatcgtgactttaaaggcccagctgaccagccaattccgcaaggacttcgagctgtacaaagtgcgggagatcaacaacctccaccacgcccatgacgcctacctcaacgcggtcttagccaccctcctgatgacctcctttcccgagctggaacccgagtttgtgtacggcaagtaccgcaagactaagttcaaggggctcggcaaggcaacggccaagaacaatttatacaccaacatactgcagctcctgaaggaggagagcgcacagtactgggacaccaaggagcgcgacctggcgaccatcaagaagaacgtgtaccaggcccaggtcaacaaggtgcgcaaggtcgagcggcagactgggtccttctacgacgagaccgtcgccaagaaatccgccagccagaagctattcccccgcaagaacggcctggaccccgtgaaatacggcgggtaccaacgcgccaacgagggatacagcctcctcttccgcgcggacatgctgaacaagcgggggaagaccaaatccgtgaagaccctggtcaaaatcccgatcatcgagagcgcccagtacctcgccgatccgacggagtacctggccaagcgcggctactataacgtgtccgagcatagcctgttactgcccaaattctcactgctcgagaacaacaacggcctgcggcgctacctggcgtctagcaacgagttccagaaggcgaacgagctcatcctgccgaagcacctggtgcggctcctgtactggtcccagtcgaagcagcgcaaggaggagctgaacaagcaccgggccgagttcgccgagctgttcacctatatcatggacttcgccgacaagtatgtcgtggcgcccaaaaactccgagaagattaagaacatctacgagaacaacaaagacagctccgtggaggtcctgggaaagaactttatcgagcttctcaagtacaccgccgacggcgccgccagcgacttcactttcttcgacacgaaaatcccccgcaagcggtacaactccgccggggacctgctggacggcacactaatataccagagcaagaccgggctgtacgaaacccgcatcgacctgggcgcgatatga

SEQ ID NO: 7569 - RNA, 3957 nt, synthetic construct
  misc_feature 1..3957: note = Cas9 variant
  source 1..3957: mol_type = other RNA
atgatgatcaagctgaacaacatgaaaaagatcctcggcctggacctggggaccaacagcatcggctgggcggtggtcgagactgaagacaacaagaagttcgagctcctggacaagggggtgcgcatcttccaggagggcgtgaagatcgagaaggggatcgagtccagcaaggccgcggagcggacgggctaccgctccgcccggcgcatcaagttccggcgccggctgcgcaagattgagaccctcaaagtcctgatcgagaacaacatgtgccccctgagcatggacgagctcattgtgtggaaggagaacaagaacaactacccgaagaacaagatcttctacaactggctgaagaccaaggaccccaaggagggcaccaacgggacgtacatcaacccctactacttccggaccgaagccatcaagcgcaagctggagaacaccaacgacgtgggccgggccctctaccacctggcccagcgccgggggttcaagtccaacaggctggagagcaccgacgagaagtcccggggcatcgtcaagacggaaatcaacaagctcagctcggagctgaacggtcgctacctgggcgagtacttttacgagctctacctgaagggcgagaagatccggaagcgccacatcagccgggaggagcactacctgaacgagtttaagaagatctgcgaggtgcaaaacttcaacaaagagctcgcggagaagctcgagcgcgctatcttctaccagcggcccctgaagtcccagaaagggctcgtgggcaagtgcaccctgcagaacaacaagcaccgctgcccgatcagccgccccgagttcgaggagttccggatgtggcagttcatcaactccatcaagtacaagaacagcgacgggaagttcgacttcctgaacaaggagcagcgcgagaacatcataccggccttcgtctccaacaagaacgcaaccttcgagttcagcaagatcgagaagatcctcaacaagggcgtgcacatctaccagtttaactacaagtccaaccacaccatcggcagcaaccagacaatgatcaacttcatggacgtgttcgacatcgaccggaagctgaccaacgcgtggctgctctgcgtcaacaagatctacgagctgtacaccgccaagaccaagaaggacgggtccctcaagagcaagagcgaagtgatcacggacgtgtggcacgtcctgttcaccttcgacaacgaggagaacctgaaggagttcgcccgcaacaagctgctcctggacgagtccagcgcccagaaattctccaagatcaacctgaagcaggactacagccagctatctctgaaggccatcaacaagatcctgccctacctccaggagggcctgatctacagctacgcggtgttcatcgccaacatcgagaacgtgatcgggaagtccatctggaacattaaggagaaccagcagattatccggaccagcataaagaagatcatcgacaaccacaagaccgagctggacatcaacacgatcaccaactccctcatcaacgacttcaaggtcaactacaacaacgcccacaaggagtacaaggtggacgacatcgacctgaagaacatccgcgagaagatcatcaagtactacggaaacaagacctggaattgcctgccggaggacgagaagctctacgtgaaggagaaggtcgagaagctgtacgaaaagcagctcaagagcgggaagcggggcatcttcatcgagaagatccgcctggacgaccggatcgagaatttcctgaaggacaactttgactccagcgagctgaacctgaagaagctctaccacccctccgacgtatcagtgtacaagtccgtcaagatcaccgacctgggcctgcgcctcctggggagccccatgatcccctccatcaagaacccgatggccatgcgggctatgcaccagctgcgcaagctcatcaaccacctgatcatcgagggcgtgattgacgacagcacgatcatcaacgtcgagatgtcccgggagctgaacgacgcgaacatgaggaaggccatcgagaggtaccagcgccagcgggctaccgagaacgaggagttcaagaccaagatcaaggaactctacaagaaagagtgcgggaccgacttcgagcccaacaatgacgacatcatgaagtaccgcctgtgggaggagcagaatcacaaatgcctgtacacgggcaagagcatcgggatctgcgacttcatcggcagcaaccccgccttcgaaatcgagcacaccatcccccggtccctcagctacgacaactcgctggagaacaagaccctgtgcgagaaggagttcaaccagcaggtcaagaagaaccgcatcccgttcgagctcagcaactacaaagagatcatctcccgcatcaacaactgggagatcaaggccgaggagctgttcaagcagatccagaaggtgaagatccagagccggatggcggccaccaaagagatcaaggacaacgccatccagcgcaagcacctcctgcagatggagttcaactactggaacgggaagctgtcccggttcacgcgcgaggacgtgcccgaggggttcaagaacagccagctggtggacataggcatcatcaccaagtacgcccgggcttaccttaagaccgtgttcaacaacgtcaacaccgtgaaggggtccacggtggcggagttccgcaacatctggggcctgcaggagtactttgagaagaaagaccggagcaaccacatccaccactgcatcgacgccatcaccatcgcgtgcctgaccaaagacaaatacgacttcctcgctcacctgtaccacctggacgagcagaacaatcgtgacgcggtccaccgggccatgatcaagtccaagccctgggagaacttcgtgcaggacgtgaaagagatcgagaaccagatcctcgtcagccactacacccccgacaacctgccgaagcagtccaagaagatcctgcgcaagcgggggaagatccagaagaacgagaacggcgacctcatctacgagaagggcgacgccgtgcgcgggtcactgcacaaggagtccttctacggcgccatcaagcgggagatcatcaacaagaagggggagaccgaggagaaggtgctttacgtcaagcgcaagcccctcgagttcagcgacctgggcttcaagacgatctccgagctggagaacatagtggacgacgccgtgcgggacaaggtcctcaacgcggtgaaggacaagggcctgaagcaggccctgaacgagcccatctggatgaacgaggagaagcagatccccatcaagaaggtgcgctgctacaccccgagcgtcaccaaccccatcaacctcaagaagcaccgggacaagagcaaacacgagtacaagcagtcctaccacgtcaccaacgacgggaactacctgatggtgatctacgagggcaaggacagccaggagaaggtcaagcgcgactacgaaatcgtgtccaacctgcaggccggggagtacttcaagcagagcgtgcacggcgtcctaaaagcccaggggatcaataacctggagggcctgatccccaagttcaaggagtccggcaagaacatcctccccctgaagtacatcctgaagacggggaccatggtgatcttctgggagaactacccggaggagatctgggacatcgataagaaccagttgtacaagcggctgttcaaggtgacccagttcgagagcgacggccgcatccaggcccgattccaccagatcgcgaagcccgacaacgaactgaccaaggtctccgagctcgacttcagcaacatcgccgagaagatccgcctgtccaaggggaaccttaacatgctcgtgaacgggtacgacttcaaaatcaacgtgctggggcacatcgaaaagctgagctga

SEQ ID NO: 7570 - RNA, 3957 nt, synthetic construct
  misc_feature 1..3957: note = Cas9 variant
  source 1..3957: mol_type = other RNA
atgggcagcaacatgctgaagaaggactactccatcgggctcgacattggcaccaacagcgtggggcacgccgtcgtgacagacgactacaaggtgcccacgaagaagatgaaggtctttggcgacacctcaaagaagactattaagaagaacatgctgggggtcctgctgttcaacgagggccagaccgccgcggacacacgtctgaagcggggcacacgccggcgctacacccggcgcaagaaccggctgcgctacctccaggagatcttcgcaccggagctggccaaggtggaccccaatttcttataccggctcgaggagagctccctggtcgccgaggacaagaagtacgacgtgtacccgatcttcgggaagcgggaggaggagctgttataccacgacacctacaagacgatctaccacctccggagcgccctggcgaacaacgaccagcccgccgacctccgcctggtgtacctggccctcgcccacatcatcaagtaccggggcaacttcctgctggaaggggagattgacctcagaaccaccgacatcaacaaggtcttcgcggagttctccgagaccctgaatgagaacagcgacgagaatctcggcaagctcgatgtggccgacatcttcaagaacaacacattctccaagactaagaagtccgaggagctgctgaagctcagcggggccaagaagaaccagctggcccaccaactgttcaagatgatggtgggcaacatgggcagcttcaagaaggtccttggaaccgacgaggagcacaagctgtccttcggcaaggacacctacgaggatgacctgaacgacctcctggccgaggcgggggaccagtacctggacatcttcgtggccgccaagaaagtgtacgacgccgccatactcgcgagcatcctggacgtcaaggacacccagaccaaaacggtgttctcccaggccatgatcgagaggtacgaggagcaccagaaggacctgatcgagctcaagcgcgtattcaagaagtatctgccggaaaagtgccacgacttcttcagcgagcccaagatctccggctacgccggctacatcgacgggaaggtcagcgaagaagatttctacaagtacacaaagaaaacgctgaagggcattcctgagaccgaggagatcctccagaagatcgacgccaacaactacctgcggaagcagcgcaccttcgataacggggccatcccccaccaggtgcacctgaaggaactcgtggcaatcgtcgagaaccagggcaagtactacccgttcctgcgggagaacaaggacaagtttgaaaagatcctgaacttccgcatcccctactatgtggggcccctcgcccggggcaactcaaagttcgcctggctgacccgcgccggcgaggggaagatcacgccctacaacttcgatgagatgatcgacaaggagacctcagccgaggacttcatcaagcacatgaccatcaacgacctgtacctgccgaccgagcccgtgctccccaagcacagcctgctctacgagcgctacacgatcttcaacgagctcgcgggcgtccggtacgtcactgagaacggggaggccaagtacttcgacgcccagaccaagcgctccatctttgagctgttcaagctggaccggaaagtcagcgagaagatggtgatcaagcacctcaaggtggtcatgccagccatacgcatccaggcgctgaagggcctggacaacgggaagttcaacgcctcgtatggcacctataaagacctcgttgacatgggtgtggccccggagttactgaacgacgaggtcaacagcgagaagtgggaggacatcatcaagacgctcaccatcttcgagggtcggaagctgatcaagcgacggctggagaactatcgcgacttcctcggcgaggacatcttgaggaagctgtcccggaagaagtacaccgggtggggccggctcagcgccaagctattggatgggatatacgacaagaagactcacaagacgatcctcgactgcctgatgaccgaggactactcccagaacttcatgcagctgattaacgacgacaactacagcttcaaggagaccatcaagaacgcccaggtgatcgagaaagaggaaaccctcgcgaagaccgtgcaagagctgcctggttcccccgccattaagaagggcatcctgcagagcctcgagatcgtcgatgagatcatcaaggtcatgggatacaagcccaagtccatcgtggtcgagatggcccgagagacgcagaagacccacggcacccggaaacgcgaggaccgggtgcagcagatcgtggagaacttgaaggacgccaacgagctgccggagaagttaccctcgaacgccgagctgtccgacgagcgcaagtacctgtactgcctccagaacgggcgggacatgtacactggcgcgcctttagactacgaccatctccagttctacgacgtcgaccacatcattccccagagcttcctaaaggacgattccatcgagaacaaggtgctgacgatcaagaaggagaacgtgcgcaagaccaacggcctgccgagcgaggccgtcatccagaagatggggtccttctggaagaagctcctggacgccggcgccatgaccaacaagaagtacgacaacctgcggcgcaacctccacgggggcctgaacgagaagctgaaagagaggttcatcgaacggcagctcgtggaaacccgccagatcacgaagtacgtggcccagctgctggaccagagactcaactatgacgggaacggcgtcgagctggacgagaagatcgcgatcgtgaccctgaaggcccagctggccagccagttccgctccgagtttaagctgcggaaggtgagagccctgaacaacctccaccacgcgcacgacgcctacctgaacgccatcgtcgccaacctgatcatggccaaataccccgagctcgagcccgagttcgtgtacggcaagtaccggaaggcgaagttcaaggggctgggcaaggccaccgccaagaacaccctgtacgccaacgtgctctacttcctgaaggagaacgaggtctaccccttctgggacaaagcccgcgacctgccaacgatcaagcggtacctctaccgcgcccaggtcaacaaggtgcggaaggccgagcgccagatagggggcttcagcgacgagatgctggtccccaagagcgactcagggaaacttctccccagaaaggagggcctggacccggtcaagtacggcgggtacgccaaagccgtggagagctacgccgtcctgatcaccgcggacgaggtgaagaagggcaagaccaagaaggtgaagaccctcgtcaacatccccatcatcgactccaagaagtatgaggccgaccccacggcgtacctagccagccgcgggtacaccaatgtgaccaactccttcatcctgccaaagtacagcctcctggaggacccggaggggcggaggcggtatctggcgtccttcaaggagttccagaaggcgaacgagctcatcctgcctcagcacctggtggagctcctgtactgggtcaacgccaaggacggggagcagaagctggaggaccacaaggccgagttcaaagagttattcgacaagatcatggagttcgcagacaagtacgtggtggcgcccaagaacagcgagaagatccgccggttgtatgaggagaaccaggacgccaccccgatggaactgggcaagaatttcgtcgagctcctgcgctacacggcagacggcgccgcctccgacttcaagttcttcggcgagaacatcccccggaagcgctacaacagcgcgggctccctgctcaacgggactctgatctaccagagcaagaccggcctgtacgagacccgcatcgacctggggaaattatga

SEQ ID NO: 7571 - RNA, 3960 nt, synthetic construct
  misc_feature 1..3960: note = Cas9 variant
  source 1..3960: mol_type = other RNA
atgtttagccagcgcaacaacccctactgcgagctcctgttcaagatcatcgtgacaaacatcgaggaaaagaacctggaggtcatcatgggcatccggaactccgacatcttcttcatctctaacttcatgtggtaccaaaagctgatcatgatgatcaagaacatcctcgggctggacctcggtaccaactccatcgggtgggccctcatcgaggtggacgagaacaacattccgatccgcatcatcgccatgggcagccggatcatccccctgtccacgagcgacaaggaggagttccagcgcggactgtccataaccaagaaccagaaccggaccgtcagccgcacccagcggaaaggctacgaccgcaagcagctccggcgctccgacctgaagaaaatcctgaagaagtacaacatcttccccagcgaggagctcctgaagctgcccatgctcgacctgtggaagctacggtccgacagcgcgaatccaaacgaggacatctccgccgagcaactcggccgcatcctgtacatgctgaaccagaaacgggggtacaagagcgcccgcagtgaggccaacagcgacaagaaggacacggactacgtccaggccgtgaagggccgttacgcgcagctcaaggaccgccggcagaccatcgggcagtacttttacgaggagctgtccaccgccttcagcgacaagaacaaccaacagtacttcagggtgaaggaggaggtctatccccgggaggcctacatcgaggagttcgacaccatcatcaacgcccagaaagacaagcacggcttcctgacggacaaagtgatccaccagctacgcaacgaaattatctactttcagcggaagctgaagtcccagaaggggctggtgtcgatctgcgagctcgagggcttcgagaagaccgtctacgacaaagagaagaacaagaacaaggtggtcttcgtcggccctaaggtggctcccaagaccagcccgctgttccagctgtgccgcatctgggaggtggtcaacaccatctccctcaagatcaagaaccccgaggggtcaaagtacaaatggggcgagaaggtgcccaacctgaagcagaaggagatcctggccgactacctcttcaagaacgagaacctgtccttcagcaccctgctcgagatcctggagctgaagaaggaggacgtgtacgttaacaagcagatcctcaaagggatcaagggcaacgaggcctacgccgccctgcacaacgtgctaggcgaccacgagcttctgaacttcgacgtgtccatcatcaccagcgaccacaccgcgatactggtcgacaagaagaccggggagatcctcgaggagcgcgccggcctggagctggacgcctcactcgagcgggagcccctgtaccagttctggcacacgatctactcattgaaggacctggacgagtgtaagaacgccctcatcaagcgcttcgggctggacgaggacatcgccgaaaagctgtcccacatcgacttcaacaagcaggcgttcggcagcaagtccaacaagagcatgcggaagatcctcccgttcctgatggaggggtacaactattccgagagctgctccctggccggctataatcacagcaactccctcaccaaggacgagcgcgagagccagatcaccctggagcggcttgagctcttgcccaagaacaatctgcgccagcccatcgtggagaagatactcaaccagatgatcaacgtggtcaacaccattttggagaagtacggcaagccctcggagatccgggtggagctggcccgcgagctcaagcagagcaaggacgaacggaacgacacggacctgcagaacagccgcaacaagaagctgaacgaggaaatcgggaagcggctcgcggagctgggcctgccggttaccaagcgctacatacagaagtacaagttcatcttcccctccctcagcaagaacctgaaggacgcccacgtgaacaaccagtgcatctactgcggggagaccttcaacctgacagaggcgctcaacggcgacgcctacgacgtggatcacatcgtccccaaggccctgctgttcgacgactcccagacgaacaaggtgctcgtgcaccggaagtgcaacagcaccaagaccaaccagaccgcctacgactacatcacggccaaaggggaggaggaggtccgcatctattccgagcgggtggacgactggttcaagaagggcatcatcagctactccaagatgcagcgcctgaaggtgagccataaggagtacctggagagaaagaagctcggcaaggagaccgagaccgacaagaagctgtgggagaacttcatcgaccgccagctgcgcgacacccagtacatatcgcgcaagagccgcgagatcctgcagaaggtctgcaacaacgtgacgaccaccgagggcggggtgaccgcgaagctgcggaacctgtgggggtgggacgacatcctcatgaatctacagatgcccaagtacaaggagctgggccagacgatcaccaaggagtggacctccgagcatgggaagcgcaagcaccaaaaggaggaaatcgagaactggaccaagcgggacgaccatcgccaccacgccattgacgccttagtcgtggcctgcaccaagcagggcttcatccagagaatcaacacgctgaacagctccgagaccaaggacctgatgatcaaggaggtggaggaggcgaaaatcgagttcaacgagaagaccacactcctagagaagtacctgaagacgcagaagccgttcaccacccgcgaggtcatgaaggaggccgacaagattctcatcagcttcaaggccggcaaaaaggtggccaccatcacgaagttcaaggccaccgggaagaacaaggagaccggcgttatcgtcccccgcggggcgttgcacgagcagtccgtgtacggcaagatcaaggtgatcgagaaggacaaacccctgaagtacctcttcgagaaccccgacaagatcgtcaactcccggatcagagatctggtggagacccgcctgtctgagaatgagaacaacagcaagaaggccctcagcacggtgaagaagaacccgatattcttcaacgaggagaagaacgagattctggagaaggcctcctgttacaacgacgccaccgtactgaagtacaagctccagaacctgaaggcgaaccaggtggacgatatcgtggacgagcgggtcaagttcctggtgaaggagcgcctcacccagtttggtagcaaggagaaagaggcgttcaaggacatactgtggttcaaccaggagaagcagatccccatcatcaccgtgcgcctgttcgcccgccccgacgccaacaacctccagatcatcaagaaggacaagaacgggaaggacatcggcttcgtcctgacgggtaacaaccaccacatcgccatctacgaggacaaggactccaagctggtacagcacagctgcgcgttctggcacgcggtggagcggaagaagtacaacatccctgccgtcatcaaaaattccgccgacgtgtggagtctcctgctggacaaggaattgccggtgctgttcctggacaagctccccgccgacgagctgaacctgaagttctcgatgcagcagaacgaaatgttcatcctcggcctgagccaggaggggtttgacgaggccataaagaacaacgacaagtccctgctctctaagcacctgtacctggtctggtccatcagcaacaacgactactacttccgccatcacttagagaccaagaacaccgagctgaagaacatccccaccgccaaagactccaagcggtacttccgcttcaagagcgtgggcgccctagtgggcatcaaccccatcaaggtccggctcaaccacctcggggaaatcactaagatcggagagtga

SEQ ID NO: 7572 - RNA, 3960 nt, synthetic construct
  misc_feature 1..3960: note = Cas9 variant
  source 1..3960: mol_type = other RNA
atgggatacaacatcgggctcgacatcggcactggtagcgtggggtgggccgccctaaccgacgaagggaagctggcgagggccaagggcaagaacctgatcggcgtccgcttgtttgactccgcgcagagcgccgcccagcggcggtcctaccgcaccacccggcgccggcttagccgccggaaatggcgcctgcggcttctagagaacatcttctccgatgagatgggcatgatcgacgagaacttcttcgcgcgcctgaagtacagctacgtccaccccaaggacgaggtgaacaacgcccactactacggcggttacctcttcccgacccagcaggagacccacgacttccacgagaagttccagacaatctaccacctccgtctgaagctcatgatcgaggactgcaagttcgacctccgcgagatctacctggccatgcaccacatcgtgaagtaccggggccacttcctcaattcgcagagcaagatgaccatcggggactcctacaacccccgcgacttccaacaggctatccaaaactacgcggaagccaaaggcttgatctggagcctgaacgacgcccaagagatgaccgacgtgctcgtgggccaggcggggttcggcttgagcaaaaaggccaaggcggagcggttactcagcgcgttctccttcgacaccaaggaggataagaaggccatccaggccatcctggccgggatcgtcggcaatacgacggactttaccaaaatcttcaaccgcgagcggagcggtgacgagctgaagaaatggaagctcaagctggattccgaggcgtttgacgagcagtctcaggccatcgtggacgagctggacgacgacgagatggagctgttcaacgccatccgccaggccttcgacgggttcaccctgatggacctgctcggcgaccagaccagcatcagtgccgcgatggtgaagcggtaccaacagcaccacgacgacttaaagatggtcaaggaaatcgccaaaaagcagggactgtcccaccaggacttctccaagatctacaccgctttcctcaaggacgacaccgacaagggcatgaaggccctgctggacaaagcggatttggctgacgacgtgctagtggagatccagcaacgcatagagagccacgacttcctgcccaagcagcgcacgaaggccaattccgtgatcccgtaccagctccacctggccgaactggagaagatcatcgagaaccaggggaagtactacccgttcctcctggacacgttcaccaacaaggccggtgagaccatcaacaagctggtggaactcgtgaagttccgggtcccatactacgtgggtcctatggtgaccgcggccgatgtcgagaaggccgggggagacgccacgaaccattgggtgaagcgcaacgaggggtacgagaagtcccccgtgaccccctggaacttcgaccaggtattcaatagggaccaggccgcgcaagatttcatcgaccgcctgaccggaaccgacacgtacctgataggggagcccacgctcctgaagaactctctgaagtaccaactgtttaccgtcctcaacgagctgaacaacgtgaagatcaacggccacaaaatcgacgagaagacgaagcacgtcctgattcaggatttattcaagtcaaagaagacggtgtctgagaaggccatcaaggactactacctgagccagggtatgggggagatccagatcgtcggcctggccgataagaccaagttcaactccaacctcagctcctacatcgacctgtcaaagaccttcgacgccgagttcatggagaaccccgccaaccaggagctgttggagaacatcatccagatccagaccgtgttcgaggacgtgaagatagcggagcgggaactacaaaagctggccctcccggacgagcaggtccagcagctggccaagacccattacaccgggtggggcaacttgtccgacaagctcctttctaccccaatcatccaggaggggagccagaaggtgagcatcctgaacaagctccaaaccacgtctaagaactttatgagcatcatcaccgacaacaagtttggcgttcagcaatggatccaggagcagaacacggccgagaccgctgacagtattcaggaccgcatcgacgagctgactacggcccccgccaacaagcggggcatcaagcaggccttcaacgtcctgttcgatatccagaaggccatgggggaggaacccaaccgcgtgtacctcgagttcgcaaaggaaacccagaacagcgtgcggaccaactccaggtacaaccggctgaaagacttgtataagagcaagacgctcagcgacgacgtcaaggccctgaaggaggaactagagtcccagaagtctagcttgcagagcgagcgcatcggcgaccggttatacctgtacttcctccagcaggggaaggatatgtacacgggccagcccatcaacatcgataagctatccaccgactacgacatcgaccacatcatcccccaggcctacaccaaggacgacagcatcgacaaccgcgtgctggtttcccggcccgagaacgcacgcaagagcgactccgctacctacacgaccgaggtccagcagagcgcgggcggtctctggaagtccctgaagaacgccggcttcatctcgcaaaagaagtatgaccggctgaccaagggcggggattactccaaagggcagaagaccggcttcatcgcccgccaactcgtagagacgcggcagatcatcaagaacgtggccagcctcatcgagtccgagttcagccagaccaaggccgtcgcgatccgctctgaaatcaccgccgacatgcgccggctggtagccattaagaaacaccgcgagatcaacagcttccaccacgccttcgacgccctcctgatcaccgcggccgggcaatacatgcaggctagataccccgaccgcgacggggccaacgtttacaatgagttcgactactacacgaacacctacctgaaggagctccggcagtcgtcctcgtccagccaggtccgccggctcaagcccttcggctttgtggtggggaccatggcgaagggcaacgagaactggtccgaggacgacacccagtacttacgtcacgtcatgaacttcaagaacatcctcacgacacggcgcaacgacaaggataacggggccctgaacaaggagaccatctacgctgtggacccgaaggccaagctgatcggcaccaacaagaagcggcaggacgtgagcctctacggagggtatatctacccctactccgcgtacatgacgctggtccgcgcgaatgggaagaacctgctcgtgaaggtgacaatcagcgccgccgagaagatcaagtccgggcagatcgagctgtccgagtacgtccagcagcggcccgaggtgaaaaagttcgagaagatcctgatcaacaaactcgccatcggccaactggtgaataacgacggcaatttgatttacctaacctcctacgagttctaccacaatgccaaacagctgtggctgcctaccgaggaggcggacctcatctctcagctgaacaaagactccagcgatgaggacctgatcaagggcttcgacatcctcacatccccggcaatccttaagcgcttccccttctacgaattggacctcaagaagctggtcaatatccgtgacaaattcatcgccgtggagaacaagttcgatatcctgatggtgatactcaaagccctgcagctggacgccgcgcagcagaagcccgtcaaaatgatagacaagaagagtgcggactggaaggactaccgccagcggggtgggatcaagctcagcgacaccagcgagatcatctaccagtccactaccggaatcttcgagaaacgcgtgaaaattagcaacctgctatga

SEQ ID NO: 7573 - RNA, 3963 nt, synthetic construct
  misc_feature 1..3963: note = Cas9 variant
  source 1..3963: mol_type = other RNA
atgaccgagcagcagcgcccctacaacatcggcctggacatcgggaccagctccatcggctgggccgtgactgaccagaacgacaagctcctgcacatccgggggcataacggcatcggggtccgcctgttcaaggagggcgagagcgccgcggagcggcgcggcttccggaccacccgccggcgcctctcccggcgccggtggcgcctgcggttcctggaccgcatcttcgacgccgagctggcgaaggtggacccgaacttcctggcccggttgaagcagagcaacatcagccccctcgaccccaacaagcagatgttcgggaacatcctgttcgatgacgcccagttcgacgaccagaagttccaccagcagtaccccaccatctaccacctccgcagcgcgctggcccagccggacgcgccccaggccgacgtgcggctgatctacctggccctccaccacatgatcaagttccgcggccacttcctgaacggggccgccgtcgagaagtttcacggcgggcagctgcacttagaggccgagttccaggagctgaaccagatcttctccaaccagcagcgggaccacgtgcagctgcagacgagctccctggacgaagtagccaccatcctgaaggacaaccagcgcacccccagcgaccggcagcgcgagctgtccgcgcgcctcttcgtccccgtagacaagaccatcgacaaggagaacaagaagttggccacggagctgctcaaggccgtgctgggcctgaaggccaagttcgacgtcatcctaggcgtggaggcaaccgacccgcaggcgttcaagctgcagttcagctccgacgacttcgacgacaaaatcgccgagctggccagcgagctcaccgacgaggccaacgagatcttaaccgtgctgcagcgtctctacttctccctgaacctggccgacatcctcacgaaccgccagaccaaacaggtggcggacagcatctccaccgccatgatcaaccggtacgacgaccacaagcaccacctgaagatgctgaaggagctcgagacccaggtaacgcaggagcagcgcgacgggctgaagaaggcctacgacgagtacatcgacggcgacaagcccaccatcgacaccttctacaccaacgtgaagaagaacctggacgacagcgagctcgccaaccaaatcaagtccctgatcgacctgcaggccttcatgcccaagcagcggagcaaggagaatgggagcatcccccaccagctccaccagcgtgagctggaccagctgatcgaggtccagggcaagtactacccctggctgctcgcggccaaggacaagttggacgccctgatcgccttccgggtgccctactacgtgggacccatgatcgacccaaacgagtccgacgacccgcagaacacgaagttcgcgtggatggtccgcaaggaggccggggagatcaccccctggaacttcgaggagaaggtggacaagaccggcagcgccaccaacttcatcaagcggatgacgaccacagacacctacctcctgggggagcccgtgctgcccaagaactccctcctgtaccagcagttcacggtcctgaatgagctcaacaagctgaaggtggacggcaaggccctgaccgtggaccagaagaagtacctctacgagcacgtctgcaagaagcagcgccgggtaaccctgaagaagctgagcgactgcctcatggcccgcggggacttcccgatgggcgcgatcttcaccggcacgaccgaccagaagaacatgaacaacacactgaagacctaccaggacttccaggagatcttcggggacgagattgacaaccccgaccggcaggtcgacttcgagaagatgatcgaatggtccacgatcttcgaggaccgcgagatcttcaagctgaaactcgccgaactgaactggctgaccagcgagcagctcgagcgcgtgtccaagaagcgctaccaggggtgggggcggctgagccagaagctgctcacccacatcgtgaacgagaacggcgagcgcatcatcgaccagctatggaacaccaaccagaactttatggagatcatggggcaggacggcgtcaagcaggccatccaggagcacaacggcgcgaacgttgcccagaccgggatcaacgagacgatcgacgagctgtacaccagcccccagaacaagaaggcgatccggcagatcctcctggtggtcgacgacatcaagaaggccgtgggctacgcccccgccaacatcatgatggagttcgcccgcgaggaccgggacgaccaccggctgatcgcgtcccgcgcccggcagctcgagaagacctaccaggagatctccaagaactggttcgacaacgagagcgtgacccaggagctgaaggaccagatcaagaacaagacgaagttcaccgaccgcctgtacctctacttcatccagggcgggatcgacctgtacaccgggcacccgctgaacatcgaccagctctccagctacgacatcgaccacatcctgccccagtccttcctgctcgacaacagcctgaacaaccgggtcctgacctcccagagcgagaaccgcgtgcacaaggaggaccggctccccggcgagacggtggccaacaagatgcgccccacctggaagatgatgcgagagcagggcctgatgacccagcgcaagtacaacaacctgaccctcaagccagaccagatctctaagttcaacaaccgggggcagttcatcaaccgccagctggtcgagacgcgccaagtgatcaagctggccgcggacatcatgaaccagaagtaccaggccgaccagaccaaggtggttaccgtgaaggccaacttaacccaccacatgcgggagaagttcaacttctacaagagccggaacgtgaacgactaccaccacgccttcgacgcttacctgacggtcttcgtgggcaactggctgctcaaggagtaccccaagctgcagccctacttcgtgtacggggacttcgcgaagaccggcaccaacaacctcaagagcttcaactttctgtaccgcttcgaaagagatcacaagctgaacgacaagggcgccatcgacaccgacaaggaccagcagctggggtacatgaagcgcatctaccggttcaagaagatgctcgtcacgaagcagctggagaccaacgagggcgccctgtacaagcagaccatctacaaggccccggctaacgagaagaacaccaagaagaaccgcagtctcatcaacacgaagaagaaccggcccagcgacatctacgggggctactcccagagcgtgaccgcgtacatgtccctggtgttcttcaagaacaccttcaagctgatcaagatgcccttggtcgccgccaacgccatcaagaacagcctgtcaagctaccacgacaccatcctgaagatcctcgggtccaacgagttcaaagtgctaatccccaaggtgaagatgaaccagctgatcaaggagggagacagcctctacacggtcgtgggcgtgtacaagcacaacgcccagcagctgatcctgtccgacaacagcatggggatcatcaccaagccgatccgcgagatctgcgactccgacctcgacagcgtcttcaacgagctggtggacaatatcgacaagtacctgaacctctacaagatcgaggacaagctgaccatcaaggagaagttctacgcgctgaagaacaaggagtccaagttcaagtgcatcagcgacatcctcgtgggcacgcactgcaacgccgggcgctccaacctgaagatcatcggcctgagcagctactgggggatgttctccggcaacaacgacggcctcaagatcaacgagaacagccagctgatctaccagtcccccacagggctgttcgagcaccgggtcaaggtgagcgacctctga

SEQ ID NO: 7574 - RNA, 3972 nt, synthetic construct
  misc_feature 1..3972: note = Cas9 variant
  source 1..3972: mol_type = other RNA
atgaaagacttctacatcggcctggacatggggaccgacagcgtgggctgggcggtagccgacgaggactacaacctctgcaagttcaaggggaaggcgatgtggggcgtgcgcctgttcgatgagtccgccaccgccgcagagcggcgagggttcaggacggcccgccggcgagcgcaacgaaagcgccagcggatcctgtggctccagatgctgttcaacgaggagatcagcaaaaaggacatcgcctttttccagcgcctgaatgagtccaagctctacctggaggacaagagcaccaacgtgccctatgccgtcttcgccgacgagtccttcaccgacgtggactaccacaaactttacccgaccatttaccatctccggaaggagctggtgcagtctgatgagccccatgacgtccgcctggtctacctcgcgctgcaccacctcatcaagaaccggggccattttctcttcgagaacgttggcagcgacttcgagaaggagagctccttcgaggtcctgttcaagaacctgcagaattacatcctcggggagtacgagctggccctggagtgcatcagccccctccagatcgccgacatcctgaaggacaagtccaagcgcaagacgaccaagagctccgagatctgcaagctgctcggaatcagcaagaaggggcagccccggctgaacgccatcgtgctgttaatgtgcggccagtccgtgaagctcgccgacctgtacggggacgagaactacaacaaggaggaaaagtccagcatcagcttcgagaagggctacgaggacaacgaagagacctatagggagctcctgctggagcggttcgagctcatcgagaagatcaaggcgttatacgactgggccatcttagctgacatcttaaagggtgagacctacatctccttcgccaaggtcaagacgtacgacgagcaccgccacgacctgcaacagttgaaggccttcgtgaaggagcggtgccgcagcgactataacgagatcttccgggagaccagcgacaagctcaacaactacaccgcgtactgcggcaagttcaaggagaacggccgcaacggagttatcctgcactccgccaaccagaccgacttttgcaagtacctcaagagcaagttcgacaagctcgacaagtctggctacgaagacatgttcgagaaaatcgagaacggcagcttcatgccgaagatcgtcgtgaaggacaacggggtgatccccatgcaggtcaacgagtccgaggtgcgtgctatcctgaagaatgccagcggctacctcgacttcctcaacaaccaggacaaggacgggatcacggtggccgacaagatcctgcagatcttcgagtttcggatcccctattacgtcggccccctgaacgtgcactccgataacagctggctcgtgcgcaaggacgggaagatctacccgtggaacttcaacaagatcgtcgacgtggacaagtccgcggaggagttcatcaacaagctgaccgccaaatgcacctacctgcccgaccgggatgtcatcccaaagaacagcatcctgtactcccgctacatggtcctcaacgagttgaacaacctgaaactcgacggtaagaagcccgacgtgagcttcaagcaggccgtcttcaacgacctgttcatgcatcggcgcaaggtgacccagaaggccctgcgggagtacatcaaagcccagacgggcaccgaaccggagatcaccgggatcgacggcgacttcaaggcgaacatgcgcccggccatcgagctcgccgggtacaacctgtccgaacccgacaaggaggagatcattaaggccatcaccatcttcggcgacgacaagaagctgctcaagcgtcgcatcaaggacaagtacagcgagatgctgtccgaggacgagatcaaaaagatctgcaagctgaagtacaaggactgggggcggctcagccgcgagttcctgacggaaatcttcgacgtggacacagcgaccggcgaatgtaaggacaacatcatcaacaccctgtggaacacgaacgacaacctcatggagctgctgggcgccaagtacaacttcacccagtccatcgagcaggccatcagcaaatccacccacaaggccagcatcgagaagatggtcgaggatatgtatgtgtcgcccaaggtgaagcggaccgtcttccagtccctcaaaatcatgaaggaaattgtgaaaatcaaggggcacgccccgaagaaggtgttcgttgagatgacgcgccacgacggcaccaagggggacaacggccggaccaaaagccggaagaagcaactggaggaactgtacaagaagtgcaaggaggactccaccgagctctgggacgagctggagaagacggacgacgatgagttccggcaggacaagctgtttctctactacacccagatggggcgctgcatgtacagcggcgagcggatcgagctgcgcgacctgttcaacaagaacctctacgacatcgaccacatctttccccgctccaaggtaaaggacgactctatcgacaaccgggtgctggtcaagaagcagatcaactcccacaaggacaacgactaccccctggatagcaccgtgagagaaaagatgcggggacactggcagtacctcctgaggcacgggttcatctccaagaaaaagtacgaccggctgacccgcgtgacacccctcactgacgacgagctggcggacttcatcgccaggcagcttgtcgagaccagccagtccaccaaggccgtggcaaccctcctgaagacgctgtaccccaccaccgagatcgtgtacgttaaggccgagctcgtgagccgcttccggaccgagtacaagtttatcaagtgccgcgaagtgaacgacctgcaccatgcgaaggacgcctacctgaacatcgtcgtgggcaacgtgtacaacgtccggtacacgcactccaaggccatcttcatcaaggggctccagaccaagaaatactctctgaaccgcatgttcgccttcgacacccccggcgcctggaacatcgagaacgagaaatccctgagcatcgtgaagaagaccgtgatgaagaacaacatcctctatacgcggtactcctacatgaagaagggtgggctgttcaagatccaacccttaaagaaggggaatggccaagcgcccctgaagaaggacctcccgctgagcgacatcggcaaatacggaggctacgacaagcccaccgccagctacttctcctacatcaagtacgagggtaagaaggggaaagagtgccgccaacttgtcgccatcgacaactacctgaagaagtactacgaggagaaccccatcgagtatctgaccaaccggctaggcttaaagaaccccgccgtgctaatcccggtgatcaagtacaacagctgcatcgagatcgacgggttccgcatgaatatctccagcaaaagcaacgagggcaagaccatcgtctacaagcccgcggtgcagttagtgctgggggccgagaaggaggcctacgtcaagaagatcagcaaggtgttgtccaagcccgaggagcagaagatcaccagctacgacggcgtgtcagccgaggagaacatcgagctgttcgacgccctgaccgcgaagatgacgaacaccattttcaagatcaagctggaggacatcggcaacaagatcaagagcggccgggacaagttcgtcacgctcgacgtgaagaagcagtgctacgtgatcaacgagatactgaagatcatgcactgcaacgtcgtgaccggcgacctgtccctcatcggggccgccaagaaggccggcatcgtgagcaccaactccgccctgagcgagatcaagaaggtctccagcatcatgctgatcaaccagtccgtcaccggcctcttcgagaccaagatcgacctgctgaacatttga

SEQ ID NO: 7575 - RNA, 3975 nt, synthetic construct
  misc_feature 1..3975: note = Cas9 variant
  source 1..3975: mol_type = other RNA
atgagagccaagggcaaaaccctgatcgggaccagcctcttccgggagggcaacacggccgcggagcgccgggggtacagaaccacccagcggcgcctgaagcggcgcaagcggcgcctgaagctcctggaggccttcttcgatccgtacatcttcgaggttgacgagaacttcctggcccggctccacgaggccgacatctccccaaaggacgagaacaagcgcttctggggcagcctgctgttccccaacgagaaggacgccaacttctaccggaagtaccccaccatctaccacctccgcaaggcgctgatggaggaggaccggaagttcgacgtccgtgccatcttcctggccatacaccacatcatgaagtaccgggggaacttcctcagccccctgagcgtggactccttcaagcaggagggcctggagctcaaggagcagctggaccgccagctgaagcgcgtggccgagctctacaatgagctgaatactgacgtcaagatcaacgtgagcgacgtggagaccatccaggacataatcatcgacaagaacaagtcccgccgggacaaggcgggcgccctgaagaagctcctggccgtctcctccgaccgcaaggagatcaacaagctgaacgccagcctcgccaaggagctgtccaacgcgatcttggggatgaaggcccaattcgccaacctcctgctggccgacgacctcgagatcgacaagaacaagaagaacttcagcctgctggacaccaacgccgaggagaacgtgtccggcctcctggagctggtgaacgagaagcaggcggagctgttcgacgccatcaagaccatccacgaccagatcatcctgaacgagatcgtcccggacggtaagagcatctcccagagcatggtggacaagtacgaggcccaccgcgagcagctccaggtgctcaaggccctgtacgagaagatggacgccaagcagatcaaagcgatcaagaaggcctactccctgtacatcgacgggaaggaccccaaggccaagaaggtcgacaagcgggcccaccagaaccgcgccgacttctacaaggaggtgaagaaggttctcgtcgagctggacgacagccgggcggagaagctgctcgggctgatcgagatgggccagttcctgcccaagcagcgcacggccatgaacggggtgatccccaaccagctccaccaggtggagctggacaagatcatcgagatgcagtccaagtactacccgtggttggccgagaagaacccggtcaagtctcaccagaagcgggctccctacaagctagacgagctcctgaccttccgcgtgccatactacgtggggccgatggtcaccagcaagaagcagcagcagacctccaacagcaactttgcgtggatggtgcggaagcaggagggcgagatcacgccctggaacttcgaggagaaggtggacaccatcgcctccgccaacgacttcatcaaacgcatgaccgccaaggacacctacctggtcggcgaggacgtgctccccgccaacagcctgctgtaccagcggtacaaggtcctcaacgagctgaacaacatcaaggtgaacggcagacggctgcccgtggagctcaagcgcgaggcgtacgtcgccctgttcgaaaatggcgactccaagacggtgagcgccaagtgcttcaagaactggctgaacgtgaagttgaagaacctcaattccctgaagctggaggggctgagcaccggcaccaagttcgacaataacctgtccacctaccacgacctcaagaagatcttcgggaaggccgtcgacgacgccggccgtcagaaggacttcgagcagataattgagtggctgacgatcttcgaggacaagaagatcctgcgcatcaagctcaaggagatcgagtggctgaccgaggagaacatcacccagctgacccggctcaactacaacgggtggggccgcctgagccggcgcctgctcacgggcatctgcgactccaacgggcagaggatcatggactggctgtgggacaccaccaacaacttcatgcagattcagagccagccggacttccagaaagcgatcgtggagtacaactccgacaaactggagcagggcgacatcgagcagatcctcggggaggcctacacgagcccacagaacaaaaaggccatccgcaaggtgatcaaggtcgtccaagacgtggagaaggccatgggcgccaagcccacgtccatcagcatagagttcacccggtccgacgggcggagcgagctgaccaactcccgcatgacccagctgcagaagacgctcatgagcctgagcgaggagatgaccgaccaggcgctgctcgccgagttcaaggacttccaggcttccaagaagaagctgaccaacaagtactacctgtacttcacccagctcggccgggacatgtacacgggcgagcccctgaacatcgaccagctgagcctatactccgacggggaccacatcctgccgcgcagcttcatcaaggacgactccctggacaatcgggtcctcaccaagcgcgccgtgaacaacgagaagtccgacaccgtgcccgtctgcgagtacggcgcgaagatgaaagacttctggaacgacctgtatgacaacgggcttatctccaagcagaagctcgccaacctgctgaccgatcccgacgagatcggcccctacaaggccaacgggttcatccggcgccaactcgtggagaccagccaggtgatcaagctgtccgccgagatcctgcagacgctgtaccaggacaccaagatcatcgaggtccggcagaagtacacccacgagctgcgcgagcatttcaacttcgtgaagatccggcagctgaacgactaccaccacgccttcgacgcgtacctcaccgccttcagcggccgctacctgtaccagcggtacccgaaactgcgcggctacttcgtctacggggactataacaagttcgacgccaagaaggaccggaactacctgaagtcctacaacttcctgtacgacctggaagagggcaagacggaccagatcgtcgacaacgtggagcacaaggtgttcatgaaccgccaggacgccatcaaccagctcaagaaggcctacgagtacaagtacatgctggtcagccaggagacctacaccaactccggggcgatgttcaaggagaccatataccccgtgaaccccaaacagaagctgatccagaagaagaacgacaagcccgtggacatctacggcggctacagcaacaactacgacgcctacctctccatcgtccggctggaggacaagaaggggatcaagttccgcgtcgtgggcatcccgatgcggaacaaggccgagctcgacaacctggccaaggaggaccacaacgggtacatgcagcgcctgaacgagatcgttgacgagcagatcaacagctccggcaagaagaagacgttccggatcatcctgcccaaggtgcacttcaagcagctcgtggaggacgacagcggtaagttcatgctgggcagcgccgcgtacccgtacaacgccaagcagctggtcctctccgtcaagagcatcgagtccctggccaacaaggacgccagcgaccgcgagctggtggcggtgtacgaggagatcctcaacgtggtgaacgacaagttcaccctgtatgacgcccgccagttcagaaataagctgacctccagcaaggacaaattcgtggagctcaacaccgccgacaaggtgacggagctgctggacatcctcgacggcctgcacgccaacccggtggtcaagaagctgaagatcatctccgggagccccttcggcttcctccagcgcccctccgggattgtgctgaccgagaacgccaagctgatctaccagagccccaccggcatcttcgagcgggtggtctacctccgggacctgtga

SEQ ID NO: 7576 - RNA, 3984 nt, synthetic construct; identical to SEQ ID NO: 1776
  misc_feature 1..3984: note = Cas9 variant
  source 1..3984: mol_type = other RNA

SEQ ID NO: 7577 - RNA, 3984 nt, synthetic construct
  misc_feature 1..3984: note = Cas9 variant
  source 1..3984: mol_type = other RNA
atgaagaactacagcatcggcctggacatcgggaccggctccgtgggatgggtctgcatcgacgagaactaccagatcctcaggtacaacaaccgggccgccttcggcgtgcacgagttcgagaccgcgcacgtggccgaggagcgccggatcaaacgcggggcccggcgccggtacaaccgccggaagaagcgcatccagctgctgcagagcctcttcgtcccccacatgcagcagaaggccttcttcgccccgacgatcaccgagcactactggaagaacgataaccagttcgagaaccggaccctgtccgaggtgctgatgagcctcggcatgaacccaaacacctatcccacgatcttccacctccgccacgagctgatcgagtccagcgtgaagaaagacgcgcggctgatctacctggccctgcacaacctcgtcaagttccgcggccacttcctgcaggaggggtccacctggaacgccaacatgtccgacgccaacctgtccgagcagttcgagcagctcctgcacatctacaccgagatggaggagctgcctcaggtgagtctcaccgcgcagcagtccacggacgtggagcacatcctgctgaacaaccacataagcaaggccgagcgggcccgccagctcaccgccctcttcgagcggacctacgagccgttcttcaaactgatcgtcggcctcgacatcgccgcggcccagctgttcaaacagtccgagcagcagctgctctacaaggagagcaagaccaaggtgaacctgacggccgagaccctgcccgaggtgctccaaaccatgctggaacccgaggtcgcgttcatcgaggccgtgcagcccttctaccagcagaccgtgctgttcgacctcctaaaggggcagtcctacgtcgcggccgccaaggtggaggccttcaaccagtacgagcgcgacctggctttactcaagagcgtaatcaacgaggtcggctccgagaagcagtaccgggcgttcttcatcacgagcaagcagaagaagcgccagttcgagcagaaaccgaacatggagctgctgtgccacctggaccggttcaaccgcgagaagaagtacgaggagaccttctacaaggaggtgtccaagctgctcaccgccctgatcaaggaggccaccggggaggtgaaggagcacatcgagcagatcatacaggccatggagagccagagctttcttgttaagcagaagggcatccagaacgcctccatcccctaccagaacagcctctacgaggcggagatgatcctgcgcaaccagcaggcgtactacccctggatcacggacgagttcatcgagaaggtgaagcagctgatcgccttcaggatcccctactacatcggcccgctcgtgcagggggacgagcagccctttggctggctgcagcgccaggccgacgggaacatcaccccatggaacttcgacgagaaggtcaacaaggcggcctcggccgagagcttcatcacccggatgaccaagaactgcacgtacctgaaggaggagaaggtgctgcccaagcagtccctcatgtacgagaagttcaccctgctgaacgagctcaacagcgtccagatccgctccagcctggagcagccgcacaaaaagcaccggctgtgcgaggacatgaagcagtggatcatcgagcacgtgttcaagaagaccaagaccgtgacgcacaagaccctcatccaggccctgaagaagagtccctacaaggacgagctgtacgacgagagcaccggcaactggaaggacgtctacggcacccagaaggaggacaggttcgcctccagcctatccacgtacatcagcctgaaggagatcgtgggggacatcgtggacaacgccttcatggaggagatcatctactggctgaccgtcttcaccgaccgggacatcatcaccctcaagatgaacgataagtaccccttcatcacggagcagcagatccagcgcctgctgtccctcaacatcagcggctgggggcagctgtcccagcggctgctccagagcatccccgtggacgacatgaaccgctccgtgatcgagtacatggagaagcatgccgtcaactttatggagctgctgagcccgcggcagagcgacctcgcctacaagatcgagcaggtcaacaagcagcactccaagaagatccacaagatccgctatgaggacatcgagcagctgaccggcagccccgccctgaagcgggggatctggcgctccgtgaaaatcatcgaggagctcaccgccatcttcggcgagcctaagaacatcatgatcgaggtggcgcgggaggaccaggccagccaccgcaccaagtcccgcaaagagcagtgggagagcatcggcaagtccctggccaaggaggagaaggagctgaaggccttcttcaaggagatggcccagtaccccaagcagcagttcgaccgcacacggttctggctctacgtgacgcagcaggggaagtgcttgtacaccggcaagaccctgcgcctcgaggacctgagctcctacgagatcgaccacatcctgccgcgcaacttcgtgaaggacgacagcatcgacaacctcgcacttgtctaccccatggccaaccaggagaagaacaaggccgggaacaacaagatgcccctggagatcatcgacgccaagcagcagcccgcgatgatggcccactggaagcggctcaatcaactgaagctgatctccgacagcaagctccacaagctgatgaagccgtccttcaacgacgtggacaaggagaacttcatcgcccgccagctggtggagacccggcagatcatcaagcacgtccgcgacctcctgcaggagcggttcgagcacacggacatccacgtggtgaaggccaagatggtcagccagtttcgcaagttctcccggatccctaagatccgcgactacaacaacaagcaccacgccatggacgcgctgtttaccaccgtgctgatccagttcatcctgcagaagtacggcaagaacttcctgcagttcgacctccagcacaaggacatcagcaagaagtggtccaagatcgcccagagcaccaagcacttcttcctgttccagcagttcgccgagcagcagatcaagtcacccgtgacgaaggagctggtatccggggtgcagtacttcgagcacatcttctacgagcagagctggcagaccaccaagatgacccagacgatcgactccaatttctacaaggagaccatcttcagcccgaagctcaagaccgccaagtacacgtccgccaaggcggagaagttcgtgcacgacgccatcgtcaagtacgccgtgtgcggcatccagtacacgagcctgaagaagaacaaggagcagcaccacgtgctgctcaccgacatcaacgtcatcgagcactaccagttaaaggaggcctccctgaacgagctcgccctgcacctggcgaagcgggagagcaaggacgacgtgatcgacgcccagatgctcgtggtcatccccaagtataagaagatcatgctgaacggctccccctactactgcatcagctccgacgagcgccacatcgccacccagttcgtgctgaggaaggacctcctggaggccgtgttacacgtcaacgacgagaccagcgtggacgagctccgcacgcttttccggtccatcgtcgaggagatgatgacccagtacaaggtctacaacaaggacaccatccgcaacaagatcgacgcgttcatcgagaccgagctgatcgacgtggagacgttccaagtggggttcaccgagatcaaaaagatggtcgcagccaatgcccagcggagcgacaagttcggcgggcgcctccgccaggtgatgaaggtagaggacatctacatcatcgacgagtccatcaccgggctgcggtatcgcaagccccgcaagctggtcaagtga

SEQ ID NO: 7578 - RNA, 3984 nt, synthetic construct
  misc_feature 1..3984: note = Cas9 variant
  source 1..3984: mol_type = other RNA
atgaagaagaactacactatcggcctagacatcgggaccgcgagcgtgggctgggccgtcctcacggaggactacgagctcatcaagcgcaagatgaagatctccggcaacacccagaagaaggcggtgaagaagaacttctggggtgtgcggctgttcgagcagggggagactgccgagggccgccggctcaagcgcaccacgcggcgccggatcgccagacggcgccagcggatccagtacctgcgcacaatcttcgacgaggggatgaaccaggtcgacgccaacttcttcgcccgcctggacgagagcttctccatcatcgacgagaaggagaacgagcgccaccccatcttcgggaacgttgcggaggaggccgcctaccacgagcagttcccgaccatctaccatcttcgggagcacctggccaacagctccgagcaggcagacctgcgcctcgtgtacctggccctggcccacatcatcaagttcagaggccatttcctcatcgagggtgagctgaacaccgagaacagctccgtctccggcactttcgaacagtttatcaaggtgtacaacgagacctttaacgttgagaaggccctggacctcaccgtcgacctggacgggatcgccgagcagaaaatctcgagaatgaaacgggctgagctgatcctctctctgttccccgaggagaagtccaccggtgacttcgcccagttcatcaagatgatcgttggcaaccaggggaacgtgaagaaaacgttcagcctgaacgaggacgccaagatccagttctccaaggaggagtacgaagagaacctcgagacactgctggccgagatcggagaggacttccgcagcgtcttcgacgccgcgaagtccgtgtacgacgccatcagccttgccaacatccttaaggtgaccgacgccaccactcgggccaagctgtcgagctccatggtcgtgagattcaccgaccacaaggaggacctcaagaccctgaagcgcttcgtgcgggagaacctacccgacgagtacgacgacctcttcaagaacaagaaggtcgcagggtatgccggctacatcgacggcaacgagacacaggaggccttctacaagtacctgaagaagacgctggccaaagccaccggggcggagggcttcctggccaagatggagcaggaggacttcctgcgcaagcagcggacattcgacaacggggtgatcccttaccaactgcacctcgaggagctgaaggccatcatcaagaaccagaagtcctactacagcttcctggacgaggagaagatcagccagctcatgaccttccgcatcccctactacgtgggccccctggccaaggagaaggggcagttcgcgtggctgacgcggaaggagatgggcaagatcaccccctggaacctcaacgagaaggtcgacatcgagaagagtgccactgacttcgtggagcgcatgacaaacaacgacagctacctgccaatggagaaggtgctgccgaagcacagcctcctgtacgagacgttcaccgtatacaatgagctgaccaaggtgcggtacatcgacgacaacggccgcgcacagaacttctccagcaaggagaagcggcagatcatcaacgagctgttcaagcagcagcgcaaagtcaagaaggagatgctggaagccttcttgaagaacgagtacgggatcgagaaccccaaggtggagggcatcgaaaagtccttcaacgcctgcctgggtacttaccacgacctcatcaagctgggcatacggcccgagctgttcgagcagcctgagcacgagcagcaattcgagcagatcgtgaaaatcctcacagtcttcgaggaccgcaagatgcggcgcaagcagctcgagaagttctctaacatcctgaccgaggaggagcagaagcagctcgagcgaaagcactacaaggggtggggccgcctgtccgcgaagctgatccacggcatcgtggaccagaagacccagaagaccatcctcgactacctgatcgacgacgacgacttaccgaagaaccggaatcgcaacttcatgcagctcatcaacgacgagaacctgagcttcaaggaggagatcgagaagatcgcctttgacaacgacaagtccacggaggagatcgtgcaggagctggccgggagtcccgccatcaagaagggcatcctgcagagtctcaagattgtcgaggaaatcatcgacatcatgggggagctgcccaccaacatcgtggtggagatggcccgagaaaaccagactaccgcccagggcaaccgcgccagcaaggcccgcatgaaatacctcgaggagtccatcaaaaagctggggagctccatactggaggacgagcccatcagcaaagacgccaacctcttacggaacgaccgcctattcctctactacctgcagaacggccgtgacatgtacacaggcaacgagctggacatcaacaacctctccagctatgatatcgaccacatcgtgccgcagagcttcgtgaaggacgacagcatcgacaaccgcgtgctgacgaccagctccatgaaccggggcaagagcaacaccgtccccgccgagtccgtagtgaaaaagatgcgccccacctgggagcggttactcgcgagcgggctgatctccaagaagaagttcagctacctgacgaaggccaccaacgggggcctgaccgaagaggacaaggcccacttcatccagcgccagctggtcgagacccgacagatcacgaagaacgtggcccagatcttgcaccagaaatacaacaacgagcagctctccgagaagcccgtgcgcgttatcaccctcaagagcgcgctggcctcccagttccggaaggacttcagcctctacaagatccgcgagctgaacgactaccaccacgcccaggacgcctacctgaacggcgtgatcgctcaggcgctccttaaggtgtacccgaagctggagcccgagttcgtctacggggagtaccagaaggtgtccatccgggcccttaacaaggccaccgccaagaaggagttttacagcaacataatgaacttcttcacctccgacgaaatggtggccaacgaggagacgggcgaggtcttatggaaccgccagcgggacatcaagaccatcaagaaagtgatgaattaccaccagatgaacatcgtgaagaaagtcgagatccaaaccggggcgttcaccaaggagagcatcctgcccaagggcccctccaagaagttgatcgcccgcaagaataactgggccccggtgaactacgggggcgtggatagccccacggtcgcatacagcgtgatcatcacccacgagaagggcaaggccgcgaaggtggtccagcagttggtggggattaagatcctggagcggcaggccttcgagcaagacgaggtggccttcctcgaggagaagggctttatccaccccaaggtccagttgaagctgcccaagtactccctctaccagttcgccgacgggcgccggcgcctgctggcgtcagccgaggagagccagaagggcaaccaaatggtgctcccggtgcacctgatcgagctgctctaccacgccaagcacgtcagcgactcctctggaaagtccctggagtacctgaacgagcaccggcacgagttcgccgagctcctggaggccatcctgcagttcaccgaacagtatatagatgcgggcaagaaccagaagaaggtgcgcgacctgtacgagaagaaccaggacgccgacatgcgcgagctggccagctccttcatccagctgctacagctaaataaacagggcgcccctgccgatttcaagttcttcggggagaccatcccccggcgccgctacaagaacacggcggaaatcgtggacgccaccttcatcaaccagagcatcaccggcctatacgaaacccagaagcgcctcgtttga

SEQ ID NO: 7579 - RNA, 3984 nt, synthetic construct
  misc_feature 1..3984: note = Cas9 variant
  source 1..3984: mol_type = other RNA
atgaccgaacagcagcagccctacaacatcggcctggacatcgggaccagctccatcggctgggccgtgacggaccagaacgacaagctcctgcacatccgcgggcacaacggcatcggggtccggctgttcaaggagggcgagagcgccgcggagcgccggggcttccgcaccacccggcgccggctctcccgccggcgatggcggctgcgcttcctggatcggatcttcgacgccgagctcgccaaggtggacccgaacttcctggcccgcctgaagcagagcaacatcagcccactcgaccccaacaagcaaatgttcgggaacatcctgttcgacgacccccagttcgacgaccagaagttccaccagcagtaccctaccatctaccacttacggagcgccctcgcgcagcccgacgcgccccaggccgacgtgcgcctgatctacttagccctccaccacatgatcaagttccgaggccacttcctgaacggggcggccgtcgagaagttccacggcgggcagctgcacctcgagtccgagttccaggagctgaaccagatcttcagcaaccagcagcgcgaccacgtgcagctgcagacttccagcctcgacgaggtggccaccatcctgaaggacaaccagcggaccccctccgaccgccagcgggagctgagcgcccgcctcttcgtcccggtggacaagaccatcgacaaggagaacaagaagctggccacggagctgctcaaggcggtgctgggtctgaaggccaagttcgacgtcatcctcggcgtggaggccaccgacccccaggccttcaaactgcagttctccagcgacgacttcgacgacaagatcgccgagctggcgtccgagcttaccgacgaggccaacgagatcctgaccgtgctgcagcgcctctacttcagcctgaacctggccgacatcctcacgaaccggcagactaagcaggtcgccgactccatcagcaccgcgatgatcaaccgctacgacgaccacaagcaccacctgaagatgctgaaggagctcgaggcccaggtgacccaggagcagcgggacgggttgaagaaggcctacaacgagtacatcgacggcgacaagcccacgatcgataccttctacaccaacgtgaagaagaacctggacgactccgagctcgccaaccagatcaagagcctgatcgacctgcaggccttcatgcccaagcagcgcagcaaggagaacgggtccatcccgcaccagctccaccagcgggagctggaccagctgatcgaggtccagggcaagtactacccctggctgctcgccgcgaaagacaagctggacgccctgatcgccttccgcgtgccctactatgtgggccccatgatcgacccgaaccagtcagacgacccccagaacaccaagttcgcctggatggtccgaaaggaggcgggggagatcacgccctggaacttcgaggagaaggtggacaagacctccagcgccaccaacttcatcaagcgcatgaccacgaccgacacctacctcctgggagagcccgtgttgccgaagaactcccttctataccagcagttcaccgtcctgaacgagctcaacaagctgaaggtgaacgggaaggccctgaccgtggaccagaagaagtacctctacgaccacgtctgcaagaagcagcggcgcgtgaccctgaagaagctgagcgactgcctcgtcgcccggggcgacttcccgatgggggccattttcaccggcaccactgaccagaagaacatgaacaacacgctgaagacctaccaggatttccaggagatcttcggcgacgagatcgacaaccccgaccgccaggtggacttcgagaagatgattgagtggtccaccatcttcgaggaccgggagatcttcaagctgaagttagcggagctgaactggctgacgagcgagcagctcgagcgcgtgtccaagaagcgataccaggggtggggccgcctgagccagaagttactcacccacatcgtcaacgagaacggagagcggatcatcgaccagctgtggaacaccaaccaaaacttcatggagatcatgggccaggactccgtgaagcaggccatccaggagcacaacggggccaacgtggcccagaccggcatcaacgagaccatcgacgagctgtacacgagcccccagaacaagaaggccatccgccagatcctcctggtcgtggacgacatcaagaaggcggtgggctacgccccggccaacatcatgatggagttcgcccgggaggacagggacgaccaccgcctgatcgcctcccgggcgcgccaactcgaaaagacctaccaggaaatcagcaagaactggttcgacaacgagtccgtcacccaggagttaaaggaccagatcaagaacaagaccaagttcacggaccggctgtacctctacttcatccagggcgggatagacctgtacaccgggcaccccctgaacatagaccagctcagctcctacgacatcgaccacatcctgccccagagcttcctgctcgacaactccctgaacaaccgcgtgctgaccagccaagccgagaaccgggtgcacaaggaggaccgcctccccggcgagaccgtcgccaataagatgcggcccacgtggaagatgatgcgcgagcaggggctgatgacccagcggaagtacaataacctgaccctcaagcccgaccagatcagcaaattcaacaaccgcggccagttcatcaaccggcagctggtggagaccagacaggtgatcaagctggccgcggacatcatgtcccagaagtaccaggccgaccagacgaaggtcgtgaccgtgaaggccaacctcacccaccacatgcgggagaagttcaacttctacaagagccgcaacgtcaacgactaccaccacgccttcgacgcctacctgaccctgttcgtgggaaactggttgctgaaggagtaccccaagctacagccgtacttcgtgtacggggacttcgcgaagacaggcaccaacaacctcaagtccttcaacttcctgtaccggttcgagcgcgaccacaagctgaacgacaagggggccatagacaccgacaaggaccagcagctcggctacatgaagcggatctaccgcttcaaaaagatgctggtcaccaagcaactggagacgaacgagggcgccctctacgggcagaccctgtatcccgcccccaagaacgacaagaagacccggaacctgatcaacagcaagaagaaccgcccctccgatatctacggcgggtacagcaacgagaacggctccttcctcaccctggtgaagctgaagaaggggagcaagtacgactaccggctcgtggccgtcccggtgtccaagatcagcgagatcaaagaaagcgagctggcgacgatcgagaaggccatcgcgccccagttcctgaagtcatccggcaagtacagagacttccaggtggtcctcagcaagatcctgatcaaccaaaaggtgatcgacgacggtatgattttcaccatcgggtccaagagttacaagcacaacgcgaagcaggtcgtgctgtccgacaacagcatccagatcgtgtcgaccctctcccgcatcagcgacaaggagaagctgatcaccgtgttcgacgagatcgtcgatatcacgtccaagtacctgccctggtacaaggtgaacgacgtggagaagaccaagatgctgttccggcagatgcaggacatcgacgagatgaagaagatcatcgataacagcctgatcggactgcactgcaacgcctccatcaccgacctcgggaaagtcggcctgagcaagtactgggggcgcttcgtgctgaccgccggcatctccctcacggtggatgcccagctcatctaccagagccccaccggcctgttcgagcaccgggtcaaggtgtccgacctctga

SEQ ID NO: 7580 - RNA, 3990 nt, synthetic construct; identical to SEQ ID NO: 1780
  misc_feature 1..3990: note = Cas9 variant
  source 1..3990: mol_type = other RNA

SEQ ID NO: 7581 - RNA, 3993 nt, synthetic construct
  misc_feature 1..3993: note = Cas9 variant
  source 1..3993: mol_type = other RNA
atgaagaacgactacaccatcggcctggacatcgggaccaacagcgtaggctactccgtcgtgacggacgactacaaggtgatcagcaagaagatgaacgtcttcgggaacaccgagaaaaagtccatcaagaagaacttctggggcgtgcgactcttcgagagcgggcagaccgcccaggaggcccggatgaagcgcacctcccggcgccggatcgcacgccggaaaaaccgcatatgctacctgcaagagatcttccagcccgagatgaaccatctggataacaacttcttctaccggcttaatgagagcttcctggtagccgacgacgctaagtacgataagcacccgatcttcggcaccctggacgaggaaatacactttcacgagcaattccccaccatctatcacctccgcaagtacctagcagacggcgacgagaaggccgacctgcggctcgtctacctggcgatcgcccacatcatcaagttccgcgggaatttcctgatcgagggcgagctcaacactgagaacaactccgtgatcgagctgtcgaaggtcttcgtccagctgtacaatcagaccctctccgagttagagggtttccagttcatagacgagagcatagacttctccgaggtgttaacgcagcagctctcgaagtcagagcgggccgacaacgtactgaagctgtttcccgacgaaaagggcaccgggatcttcgcccagttcatcaagctcatcgtcggcaaccagggcaacttcaagaaggtattccagctggaggaggaccagaagctgcaactcagcacggatgactacgaggagaacatcgagaacctgctggccatcatcggtgacgagtacggcgacatcttcgtcgccgcacagaacctctaccaggccatcctgctggccgggatcctcacgtccacggagaagacccgcgcgaagctgagcgcctccatgatccagcggtacgaggagcacgccaaggacctgaagctcctgaagcgttttgtcaaggagcacatccccgacaagtacgccgagatcttcaacgatgctaccaagaatggctacgcgggctacatcgacgggaaaaccaaggaggaggagttctacaagtacctgaagacgaccttggtgcaaaaatccggctaccagtatttcattgagaagatcgagcaagagaactttctgcggaagcaacgaatctacgataatggggtgatcccgcaccaggttcacgccgaagaactgcgggccatcctccgcaagcaagagaaatactacagcttccttaaggaaaaccacgagaagatcgagcagatcttcaaggtgcggattccctactacgtgggccccttagcaaagcacaacgagcagagccgcttcgcctggaacatccgtaagagcgacgagcccatccggccgtggaatatgaacgacgtcgtggatgaaaacgcgtcagccgtcgccttcatcgagcgcatgaccatcaaggacatctatctcaacgagaacgtcctgccgcggcacagcctgatctacgagaagttcaccgtattcaacgagctcacgaaagtcctgtatgccgacgaccgcggggtgttccagagattcagtgcagaggagaaggaagacatcttcgagaaactgttcaagtctgagcgcaaggtaaccaaaaagaagctcgagaattacctgcggatcgaactgtccatcagctcccctagcgttaagggcatcgaggagcagttcaacgcgaacttcggcacatacctggacctcaagaagttcgacgagctgcacccctacctggacgacgagaaataccaggacaccctcgaggaggtgatcaaggtactgacggtgttcgaggacagatccatgatccagaaccagctggaacagctcccgctgaacctgagcaccaagaccatcaaggccctcagccggcgcaagtacaccgggtggggccggctgagcgccagactgatcgacgggatccacgacaagaactccggcaaaacgatactcgactacctgatcgaggacgagtctgactcctatatcgtgaaccggaacttcatgcagttgatcaacgacgaccacctcagcttcaagaaaataatcgaagactcccagccatacaaggagcagcagtcggcggaggagatcgtgtccgagctgagcgggagccccgcgatcaagaagggcatcctgcagtccctcaagatcgtagacgagctggtggccatcatggggtacaagcctaagaacatcgtggtggagatggcccgcgagaaccagaccaccgggcggggcaagcagaacagcaagccgcgcctgaaggggatcgagaacggcctcaaggagttctccgacagcgtcctgaaggggtccagcatcgacaacaagcagctgcagaacgatcggctctacctatactacctgcagaacggcaaggacatgtacaccggccacgagttggatatcgaccacctgtccacgtacgatattgaccacatcatcccccagagcttcctgaccgacaactccatcgacaaccgcgtgctcaccaccagcaagagcaaccggggcaagtcagacaacgtcccctccgaggaggtggtgcgcaagatggaccgcttctggcggaaacttctgaatgccaagctcatcagcgagcgcaagtacacgaacctgaccaagaaggagctgaccgaatccgacaaggctggattcctgaagcggcagctggtcgagacgcgccagatcaccaagcacgtggcgacgatcctggacagcaagttcaacgaggactccaataacagggacgtacagattatcaccctcaagagcgccctggtcagcgagttccgtaagacctttaatttgtacaaggtgcgggaaatcaacgacctccaccatgcccacgacgcctatttaaacgccgtggttgcgctgtcactcctgcgcgtgtacccccagctgaagccagagtttgtgtacggggagtacggcaagaactcgatccacgatcagaacaaggctaccatcaaaaagcagttctactccaatatcacgcggtacttcgccagcaaggactacatcatcaacgacgacggcgagatcctctggaacaagcaagagaccattgcccaagtcatcaagaccctggggatgcaccaggtgaacgtggtcaaaaaggtggagatccagaagggcgggttctccaaggagagcatccagccgaagggcgaatcccagaaactcatcagaaggaagcagcaatggaacaccaagaaatatggcggcttcgacagccccgtggtcgcctacgcgatcctcctgtccttcgacaagggcaagcgtaaggcccggagcttcaaaatcgttggaattacaatccaggaccgcgagtccttcgagggaaaccccatcctgtacctcagcaagaaggactaccacaacccgaaggtggaagccatcctgcccaagtattccctcttcgagttcgagaacgggcggcggcggatggtcgccagcgcgtccgagacccagaagggcaatcaactaattatccccgggcacctcatggagctgctctaccacagcaagaaaatcatcaacggcaagaactccgactcagtgtcctacatccagaacaacaaggagaagttccgagagatcttcgagtacatcgtggatttcagcagcaagtacatctccgccgatgccaacctgaacaagatcgagaagatcttcgagaacaatttccacaaggccagcgagcaggagattgccaagtcctttatcaacctccttacgttcaccgcgatgggcgcccccgccgatttcgagttcttcggcgagaagatcccgcggaagcgttatgtaagcatctccgagattatcgacgccgtattcatccaccagagcatcacgggcctgtacgagaccagggtgcgcctgaccgaggtctga

SEQ ID NO: 7582 - RNA, 3993 nt, synthetic construct
  misc_feature 1..3993: note = Cas9 variant
  source 1..3993: mol_type = other RNA
atggagaaggagtacaccatcggcctggacatcgggaccaacagcgtgggctgggccgtgctcacggacgactaccgcctggtggcccggaaaatgtccatccagggcgacagcaaccgcaaaaagatcaagaagaacttctggggcgcgcggctgttcgaagaaggtaagacagcccagttccgccggatcaagcgcaccaaccggcgcagaatcgcccgccggcgccagcgggtgctcgccctgcaggacatcttcgccgaggagatccacaagaaggaccccaacttcttcgcgcgccttgaggagggcgaccgggtcgaagccgataagcgcttcgctaagttccccgtgtttgccacgctctccgaggagaaaaactaccaccggcagtaccccacgatctaccacctccgccacgacctggcgaacagcaaggagcaggccgacatccggctcgtttacctggctatcgcccactgtctgaagtaccgcggtcactttctcttcgaaggggagttagataccgagaacaccagcgtcaccgagaattaccagcagttcctacaggcctaccagcagtttttccccgagcccatcggcgacctcgatgacgcggtgccgatcctgacggagcggctgagcaaggccaagcgcgtggagaaggtcctcgcctactacccctccgagaaatccaccgggaatttcgcacagttcctgaagctgatggtcggcaaccaggccaacttcaagaagacctttgacctcgaggaggagatgaagctgaactttacccgcgactgttacgaggaggacctgaatgagctgttagagaagacgtccgacgactacgcggagctgttcctcaaagccaagggggtgtacgacgccatcctgctgagccagatcctctccaagagcgacgacgagaccaaggccaaactgtccgccaacatgaagctgcggttcgaggagcaccagcgcgacctaaagcagctgaaggaactggtccggcgcgacctccccaagaagtacgacgacttcttcaaaaaccggagcaagaatggctacgcgggttacgtgaaagggaaggccacccaggaggacttctacaagttcctgaggaccgaactggcgggcctcgaggagtcccagagcattatggagaaaatcgacctggagatctacctgcttaaacagcggacgttcgccaacggggtgatcccccaccagattcacctggtcgagatgcgcgagatcatggaccggcagaagcgcttctacccgtttctgaagggcgcccagggcaagatcgagaagctcctgaccttccggatcccctactacgtggggcccctggcgcaggagggccagtcccccttcgcctggatcaagcgcaagagcccgtcccagatcacaccctggaacttcgccgaggtggtcgacaaggagaatagcgccatcgagttcatcgagagaatgaccaaccaggacacgtacctccccaaggagaaggtgctgcccaagcagtctctgatctaccagcgcttcatgatcttcaacgagctgaccaaggtgtcctacaccgacgagcggggcaagagccactacttcagtagcgagcagaagcgcaagatcttcaacgaactgttcaagcagcacccgcgggtcaccgagaagcagctgcgcaagttcctggagctcaacgaacagatcgactcgacggagattaaagggatcgagaccagcttcaacgcgtcctacagcacatatcatgacctgctgaagctctccgaccaaatggacaccctgctggacgaccccgacatgacgaccatgttcgaggagatcattaagatcctcaccatcttcgaggaccgggagatgatccgcgagcaactgaagccgtacgagaccgtgctggggctccccgcaatcaagaagctggccaagaagcactacacgggctggggccgtctgagcgagaagatgatccaggggatgcgggagaagcagtcccgcaagaccatcctcgactacctgatcgacgacgacgacttcccttgcaatcggaaccgcaacttcatgcagctgattaacgacgaccacctcagcttcaaggagaccatcgccaacgaactgataatgagtgacagcaacgtgctgctcgaccaagtgaaggccatccccggctcccccgcagtgaagaaggggatctggcagagcattaagatcgtcgaggagatcatcggcatcatcgggaaggcccccaaaaacatcgtgatcgagatggctcgggagaaccaacgcacctcccggtcacgcccgcggctgaaggccctggaggaggccctcaagaacatcgacagccccctgttaaaggactaccccacggacaaccaggcgctccagaaggaccgcctgtacctgtactacctacagaacggcaaggacatgtacaccggcgagcccctggagatccaccggttgagcgagtacgacatcgatcacatcatcccgcgcagcttcatcgtggacaactccctcgacaacaaggtcctggtgagctccaaggtgaaccgggggaagctggacaacgcccccgatcccctcgtcgtgaagcgcatgcggagccactgggagaagctgcaccaggccaagctgatctccgacaagaagctcgcaaatctcaccaagcagaacctgaccgaggccgacaaggcgcgattcatccagcggcagctcgtagagacccgccagatcacgaagcacgtcgccaatctgctgcaccagcacttcaacctcccagaggaggtgagcgccaccgagaagacctccatcatcaccctcaagagcacgctgacctcccaattccggcagatgttcgacatctacaaggtgcgcgagatcaaccaccatcaccacgcccacgacgcttacctgaacggtgtcgtggcaatgaccctgctgaagaagtacccaaagctggcacccgagttcgtgtacgggagctacatcaagggcgacattaaccagatcaacaaggccaccgccaagaaggagttctactccaacataatgaagttcttcgagtcagaggagatcatctgcgacgagcagggggaggtcatttggaacaagaaacgggacctgtccacgatcaagaaaaccatcggcgcgcaccaggtgaacatcgtgaagaaggtcgagaagcagaagggcgggttctacaaggagaccatcaacagcaaggccaaccccgagaagctgatcccgcggaaggcctccctcgaccccttgaagtacggcggctacggcagccccctggtggcctacactgtgatcttcatcttcgagaagggcaagcagaagaaggtcacaaaggggatcgagggcatcaccgtgatggagcagctccgcttcgagcaggatcctcgggagttcttgaagaccaaggggtacgagggcgttaagcaatggctgatcctccctaagtacatactgttcgaggcccagggcggataccgccggatgatcgcgtcccaccaggagacccagaaggccaattctttaatcctccccgagaacctggtgacgctgctctaccacgcccgccactacgacgagatcaatcacaaggtctcgtttgactacgtgaacgcccacaaggagggcttcaacgacatcttcgacttcatctccgacttcggggtccggtacatcctggcgccccagcacctggagaagatcaaggtggcctacgagaagaacaaggaggtggacctcaaggagatgatcgacgccatcctgtctctgctcaaattcaccctgttcggcgcctcggtcgagttcaaattcttcgacatcaagatcctgaaacgctacaagagcctcaccgacatctgggaagccaccatcatttaccagtccgtgacggggctgtacgagcggcgcgttgaggtccggaagctgtgggacggcgagcgcctctga

SEQ ID NO: 7583 - RNA, 3996 nt, synthetic construct; identical to SEQ ID NO: 1783
  misc_feature 1..3996: note = Cas9 variant
  source 1..3996: mol_type = other RNA

SEQ ID NO: 7584 - RNA, 3999 nt, synthetic construct
  misc_feature 1..3999: note = Cas9 variant
  source 1..3999: mol_type = other RNA
atgaagaaccgcgagaacatcaagtactacatcggcgtggacatcgggaccaacagcgtcggctgggccgtgatcgacgagaacggcaacctgctcaagaagggcaagcaccacctgtgggggtcccggctgtttgaccaggcccagacagcgcagaaccgccggaactaccgcagctcccggcgccggtacaacaagcgccggcagcgcatcggcctcctgcggctgataatgagcgacatggtgctcgaggtcgacccctccttcttcatccgcctagagaagacgaccttcctggacaaggaggacaagaaggccatcctcaaggacaactacaagatgaactacaacctgttctgcgacgaggactacaacgacaaaaagtacttcaaggactacccgaccatataccacctccggaagaagctctgcgagagcgacgagaaggccgacccccgcctgatctacctggctctccaccacatcgtgaagtaccggggcaacttcctgtacgaggggcaggagcttcacctcgagccctccaacaaggaggaggacctgaagatcctgttcgacatcctcggcaagaacaacgacaccgtgtacgacatcagcgaggagcagatccagttcatcctgaagacggtcgtggagaacatctccaagaccgccaaggtggacgagtgcatgagccagttgaagctcaactccgaggacaagaagatcgtcaaggagttcatgcgcgggctggtgggcaacaagttcaacgtgagcaagctgtatatgcacgaggacctccagttcgacgacgaggacctgaagctgcagttctccgacaagagctacgaggagaagatcaccgagtacgagaacgtactcgaggaaaagatggagttcatcgacctgatgcagcggttctactcctggatcgagctgagcaagatcgtggggtccgacagccagcacgcgtccatctctggcgccatggtgaacatctacgagagccaccgcgaagacctccggaccctgaaagaggtcatgctaaagatcggcaagaaggaatacgacgagatgttcaagcctacgtccaagaacgtggtgaactactacaactacgtcaacccggtggcctgcagcggggacaagaccgacggcttctacaagtacgtgaagaaggccatcgagaaatccgacgacagccgcaaggacgagatcctccagaagatcgcgaacgagacctacatgctgaagcagacctccaagaacaacgcctacatcccctaccagatgcagaaggatgagctgatcaagatcctcgaccaccaggagaagtactaccccgtcctgaaggagaaccgggacaagatcatcagcatcctggagtttcgcatcccctactactacgggccgctcgacggcaacaagcagttcggctggctgatcaagaagaaggggaaggagaacgagcgcatcctgccctggaaccaccaggagatcgtggacgtgcaggagacggccgcccagttcattaagaagctcaccaactattgcacttacctgcccatcgagaaggtcatgccccagaagtccctgacctgcagcatgtacgaggtgctctccgaagtcaacaagatccggatcgacggcaagctgctcccgatcgacacgaagaacagattgatcgaggacctcttcttcaagcggaagaccgtgaaggagaaggacttgatcaactggctgaagcagaaccagctcaccgtgggggagatcaccggctaccagaaggagaaggccttcagctccagcttagccccctggatcgacttcaaggagatcttcgacgagatcaacgactccaactacgacctgatcgagaagatcatcgaggacatgacaatcttcaacgaggggagcatcctcaaggagaggctgaagaaggcctacaacctggaccagaacaaggtcaagaagatcatgaagctcaagtactccggctggagtcggctgtccaagaagctgatcaacggcatccgcgccgacaacaagttcggaagctccgtgagcatcctcgacgtgatgaaggagagccatatggccctaatggagatcatcaacgaccaggacctaggcttcaagcagatcatcgagaaggagaacttcaagaacgagaccgggtccttcgagtacgaggacatcgagaacctcgctggcagccctgcgctgaagcgggggatctggcagaccctgcaggtcatcgaggagatcaagaactacatgggccacgagcccaagaacatctacatcgagttcgcccgcgaggagcaggagaaggtgcggaccacgacccgcgtgaagaagctcaagtccatctacaacgacatcaagaaccagctggacgtccacgggaaggaggtgtacagcaacctgaacaagcaagacgagaagtccagcatcgagaagcggctctacctgtactacacccagctggggaagtgcatgtactccggcgagagcctcgacatcgataagctgtccaactacgagatcgaccacatcttcccgcgcaccctgacgagcgacgactccctcgacaacctggtgctggtcaagaagaaggagaaccagcggaagctcgacgacctggtgctgcccctcgagatccgcaacaagatggaggtgttctggaagaagctgtacgacaacgggcttatcacccagaccaagtactaccggctcatgcgcgacgagttccggcgcgaccagatcgacaagttcatcaaccggcagctggtcgagacccgccaaatcatcaagcacgtggccaacatcatcgagaaccactacgaggacacgaaggtgttcaccgtccgcgccaacctgagccacgagttccgggagaagtacggcatctacaagaaccgcaacgtgaacgacttccaccacgcccacgacgcgtacatcgcctgcatcatcgggcggtacatccagatccgcttccccggcctcgaggccaagtacgtgtacggccagtatatgcagaacgtcaagaagaccaagaacaacatcgacaaggagaaccacgggttcatcatcaactccatgaagtacgagtgcatcgacgaggacaccggcgaggtgatctggaaccccgaacggattctggactacatcaagtgcttcaactaccgcgacgtgtacatcaccaaaaagctggacaccaacaaccgggagctgttcaatgtcacgatcttaccgaacgacaagaacagcgagaaggggaaaaccaaggccaccatccccgtgaacaagctgcgcagcaacgtgcggaagtacggcggcttcagcgggctccaatccgacatcgtggccatcgagggcaagaaggggaagaagatcgaccgccggctgatcaacctgcccatcctcctgcgctacgtgagcatcgaggaccagtgcaagtacataatggagaacaacaagtacagcgacgtgaagatcatcaagaagatcaagaagaaccagctgatcgagatcgacggcatctgctactacctcaagtccgcggacgagctggatacggcctaccagctgatcctcagccgggacgacaacgagatgatctaccgcatcgaccgggccatccagaacaacgacttctcgtacttcgacaacaagaaggagaacatcgacgagctgtaccgccttatctgccacaagatgatcgagaactaccccaaatacaagaagaaggtctatgagttcatcaaggagcgggaagaggagtttttcgagctcgacaacagccagaagtgcatcgtgatcttcgagatgatccgcgtgatgaagcgcggggagcagtacatcaacatcccgttcgagccctacaacctgaagaacgaccggaagggccggctgaactgccagtccatcctcctggataacacatacttctacgacgtcagcatcaccggcatctactccaagaagtacaaactttga

SEQ ID NO: 7585 - RNA, 3999 nt, synthetic construct
  misc_feature 1..3999: note = Cas9 variant
  source 1..3999: mol_type = other RNA
atgcagaagaactacaccatcggcctggacatcgggaccaacagcgtgggctgggccgtcatgaaggatgactacacgctcatccgcaagcggatgaaggtgctagggaatacggacatcaagaagatcaagaagaacttctggggcgtgcgcctgttcgacgagggggagaccgccaaggagacacggctcaagcgcggcacgcggcgccggtaccagcgccggcgcaaccggctaatctacctgcaggacatcttccagcagcccatgctcgcgatcgacgagaacttcttccaccgcctggacgacagtttcttcgtcccggacgacaagtcttacgaccggcaccccatcttcggctccctggaagaggaggtggcctaccacaatacctaccccacaatctaccacctccgcaagcacctggcagataaccccgagaaggccgacctgcggctcgtgtataccgccctggcgcacatcgtcaaataccgcgggcacttcctgatcgagggcgagctcaacacggagaacaccagcatctccgagaccttcgagcagttcctggacacctactcagacatcttcaaggagcagctggtcggggacatctccaaagtggaggagatcctcagctccaagcagagccggtcccgcaaacacgagcagatcatggccctgttcccgaacgagaacaagctgggcaacttcgggcgtttcatgatgctcatcgtcggcaacacgagcaatttcaagcccgtgttcgacctggacgacgagtacaaactgaagctctccgacgagacctacgaggaggacctggacaccctgctcggcatgaccgatgacgtgttcctggacgtcttcatggccgccaagaacgtgtacgacgcggtcgagatgagcgccatcatctccacggacaccgggaacagcaaggccgtcctgtccaatcagatgatcaacttctacgacgagcacaaggtggatctcgcccagctgaagcagttcttcaagacccacctccccgacaagtactacgagtgcttcagcgacccctccaagaacggctacgccgggtacatcgacggcaagaccaaccaggaggacttctacaagtacatcgagaaggtgatgaagacgatcaagagcgacaagaaggactacttcctcgataagatcgaccgcgaagtcttcctgcggaagcagcgcagcttctacaactccgtgatcccgcaccagatccacctccaggagatgcaggcgatcctggaccgccagagccagtactaccccttcctggccgagaaccgggacaagatcgaatccctggtgacgttccgcatcccctactacgtcggccccctcaccgtgagcgaccagtcggagttcgcctggatggagcggcagagcgacgagccgattcggccctggaacttcgacgagattgtgaacaaggagcggtccgccgagaagttcattgagcgcatgaccaacatggacacgtacctgctggaggagaaggtcctccccaaacggtcactgctgtaccagaccttcgaggtgtacaacgagctcaccaaggtccgctacaccaacgagcaggggaagacggagaagctgaaccggcagcagaaggccgagatcattgagaccctcttcaagcagaagaaccgcgtgcgggagaaggacatcgcgaactacctcgagcagtacggctacgtcgacggcaccgacatcaagggcgtcgaggacaagttcaacgcctccctgagcacctacaacgacctggccaagatcgacggagccaaagcctacctggacgaccccgagtacgcggacgtgtgggaggatatcatcaagatcctcacgatcttcgaggacaaagccatgcgcaagaagcagctgcagacctactccgacaccctgagcccggagatcttaaagaagctggagcggaagcactacaccggctggggccgcttctccaagaagttaatcaacgggctccgggacgagggcagcaacaagacgatcctggactacttaaagtccgacgaggggagctccggccccaccaaccgcaacttcatgcagctcatccgagacaacaccctgagcttcaagaagaagatcgaggacgcccagaccatcgaggacaccacgcacatctacgacaccgtggccgagctgcccgggagccccgccatcaagaagggcatccgccaggcgctcaagatcgtcgaggagatcatcgacatcatcggctacgagccggagaacatcgttgtggagatggcccgggagagccagaccaccaagaaggggaaagacctgtccaaggagcgcctcgagaagctcacggaggccatcaaggagttcgacggcccctccgacgtcaaggtgaaggacttgaagaacgagaatctgcgcaacgaccggctctacctgtattacctgcagaacgggcgcgatatgtacaccaacgagcccctcgacatcaacaacctgagcaagtacgacatcgaccacatcatcccccagtccttcaccaccgacaacagcatcgacaacaaggtgctggtctcccggacgaagaaccagggcaacaagagcgacgacgtgccgtccatcaacatcgtgcacaagatgaagcctttctggcgccagctccacaaggccgggctgatcagcgaccggaagttcaagaacctgaccaaggcggagcacggcggcctcaccgaggccgaccgcgcccacttcctcaaccggcagctggtcgagacccgccagatcacgaaacacgtggccaacctcctggactcccagtacaacaccgccgaggagcagcggattaacatcgtgctgctcaagagctccatgaccagccgcttcaggaaggagttcaagctgtacaaggtccgcgagatcaacgactaccaccacgggcacgacgcgtacctgaacgccgtggtggccaccacgatcatgaaggtctacccgaacctcaagccccagttcgtgtacggccagtacaagaagacttccatgttcaaggaggagaaggccaccgcccggaagcacttctacagcaacatcaccaagttctttaagaaggagaaggtggtcaacgaggaaacgggggagatcctgtgggacaccgagcgccacctgtccaccatcaaacgggtgctcagctggaagcagatgaacatcgtaaagaaggtcgagaagcaaaagggccagctttggaaggagaccatctacccgaagggcgactccagcaagctgatccccgtgaaagaggggatggacccccagaagtacggcgggctcagccaggtgtccgaggcgttcgccgtcgtgatcacgcatgagaagggcaagaagaagcagctcaagagcgacctgatctccatcccgatcgtggaccagaaggcctacgagcaacaccccaccgcctacctggaggaggccgggtacaacaaccccaccgtcctccacgagctgttcaagtaccagctgttcgagctggaggacggcagccgccggatgatcgcgtccgccaaggagttccagaagggcaaccaaatggtgctgcccctcgaactggtggagctgctctaccacgccaaccgctacgacaaggtcaagttcccggacagcatcgagtacgtgcacgacaacctggccaaattcgacgacctgctcgagtacgtgatcgatttctccaacaagtacatcaacgccgacaagaacgtccagaagatccagaagatctacaaggagcacgggaccgaggacgtggagctgacggtggagagcttcgtcaacctgatgaccttcaccgccatgggcgcccccgccaccttcaagttctacggggagtccatcacgcggagccgctacacctccattaccgagtttcggggcagcaccctcatcttccagtcaatcacggggctgtacgaaacccgctacaagctggaggacaactga

SEQ ID NO: 7586 - RNA, 3999 nt, synthetic construct
  misc_feature 1..3999: note = Cas9 variant
  source 1..3999: mol_type = other RNA
atgatgaaggaatacagcataggcctggacatcggaagcagctccgtgggcttcgtcgccgtggacgaccagtaccgcgtagtccgggccaaggggaaaaacgtcatcggcacccgcttgttcgatgaggggaagaccgcagcagaccggcgcgggctgaggacgacccgccggcgccttagccggcgcaagtggcggctcaggctgctgcgggggatctttgagccccacatcaacgagatcgacgagtccttcttcatgcgcctgaaggagagcaatatttccccgaaggatagcaacaagcacttccccggagacatcctgtttaacgaccggtccgaccgcgagttctacgaaaattaccccaccatctaccacctccggcaggccctcaagaccgagaagcgccagttcgacatccgggagatatacctggcaatgcaccacatcgtgaagtaccgcggccacttcctagagggcgggactgtcaccgacttcgaggtgggggagctcgacctggccgggaaattcagccggctgaacgagctgttcgagtcaatcaacctggaggtgccctttgtcctacgcctcgacaatctggaggacgtgaaagcggtgctgatcgacagccagcgctccgcccaggaccgccagagaaccttgactccggacatctacgtccccagcacggacaagatcaccgagaaaagattcaagggcatcgccacagagcttctaaaggccattgtagggaacaaggcaaagtttgacgtgttggctggcctggagctggacaaggaggaggccaagctctgggccctgaccttcgactccgagacgttcgacgaggatatcgagcagctggagggagacatgaccgaggccacccaggacctaatcgagatcctcaagagcttgcggtccctcatcagactggcggtcaacatgcccgagggcgtgagcctgtccgagatgatgatccagcgctatgaggaccacgccgatcacctcaaactgctgcgggacatcatccataacaccgacgccgagaaggccgcgggcctccaggcggcctacgacggctatatcgacggcgtgaaggggaagaagacgcccgtcgacgacttctacaaggcaatcaagaagaacctggatgacagcgaggccgcccaccagatactggcgctcatcgacaagaacgagttcatgcccaagcagcgcagcaagtccaacggctggatcccccaccagatccagcagaaggaactagaccggatcatcgagaaccagaagcagtactacccctggctggccgacgtgaacccgaacgagagccgccggaaagtagccccctacaagatcgacgagctcgtaaccttccgcgttccctattatgtggggcctctggtcacctccgaggagcagaagaagtacggtagcaaattcgcgtggatggtacggaaggaggagaagggtgaaatcaccccctggaactttgatcagaaggtcgaccgcgcagcgtccgccacggagttcatcaatcggatgaccaccatggacacctacctgctcaacgaagacgtgctgccggcccacagcctgatctaccagaagtatgaggtgctgaacgagctcaacaaggtcaagatcaacggggatgccatcacgcccgagctgaagcaaaagatctaccacgacctcttcgagaagcagaccacggtatccatcaagaacctccagacctacctggtgagcgagtccgaggcgagcgaggtccccgagatcaaggggctggccgacgagaagaagttcctttccggactgactacctaccacgacctgatgaagatcttcgaccgcaacgtggtcaatgaccccgagcgggccgaggacttcgagaaaatcatccgctggagcaccgtgttcgaagacaagcacatatacagggagaaactcgactccctgagctggctgaccacggaccagaaggatcgactcgccgtgaagcgctaccgggggtggggccgcctgtccgagaaactgctcatcggcctgcgggacgagggccaccgcagcatcatggattacctgtgggagaccacctccaacttcatgcagatccaggcccagaacgacttcagtgagaagatcgcggccgagaacaaagagttcctggacaatacacagtccgtgcaggggatcatcaacgagctgtacacgagcccacagaacaaaaaggccatccggcaaactctgctcgttgtggaggacatcaagaaggcctttcacggcgaggctcccaagcgcatatttgtggagttcgctcgggagaacgagagcacgccccagaggtccatacagcggcagcgacaggtcgagaacgcctatgaaaaggtgacccagaacctgctggtggacgacaagatcagggccgagctcaaggacagcataaacgaaaagcgcctgttccatgaccggctgtttctctatttcatgcagggcgggatcgacatgtactcggggaagaagattaacatcgacaacctgagtgcctacgacatcgaccacatcttaccccagtccttcaccgtcgataacagcctcgacaacagagtgctgaccaaccagaaagacaaccgggagaagggcaattcgctgccgagcgaactctatcgcggctccatgaaggagacctgggagatgatgcggaaccaggggctgttgtcaaagggcaagttccaccgcctcatgatgacccccaactccatgaccgcctacgaccagcagggattcatcaacagacagctggtggagacccgtcaggtcatcaaactcgcggtggagatcctcgcgagcgagtttgaccaggcagacgagaaggtggagattgtctccgtgaaagccggcctgacccaccagatgagacaggacttcagccttatcaaaaaccgcgacgttaacgactaccaccacgcgtttgacgcctacctcaccgcctttgtaggcacatatctgcttaagcgctaccccaagctccgtccctacttcgtgtacggggagttcaagaagttctcccagaagcaggccaacctgacgaacttcaacttcctgtgggctctcaaacacaaggaccaggtggcggtcgaggacacaggtgagaagatctggaacaagccgcaggacctggcctacatccgccacctgtttgccttcaagaagatactcatcagccgggaggtgtccgagagacacggggccttattcgaccagaccctgtacaaggccagcgacgataaggcgagcggccaggggtccaagaagctcatccccgcgaaggacaaccggcccaccgagctgtacggtggctacagcggccagacgtccgcgttcatggccatcgtgaaggtgaccaaaggcaagaaaactaagtacctggtggtcggggtcccgaccgccgcaatcagccagctccagggcatggacgtgaagtccagccaatacacggagaagatctacaacatcctttctcccaagctgctcagcaagaacgatgacttcgaggtgatcgtccccaaggtgcgctaccggcaactcatcctggataacaaccagcttttcaccctggggtcagacacctacaagtataacgcccgccagctggtgctcagcaacgaggttttggctgtgatcaaccgggataagtccttcattgacaagaaactgtctgaggaggccgagaatcaggctctcaacgacgcattcgacgagatcgtggttgccatggacaagcacttcgacctgtacgacaagaatggcttccgcgagaaggtaaaggctggcaagcagcggttcgaagaactgcccgtgtccctctttagcgaggacaaggagaacgaagggatcaccaagaggacggtcctgaagaggatcctgcagggcctccacgccaacgccaccaccagcgacctgaaggtgctggatgggaagttctacaactga

SEQ ID NO: 7587 - RNA, 4002 nt, synthetic construct
  misc_feature 1..4002: note = Cas9 variant
  source 1..4002: mol_type = other RNA
atgaagaactacaccatcggcctggatatcggggtggccagcgtcggctgggtgtgcatcgacgaaaactacaagatcctcaactacaacaaccgccacgccttcggggtgcacgagttcgagtccgcggagagcgccgccggccggcgcctgaagcgggggatgcggcggcgctacaaccggcgcaagaagcggctgcagctcctgcagtccctgttcgacagctacatcaccgactccggcttcttcagcaagacggactcccagcacttctggaagaacaacaacgagttcgagaaccgcagcctcaccgaggtcctgtccagcctgcggatctccagccgcaagtaccccaccatctaccaccttcggtctgacctgatcgagagcaacaagaagatggacctgcgcctcgtgtacctggccctgcacaacctcgtgaagtaccggggccacttcctgcaggaggggaactggtccgaggccgcgagcgccgagggcatggacgaccagctgctcgagctggtcacccgctacgccgagctggagaacctctccccgctggacctgagcgagtcccaatggaaggccgcggagacgctcctgctgaaccggaacctcaccaagaccgaccaaagcaaggagctgaccgccatgttcgggaaggagtacgagcccttctgcaagctggtggccggcctcggggtgagcctgcaccagctgttcccctccagcgagcaggccctcgcttacaaggagacgaagaccaaggtccagctgtccaacgagaacgtggaggaggtaatggagctgctcctggaggaggagagcgcgctactcgaggccgtccagcccttctaccagcaggtcgtgttatacgagctgctcaagggcgagacctacgtggccaaggccaaagtgtccgccttcaagcagtaccagaaggacatggcgagcctgaagaacctgctcgacaagaccttcggcgagaaggtgtaccgctcctacttcatcagcgacaagaactcccaacgggagtaccagaagtcccataaggtcgaggtgctgtgcaagctggaccagtttaacaaggaggccaagttcgccgagacgttctacaaggacctcaagaagctgctggaggacaagagcaagaccagcatcgggaccaccgagaaggacgagatgctgcgcatcatcaaggccatcgactccaaccaattcctccagaagcagaagggcatccaaaacgccgctatcccgcaccagaacagcctgtacgaggccgagaagattctgcggaatcagcaggcccactaccccttcatcacgaccgagtggatcgagaaggtgaagcaaattctcgccttccgcatcccctactacatcgggcccctggtcaaggacaccacgcagtccccgttcagctgggtggagcgcaagggcgacgcccccatcacgccctggaacttcgacgagcagatcgacaaggcggcctccgccgaggccttcatcagccggatgcgcaagacctgcacctacctgaagggtcaggaggtgctccccaagtccagcctgacctacgagcgcttcgaggtcctgaacgagctcaacggtatccagctgcgcacgaccggcgcggagagcgacttccggcaccgcctgtcctacgagatgaagtgctggatcatcgacaacgtgttcaagcagtacaagaccgtctcgaccaagcggctcctgcaggagctgaagaagtccccctacgccgacgagctatacgacgagcacacgggggagataaaggaggtgttcggaacccagaaggagaatgccttcgccaccagcctgtccgggtacatcagcatgaaaagcatcctgggcgccgtggtcgacgataaccccgcgatgaccgaggagctcatctactggatcgccgtgttcgaggaccgcgagatcctgcacctgaagatccaggagaagtaccccagcatcacggacgtgcagcggcagaagctcgcccttgtcaagctgcccggctgggggcgcttcagtcggctccttatcgacggcctgccgctcgacgagcaggggcagagcgtcctggaccacatggagcagtactccagcgtgttcatggaggtcctgaagaacaagggcttcgggctcgagaagaagatccagaagatgaatcagcaccaggtggacggcaccaagaagatccgctacgaagacatcgaggagctggccggcagccccgccctaaagcgggggatttggcgcagcgtgaagatcgtcgaggagctcgtgtccatcttcggcgagcccgcgaacatcgtgctggaggtcgcccgggaggacggcgagaagaagcgcaccaagagccggaaggaccagtgggaggagctgaccaagacgaccctcaagaacgaccccgacctgaaatccttcatcggtgagatcaagagccagggggaccagcgcttcaacgagcagcggttctggctgtacgtgacccagcagggcaagtgcctctacaccggcaaggccctggacatccagaacctgagcatgtacgaggtggaccacatccttccgcagaacttcgtcaaggatgactccctggacaacctggccctcgtgatgcccgaggcaaaccagcgcaagaaccaggtggggcagaacaagatgcccctggagatcatcgaggcgaaccagcagtacgccatgcgcaccctttgggagcggctccacgagctgaagctgatcagctccggaaagctcgggcgcctcaagaagcccagcttcgatgaggtcgacaaggacaagttcatcgcccggcaactggtggagacgcgccagatcatcaagcacgtgcgggacctcctggacgaacgcttctccaagagcgacatccacctggtcaaggccggcatcgtgtccaaattccggcgctttagcgagattccgaagatccgggactacaacaacaagcaccacgcgatggacgccctcttcgccgcggcactgatccagtccatcctgggcaagtacgggaagaacttcctcgcgttcgacctgagcaagaaggaccgccagaagcagtggaggtccgtgaagggcagcaacaaagagttcttcctgttcaagaacttcgggaacctccgcctgcagtcccccgtcaccggcgaggaggttagcggggtggagtacatgaagcacgtctacttcgaactgccctggcagaccaccaagatgacgcagactggcgacggcatgttttacaaggagtccatcttcagtcccaaggtgaagcaggccaagtacgtgtccccgaagaccgagaagttcgtccacgacgaggtgaagaatcacagcatctgcctcgtggagttcaccttcatgaagaaggagaaggaggtccaggagacgaagttcatcgacctgaaggtgatcgagcaccaccagttcctgaaggagcccgagtcccagcttgccaagttcttagccgagaaggagaccaacagccccattatccacgcccggatcatccgcaccatcccgaagtaccaaaagatctggatcgagcacttcccctactacttcatcagcacccgggagctgcacaacgcgcgccagttcgagatcagctacgagctcatggagaaggtgaagcagctgagcgagcggtccagcgtcgaggagctgaagatcgtgttcgggctcctgatcgaccagatgaacgacaactacccaatctacacgaagtccagcatccaggaccgcgtgcagaagttcgtcgacacccagctgtacgacttcaagtcctttgagatcggcttcgaggagctcaagaaggccgtggccgccaacgcccagcggagcgacaccttcgggtcccgcatcagcaagaagcccaagcctgaggaggtcgcgatcggctacgagtctatcaccgggctgaagtaccggaagccccgctcggtcgtgggcacgaagcgctga

SEQ ID NO: 7588 - RNA, 4002 nt, synthetic construct
  misc_feature 1..4002: note = Cas9 variant
  source 1..4002: mol_type = other RNA
atgagccagaacatcgtggactactgcatcggcctggatctcgggaccggctccgtcgggtgggccgtggtggacatgaaccaccgcctgatgaagcggaacggcaagcacctgtgggggagccgcctcttctccaacgccgagaccgcggccaaccggcgcgccagccgatccatccgccggcgctacaacaagcggcgcgagcggatccggctgctgcgggccatcttgcaggacatggtactggagaatgaccccacgttcttcatccgcctggagcacaccagttttctcgatgaggaggacaaggccaactacctgggcgcggactacaaggacaactacaacctgttcatcgacgaggacttcaacgactacacctactaccacaagtacccgaccatctaccacctccggaaggccctgtgcgagtccacggagaaggctgacccccgcctgatctacctcgccctgcaccacatcgtgaagtaccggggcaacttcctgtatgaagggcagaagttcaacatggacgcgagcaacatcgaggaccgcctctcggacgttttcacccagttcgccgacttcaacaacatcccctacgaggacgacgagaagaaaaacctagagatcctggagatcctgaaaaagcccttaagcaagaaggccaaggtcgacgaggtgatggccctgatcgccccggagaaggacttcaagtccgcgtacaaagagctcgtgaccggcatagccgggaacaagatgaatgtcaccaagatgatcctgtgcgaacccatcaagcagggcgacagcgagatcaaactgaagttcagtgacagcaactacgacgaccagttctccgaggtagagaacgacctcggtgagtacgtggagttcatcgacagcctgcacaacatctactcctgggtcgagctgcagacgatcatgggcgccacccacacctacaacgccagcatctccgaggccatggtgagccggtacaacaagcaccacgaggatctccagctgttaaagaagtgcatcaaggacaacgtgcccaagaagtacttcgacatgttccgcaacgacagcgagaagctcaagggctactacaactacatcaaccacccctccaaggcgccggtcgatgagttctacaagtacgttaagaagtgcatcgagaaggtggacacccccgaagccaagcagatactgcacgacatcgagctggagaacttcctcctgaagcagaacagccggacgaacgggtccgtcccctaccagatgcagctggacgagatgatcaagatcatcgacaaccaggccaagtactaccccgtgctcaaggagaagcgcgagcagctgctgagcatcctcaccttcaagatcccgtactacttcggccccctgaacgagacctccgagcacgcctggatcaagcgcctggaggggaaggagaaccagcggatcctcccctggaactaccaggacatcgtggacgtcgatgccaccgcggaaggcttcatcaagcgcatgcggagctactgcacgtacttccccgacgaggaggtgctgccgaagaactccctgatcgtgagcaagtacgaggtctacaacgagttgaacaagatccgcgtggacgacaagctgttggaggtcgacatcaagaacgacatctacaacgagctattcatgaacaacaagaccgtgacggagaagaagctcaagaactggctggtgaacaaccagtgctgcaacaagaacgccgagataaagggcttccagaaggagaaccagttctccaccagcctgacgccctggatcgacttcaccaacatcttcggggaaatcaaccagtccaacttcgacttaatcgaggacatcatctacgacctgaccgtcttcgaggacaagaagatcatgaagcggagactgaagaagaagtacgccctacccgacgacaagatcaagcagatcctgaagctgaagtacaaggactggagccggctctccaagaagctgctggacggcatcgtggccgacaacaagttcgggagctccgtgaccgtcctcgacgtgctggagatgtcacgcctgaacctcatggagatcatcaacgaccgggacctgggctacgcccagatgatcgaggcggccgcctcctgccccgaggacgggaagttcacatacaaggaggtgcagcgcctggccggcagcccggcgctcaagcgcggcatctggcagtccctgcagatcgtcgaggagatcaccaaggtgatgaagtgccgccccaagtacatctacatcgagttcgagcggagcgaggagaccaaggaacgcaccgagagtaagatcaagaagctggagaacgtttacaaggacctcgacgagcagacgaaggtcgagtacaagaccgtgctggaggagctgaaggggttcgacaacacaaagaagatctccagcgactccctcttcctgtacttcacccagctgggcaagtgcatgtactcagggaaaaagctcgacatcgactccctggacaagtaccagatcgaccacatcgtgccccagagcctggtcaaggacgactccttcgacaaccgggtgctcgtggtccccagcgagaaccagcgcaagctggacgacctggtggtgccgtccgacatccgggtcaagatgaacagcttctggaagctcctgttcgaccacgagctgatctcccccaagaagttctactcgctcatcaagacggagtacaccgagcgcgacgaggagcggttcatcaaccgacagctggtggagacccgccaaatcaccaagaacgtgacgcagatcattgaagaccactactccaccaccaaggtcgccgccatccgggccaacctgagccacgagttccgcgtgaagaaccacatctacaagaaccgggacatcaacgactaccaccacgcccacgacgcgtatatcgtggccctcatcggcgggtttatgcgcgaccggtaccccaacatgcacgactccaaggccgtctacagcgagtacatgaagatgttccgcaagaacaagaacgacaagaagcggtggaaggacggcttcgtgatcaactccatgaactacccctacgaggtggacggcgagctgatctggaacccggacatcatcaacgagatccgcaagtgcttctactacaaggactgttactgcaccaccaagctggaccagaagtccgggcagatgttcaacctcacggtcctgcccaacgacgcccactcccccaagggcacaactgaggccgtgatcccggtgaacaagaaccggaaggacgtcaacaagtacgggggcttcagcgggctgcagtacgtgatcgtggcgatcgagggcaagaagaagcgcggtaagaagaccaagctcgtcaaaaagataagcggggtgcccctgcacctgaaggccgcctccctcgacgaaaagatcaagtacatcgaggagaaggagaacctgacggacgtgaagatcatcaaggacagcatacccgtcaaccagatgatcgagatggacggcggcgagtacctgctcacctcccccatcgagttcgtgaacgggcggcagctggtgctgaacgagaagcagtgcgccctcatcgccgacatctacaacgcgatctacaagcaagactgcgacaacctggacgacgtcctgatgatccagctctacatcgagctaatcaacaaaatgaaggccctgtacccggcctaccagagcatcgccgagaagttcgagtccatgaccgaggactacgtggcggtgagcaaggaggagaaggccgacatcatcaagcagatgctcatcatcatgcaccgcggcccccggaacgggaagatccagtacgccgacttcaacgtcggcgaccgcatcggtcggaagaacaagatgtccctggacctggagcgcgtgaccttcgtgagccagtcccccacgggcatctacaccaagaagtacaagctctga

SEQ ID NO: 7589 - RNA, 4002 nt, synthetic construct; identical to SEQ ID NO: 1789
  misc_feature 1..4002: note = Cas9 variant
  source 1..4002: mol_type = other RNA

SEQ ID NO: 7590 - RNA, 4002 nt, synthetic construct
  misc_feature 1..4002: note = Cas9 variant
  source 1..4002: mol_type = other RNA
atgagccagaacatcgtggactactgcatcggcctggacttagggaccggctcagtggggtgggccgtggtggatatgaaccaccgcctgatgaaacggaacggcaagcacctgtggggaagccgcctcttctccaacgccgaaaccgcggccacgcggcgcagctcccgcagcatccgacggcgctacaacaagcggcgagagcggatccgcctgttgcgggccatcctccaggacatggtcctggagaaggaccccaccttcttcattcgcttagagcacacctccttccttgacgaggaggacaaggccaagtacctgggcaccgactacaaggacaactacaacctgttcatcgacgaggacttcaacgactacacgtactatcacaagtacccgaccatctaccacctccggaaggccctgtgcgagagcaccgagaaggcggacccacgcctgatttacctcgccctccaccacatcgtgaagtaccggggcaacttcctgtacgaggggcagaagttcaacatggatgcctccaacatcgaggacaagctcagtgacgtgttcacccagtttgccgatttcaacaacatcccctatgaggatgacgaaaagaagaacctggagatcctggagatcctcaagaagcccctgtccaagaaggcgaaggtcgacgaggtaatggccttaatcagcccggagaaggagttcaagtccgcctacaaggagctcgtgacgggcatcgccgggaacaagatgaacgtcaccaagatgatcctgtgcgagagcatcaagcagggagactccgagatcaagctgaagtttagcgactccaactacgacgaccagttcagcgaagtggagaacgacttgggggagtacgtggagttcatcgactccctgcacaacatatactcctgggtcgagctccaaacaatcatgggcgccacccacacggacaacgcgagcatctccgaggccatggtgagccgctacaataagcatcatgaggacctccaactgctgaagaagtgcatcaaggacaacgtgcccaagaagtacttcgacatgttccggaacgattccgagaaggtaaagggctactacaactacatcaacagacccaataaggcccccgtcgatgagttctacaagttcgtgaagaagtgcatcgaaaaggtcgacaccccggaagccaagcagatcctccacgacattgagctggagaatttcctgctcaagcagaacagccggaccaacgggtccgtgccctaccagatgcagctggacgagatgatcaagatcatcgacaaccaggctaagtactaccccgtgctgaaggagaagcgcgagcagctcctgagcatcctgaccttccgcatcccctactacttcggcccgctcaacgaaacgtccgaacacgcatggatcaagcggctggaggggaaggagaaccagcgcatcctgccctggaactaccaggacaccgtcgacgttgacgccacggccgagggcttcatcaaacggatgcgcagctactgcacctactttcccgacgaggaagtcctccccaagaactccctgatcgtctctaagtacgaggtgtacaacgaactgaacaagatccgggtcgacgacaagctcctggaggtggacgtgaagaatgacatctacaacgagctattcatgaagaacaagacagtcaccgagaagaagctgaagaattggcttgtgaacaaccaatgctgccgcaaggacgccgagatcaaaggcttccagaaagagaaccagttctccaccagcctgaccccatggatcgacttcacgaacatcttcgggaagatcgaccagtcgaacttcgacctgatcgagaagatcatctacgacctcaccgtgttcgaggacaagaagataatgaagcggcgcctgaagaagaagtacgccctgccagacgacaagatcaagcagatcctcaagctgaagtacaaggactggagccggctgtccaaaaagctcctggacggcatcgtcgcggacaaccgcttcggcagctccgtgaccgtgctggacgttctcgagatgagccggctgaacctaatggaaatcatcaacgacaaggagctcggctatgcccagatgatcgaggaggcctccagctgccctaaggacgggaagttcacctatgaggaggtggccaagctggcgggcagccctgcgctgaagcgcggcatctggcagtccctccagatcgtggaggagatcacgaaggtcatgaagtgccggccgaagtacatctacatcgagttcgagcgcagcgaggaggcgaaggagcggaccgagtccaagatcaaaaagctggagaacgtatataaggacctggacgaacagaccaagaaggagtacaaaagcgtgctcgaggagctgaaggggttcgacaacaccaagaagatctccagcgactcccttttcctctacttcacgcagctgggcaagtgcatgtacagcgggaagaagctggacatcgactccttggacaagtaccagatcgaccacatcgtcccccaaagcctggtaaaggacgactccttcgacaaccgcgtgctggtcctcccctcagagaaccagcgcaaactagacgacctggtggtgcccttcgacatccgcgacaaaatgtaccggttttggaagctcctgtttgaccacgagctgatctccccgaagaagttctacagcctcattaagaccgagtataccgagcgcgacgaggagagattcatcaaccgtcagctggtcgaaacacgccagatcacgaagaacgtgacccagatcatcgaggaccactactccaccaccaaggtggccgccatccgggcaaacctgagccacgagttccgcgtcaagaaccacatctacaagaaccgtgacatcaacgactaccaccacgcccacgacgcctatatcgtggccctcatcggcgggttcatgcgcgaccggtaccccaatatgcacgactccaaggccgtgtacagcgagtacatgaagatgttccgcaagaacaagaacgaccagaagaagtggaaggatggcttcgtcatcaacagcatgaactatccctacgaggtggacggcaagctgatatggaatcccgacctgatcaacgaaatcaagaagtgcttctactacaaggactgctactgcaccacgaagctcgaccagaagtccgggcagatgttcaacttgaccgtgctgccgaacgacgcgcacagcgccaagggcaccaccgaagccgtcatccctgtgaacaagaaccggaaggacgtcaacaagtacgggggattttccggactccagtatgtcatcgccgcgatcgagggcacgaagaagaagggcaagaagctggtgaaggtgcgcaagctgagcgggatccccctctacctgaagcaggcggacataaaggaacagatcgagtacgtagagaaggaggagaagttgtccgacgtgaagatcatcaaaaacaacatcccgctcaaccagctgattgagatcgacggccggcagtaccttctcacctccccgaccgagtgcgtaaacgccatgcagctggtcctgaacgaggaacaatgcaaactcatagccgacatctacaacgccatatacaagcaggactttgacgggctggataacatgctgatgatccagctctacctgcaactgatcgacaagctcaagaccctgtaccccatctacatgggcattgtggagaagttcgagaagctgactgaggacttcgtgtccatcagcaaggaggaaaaggccaacgtcatcaaacagatgctcatcatcatgcacaagggcccccagaacgggaacatcatctacgacgacttcaacgtgggcaagcgcatcggccggctgaacggccgcaccttctacctggacaacatcgagttcatctcccagagcccgaccgggatctacaccaagaagtacaagctctga

SEQ ID NO: 7591 - RNA, 4002 nt, synthetic construct
  misc_feature 1..4002: note = Cas9 variant
  source 1..4002: mol_type = other RNA
atgtacacgtactacttcaaagagagtgagatggtctacgacgttggactggacatcggcaccggctccgtggggtgggtggcacttgacgaaaatggcaagctagcacgcgcaaaggggaagaacctggtgggcgtgcggctgttcgacacggcccagaccgccgccgaccgccggggcttccgaaccacccggcgccgactgagtcgccgaaagtggcgcctgcgactcctggacgaattattttccgctgagatcaatgaaatcgacagctccttctttcaacgcctcaagtacagctacgtgcaccccaaggacgaggagaacaaggcgcactactacgggggctacctattcccgacggaggaggagaccaagaagttccacaggtcctaccccaccatctaccacctccgccaggagttgatggcgcagcccaacaaaagattcgacatccgcgagatctacctagccatccaccacttggtcaagtacagagggcatttcctctcatcccaagaaaagatcacgatcggcagcacgtacaaccccgaggacctggccaatgcgatcgaggtgtacgccgacgagaagggcctatcctgggagctcaacaacccggagcagctgaccgagatcatcagcggtgaggccggctacgggctgaacaagtccatgaaagccgacgaggccctcaaactcttcgagttcgacaacaaccaggacaaggtggccatcaagaccctcctcgccggcctcaccgggaaccaaatcgatttcgccaagctgttcggcaaggacatcagcgacaaggacgaggcgaagctctggaagctgaagctggatgacgaggccctcgaggaaaagagccagacgatcctgagccagctgaccgacgaggagatcgaactgttccacgcggtcgtgcaggcctacgacggtttcgtgttgatcgggctgctaaacggcgctgactccgttagcgccgccatggtccagctgtacgaccagcaccgggaggacagaaagctgctcaagtccctggcccaaaaggctgggctgaagcataagcgcttcagcgagatctacgagcagcttgccctggccaccgatgaggccaccatcaagaacggcatcagcacagcgcgggaactggtggaggagtccaacctcagcaaggaggtcaaggaggacaccttacggagactggacgaaaacgagttcctcccgaagcaacggaccaaggcaaactcagtgatcccccaccagcttcatttagccgagctgcagaagatactccagaaccagggtcagtactaccccttcctgctggacaccttcgaaaaggaggacggccaggacaacaagatcgaggagctcttgcgcttccggattccgtactacgtgggtcccctggtcacgaagaaagatgtggaacacgccgggggcgacgctgacaaccactgggtggagcgcaatgaggggttcgaaaaatcccgggtcaccccctggaacttcgacaaggtgttcaaccgagacaaggccgcccgggacttcattgaacgactcaccgggaacgacacctacctgatcggggagaagacgctgccccaaaacagcctcagataccagctgtttaccgtgctgaacgagcttaacaacgtccgcgtgaatggcaagaagttcgacagcaaaacaaaggccgacctgatcaacgatctgttcaaggctcggaagaccgtctccctcagtgcgctgaaggactacttgaaggcccagggcaagggtgacgtcacgataaccgggctcgccgatgagtcgaagttcaacagctccctttccagctacaacgacctgaagaagacctttgacgccgagtacctcgagaacgaggacaaccaggagacgctggaaaagatcatcgagatccaaacggtgttcgaagactcgaagatcgcctcccgcgagctgagcaagttaccgcttgacgacgaccaggttaaaaagctctcccaaacccattataccgggtggggccggctctcagagaagctgctggactccaagattatcgacgagcgcgggcagaaagtaagtatattggataagttaaaaagcacgtcccagaacttcatgagcatcatcaacaacgataagtacggcgtgcaggcgtggatcactgaacagaataccggctccagcaagctgaccttcgacgagaaggtcaacgagctcaccacatccccagcaaacaaacggggaattaagcagagcttcgccgtactgaacgacatcaagaaggccatgaaggaggagccccgccgggtgtacctggagttcgcgcgcgaggaccagacatccgtcaggagcgtgccccgctataaccaactcaaggagaagtatcagtccaagagcctgtccgaggaagcgaaagtgctgaagaagactctcgacggcaataagaacaagatgagcgacgaccgctacttcctgtacttccagcaacaggggaaggacatgtacacgggacggccgatcaacttcgagcgcttgtcccaggactacgacatcgaccacatcatcccccaggccttcaccaaagacgatagcctcgacaatagagttctggtgtcccgccccgagaacgcccgaaagtcagactccttcgcttacaccgacgaggtgcagaagcaggacgggtccctatggaccagccttctgaagtccgggttcatcaaccgcaagaagtacgagcggctgaccaaggctggcaagtacctcgacgggcagaagaccggcttcatcgcccgacagctggtcgaaacgcggcagatcataaagaacgtagccagcctgatcgagggcgaatacgaaaactccaaggccgtggccatacgtagcgaaatcaccgcggacatgcggctcctggtgggcatcaagaaacaccgcgagatcaactccttccaccacgcgttcgacgccctgctcatcaccgccgccggccagtatatgcaaaaccggtaccccgacagagactctaccaatgtgtataacgagtttgaccggtacacgaatgactaccttaagaacctgaggcaactctccagccgagatgaggtgcgccgacttaagtccttcgggttcgtcgtgggcacaatgcgcaagggaaatgaggactggagcgaggagaacacctcgtaccttcggaaggtaatgatgttcaagaatatcctcaccacgaagaagaccgaaaaggatcggggaccgctgaataaggagaccatcttcagccccaagtcggggaagaagctaattcccctcaacagcaagcgctccgacaccgcgctgtacggcggctacagcaacgtctactccgcctacatgacactggtgcgcgccaacgggaagaacctccttatcaaaatccccatcagcatcgcaaaccaaatcgaggtgggaaacctgaagattaacgactatatcgtcaacaatccggctataaagaagttcgagaagatcctcatatctaaattacccctggggcagctcgtgaacgaagatggcaacctgatctacctggccagcaatgagtaccgccacaacgctaagcagctctggctgagcaccaccgacgccgacaaaatcgcatctattagcgaaaactccagcgacgaggagctgctcgaggcgtacgacatcctgacatctgagaacgttaagaaccggttcccctttttcaagaaggacatcgacaaactttcgcaggtccgcgacgagttcctagattccgacaaacggatcgccgtgatccagacgatcctgcgtgggctgcaaattgacgccgcctaccaggcgcccgttaagatcataagcaagaaggtctccgactggcacaagctccaacagagcggcggcatcaagctctccgacaacagcgagatgatctaccagtcggcgacagggatcttcgagaccagagtgaagatctctgacctgctctga

SEQ ID NO: 7592 - RNA, 4005 nt, synthetic construct
  misc_feature 1..4005: note = Cas9 variant
  source 1..4005: mol_type = other RNA
atgaaaaacccctacaccatcggcctggacatcgggaccaacagcgtgggctgggccgtcctcacgaaccagtacgacctggtgaagcgcaagatgaaggtggcagggaactccgacaagaagcagatcaagaagaacttctggggcgtccggctgttcgacgacgggcagacagcggtggaccgccggatgaaccgcacagcccggcgccggatcgaacgccggcgcaaccggataagctacctccaggagatcttcgccgtggagatggccaacatcgacgccaacttcttctgcagactgaacgactccttctacgtagacagcgagaagcggaactcccgccacccgttcttcgcgaccatcgaggaggaggtggcctaccacaagaactaccggacgatataccacctccgcgaggagctcgtgaacagctctgagaaggccgacctgcggctggtctacctcgccctggcgcacatcattaagtaccgcgggaacttcctgatcgagggcgccctcgacaccaagaacaccagcgtggacggggtgtacgagcagttcatccagacctacaaccaggtcttcatgtccaacatcgaggagggcacgctggccaaagtggaggagaacatcgaggtggcgaacatcctggccgggaagttcacccggcgcgagaagttcgagcggatactccagctgtaccccggcgagaagtcaaccgggatgttcgcgcagttcatcagcctgatcgtcggcagcaagggcaatttccagaaggtattcgacctcatcgagaagaccgacatcgagtgcgccaaggacagctacgaggaggacctggaggcgctgctcgccatcatcggggacgagtacgccgagctgttcgtggcggccaagaacacgtacaacgccgtcgtgctcagctccatcatcaccgtgaccgccaccgagacgaacgccaagctcagcgcgtccatgatcgagcgcttcgacgcccacgagaaggacctgggcgagctgaaggccttcatcaagctccacctccccaagcagtaccaagagatcttcaacaacgccgctatcgacgggtacgcgggctacatcgacggcaaaaccaagcaggtcgatttctacaagtacctgaagaccatcctcgagaacattgagggtgcggactacttcatcgccaagatcgaggaggagaacttcctgcgcaagcagcggaccttcgacaacggcgccatcccccaccagcttcacctcgaggagctggaggcgatcatccaccagcaggccaagtactacccgttcctgcgcgaggactacgagaagatcaagagcctcgtcacgttccggatcccctacttcgtggggcccctggccaaaggccagtccgagttcgcctggctgacccgcaaggccgacggggagatcaggccctggaacatcgaggagaaggtcgacttcggcaagagcgcggtggacttcatcgaaaagatgacgaacaaggacacctacctcccgaaggagaacgtcctacccaagcacagcctttgctaccaaaagtacatggtgtacaacgagctcacgaaggtgcgctacatcgacgaccagggcaagaccaactacttctccgggcaggaaaagcaacagatcttcaacgacctgttcaagcagaagcggaaggtcaagaagaaggacctggagctgttcctgcgcaacatcaaccacatcgagagccccaccatcgagggcctggaggactccttcaacgccagctacgccacctaccacgacctcctgaaggtggggatgaagcaggagatcctggacaaccccctgaacacggagatgcttgaggacatcgtgaagatcctgaccgtcttcgaggacaagccgatgatcaaggagcagctgcagcagttctccgacgtgctcgacggcggggtgctgaagaagctggagcggcgccactacaccggctggggccggctcagcgccaagctgctggtcgggatccgcgagaagcagtcccacctcaccatcctggactacctgatgaacgacgacggcctcaaccggaacctgatgcagctgattaacgacagcaacctctccttcaagagcatcatcgagaaggagcaggtctccacgaccgacaaggacctgcagagcatcgtggccgacctggcggggtcccccgccatcaagaagggcatcttgcagagcctgaagatcgtcgatgagctcgtgtccatcatggggtacccgccccagaccatcgtggtcgagatggcccgcgagaaccagaccacaggcaagggcaagaacaacagcaagccccggtacaagtccctcgagaaggccatcaaggagttcgggagcaagatcctgaaggaacacccgaccgacaaccaggaactgaagaacaaccgcctctacctgtactacctgcagaacggcaaggacatgtacaccgggcaagagctcgacatccacaacctgtccaactacgacatcgaccacatcgtgccccagagcttcatcaccgacaacagcatcgacaacctggtgctcacctccagcgccggcaaccgggagaagggaggggacgtgcccccgcttgagatagtgcgcaagcggaaggtgttctgggagaagctgtaccagggcaacctcatgtccaagcgcaagttcgactacctgacgaaggcggagcgcgggggcctgaccgacgccgacaaggccaggttcatccaccgccagctcgtcgagacccggcagatcacgaagaacgtggcaaacatcctgcaccagcgcttcaacaacgagacggacaaccacgggaacaccatggagcaggtccggatcgtgaccctaaagagcgcgctggtgtcacagttccgcaagcagttccaactgtacaaggtgcgggaggtcaacgactatcaccacgcccacgacgcctacctgaatggcgtggtggccaacaccctcctaaaggtctacccccagctggagcccgagttcgtgtacggcgagtaccaccagttcgactggtttaaggccaacaaggcgactgccaagaagcagttctacaccaacatcatgctgttcttcgggcagaaggagcgcatcatcgacgaaaacggcgagatcctgtgggacaagaagtacctggagaccatcaagaaggtgctcgattaccggcagatgaacatcgtcaagaagaccgaaatccagaagggggagttttcgaaggccacgatcaagcccaagggcaactccagcaaactgatcccgcgcaaggagaactgggaccccatgaagtacgggggcctggactcccccaacatggcctacgctgtgatcatcgagcacgcgaagggcaagaagaagctcatcttcgagaagaagatcatccggatcaccatcatggagcgcaagatgttcgagaaagatgaggaggccttcttagaggaaaaggggtaccggcaccccaaggtgctgaccaagctcccgaaatacaccctgtacgaatgcgagaagggccgccggagaatgctggccagcgccaacgaagcccagaaggggaaccagctcgtcctgtccaaccacctggtgagtctcctgtaccacgcgaagaactgcgaggcctccgacggcaagagcctgaagtacatcgaggcccaccgggagacgttcagtgaactcctggcccaggtgagcgagttcgcgacccgctacaccctggccgacgccaacctctccaagatcaacaacctgttcgagcagaacaaggagggagacatccaggccatcgcccagagcttcgtcgacctgatggcgttcaacgccatgggcgcccccgccagcttcaagtttttcgaggccacgatcgaccggaagcgctacacgaacctcaaggagctgctgtccagcaccatcatctaccagtccatcaccggcctctacgagagccggaagcgcctggacgactga

SEQ ID NO: 7593 - RNA, 4005 nt, synthetic construct; identical to SEQ ID NO: 1793
  misc_feature 1..4005: note = Cas9 variant
  source 1..4005: mol_type = other RNA

SEQ ID NO: 7594 - RNA, 4005 nt, synthetic construct; identical to SEQ ID NO: 1794
  misc_feature 1..4005: note = Cas9 variant
  source 1..4005: mol_type = other RNA

SEQ ID NO: 7595 - RNA, 4005 nt, synthetic construct; identical to SEQ ID NO: 1795
  misc_feature 1..4005: note = Cas9 variant
  source 1..4005: mol_type = other RNA

SEQ ID NO: 7596 - RNA, 4005 nt, synthetic construct
  misc_feature 1..4005: note = Cas9 variant
  source 1..4005: mol_type = other RNA
atgaagaacccatacaccatcggcctggacatagggaccaacagcgtgggatgggccgtcttgacggaccagtatgacctggttaagcgcaagatgaaggtggccgggaactccgacaagaagcagatcaaaaagaacttctggggagtccggctgttcgacgagggggagaccgcagccgacagacggatgaaccgcaccgcgcggaggcggatcgaacgccggcgcaaccggatcagctacctccaggagatcttcgccctggagatggctaacatcgacgcgaatttcttctgccgcctgaacgactccttctacgtagacagcgagaagcggaactcccgccacccgttcttcgcgaccatcgaggaggaggtggcctaccataagaactaccgcacgatctaccacctccgcgaggagctggtcaacagctcagagaaggccgacctgcggctcgtgtacctggcgctcgcccacatcatcaagtaccgcggcaacttcctaatcgagggcgccctggacaccaagaacaccagcgtggacggggtctacaaacagttcatccagacctacaaccaggtgttcatttccaacatcgaggagggcacgctggccaaaatggaggagaacaccaccgtggccgacatacttgcggggaagttcaccagaaaggagaagctggagcgcatcctgcagctctaccccggcgagaagtccacggggatgttcgcccagttcatcagcctgatcgtcggcagcaagggcaacttccagaaggtgttcgatctggtggagaagaccgacatcgagtgcgccaaggactcctatgaggaggacctcgaggccctgctggccatcatcggggacgaatacgcggagctgttcgtcgccgccaagaacacctataacgccgtggtgctcagctccatcatcacagtaacggacaccgagaccaacgccaaactgagcgcgtccatgatcgagcggttcgacgcccacgagaaggacttaagggagctgaaggccttcataaagctgcatcttcccaagcagtacgaggagatcttcagcaacgtggccatcgacggctacgctgggtacatcgacggcaagaccaagcaggtcgacttctacaagtacctgaagacgctgctcgagaacatcgagggcgcggattacttcatcgccaagatcgaggaggagaacttcctgcgcaagcagcggaccttcgacaacggggccatcccccaccagctgcacctcgaggagctggaggccatcctgcaccaacaggcgaaatactacccgttcttcaaggaggcctatgataagatcaagtccctcgtgacattccgcatcccctactttgtgggccccctggccaatgggcagagcgacttcgcctggctgacccggaaggccgacggcgagatccgcccctggaacatcgaggagaaggtggacttcggcaagagcgctgtcgacttcatcgagaagatgactaacaaggacacctacctcccgaaggagaatgtgctgcccaagcactccctgtactaccagaagtacatggtctacaacgaactaaccaaggtaagatacatcgacgaccaggggaagaccaactatttcagcggccaggagaagcagcagatcttcaacgactatttcaagaaaaagcgcaaggtgtccaagaaggacttagagcagttcctgcggaacatgtctcacatcgagtcccccacgatcgaggggctcgaggacagcttcaactccagctacgcaacctaccacgacctgctgaaggtcggtatcaagcaggaggtgctggaaaaccccctcaacaccgagatgctggaggacatcgtgaaaatcctgaccgtcttcgaggacaagcgcatgatcaaagagcagctccagcagttctccgacgttctggacggggccgtgctgaagaagctcgagcggcgccattacacgggctggggtcggctgagcgccaagctgctagtcggcatccgcgacaagcagtcccacctgaccatcctggattacctcatgaatgacgacggcctgaaccgaaacctgatgcagctcataaacgacagcaacctgtctttcaagagcatcatcgaaaaggagcaggtctccaccaccgacaaggatctgcagagcatcgtggccgacctcgcggggtccccggccatcaagaagggcatcctgcagagcctgaagatcgttgacgagctcgtgtccataatggggtacccgccacagacgatcgtggtcgagatggcccgcgagaaccagaccaccgtgaagggcaagaacaacagccggccccgttacaagagcctggagaaggccatcaaggagttcgggtcccagatcctgaaggagcatcccaccgacaaccaggagctccggaacaaccgcctgtacctgtactacctccagaacggcaaggacatgtacaccggccaagagctggacatccacaacctgtcaaactacgatatcgaccacatcgtgccccagtccttcatcacggacaacagcatcgacaacctggtcttgacctccagcgccgggaaccgggagaaaggcgacgacgtgccgcccctggagatagtgcgcaaacgcaaggtcttctgggagaagctgttccaggggaacctcatgtccaagcggaaattcgactacctaaccaaggcggagcgcggcggtctcacggaggccgacaaggcaactttcatccaccggcagctggtggagacccgccagatcaccaagaacgtggccaacatcctgcaccagcgtttcaacaatgagacagacaaccacgggaacaacatggagcaggtccgcatcgtgatgctcaagagcgccctggtgtcccagttccggaagcagtttcaactgtacaaggtccgcgaggtgaacgactaccaccacgcccacgacgcctacctcaacggcgtggtcgccaacacgctgctgaaggtgtacccccagctcgagcccgagttcgtatacggggagtaccaccagttcgactggttcaaggccaacaaggctaccgccaagaagcagttctacaccaacattatgctgttcttcgcccagaaggagcggatcatcgacgagaacggcgaaatcctgtgggacaagaaatacctcgagaccatcaagaaggtcctggactaccgccagatgaacatcgtgaagaagacggagatccagaagggggagttcagcaaggccaccatcaagcccaaaggcaactccagcaagctcatcccccggaaggagaactgggacccgatgaagtacggcgggctcgactcccctaacatggcatacgcggtgatcatcgagcacgccaagggcaagaagaaggtcgttttcgagaagaaaatcatccgcataaccatcatggagcggaaggcctttgagaaggatgagaagtcctttttagaaaagcaggggtaccgccaacccaaggtgctgacaaaactccccaagtacacgctgtacgagtgcgagaatggccggcgccggatgttagccagcgccaacgaggcgcagaaagggaaccagcaggtcctcaagggccaactgatcaccctgctccaccacgccaagaactgcgaggccagcgacggcaagtccctggactacatcgagagcaaccgcgaaatgttcggggagctgctcgcccacgtgagcgagttcgcgaagcggtacaccctggcagacgccaacctgtccaagatcaaccagttattcgagcagaacaaggataacgacatcaaggtgatcgcccagagcttcgtgaacctcatggccttcaacgcaatgggcgccccggcctcctttaagttcttcgaggccaccatcgaacgcaagcggtacacgaaccttaaagagctcctgagcgccaccatcatctaccagtccattaccgggctgtacgaagcgcgcaagcgcctcgacggctga

SEQ ID NO: 7597 - RNA, 4005 nt, synthetic construct; identical to SEQ ID NO: 1797
  misc_feature 1..4005: note = Cas9 variant
  source 1..4005: mol_type = other RNA

SEQ ID NO: 7598 - RNA, 4005 nt, synthetic construct
  misc_feature 1..4005: note = Cas9 variant
  source 1..4005: mol_type = other RNA
atgaagaacccctacaccatcggcctggacatcgggacaaacagcgtgggctgggctgtcctcacggaccagtacgacctggtgaagcgcaagatgaaggtggccgggaactccgacaaaaagcagatcaagaagaacttctggggcgtccggctgttcgacgagggggagaccgcggccgaccgccggatgaaccgcaccgctcggcgccggatcgagcgccggcgcaaccgaatcagctacctccaggagatcttcgctctagagatggccaatatcgacgcgaacttcttctgccgcctgaacgactccttctacgtggacagcgagaagcggaactcccgccacccgttcttcgccaccatcgaggaggaggtggcctaccacaagaactaccggacgatctaccacctccgcgaggagctggtcaacagctccgagaaggccgacctgcggctcgtgtacctggcgctggcccacattatcaagtaccgcggcaacttcctcatcgagggcgccctggacaccaagaacacctctgtggacggggtctacaagcagttcatccagacctacaaccaagtgttcatctccaatatcgaggagggcacgctggccaagatggaggagaacaccaccgtggccaacatcctcgcggggaagttcacccgtaaggagaagctggagcgcatcctgcaactctaccccggcgagaagtccacggggatgttcgcccagttcatcagcctgatcgtcgggagcaagggcaacttccagaaggtgttcgacctagtggagaagaccgacatcgagtgcgccaaagactcctacgaggaggacctcgaggccctgctggccatcatcggggacgagtacgcggagctgttcgtcgccgccaagaacacctacaacgccgtggtgctcagctccatcatcaccgtcacggacaccgagaccaacgccaagctgagcgcgagtatgatcgagcgattcgacgcccacgagaaggacctcagcgagctgaaggccttcatcaagctgcacctccccaagcagtacgaggagatcttctccaacgtggccatcgacggctacgccggctacatcgacggcaagaccaagcaggtcgacttctacaagtacctgaagacgctgctcgagaacatcgagggcgcggactacttcatcgccaaaatcgaggaggagaacttcctgcgcaagcagcgcaccttcgacaacggggccatcccccaccagctgcacctcgaggaactggaggctattctgcaccagcaggcgaagtactacccgttcctcaaggaggcctacgacaagatcaagagcctagtgaccttcaggataccctattttgtgggccccctggcaaacgggcagagcgacttcgcctggctcacccgcaaggccgacggcgagatccggccctggaacatcgaggagaaggttgacttcgggaagtccgcggtcgacttcatcgagaagatgacgaacaaggacacctacctgccgaaggagaacgtcctgcccaagcatagcctctactaccagaagtacatggtctacaacgagctgaccaaggtgcgctacatcgacgaccagggcaagaccaactacttcagtggacaggagaagcagcagatcttcaacgactacttcaagcagaagcggaaggtgagcaagaaggacctggagcagttcctgcgtaacatgtcccacatcgagagccccacgatcgaggggctggaggactccttcaacagctcctacgccacctaccacgacctgctgaaggtcggcatcaagcaggaggtgctcgagaaccccctgaacatggagatgctggaggacatcgtgaagatcctcaccgtcttcgaggacaagcggatgatcaaggagcagctgcagcagttcagcggggtgctggacggagccgtgctcaagaagttggagcgccggcactacaccgggtggggccgcctctccgccaagctcctggtcggcatccgggacaagcagagccacctgacgatcctcgactacctgatgaacgacgatgggctgaaccgcaacctcatgcagctgataaacgactccaacctgtccttcaagtccatcatcgagaaggagcaggtcagcaccaccgacaaggacctccagtccatcgtggccgacctggcgggcagcccggccattaagaaggggatcctgcagtccctcaagatcgtcgacgagctggtgagcatcatgggctacccgccccaaaccatcgtggtcgagatggcgcgggagaaccagacgaccgtgaaggggaagaacaacagccgcccccggtacaagtccctcgagaaagccatcaaggagtttggcagccagatcctcaaggagcaccccaccgacaaccaggaactgcgcaacaaccggctgtacctctactacctgcagaacggcaaggacatgtacaccgggcaggagctggacatacacaacctctccaactacgacatcgaccacatcgtgccacagagcttcatcaccgacaactccatcgacaacctggtcctgacgagctccgccggcaaccgcgagaagggggacgacgtgccgcccctcgagatcgtgagaaagcgcaaggtcttctgggagaagctgttccagggcaacctgatgagcaagcgcaagttcgactaccttaccaaggcggagcggggcgggctgaccgaggccgacaaggccaccttcatccaccgccagttggtggagacgcggcagatcaccaagaacgtggccaacatcctccaccagcgcttcaacaacgagaccgacaaccatggcaacaacatggagcaggtccggatcgtgatgctgaagtccgcgctggtgagccagttccgcaagcagttccagttatacaaggtccgggaggtgaacgactaccaccacgcgcacgacgcctacctgaacggggtggtcgccaacaccctgctcaaggtgtacccccaactggagcccgagttcgtgtacggcgagtaccaccagttcgactggttcaaggccaacaaggcgaccgccaagaagcagttctacactaacatcatgctgttcttcgcccagaaggagcgcatcatcgacgagaatggtgagatcctctgggacaagaagtacctggagaccatcaagaaggtcctggactaccggcagatgaacatcgtgaagaagaccgagatccagaagggcgagttctccaaggccacgatcaagcccaagggcaacagctccaaacttatcccccgcaaggagaactgggacccgatgaagtacgggggcctggacagccctaacatggcctacgcggtgatcatcgagcacgccaaggggaagaagaagatcgtcttcgagaagaagataatacggatcaccatcatggagcgcaaggccttcgaaaaggacgagaagtccttcctggagaagcagggctaccggcagcccaaggtgctcaccaagctgccgaagtacaccctgtacgagtgcgagaacgggcgccgtcgcatgctcgccagcgccaacgaagcgcagaagggcaaccagcaggtcctgaagggccagctgatcacgctcctgcaccacgccaagaactgcgaggcctccgacggcaagagcctggactacatcgagagcaaccgcgagatgttcggggagctcctggcccacgtgagtgagttcgcgaagcgctacaccctggccgacgccaacctctctaagatcaaccagctgtttgagcagaacaaggacaacgatatcaaggtgatcgcccagagctttgttaacctgatggcctttaacgcgatgggggccccggccagcttcaagttcttcgaggccaccatcgagcggaagcgctacaccaacctcaaggagctgctgcgggccacgatcatctaccagtccatcaccggcctctatgaggcgcgcaagcgcctggacgggtga

SEQ ID NO: 7599 - RNA, 4005 nt, synthetic construct
  misc_feature 1..4005: note = Cas9 variant
  source 1..4005: mol_type = other RNA
atgaagaacccctacaccatcggcctggacatcggcaccaactctgtgggctgggccgtcctcacggaccagtacgacctggtgaagcgcaagatgaaggtggccgggaactccgacaagaagcagatcaagaagaacttctggggcgtccggctgttcgacgagggggagaccgcggccgatcgccggatgaaccgcaccgcccggcgccggatcgagcgccggcgcaaccggatcagctacctccaggagatcttcgccctagagatggccaacatcgacgcgaacttcttctgtcgcctgaacgactccttctatgtggacagcgagaagcggaactcccgccacccgttcttcgccaccatcgaggaggaggtggcctaccacaagaattaccggacgatctaccacctccgcgaggagctggtcaacagctctgagaaggccgacctgcggctcgtgtacctggcgctggcccacatcatcaagtaccgcgggaacttcctcatcgagggcgcactggacaccaagaacaccagcgtggacggggtctacaagcagttcatccagacctataaccaggtgttcatctccaacatcgaggagggcacgctggccaagatggaggagaacaccaccgtggccgacatcctcgcggggaagttcacacggaaggagaagctggagcgcatcctgcagctttaccccggcgagaagtccacggggatgttcgcccagttcatcagcctgatcgtcggcagcaagggcaacttccagaaggtgttcgacctggtggagaagaccgacatcgagtgcgccaaggactcctacgaggaggacctcgaggcactgctggcaatcatcggggacgagtacgcggagctgttcgtcgccgccaagaacacctacaacgcagtggtgctcagctccatcatcaccgtcacggacacagagaccaacgccaagctgagcgcgtccatgatcgagcgcttcgacgcccacgagaaggacctcagcgagctgaaggccttcatcaagctgcacctccccaagcagtacgaggagatcttctccaacgtggccatcgacggctacgcagggtacatcgacggcaagaccaagcaggtcgacttctacaagtatctgaagacgctgctcgagaatatcgagggggcagactacttcatcgccaagatcgaggaagagaatttcctgcgcaagcagcgcaccttcgacaacggggccatcccccaccagctgcacctcgaggagctggaggccatcctgcaccagcaggcgaaatactacccgttcctcaaggaggcctacgacaagatcaaaagcctggtgaccttcaggatcccctacttcgtgggccccctggccaacgggcagagcgacttcgcctggctcaccaggaaggccgacggcgagatccggccctggaacatcgaagagaaggtggacttcgggaagtccgcggtcgacttcatcgagaagatgaccaacaaggacacctacctgccgaaggagaacgtgctgcccaagcacagcctctactaccagaagtacatggtctacaacgagctgaccaaggtgcgctacatcgacgaccagggaaagaccaactacttctccggccaagagaagcagcagatcttcaacgactacttcaagcagaagcggaaggtgagcaagaaggacctggagcagttcctccgcaacatgtcccacatcgagagccccacgatcgaggggctggaggactccttcaacagctcctacgccacgtaccacgacctgctgaaagtcggcatcaagcaggaggtgctcgagaaccccctgaacaccgagatgctggaagacattgtgaagatcctcaccgtcttcgaggacaagcggatgatcaaggagcagcttcagcagttcagcgatgtgctggacggggccgtgctcaagaagctcgagcgacggcactacacgggctgggggcgcctgtccgccaagctcctggtggggatccgggacaagcagagccacctgaccatcctcgactacttgatgaacgacgacggcctgaatcgcaacctcatgcagcttatcaacgactccaacctgagcttcaagagcatcatcgagaaggagcaagtctcaaccaccgacaaggacctccagtccatcgtggccgacctggcggggagcccggccatcaagaagggcatcctgcagagtctcaagatcgtggacgaactggtgagcatcatggggtacccgccccagacgatcgtggtcgagatggcccgggagaaccagaccaccgtgaagggcaagaacaacagccgccctcggtacaagtccctggagaaggccatcaaggagttcgggagccagatcctcaaggagcaccccaccgacaaccaggagctgcgcaacaaccggctgtacctctactacctgcagaatggcaaggacatgtacaccggccaggagctggacatccacaacctctccaactacgacatcgaccacatcgtgccgcagagcttcatcacggacaattccatcgacaacctggtcctgaccagctccgccgggaaccgcgagaagggcgacgacgtgccgcccctcgagatcgtgcggaagcgcaaggtcttctgggagaagctgttccaagggaacctgatgagcaagcgcaagttcgattaccttaccaaggcggagcggggcggcctgaccgaggccgacaaggccacgttcatacaccgccagctggtggagacccggcaaatcaccaagaacgtggccaacatcctccaccagcgcttcaacaacgagaccgacaaccacgggaacaacatggagcaggtccggatcgtgatgctgaagtccgcgctggtgagccagttccgcaagcagttccagctctacaaggtccgggaggtgaacgactatcaccacgctcacgacgcctacctgaacggcgtggttgccaacacgctgctcaaggtgtacccccagctggagcccgagttcgtgtacggggagtatcaccagttcgactggttcaaggccaacaaggcgaccgccaagaagcagttttacaccaacatcatgctgttcttcgcccagaaggagcgcataatcgacgagaacggcgagatcctctgggacaagaagtacctggagaccatcaagaaggtcctggactaccggcagatgaacatcgtgaagaagacggagatccagaagggggagttctccaaggccaccatcaagcccaagggcaacagcagtaagctcatcccccgcaaggagaactgggacccgatgaagtacggcgggctggacagccccaacatggcctacgcggtgatcatcgagcacgccaagggcaagaagaaggtcgtgttcgagaagaagatcatccggatcaccatcatggaacgcaaggccttcgagaaggacgagaagtccttcctagagaagcaggggtaccggcagcccaaggtgctcaccaagctgcccaagtacacgctgtacgagtgcgagaacgggcggcgccgcatgctcgccagcgccaacgaggcccaaaaggggaaccagcaggtcctgaagggccagctaatcaccctcctgcaccacgccaaaaactgcgaagcctccgacggcaagagcctggactacatcgagagcaaccgggagatgttcggtgagctcctggcccacgtgtccgagttcgctaagcgctacaccctggccgacgccaacctcagcaagatcaaccagctgttcgagcagaacaaggacaacgacatcaaggtgatcgcccagtccttcgtcaacctgatggccttcaacgcgatgggcgccccggccagcttcaagttcttcgaggccaccatcgagcggaagcgctacacgaacctcaaggagctgctgtccgccacaatcatctaccagagcatcaccgggctctacgaagcgcggaagcgcctggacggctga

SEQ ID NO: 7600 - RNA, 4005 nt, synthetic construct
  misc_feature 1..4005: note = Cas9 variant
  source 1..4005: mol_type = other RNA
atgaagaacccctacaccatcggcctggacatcgggaccaacagcgtgggctgggccgtcctcacgaaccagtacgacctcgtgaagcgcaagatgaaggtggccggcaactccgacaagaagcagatcaagaagaacttctggggcgtccggttattcgacgacgggcagaccgcggtggaccgccggatgaaccgcaccgcccggcgccggatcgagcgccggcgcaaccggatcagctacctccaggagatcttcgccgtggagatggccaacatcgacgccaacttcttctgcagactgaacgactccttctacgtcgacagcgagaagcggaactcccgccacccgttcttcgcgaccatcgaggaggaggtagcctaccacgacaactaccggacgatctaccacctccgcgaggagctggtaaacagctccgagaaggccgacctgcggctggtatatctcgccctggcccacatcatcaagtaccgcggcaactttctgatcgagggcgccctcgacacgaagaacacgagcgtggacgaggtatacaagcagttcatccagacctacaaccaggtcttcatgtccaacattgaggagggggccctggccaaggtggaggaaaacctggaggtggcaagcatcctcgcgggcaagttcacccggcgcgagaagttcgagcggatcctgcgcctgtaccccggggagaagtccaccggcatgttcgcccagtttatcagcctaatcgtcgggaacaagggcaacttccagaaggtgttcaacctggtggagaagaccgacatcgagtgcgccaaggactcctacgaggaggacctggaggccctcctggccatcatcggcgacgagtacgcggagctgttcgtcgccgccaagaacacctacaacgccgtggtgctcagctccatcatcacggtcaccgccaccgagaccaacgcgaagctgagcgcctccatgatcgagcgcttcgacgcccacgagaaggacttaggggagcttaaggccttcatcaagctgcacctccccaagcagtaccaggagatcttcaacaacgccgcgatcgacggatacgccgggtacatcgacggcaagacgaagcaggtcgacttctacaagtacctgaagaccaccctggagaacgtggagggcgccgactacttcatcaccaagatcgaggaggagaacttcctgcggaagcagcgcacgttcgacaacggggtgatcccacaccagctccacctggaggagctggaggccatcctccaccagcaggcgaagtactacccgttcctgcgggaggactacgagaagatcaagagcctggtgaccttcagaatcccctacttcgtcggccccctcgccaaggggcagtccgagttcgcctggctgacccggaaggccgacggcgagatccgcccctggaacatcgaggagaaggtggacttcggcaagtcagccgtggacttcatcgagaagatgaccaacaaggacacgtaccttcctaaggagaacgtcctacccaagcacagcctgtgctaccagaaatacatggtgtacaacgagctgaccaaggtgcggtacatcgacgaccaggggaagaccaactacttctccggccaggagaagcagcagatctttaacgacctcttcaagcagaagcgcaaggtcaagaagaaggacctggagctgttcctccggaacatcaaccacatcgagagccccactatcgaggggctggaggactccttcaacgcgagctacgccacgtaccacgatctgctgaaggtgggcatgaagcaggagtccctcgacagccccctgaatgccgagatgctggaggacatcgtgaagatcctcaccgtcttcgaggacaagcgcatgatcaaggagcagctgcagcagttctccgacgtgctggacggggtggtcctcaagaagctggagcggcgccactacaccggctgggggcggctgagcgccaagctcctggtgggcatccgggacaagcaatcccacctgaccatcctcgactatctcatgaacgacgacggcctgaaccggaacctcatgcagctgatcaacgatagcaacctgtccttcaagagcatcatcgagaaggagcaggtctccacgaccgacaaagacctccagagcatcgtggccgacctggcggggtccccggccatcaagaagggcattctgcagagcctcaagatcgtggacgagctggtgtccatcatggggtacccgccccagaccatcgtcgtggagatggcccgcgagaatcagaccacggtgaagggcaagaacaacagccggccccgctacaagtccctggagaaggcgatcaaggagttcgggagccagatcctcaaggagcaccccaccgacaaccaggagctgaaaaacaaccggctgtacctctactacctgcagaacggcaaagacatctacaccggccaggagctggacatccacaacctctctaactacgacatcgaccacatcgtcccccagtccttcatcaccgacaacagcatcgacaacctggtgctgacctccagcgccgggaaccgcgagaagggcggggacgtaccgcccctcgagatcgtccgcaagcggaaggtgttctgggagaagctgtaccaggggaacctgatgtccaagcgcaagttcgactacctcacgaaggcggagcggggcgggctgaccgacgccgacaaggccaggtttatccaccggcagctggtggaaacccgccagatcaccaagaacgtcacgaacatcctccaccagcggttcaacaacgagaccgataactacggcaataccatggagcaggtccgcatcgtgaccctcaagagcgccctggtgtcccagttccggaagcaattccagctgtacaaggtgcgcgaggtgaacgactaccaccacgcgcacgacgcctacctgaacggggtcgtggccaacacgttgctcaaggtgtacccccagttggagcccgagttcgtctacggcgaataccaccagttcgactggttcaaggccaacaaggccactgcgaagaagcagttctacaccaacatcatgctgttcttcgcacagaaggagcggataatcgatgagaacggggagatcctctgggacaagaagtacctggagaccatcaagaaggtgcttgactaccgacagatgaacatcgtgaagaagacggagatccagaagggcgagttcagcaaggccaccatcaagcccaagggaaactccagcaagctcatcccccggaaggagaactgggatccgatgaagtacggaggcctggactcccccaacatggcctacgccgtcatcatcgagcacgcgaaggggaagaagaagatcgtgatcgagaagaagctgatccagatcaacatcatggagcgcaagatgttcgagaaggatgaggaggccttcctcgaggagaagggctaccggcaccctaaggtgctgaccaagctgcccaagtacaccctctacgagtgcgaaaaagggcgccggcgcatgcttgccagcgccaacgaagcccagaagggcaaccaactggtcctctccaaccacctggtgagcctgctttaccacgcgaagaattgcgaggcctccgacggcaagagcctgaagtacatcgaggcccaccgtgaagccttctccgagctgctcgcccaggtgagcgagttcgcgacgcgctacaccctggccgacgccaacctgagcaagatcaataacctcttcgagcagaacaaggagggggacatcaaggccatcgcgcagtccttcgtcgacctgatggtgttcaacgcaatgggggccccggccagcttcaagttcttcgaggccaccatcgaccggaagcgctacaccaacctgaaggagctcttatccagcacgataatctaccagtctatcaccgggctgtacgagagccgcaagcggctcgacgactga

SEQ ID NO: 7601 - RNA, 4005 nt, synthetic construct
  misc_feature 1..4005: note = Cas9 variant
  source 1..4005: mol_type = other RNA
atgaagaaggagtacactatcggcctggatatcgggaccaacagcgtggggtgggccgtcctcacggaaaactacgacctggtgaagaagaagatgaaggtttacgggaacaccgagaccaagtacctgaaaaagaacctctggggcgtccggctgttcgacgagggggaaaccgccgcagaccggcgcctgaagcggacgacccgccggcgctactccaggaggcgcaaccgcatctgccgccttcaagaccttttcaccgaagagatgaaccaggtggacgccaacttcttccatagactgcaggagagcttcttagtacccgacgagaaggagttcgagcggcatgccatattcggcaagatggaggaggaggtttcctattaccgcgagttccctacgatctaccacctccgtaagcatctggccgacacgagcgagcaggctgacctccgcctggtgtaccttgcgctcgcccatatcgtgaagtaccggggccacttcctgatcgaaggagagctgaataccgaaaattcgagcgtctccgagaccttccgcactttcatccaggtgtacaaccagatcttccgggagaacgaggtgcccttggccgtccccgataacatcgaggagttattctccgagaaagtgtcgcgggcccggaaggtggaggcgatcctgtccgtttactccgaggagaagtccacgggcactctcgcccagttcctgaagctgatggtggggaaccaagggcggttcaagaagaccttcgacctcgaggaggacgggattatccagatacccaaggaagaatacgaggaggagctggagaccctcctggccatcatcggcgatgagtacgccgagatcttcagcgccaccaagagcgtgtacgatgcggtcgccctgtctggtatcctaagcgttactgacggggacaccaaggccaagctctccgctagcatggtggagcgctacgaggcccatcagaaggacctggtgcagttcaagcaattcatccgtaaggagctgccggagatgtacgcccccatcttcagggacaactccgtgagcggctacgccgggtacgtggagaacagcaaggtcgtgacccaggccgagttctacaagtacatcaagaaggccatcgaaaaggttcccggcgccgaatacttcctcgagaagattgagcaggagacgttcctggacaagcagcgaaccttcaataacggcgtgatcccccaccaaatccacctggaggagctcgaggcgatcatccagaaacaggctacctattatccgttcctggccgacaacaaagaggagatgaagcagctggtgacattccgcatcccctactacgtcgggccgctcgccgacggaaactcccccttcgcatggctggagcggatcagttccgagccgatccgacccgggaacctggcggaggtggtggacatcaagaagtcagccacgaagttcatcgagcggatgaccaacttcgacacctacctccccaccgagaaggtcctgcccaagcattccatgatatacgagaagtacatggtgtacaatgagctgacgaaggtgagctacgtcgacgagcgcggcatgaaccagcggttctccggggaggagaagaaacagatcgtggaggaactcttcaagcagagcaggaaggtgaccaaaaagctgctggagaagttcctctccaacgagttcggcctggtcgacgtggccatcaagggcatcgagacctctttcaacgcaggatacgggacgtaccacgactttctgaagatcgggatcacgcgtgagcagcttgacaaggaggagaactccgagaccctcgaggagatcgtgaaaattctgaccgtctttgaggaccgcaagatgatcagggagcagcttaagaagtacacatacctcttcgacgaggaggtgctgaaaaagctggagcgccggcactacacgggctgggggcgcttaagcgcgaaactgctaatcggcatcaaagagaagcgcacccacaagaccatcctcgactacctgatcgaggacgacggcgggaagcagccgatcaaccgcaacctgatgcagctcatcaacgactccgatctgagcttcaagtccgagatcgccgaggcgcagtccgacatgaatactgaagacctgcacgaggtcgtccagaacctcgccggctcccccgccatcaagaaagggattctgcagagtctgaagatcgtggacgagctcgtggatatcatgggctccttacccaaaaacatcgtcgtggaaatggcacgggaaaatcaaaccacaagccgcgggcgcacgaacagcaacccccggatgaaggccctggaggaggccatgcgcaacctccggtcgaacctgttgaaagagtacccgaccgacaaccaggccttgcagaacgaccgcctgtacctgtactacctccaaaacggcaaggacatgtacaccggcctggacttaagcctccataacctgtccagctacgatattgaccacatcgtgccccagtccttcacgaccgacaacagcctggacaaccgagttctcgtgtccagcaaagagaaccgcgggaaaaaggacgacgtgccctccaaggaggtcgttcagaagaacatcaccctgtgggaaaccctgaagaacagcaacctcatctcccagaagaagtatgacaacctgacgaaaggcctccgcggagggctcaccgaggacgaccgggcccatttcatcaagcggcagctggtggagacccgccagatcaccaagcatgtcgctcggatcctggaccagcgcttcaacagccaaaaggacgaggaggggaagacgatccgggccgtgcgcgtggtaaccctcaagtccagcctgacctcccagttccggaagcagttcgccatccacaaggtgcgcgagatcaacgactaccaccacgggcacgacgcctacctgaatggcgttgtcgccaacagcctactgcgggtttacccccagttgcagccggagttcgtctacggggactacccgaaattcaacgcttataaagccaataaggctaccgccaagaagcagctctatacgaacatcatgaagttcttcgcggaagacgccgtcatcatcgacgagaacggagagattctgtgggacaagaagaacatcgccaccgtgaagaaggtgatgtcctacccgcagatgaatatcgtcaaaaagcccgagatccagaccgggagctttagcaaggagaccatcaaaccgaagggcgactctgacaagttaatcagccgaaagacgaactggtccccaaagctctacggcgggttcgacagcccccaggtggcctactccgtgataatcacctacgagaagggcaagaaaaaggtaagggccaaggcgatcgttggaataaccatcatggagcagagcctgttcaagaaggacccggtatccctgctcgaggagaagggctacgcaaaccccgaggtcctgatccacctccccaagtacacgctgtacgagctggagaacgggcgccggcgtcttctagcttctgccaacgaggcccagaaaggcaaccagctggtgctgcccgcgtccttagtgacgctgctttaccacgccaagcaagtcgacgaggacagcggcaagtccgaggagtacgttcgcgagcaccgggcagagttcgctgagatcctcaactacgtccaggccttttctgagaccaagatcctggcgaacaagaaccttcagacgatcctcaagctgtatgaggagaacaaggaggccgacatcaaggagatcgccgagtcctttgtcaacctgatgaaatttagcgcctacggggccccgatggacttcaagttcttcggcaagaccatcccccgctcccggtacacgagcgtgggggagctcttatccgccacgatcatcaaccagagtatcaccggcctgtacgagacccgccgtaagctcgtcgactga

SEQ ID NO: 7602 - RNA, 4005 nt, synthetic construct
  misc_feature 1..4005: note = Cas9 variant
  source 1..4005: mol_type = other RNA
atgcgcaagccctacaccatcggcctggacatagggaccaacagcgtgggatgggccgtgctcacggaccaatacaacctggtcaagcggaagatgaaggtggccgggtctgccgagaagaagcagatcaagaagaacttctggggcgtccgcctgttcgatgagggtgaggtggccgccggccggaggatgaaccgtacgacccgcagacgcatcgaacggcgccggaaccggatcgcctacctccaggagatcttcgccgcagagatggccgaggtggacgccaacttcttttatcggctggaggacagcttctacatcgagtccgagaagcgccactcacggcacccattcttcgcgaccatcgaagaggaggtagcgtaccatgaggaatacaagacgatctaccacctccgcgagaaactggtgaactccagcgacaaggccgacctgcggctcgtgtacctcgccctggcccatatcatcaagtaccgcggcaacttcctcatcgaggggatgctcgacaccaagaacacctcagtcgacgaggtcttcaagcaattcatccagacctataatcagatcttcgcaagcgacatcgaggagggctccctgacgcggctggaggagaacaaggaagtggcggaaatcctcagcgagaaacttacgcgccgggagaagctggacaagatcctcaaactgtacaccggggagaaaagcaccggcatgtttgctcgcttcatcaacttgatcatcggttcgaagggcgacttcaagaaggtcttcgacctcgatgagaaggccgagatcgaatgcgccaaggacacgtacgaggaggacctcgaggccctgctcgcgaagatcggcgacgaatacgccgagatcttcgtggccgccaagtctacctacaatgccgtggtcctgagcaacatcattaccgtgactgacaccgagaccaaggcgaagctgtccgcctccatgatcgaacgcttcgacaaacacgccaaagacctcaagcggctgaaggccttcttcaagatgcagctaccagagaagtttaatgaggtgttcaacgacatcgagaaggacggctacgccggctacatcgacggaaagaccacccaggagaagttctacaagtacatgaagaaaatgctcgcgaacattgacggcgccgactacttcatcgaccagatcgaggaggagaacttcctgcgtaagcaaagaacgttcgacaacggcaccatcccccaccaactgcacctagaggagctggaggcaatcctgcaccagcaggccaagtactacccgttcctacgcaaggactatgagaagatccggtccctggtcaccttccgcatcccgtactttatcgggcccctggctaacggccagagcgacttcgcctggctcacccggaaggccgacggggaaatccgcccctggaacatcgaggagaaggtggacttcggcaagtcggccattgacttcatcgagaagatgacgaacaaggacacctacctgcccaaggagaatgttctgccgaagcacagcctttgctaccagaagtacatggtctacaacgagctgaccaagatccggtacatcgacgaccaggggaagacacaccacttcagcggccaggagaaacagcagatattcaacggtcttttcaagcagcagcgcaaggtgaagaagaaggacctcgagcggttcctgtacacgatcaaccacatcgagtcccccaccatcgagggagtggaggacgccttcaacagctccttcgcgacttaccacgacctgcagaagggcggggtcacgcaggagatactcgacaaccccctgaacgccgatatgctggaggagatcgtgaagatcctgacggtcttcgaggacaagcgcatgatcaaggaacagctccagagcttctccgacgtgctggacggcacgatattgaagaaactggagcggcgccactacaccgggtggggccggttgagcgccaagctactcaccggcatccgcgacaagcattcgcacctgaccatcctggattacctgatgaacgacgacgggctgaaccggaacctgatgcaactcatcaacgacagcaacctgtccttcaagagcatcatcgagaaagagcaggtctccacagccgacaagggcatccaaagcattgtggccgaactagcggggtcgccggccatcaagaagggcatcctccagtcactgaagatcgtggacgagctggtagggatcatgggatatcccccgcagacgatcgtcgtggaaatggcccgcgaaaaccaaacgaccggcaaggggaagaacaactccaaaccccggttcatcagcctcgagaaagccatcaaggagttcgggagccagatcttgaaagaacaccccactgacaaccagtgcctgaagaacgatcgcctatacctgtactacctgcagaacgggaaggacatgtacaccggcaaggaactcgacatccacaatctgagcaactacgacatagaccacattatcccgcagtccttcatcaccgacaacagcatcgataaccgcgtgctggtgagctccaccgcgaatcgggagaagggcgacaacgttcccctcctggaggtggtccgcaagcgaaaggcgttctgggagaagctgtaccaggccaagctcatgagtaagcgcaagttcgactacctgacaaaggccgagcgcgggggcctgaccgaggctgacaaagcgaacttcatccagcggcagctcgtggagacccggcagataacgaagaatgtagccaacatcctgtaccagcgcttcaactgcaagcaggacgagaacgggaacgaggtcgagcaggttcggatcgtgacactgaaatccaccctcgtgagccagttccgtaaacagttccagctgtacaaggtgcgggaggtgaacgactaccaccacgcccacgatgcctacctgaacggcgtcgtggccaacaccctcctgaaggtgtacccccagctcgagcccgagttcgtttacggggactaccatcagtttgactggttcaaagcaaacaaggctaccgcgaagaaacagttctatacgaacatcatgcgcttcttcgccaaggagaaccagatcatcgacaagaacggcgagatcctctgggacaaccggtacctggacacgatcaagaaagtgctgtcctaccgccagatgaacatcgtgaagaaaaccgaaatccagaagggcgagttcagcaacgccaccgtcaacccgaaggggaactccagcaagctcatctcacggaaagctgattggaaccccatcaagtacggcgggttcgacggctccaacatggcctacagtatcgtgatcgagtacgagaagagaaagaagaagacggtgatcaagaaggagctgatccagatcaacatcatggagcgggtcgcttttgagaaggaccaaaaagccttcctggaggagaaggggtattacagccccaaggtgctgaccaagatccctaagtacaccctgtacgagtgcgaaaacggccgccggagaatgctgggctccgccaacgaggcgcagaaggggaatcagatggtgctcccgaaccacctgatgaccctcctctaccacgccaagaactgcgaggccaacgacggcgagagcctggcttacatcgagatgcaccgggagatgttcgcggagctgttggcctacatctccgagtttgccaagcgctacaccctggccaacgaccgcctggagaagatcaacatgtttttcgagcaaaacaagaagggggacatcaaagtcatcgccaagagcttcgacaagctcaaggtgttcaacgcgttcggcgcgccccgggacttcgagttcttcgagaccaccatcaagcgcaagcggtactacaacatcaaagagctcctgaacgccaccatcatctaccagagcatcaccgggctctatgaagcccgcaagcgtctggaggactga

SEQ ID NO: 7603 - RNA, 4008 nt, synthetic construct; identical to SEQ ID NO: 1803
  misc_feature 1..4008: note = Cas9 variant
  source 1..4008: mol_type = other RNA

SEQ ID NO: 7604 - RNA, 4011 nt, synthetic construct
  misc_feature 1..4011: note = Cas9 variant
  source 1..4011: mol_type = other RNA
atggacgacaactaccagctgatgcacgccaagggcaagtacgggtacggcacccgcatctatagcgaggggcagaccgccgcggaccggcgcggcttccggacgacccgccggcgcctcaaccggcgcaagtggcggctgcgcctgttgcaggacttcttcgagccctacatcctgccgcaggacgaggccttcttcatccggcagaagcagtccaacctggtgccccaggacaccaagaagcagtaccccgagagcgtcctcttcgacgacacctccgataaagacttctacacggagtaccccaccatctaccaccttcgccaggccctgatgaccgagaaccggcagttcgacatccgcgaggtatacctagccatccaccacatcgtgaagtaccgggggcacttcctgaacaacgccccggtcaagaccttcaagagcggcaacctggacctcgcgatcaagttcaacgagctgaacgaggagttcaagtccgtctaccccgacctggaactccagttcaacctggaccagatcgacgagatcaagaagatcctgctcgacagtacgaagtcccgtttcgaccgccagggcgaggccgtgaagctgatctacaccgtcagcgaggtgaagaccatcgagaagctgcagaacaagatcgtgaagcagttcctctccgggatcctcggcctgaacacccgcttcgacgtcctcacgaacaccgagagcgacgactccatgtggaagttcagcctagactccgagagctccgacgacgctctggacgagatcatcgcccagctcgacgaccccgcgatccacgtggtggagttagtcaacgagatccacagctccatcaccctggccgggatcgtgcccgagggccaggggctcagcgagtccatggtggagaagtatgaagcccacaaggcccacctccagctgctgaaggcggtcgagaagctggtggacaaaaaggcggccgacaagctggaggtggcctacgaccagtatatcaacggcaaggacagcaagcagttcatcaaggaggacttctacaaggctgtccagagcgagatcaagggtgtggccggggacgaggtggcggagatcaaccagctcatcgagctggaccaattcatgccgaagcagcggaccaaggagaacggcgccatcccccaccagctgcaccagcacgagctcgacgtcatcatcgagaaccaatccaagtactacgattggctgggggagaaagtgggcaacgagtacaagctggacaagctcgtgagcttccgcgtcccctactacgtgggccccctggtagacacggcctcgaaggagaagaaggacgagacccggttcgcctggatggtgcgcaagaacccggagtcgaccgaggccataaccccgtggaacttcgaggacatcgtggacaagaacgcgtccgccgagaatttcatcaagcgcatgacgaccaaggacaagtacctgctcaacgaggacgtcctgcccaagtgcagcctgctcacacaggacttcgaggtgtacaacgagctgaacaacatccgggtgaacggggaaaagttcaccgccgagcagaagcagctgatccacgacgagctgttcacgaagcacgcctccgtcagcatcaagcagctcaaggacttcctggtgtccgagctgatgtacgtgcgcgacaacctcaaggtcgaaggcctggccgacgagaagaagctgatgagctcccttagcacccagttcgactaccagaaaatcatccccgaccaaatcaacgacgtgaagtatcgggaggacatcgagcagatcatcgagtggtccaccatcttcgaggacgcggccatcttcaagaccaagctgaaggagatcgactggctgacggacgagcagcgcaacaagctcgccaacaagcggtaccgcgggtggggcagcctgtccaagcggctgctcgcctgcctggtggacgagaacgggcagcgcatcatagacatcctgcgggacagctccgacaacttcatgatgatcgtcaaccgcccggagttcaagcaggcgatctttgacgagaacgccaacctcaccgagaccaacagcaagaaggacatgttcgagatgatcgacaacttctacaccagcccccagaacaagaaggccatccgccaggtgctgctggtggtccaggacattcagaacgccatgggtggcgtggcgccccagaaaatcttcatcgagttcgcccgggaggacgaggtgaacgggcggcgcacgaactcccggtacagccagatccgcgagatgtactccaaggtcaccgacgacgtgatcaacaagaccgtccggggtgagctcgaggccaacaaggggagcctgaataaggagaagctgttcctctacttcctgcagggcgggatcgacctgtactccggcaagaccatcaacatcgacaacattagctcctacgacgtcgaccacgtgctcccgcagagcttcatcaaggacgactccatcaacaacaaggtgctggtcaacgccaagggcaaccgcgtgaagaacgacaacgtgccgatggagctgttcggggctaagatgtaccccacgtggaagcggatggtcgacaccggcatcatgagcaaggccaagttcaagaacctcaccctgaaccccgacaacgtggacaagttcaaggcggaggggttcatcaaccgccagctggtggagacccgccagatcataaagctcgtcgcccagatcctgaacgacaagctgggcgacgacaccaagatcgtgtccgtgaaagccaatctcacgcacgacatgcgggtcttcttcgacttccccaagaaccgcaacgtgaataactaccaccacgccttcgacgcctacctgagcgcgttcgtggggacctacctgtacaagcggtacccgaagctccagccctacttcgtctacggcgagttcaagaaaatggacaagctgaagaacatgacatccttcgacttcctgcgcgacctaaagcacaccgacaaggtggtggacaaggacacgggcgagatcatcgccgacaagctggccgtcatcaccaacatgaacaagatctacgacttcaagaaggtgctggtgacgcacgaggtccacgagaacagcggggccatgtacgaccagaccctctaccccgcgaagctggacaagtccctgggccggaagggggccaagcagctcatccccaagaaggacgacatgccgacggccctgtacggcggctacaccgggagcaaggacgccttcatgtccatcgtgcgcctgaagaagaaagacgaggtgtactacaaggtcatcggcatccccgtgcggatcgccgacagcgtgcagcacgggaaggaggtcgacgtggaggcgctcacccagttcatcgagaccaagttcacgaaggagaacctgaacaagaagaccggcgagatcacccgcaaggtggagtggttcgagctggtcctccccaaggtactcttcgggcaggccgtcttcgacggcggccagccgttcatgctggggtccagcacctaccctcacaacctccgggagctggtgctgacgaaggacagcgtgaagaagatcgccggcaaggagtccaacaagagctacctcgacgcctacgacgagatcatggaggccatgaacaagtacttccccctgtacgacaccaacaagttccgcgagaaggtcatcgaggggcggtccaagttcatcgatctgcccgataaggatgagtacgagaacaacaagctcgtccaagtgggcaagagcaccattatcgaccgcatgttcatcggtctgcacgcgaacgccgcccggaccgacctgaagaacatcggcatcactaccccgttcggcttcatgcagcaggcctccgggataaagctcaccaaggacaccgtggtgctgttccagagctccacgggcctgttcgagcgcaaggtggccctcaaggacctgtga

SEQ ID NO: 7605 - RNA, 4011 nt, synthetic construct
  misc_feature 1..4011: note = Cas9 variant
  source 1..4011: mol_type = other RNA
atgacaaaagactacaccatcggtctggacatcgggacgaacagcgtgggctgggccgtcctcaccgacgactaccagctgatgaagcgcaagatgtccgtgcacgggaacaccgagaagaagaagattaagaagaacttctggggcgcccggctgtttgacgagggacagaccgcggagttccgccggacgaagcgtaccaatcggcgcagactggcccgtcggaagtaccgcctttcgaagctgcaggacctgttcgccgaggagctgtgcaagcaggacgactgcttcttcgtgcggctggaggagtccttcctagtccccgaggagaagcagtacaagccggcaagcatcttccccaccctggaggaggagaaggagtactaccagaaataccccaccatctaccacctccgccagaagctcgttgactccacggagaaggaggacctgcggctggtgtacctagccctggcgcacctcctgaagtaccgcggccacttcctgttcgagggctacctggacaccgaaaacaccagtattgaggagtccttccgggtcttcctggaacagtatgggaagcagagcgaccagcctcttatcgtgcaccagccggtgctgacaatcctcacggacaagttatccaaaactaagaaggtcgaggagatcctgaagtactaccccacagagaaaatcaactctttcttcgcccagtgcctcaagctgatcgtgggcaaccaggccaacttcaaacgcatcttcgatctggaggcggaggtaaaacttcagttctctaaggagacctacgaggaggacctggagagcctgctcgagaagatcggggacgagtacctggatatcttcctgcaggcgaagaaggtccacgacgccatcttgttgtccgagatcatcagctccacggtcaagcacacgcaggccaagctgtcttccggcatggtcgagcgctacgagcgccacaaggccgacctcgccaaattcaagcagttcgtcaaggagaatgtgccccagaaggcgaccgtgttcttcaaggacaccacgaagaacgggtacgccggctacataaagggcaagaccacccaggaggagttctacaagttcgtcaagaaggagctgagcggggtggtgggctccgagccattcctcgagaagatcgaccaggagaccttcctcctgaagcagcggacgtacaccaacggggtcattccgcaccaggtgcacctgattgaactcaaggccatcatcgaccagcagaaacagcactaccccttccttgaggaggccggccccaagatcatcgcactgttcaagttccgaatcccttactacgtcggcccgctcgcgaaggagcaggaagctagcagcttcgcctggatcgagcggaagacggcggaaaagatccacccctggaatttctccgaagtcgttgacatcgaaaagagcgcaatgcgcttcatccaacgcatgaccaaacaagacacgtacctgcccaccgagaaggtcctgcccaagaacagcctgctctaccagaagtacatgatctttaacgagctgaccaaggtgagctacaaggacgagcgcggggttaagcagtacttctccggcgacgagaagcagcagatcttcaagcagctgttccagaaggaacggggtaagatcaccgtcaagaagctccagaacttcctgtacacgcactaccacatcgagaacgcgcacattttcggcatcgagaaggctttcaacgccagctactccacctatcacgacttcatgaagctggccaagaccaaccagaagtccatgcaggagtggctcgagcaaccggaaatggaacccatcttcgaagacatcgtcaagatcctgactattttcgaggatcggcaaatgatcaagcaccagctgagcaagtaccaggaggtgtttggggaaaagctgctgaaggagttcgcacgaaagcactacacgggctggggccggttctcagcgaagctgatccatgggatccgcgacaggaagaccaacaaaacgatcctcgactacctgatcaacgacgacgacgtccccgcaaaccgcaaccggaacttaatgcagctcataaacgatgagcacctgtccttcaaggaggagatcgcgaaggctaccgtgttcagcaagcacaagtccctggtggacgtcatccaggacctccccggctccccggcgattaagaaggggatctggcagtccctgaagatagtggaggaactgatcgccatcatcggctacaagccgaagaacattgtgatcgagatggcccgcgagaatcagaagacccaccggacgaagccccgcctcaaagccctggagaacgggctgaagcagattggcagcacgctcctgaaggagcagcccaccgacaacaaggccttgcagaaggagcggctctatctgtactacctgcagaacggcagggacatatacaccggggagccgttagacatcgagaacttacaccagtacgaagtcgaccacataatccctcggtccttcatcgtggacaacagcatcgacaacaaggtcttagtcgcgtcgaagcagaaccaaaagaagcgcgacgacgtgcccaacaagcagatcgtgaacgagcagaggatcttctggaaccagctcaaggaggccaagctgatcagcccgaagaaatacgcctacctgacaaaaatcgagctcacccccgaggacaaggcccgcttcatacagcggcagctggtcgagacccgtcagatcacgaaacacgtggccaacattttacaccagagcttccaccaagaggaggagggcacggactgcgacggggtgcagatcatcaccctcaaggcgacactgacctcccagttccgccagacgttcggtttgtacaaggtcagggagatcaacccccaccaccacgcccacgacgcctacctcaacgggttcatcgctaacgtgctgctgaagcgctaccccaagctcgcccccgagttcgtgtacggcaagtacgtcaagtacagcctggcgcgggaaaacaaggccaccgccaagaaggagttctactccaacattctgaagttcctcgaatcagacgagccattctgcgacgagaacggcgagatctactgggagaaatcctaccacctcccccgcatcaagaaggtgctttcttcccaccaggtgaacgtcgttaagaaggtggagcagcagaagggtgggttctacaaggagaccgtcaatagcaaggagaagcccgacaaactgatcgagcggaagaacaactgggatgtgaccaagtacgggggctttgggtcgccggtgatcgcctacgccatagccttcgtctacgccaaggggaaaacgcagaaaaagacacgcgccatagagggcatcaccatcatggagcaggccgcgttcgagaaggaccccaccacattcttaaaggacaaagggttcccccaggtgaccgagttcataaagctgcccaaatacaccctcttcgagttcgacaacggccggcgccggttcctggccagccacaaggagtcccagaagggcaacccgttcatcctgagcgaccaactcgtgaccctgttgtatcacgcccaacactacgacaagattacatatcaggagtccttcgactacgtcaacacccacctcagcgacttctccgccatcctgacagaggtgctggccttcgcggagaagtacaccctcgccgacaagaacattgagcgcattcaggagctgtacgaggaaaacaagtacggcgagatcagcatgatcgcccagtccttcctgcaactcctgcagttcaacgccataggcgcccccgcggacttcaaattcttcggagttactatcccccggaagagatacaccagcctgaccgagatctgggacgccaccatcatataccaaagcgtcaccgggctctatgagacccgaatccgcatgggggacctgtgggccggcgagcagtga

SEQ ID NO: 7606 - RNA, 4011 nt, synthetic construct
  misc_feature 1..4011: note = Cas9 variant
  source 1..4011: mol_type = other RNA
atgaccaaggactacaccatcggcctggacatcgggacgaacagcgtgggctgggccgtactcaccgacgactaccagctgatgaagcgcaagatgtccgtgcacgggaacaccgagaagaagaagatcaagaagaacttctggggcgcccggctgttcgatgaggggcagaccgcggagttccgccggacgaagcgcaccaaccggcgccggctcgccagacggaagtaccgcctgagcaagctgcaggacctcttcgccgaggagctatgcaagcaggacgactgcttcttcgtgcggctggaggagagtttcttagtcccggaggagaagcagtacaagccggccagcatcttccccaccctggaggaggagaaggagtactaccagaaatatcccaccatctaccacctccgccagaagctggtggactccacggagaaggaggacctgcggctggtgtacctcgcactggcgcacctcctgaaataccgcggtcacttcctgttcgagggcgacctggacaccgagaacaccagcatcgaggagtccttccgggtcttcctcgagcagtacagcaagcagtccgaccagcccctgatcgtacaccagccggtgctgaccatcctaacggacaagctgagcaagaccaagaaagtcgaggagatcctgaagtattaccccaccgagaagatcaactccttcttcgcccagtgcctcaagctgatcgtggggaaccaggccaacttcaagcgcatcttcgacctggaggccgaggtgaagctccagttcagcaaggagacctacgaggaggacctggagagcctgctcgaaaagatcggcgacgagtacctggacatcttcctgcaggcgaagaaggtccacgacgccatcctcctgagcgagatcatctccagcacggtgaagcacaccaaagccaagctgtccagcggcatggtggagcggtacgagcgccacaaggccgacctcgccaagttcaagcagttcgtcaaggagaacgtgccccagaaggcgaccgtgttcttcaaggacaccacgaagaacggctacgccgggtacattaagggcaagactacccaggaggagttctacaagttcgtcaagaaggagctgtccggcgtggtggggagtgagcccttcctggagaagatcgaccaggagaccttcctcctgaagcagcggacgtacactaacggcgtcatcccgcaccaggtacacctgatcgagctcaaggccatcatcgaccaacagaagcagcactaccccttcctggaagaggccgggcccaagatcatcgccctgttcaagttccgaatcccctactacgttggcccgctcgcgaaggagcaggaggccagctccttcgcctggatcgagcggaagaccgccgagaagatcaacccctggaacttcagcgaggtcgtggacatcgagaagtccgccatgcgcttcatccagcgcatgaccaagcaggacacgtacctgcccaccgagaaggtcctgcccaagaacagcctgctctaccagaagtacatgatcttcaacgagctgaccaaggtgtcctacaaggacgagagaggcgtgaagcagtacttcagcggggacgagaagcagcagatcttcaagcagctattccagaaggagcgcggcaaaatcaccgtcaagaagctccagaacttcctgtacacgcactaccacatcgagaacgcgcagatcttcgggatcgagaaggccttcaacgcctcctacagcacctatcacgacttcatgaaacttgccaagaccaaccagaaggccatgcaggagtggctcgagcagccggagatggagcccatcttcgaggacatcgtgaagatcctgaccatcttcgaggaccggcaaatgatcaagcaccaactgagtaagtaccaggaggtgttcggcgagaagctcctgaaggagttcgcgcgcaagcactacacggggtggggccggttctcggccaagctgatccacggcatccgcgaccggaagaccaacaagaccatcctcgactacctgatcaacgacgacgacgtccccgccaaccgcaacaggaacctgatgcagctcatcaacgacgagcacctgtccttcaaggaggagatcgccaaggcgaccgtgttcagcaagcacaagtccctggtggacgtcattcaggacctccccgggagcccggccatcaagaagggcatctggcagtccctgaagatcgtggaggagctgatcgctatcatcgggtacaagcccaagaacatcgtgatcgagatggcgcgtgagaaccagaagacgcaccggacgagcccccgcctcaaggccctggagaacggtctgaagcaaatcgggtccaccctcctgaaggagcagcccaccgacaacaaggcgctgcaaaaggagcggctctacctgtactacctgcagaacggccgcgacatgtacaccggcgagccgctcgaaatcgagaacctgcaccagtatgaggtcgaccacatcatcccccggagcttcatcgtggacaactccatcgacaacaaggtgctggtcgccagcaagcagaaccagaagaagcgcgacgacgttcccaagaagcaaatcgtcaacgagcagcggatcttctggaaccagctcaaggaggccaagctgatcagccccaagaagtacgcctacctgacgaagatcgagctcaccccggaggacaaggcccgcttcatccagcgtcagctggtcgaaacccgccaaatcaccaagcacgtggcgaacatcctgcaccagtccttcaaccaggaggaggagggcacggattgcgacggcgtgcagatcatcacgctcaaagccaccctgaccagccagttccgccagacgttcgggctgtacaaggtccgggagatcaacccccaccaccacgcccacgacgcctacctcaacggcttcatcgccaacgtcctcctgaagcgctaccccaagctcgcgccggagttcgtgtacgggaagtacgtcaagtactccctggcccgggagaacaaggccaccgccaagaaggagttctacagcaacatcctgaaattcctcgaatccgacgagcccttctgcgacgagaacggcgagatctactgggagaagtcccaccacctccctcgcatcaagaaggtgctgagcagccaccaggtgaacgtcgtgaagaaggtggagcagcaaaagggcggattctacaaggagaccgtcaactccaaggagaagcccgacaagctgatcgagcggaagaacaactgggacgtgaccaagtacggcgggttcggcagcccggtgatcgcgtacgccatcgccttcgtctacgccaagggcaagacgcagaaaaagaccagagccatcgaggggatcaccatcatggagcaggcggccttcgagaaggaccccaccacgttcctgaaggagaagggcttcccccaagtgaccgagttcatcaagctgcccaaatacaccctcttcgagttcgacaacgggcggcgccggttcctggcctcccacaaggagtcgcagaagggcaatccgttcatcctgtccgaccagctcgtgaccctcctgtaccacgcccagcactacgacaagatcacgtaccaggagagcttcgactacgtcaacacccacctctccgacttcagcgccatcctgaccgaggtgctagcgttcgccgagaagtacaccctcgccgacaagaacatcgagcgcatccaggaactgtacgaggagaacaagtacggggagacgtccatgatcgcccagagcttcctgcagctcctgcagttcaacgccataggcgcgcccgccgacttcaagttcttcggcgtgaccattccccgcaagcgctacaccagcctgaccgagatctgggacgccacgatcatctaccagtccgtcaccgggctctacgagacccggatccgcatgggcgacctgtgggccggggagcagtga

SEQ ID NO: 7607 - RNA, 4014 nt, synthetic construct
  misc_feature 1..4014: note = Cas9 variant
  source 1..4014: mol_type = other RNA
atgaaaaacatgaagaagccctacacgatcggcctggacatcgggaccaacagcgtgggctgggcagttctcacggatcagtacgacctggtgaagcgcaaaatgaagatcgccggggacagtgagaaaaagcagatcaagaagaacttctggggcgtgagactgttcgacgaggggcagactgcggccgaccgccggatggcaagaaccgcccggcgccggattgagcgccggagaaaccggatctcgtacctccagggcatctttgccgaggagatgtccaagaccgatgcgaactttttctgcaggctgagcgactccttctacgtcgacaacgagaagaggaacagccgccatccgttcttcgcaactattgaggaggaggtcgagtaccacaagaactatcccaccatctaccacctccgggaggagctggtgaactcctctgagaaggcagacctacgcctggtctacttggccttggcgcacattatcaagtatcggggcaacttcctgatagagggagcgttggacacccaaaatacctccgtcgacggcatctacaaacagttcatccagacgtataaccaagtgttcgccagcgggatcgaggacggctccttaaagaaactagaggacaacaaggacgtcgccaagatactcgtggagaaggtgacgaggaaggagaagctggagcggatcctgaaactctaccccggggagaagtccgccggcatgttcgcacagttcatcagccttatcgtcggcagcaaggggaacttccaaaagcctttcgacctgatagagaagtccgacatcgagtgcgccaaggactcatacgaagaggacctagaatccttgctggccctcatcggcgacgagtacgctgagctgttcgtggccgcgaagaacgcctacagcgccgtggtcctgtccagcataatcaccgtggccgagaccgagacgaacgccaagctcagcgcctccatgatagagcgcttcgacacccacgaggaggacttgggggagctgaaggccttcatcaagctccacctcccgaagcactacgaggaaatcttcagcaacactgagaagcacggctacgccggctacatagacgggaagaccaagcaggcagacttctacaaatacatgaagatgacgctggaaaacatcgagggcgcagactactttatcgcgaagatcgagaaggagaacttcctgcggaaacagcgcaccttcgataacggggccatcccccaccagctgcatctggaggagcttgaggccatcctgcatcagcaggccaagtactaccccttcctgaaagagaactacgacaaaatcaagtcgctcgtgaccttccgcatcccctacttcgtcggccccctggcgaatgggcagagcgagttcgcctggctgacccgaaaggcagatggtgaaatccgcccatggaacatcgaggagaaggtggacttcggcaagtccgctgtggacttcatcgaaaagatgacgaacaaggacacctacctcccaaaggagaacgtcctgccaaagcacagcctgtgttaccagaagtacctcgtgtacaacgagctgacgaaggtgcggtacatcaacgatcaggggaagacctcctacttcagcggccaggagaaggagcaaatcttcaacgacctgttcaagcagaagcgcaaggtcaagaagaaagacctcgaactgttcctgcggaacatgtcacacgtggaaagcccaacgatagaggggctagaggactccttcaattcttcctacagcacctaccacgacctcctgaaagtaggcatcaagcaggagatcctggacaaccccgtgaacaccgagatgctcgagaacatagtgaagatcctgaccgtgttcgaggacaagcgcatgatcaaggagcagttacagcagttctccgacgtgcttgacggggtggtcctgaagaagctggagcggcgccattacacgggctggggtcggctcagcgccaaacttctgatggggatccgcgacaagcagtcccacctcaccatcctggactacctgatgaacgatgacggactcaaccgcaacctcatgcagctaatcaatgacagcaacctctccttcaagagcatcatcgagaaggaacaggtcaccacagcggacaaggacatccagtcgatcgtggccgacctcgccgggtcccccgccatcaagaaggggatcctgcagagcctgaagatcgtggacgagctggtgtccgtgatgggctatccgcctcagacgatcgtcgtggaaatggctcgagagaaccagaccaccggaaagggaaagaacaacagccggccccgttacaagtccctggagaaggcgatcaaggagttcgggagccagattctcaaagagcaccccacagacaaccaggagctgcggaataatcgcctgtacctctactacctgcagaatggcaaagacatgtacacggggcaggacttagacatccacaacctctccaactacgacatcgaccacatcgtgccccagagcttcatcaccgacaactccatcgacaacctcgtcctgaccagctccgccggcaaccgtgagaagggcgacgacgtcccgcccctcgagatcgtgcgcaagcggaaggtcttctgggaaaagctgtaccaggggaacctgatgagcaagcgcaagttcgactacctcaccaaggccgaacgcggcgggctgaccgaggccgataaggcccggttcatccaccgccagctggtggagacgagacagatcaccaagaacgtggcgaacatcctccaccagcgcttcaactacgagaaggacgaccacggtaacaccatgaaacaggtgcggatcgtgaccctgaagtccgccttggtgagccagttccgcaagcaattccagctctataaggtccgggacgtgaatgactaccaccacgcccacgacgcctacctgaacggcgtggtcgctaacacgctgctcaaggtgtacccccagctggagccagagttcgtgtacggcgactaccaccagtttgactggttcaaggccaacaaggccaccgcaaagaagcagttctacacgaacatcatgctgttctttgcccagaaggaccgaatcatcgacgaaaacggcgagatcctctgggacaagaagtacctggacactgtcaagaaggtgatgtcctaccggcagatgaacatagtgaagaagacggagattcagaagggggagttcagcaaggcgaccatcaagccgaagggcaactccagcaagctgatcagccgcaagactaactgggatcccatgaagtacgggggcttagactcccccaacatggcttatgccgtcgtgatcgaatacgccaaggggaagaacaagctggtgttcgagaagaagatcatccgggtcaccatcatggagcgcaaggcattcgagaaggacgagaaggcgttcctggaggagcagggctaccggcagcccaaggtgctagccaagctgccgaagtacaccctgtacgagtgcgaggagggccgccggcgcatgcttgccagcgcaaacgaggcccagaaggggaatcagcaagtcctgcccaaccacctcgtgaccctcctgcaccacgtggcgaattgcgaggtgtccgatggcaagagcctggactacatagagtccaaccgggagatgttcgccgagctcttagctcacgtcagcgagttcgcaaagcgctacaccctggcagaggccaacttaaacaagatcaaccagttatttgagcagaacaaggagggggacatcaaggccatcgcccagtcgtttgtcgacttgatggccttcaacgcgatgggcgccccagccagcttcaaatttttcgaaacaacgatagagcgaaagcgctacaacaacctcaaggagctgctgaactccacaatcatctaccagagcatcaccgggctctacgagtctcggaagcgtctggacgactga

SEQ ID NO: 7608 - RNA, 4014 nt, synthetic construct; identical to SEQ ID NO: 1808
  misc_feature 1..4014: note = Cas9 variant
  source 1..4014: mol_type = other RNA

SEQ ID NO: 7609 - RNA, 4014 nt, synthetic construct
  misc_feature 1..4014: note = Cas9 variant
  source 1..4014: mol_type = other RNA
atgaagaaggactacgtgatcggtttagacatcgggaccaacagcgtcggctgggccgtgatgaccgaggactaccagctcgtgaagaagaagatgcccatctacgggaacacggagaagaagaagatcaagaagaacttctggggcgttcgcctgttcgaggaggggcacaccgccgaggatcggcgcctgaagcggaccgcgcgccggcgcatcagccggcgccggaaccgactacggtacctgcaggccttcttcgaggaggccatgacggacctggacgagaacttcttcgcccgattacaggagagcttcctggtgccggaggacaagaagtggcaccggcaccccatattcgccaagctggaggacgaggttgcgtaccacgagacgtaccccaccatctaccacctccgcaagaagctggccgactccagcgagcaagccgacctgcggctcatatacctggcgctggcgcacatcgtcaagtaccgcggccacttcttaatcgagggcaagctgtccaccgagaatatcagcgtgaaggagcagtttcagcagttcatgatcatctacaaccagaccttcgtcaacggggagtcccggctggtctcagcgcccctccccgagtcggtgctgatcgaggaagaactgacggagaaagccagccgcaccaagaagtccgagaaggtgctccaacagttcccccaggagaaggccaacggcctgttcgggcagttcctgaagctcatggtcggaaacaaggccgacttcaagaaggtgttcggcctggaggaggaggccaaaatcacctacgcctccgagtcctacgaggaggacctggagggcatcctcgccaaggtgggcgacgagtacagcgacgtcttcctggcagccaagaacgtgtacgacgcggtggagctgtccaccatcctcgccgacagcgacaagaagtcccacgccaagctgagctccagcatgatcgttcgtttcacggagcaccaggaagacctgaagaagttcaagcgctttattcgcgagaactgccccgacgagtacgacaacctcttcaagaacgagcagaaggacgggtatgccggctatatcgcccacgcggggaaggtgagccagctgaagttctaccagtatgtgaagaagatcatccaggacatcgccggcgccgagtacttcctggagaagattgcccaggagaacttccttcgcaagcagagaaccttcgacaacggcgtcatcccccaccagatccacctggccgagctgcaggcgataatccaccggcaggccgcctactatccctttctcaaggagaaccaggagaagatcgagcagctggtgacctttcgcatcccctactacgtggggcccctgtccaagggcgacgccagcaccttcgcgtggctcaagcggcagtccgaggagcccattcgcccgtggaacctgcaggagacggtcgacctggaccagagcgccacagccttcatcgagcgtatgaccaactttgatacctacctccccagtgagaaagtgctgcccaagcactctctgctctacgagaagttcatggtcttcaacgagctgaccaagatctcctacaccgacgaccgcgggatcaaggccaatttctcaggcaaggaaaaggagaagatcttcgactacctgttcaagacccggcgcaaggtcaaaaagaaagacatcattcagttttatcggaacgaatacaacaccgagatcgtgacactgtccgggctcgaggaggaccagttcaacgccagcttcagcacctaccaggacctgctgaagtgcggcttaacccgagccgagctggaccaccccgacaacgccgagaagttagaggacataatcaagatccttaccatcttcgaagaccggcagcgcatccggacacagctgagtaccttcaagggccagttctccgccgaggtcctgaagaaactcgagcgcaagcactacaccggatggggccggctgagcaagaagctcataaacgggatctacgataaggagtccggcaaaaccatcctcgggtacctgatcaaggacgacggcgtgagcaagcactacaaccgcaacttcatgcagctgatcaacgactcccagctcagcttcaagaacgccattcagaaggcccagtccagcgagcacgaggagacgctgagcgagaccgtgaacgagctggcgggctccccggccatcaagaaggggatctaccagagcctcaagatcgtcgacgagctggtggccatcatgggctacgctccgaagcggatcgtggtcgagatggcccgcgagaaccagaccacctccacggggaagcggcgcagcatccagagactgaagatcgtggagaaggcgatggcagaaatcggctccaacctcctgaaggagcagcccaccaccaacgagcagctgcgggacacccgcctcttcctgtactacatgcagaacgggaaagacatgtacaccggcgacgagctgagcctccaccggctgtcccactatgacatagaccacatcatcccgcagagcttcatgaaggacgactccctggacaatctcgtgctggtcggcagcacggagaaccgcgggaagtccgacgacgtgccgtctaaggaggtggtcaaggacatgaaggcctattgggagaaactgtacgctgcgggactcatctcccaaagaaagttccagagactgacgaagggggagcagggcggcctgaccctcgaggacaaggcccacttcatccagcgacaactggtggagaccaggcagatcacgaagaacgtggccgggatcctggaccagcggtacaacgctaatagcaaggagaagaaggtccagatcatcactctcaaggcctctctgaccagccagttcaggtccatcttcggcctgtacaaggtgcgtgaggtaaacgactaccaccacgggcaagacgcgtacctcaactgcgtcgtggcgaccacgctgctgaaggtttaccccaacctcgccccggagttcgtctacggcgagtaccccaagttccagaccttcaaggagaataaggccaccgccaaggcgatcatctacaccaacctgctgcgtttcttcacggaggacgaaccgcggttcaccaaggacggtgagatcctctggagcaacagctacctgaagaccataaagaaggagctgaactaccaccagatgaatatcgtgaagaaggtagaggtccagaagggcggcttctccaaggagagcatcaagcccaaggggccctccaacaagctcatccccgtgaagaacggcctcgacccgcagaagtacgggggcttcgacagccccatagtggcctacaccgtcctgtttacgcacgagaaagggaagaagcccctcatcaagcaggagatcctgggcatcaccatcatggagaagacccgcttcgagcagaatccgatcttgttcctagaggagaagggcttcctgcggccccgcgtactgatgaagctccccaagtacaccctgtacgagttcccggaggggcggcgcagactgctcgcctccgccaaggaggcccagaagggcaaccaaatggtgctgccggagcacctcctgacgctgctgtaccacgcgaagcagtgtctcttaccgaaccagagcgagtccctgacctatgtcgagcagcaccagcccgagttccaggagatactcgagcgcgttgtggacttcgcagaggtacacaccctggccaagagcaaggtgcagcagatcgtgaagctgttcgaggccaaccaaaccgcggacgtcaaggagatcgctgcctccttcattcagctcatgcaatttaacgccatgggggcgccgagcacgttcaagttcttccagaaggacatcgagcgggcgcggtacacctccatcaaggagatcttcgacgccaccatcatctaccagagcaccacgggcctgtacgagacccgtcggaaggtggtggactga

SEQ ID NO: 7610 - RNA, 4014 nt, synthetic construct
  misc_feature 1..4014: note = Cas9 variant
  source 1..4014: mol_type = other RNA
atgaaaaaggactacgtgatcggcctggatatagggaccaatagcgtcggctgggcggtgatgaccgaggactatcagctcgtgaagaaaaagatgcccatctacgggaacaccgagaagaagaaaatcaagaagaatttctggggcgtccgactgttcgaggagggccacacagcggaggaccggcgcctgaagagaaccgcgcgccggcgcatctcccggcgccgaaaccgcttgcggtatctgcaggcgtttttcgaggaggctatgactgacctggacgagaacttcttcgcccgcctccaggagtcttttctggtcccggaggacaagaagtggcaccggcaccccatctttgccaagctggaggacgaggtcgcgtaccacgagacgtaccccaccatctaccacctccgcaaaaagctggccgactctagcgaacaggccgaccttcggctcatttacttagcgctggcgcacatcgtcaaataccgcggccacttcttaatcgagggcaaactgtctaccgagaacaccagcgtgaaggatcagtttcagcagttcatggtaatctacaatcagacgttcgtgaacggggaatcccgactggttagcgcacccctcccggagtccgtgctgatcgaggaggaattaaccgaaaaggccagccggaccaagaaatccgagaaggttcttcagcagttcccccaggagaaggccaacggactgttcgggcagttcctgaagttaatggtgggcaacaaggctgacttcaagaaagttttcgggctggaggaggaggccaagatcacctatgcctccgagtcctacgaggaagacctcgaaggcatactcgccaaggtaggcgatgagtactcggacgtgttcctagccgccaaaaacgtgtacgatgcagtcgaactgtccacgatcctcgccgactctgataagaagagtcacgccaagctgagctcgtcaatgattgtccggttcaccgagcaccaggaggacttaaagaagttcaaacgcttcatccgggagaactgccccgacgagtacgacaacctcttcaagaacgagcagaaagacggatacgccggctacatcgcccacgcggggaaggtatcccagctgaaattctaccagtatgtcaaaaagatcatccaggacattgccggcgccgagtacttcctggagaagatcgcccaagagaatttcctccgcaagcaacgcactttcgacaatggggtgatcccccaccagatccacctagccgaactccaggcgatcatccatcgccaggccgcctactatccgttcctaaaagagaatcaggagaaaatcgagcagcttgtgactttccgcatcccctactacgtcgggcccctgtccaagggcgacgccagtacattcgcctggttaaaacggcagtccgaggaacccatccgcccgtggaacctgcaggagaccgttgacctggaccagtccgccaccgcattcatcgagcggatgaccaacttcgacacgtacttaccctccgagaaggtcctgcccaagcacagcctgctctacgagaagttcatggttttcaatgagttgaccaagatctcctacacagacgaccgcgggatcaaggccaacttcagcggcaaggagaaggagaagatcttcgattacctgtttaagacgcggcgcaaggtgaagaagaaggacatcatccaattctatcggaacgaatacaacaccgagatcgtcaccctttcagggctggaggaggaccagttcaacgccagcttctccacctaccaggacttactgaagtgtggcctcaccagagcggagctagaccaccccgataacgccgagaagctggaggatatcatcaagatcctaacgattttcgaagatcggcagagaatccgcacccagctgagcacctttaagggtcagttttcagccgaggtgctgaaaaagctcgaacgcaagcactacacagggtggggtcggctgagcaagaagctgatcaacgggatctacgacaaggagtctgggaagacgatcctcgattacctgatcaaagacgatggtgtgagcaagcactacaacaggaacttcatgcagctgataaacgactcccaactctccttcaagaacgccatccaaaaggcccagagttgtgagcacgaggagaccctaagcgagaccgtcaacgagctggctggcagcccggccatcaagaagggtatctaccagtccctcaagatagtggatgagctggtggccataatgggatacgcccccaagcggatcgtcgtggagatggcccgcgaaaatcagaccacgagcaccggcaagcggcgctctatacagcgcctgaagatcgtggaaaaggcgatggccgaaattgggtctaacctcctgaaggagcagcccaccaccaacgagcaactgcgggacacccggctctttctgtactacatgcagaacggcaaggacatgtacactggggacgagctgagcctccaccggctgagccactacgacatcgatcacatcatcccccagagcttcatgaaagacgacagcctggacaacctcgtcctggtgggctccacagagaatcgcgggaagagtgacgacgtgccatccaagaaggtcgtgaaggacatgaaggcctactgggagaagctctacgctgcggggttgatcagccagcggaagttccagcggctgaccaagggcgaacagggcggtctgacccttgaggacaaggcgcacttcatccagcggcagctggtggagactcgccagattaccaaaaacgtagcaggcatccttgatcagcggtacaacgccaagtccaaggaaaagaaggtgcaaatcatcaccctcaaagccagcctgacctcccagttccgcagcatctttgggctgtacaaggtccgggaggtcaacgactaccaccatggccaagatgcttacctcaactgcgtcgtggccacgaccctcttaaaagtctatcccaacctcgcccccgagttcgtgtatggggagtaccccaaattccaggccttcaaggagaacaaggccaccgcgaagaccataatctacacaaacctaatgcgcttctttacagaggacgagccgcggtttaccaaggactccgagatcctctggagcaactcctacctcaagacaatcaagaaggagctaaactaccaccagatgaacatcgtaaagaaggtcgaggtgcagaagggcgggttctccaaggagagcatcaagcccaagggcccctccaacaagctaatcccagtaaagaacggcctcgacccgcagaaatacggcgggttcgacagcccggtggtggcctacacggtgctgttcacacacgagaaggggaagaagcccctgatcaagcaggagatcctcgggatcaccatcatggagaagaccagattcgaacaaaacccgatattgttcctggaagaaaaggggttcctccggccccgcgtcctgatgaaacttcccaagtacacgctctacgagttccccgagggccgccgccggctgctggcctccgccaaggaggcccaaaagggcaaccagatggtgctcccggagcatctgctgaccctgctgtatcacgcaaagcagtgcctgctccccaatcagtcagagtccctggcctacgtggagcagcaccagcccgagttccaggagatactcgagcgcgtcgtggacttcgccgaggttcacactttggccaagtccaaagtgcagcagattgtgaagctgttcgaagcgaaccaaactgccgacgttaaagagatcgccgcctccttcatccagctgatgcaattcaacgccatgggggcgcccagcacattcaagttcttccaaaaggatatcgagcgggctcgctacacatccatcaaggagatcttcgatgccacaatcatctaccagagtaccacggggctctacgagactcgccggaaagtcgttgactga

SEQ ID NO: 7611 - RNA, 4014 nt, synthetic construct
  misc_feature 1..4014: note = Cas9 variant
  source 1..4014: mol_type = other RNA
atgaagaaagactacgtcatcggcctggatatcggcaccaattcagtaggctgggcagtgatgaccgaagactaccagctcgtaaagaagaagatgcccatctacggcaacacggagaaaaagaaaatcaagaagaacttttggggcgttcgcctgttcgaggagggacacaccgccgaggatcggcggctgaaacgcaccgcacgtcggcgcatctcacgtcgccgcaaccgcctgcggtatctgcaggcattcttcgaggaggccatgaccgccctggatgagaacttcttcgcgcgcctccaggagagcttcctggtgccggaggataagaagtggcaccggcaccccatcttcgcgaaactggaggacgaggtagcctaccacgagacgtaccccaccatctaccacttacgcaagaagctggccgattctagcgagcaggccgatctgcggctgatctatctggcgctggcccacatcgtgaagtaccgcggtcacttcttaatcgaaggaaaactctccaccgaaaatataagcgtaaaggaacagttccagcagttcatgatcatatacaaccagacattcgtaaacggagagtcccggctggtatctgctcccctcccagagtccgtgctgatcgaagaggagctgacggagaaagccagccgcaccaagaaatccgagaaggtcctccagcagttcccccaggaaaaggccaacggcctgttcgggcagttcttaaaactcatggtcggcaacaaggccgacttcaagaaagtattcggcctggaggaggaggctaagatcacttatgccagcgagagttacgaagaagacctggagggtatcctcgccaaagtcggagacgagtatagcgacgtcttcctggctgcgaaaaacgtgtacgacgcagtcgagctgtccaccattctagccgacagcgacaagaaatcccatgccaagctgtcatccagcatgatcgtccggttcacagagcaccaggaggatctgaaaaattttaagcggttcatacgggagaactgccccgatgagtacgacaacctcttcaagaacgaacaaaaggacgggtacgccggatacatcacgcacgcagggaaggttagccagctgaagttttaccaatacgtgaagaagatcatccaggacatcgcaggcgccgaatatttcctggaaaagatcgctcaggaaaacttcttgcgcaagcagcgcaccttcgacaacggcgtaatcccccaccagatccatctggctgagcttcaggcaatcatacaccggcaggccgcctactacccattcctgaaggaaaaccaggagaagatagagcaactggtgaccttccgcatcccctattatgtggggcccctttctaaaggcgacgcaaacacatttgcgtggctcaagcggcagagcgaagaacccatccgcccgtggaacctgcaggagacagtcgacctggatcagtctgctacggccttcattgagagaatgaccaacttcgacacgtacctccccagcgagaaggttctgcccaagcactccctgctctacgagaagttcatggtttttaacgaactgactaagataagctacaccgacgaccgcgggatcaaggctaacttctcaggcaaggaaaaggagaaaatcttcgactacctgttcaaaacccggcggaaggtgaagaaaaaggacatcatacagttttaccgaaatgagtacaatacggagatcgtcaccctgagcgggctcgaggaggatcagttcaacgccagcttctccacctaccaggacctgctgaagtgcggcctcacccgcgcggagctggaccaccccgacaacgccgagaagctggaggacataatcaagatcctcaccattttcgaggaccggcaaaggattcggactcagttatccaccttcaagggccagttcagcgccgaagtcctgaagaaactcgagagaaaacactacacagggtggggccgtctgagcaagaagctgatcaacgggatctacgacaaggagagcggcaagacgattctcgattacctgattaaggatgatggggtttccaagcactacaaccgcaacttcatgcagctgatcaacgacagccaactctccttcaaaaacgccatccagaaggcgcagagctccgagcacgaggaaaccttgtcggagaccgtcaacgagctggcgggaagccctgccatcaagaagggcatctaccagtccctcaagattgtggacgagctggtggcaatcatggggtacgccccgaagcggatagtggtagaaatggcgcgagaaaaccagaccacgagtaccggcaaacggcgctccatccagcggctcaagatagtggagaaggctatggccgagatcggctcaaacctcctgaaggagcagcccaccaccaacgagcaactgcgggacacacgccttttcctctactatatgcagaacggcaaggacatgtacacgggcgacgaactgtccctacacagacttagccactacgacatcgaccacatcatcccgcagtcctttatgaaggacgacagcctggacaacctcgtgctggtcggcagcaccgagaatcgcggcaagagcgacgatgtcccgagcaaggaggtggtcaaggacatgaaggcttactgggagaaactgtacgcagcgggtcttatcagccagcgaaagttccagcgactgaccaaaggcgagcagggcggtctgacgctcgaggacaaggcccactttatccagcggcagctggtggagacgaggcagattaccaagaacgtggccggcatcctggaccagcggtacaacgcaaagtccaaggagaagaaggtgcagatcatcaccttgaaggcctccctgacatcccagtttcgcagcatcttcgggttgtacaaggtgcgggaggtcaacgattaccaccatggtcaagacgcatacctcaactgcgtcgtagctacgaccttgctaaaagtgtatcccaatctcgcccccgagttcgtatacggggaatacccgaagttccagaccttcaaggagaacaaggccaccgccaaggcgataatctatactaacctgctgaggttcttcaccgaggacgagccgcggttcaccaaggatggtgagatcctgtggtccaacagctatctgaagactattaagaaggagttgaactaccaccagatgaacatcgtgaaaaaggtcgaggtccaaaaaggcggttttagcaaggagtccataaaaccaaagggcccgagcaacaagctcatccctgtgaagaacgggctggatccgcaaaagtacggcgggttcgactcccccatcgtggcttatacggtcctgttcactcacgaaaagggcaagaagcctctcatcaagcaagagatccttggcatcaccatcatggagaagacacgctttgagcagaatcctatccttttcctcgaggagaagggcttcttacggccccgcgtgctgatgaagctccccaaatataccctgtaccagtttccggagggccggcgtcgcctgcttgccagcgccaaggaggcgcagaaggggaaccagatggtactgccagaacacctacttaccctgctgtaccatgcgaagcagtgcctcctgcccaaccagagcgagagcctggcctacgttgagcagcatcagcccgagttccaggaaatcctcgaacgcgtagtggacttcgcggaggtccacaccctggcgaagtccaaagtgcagcagatcgtgaagctgttcgaggcgaaccagaccgctgacgtcaaggagatcgccgccagtttcattcagctcatgcaattcaacgccatgggcgcgccctccacgttcaaattctttcaaaaagacatcgagcgggcacgctataccagtatcaaggagatcttcgacgccaccatcatataccagtccaccaccgggctgtacgagacccgccggaaagttgtggattga

SEQ ID NO: 7612 - RNA, 4014 nt, synthetic construct
  misc_feature 1..4014: note = Cas9 variant
  source 1..4014: mol_type = other RNA
atgaagaaggactacgtgatcggcctggacattgggaccaactcagtcggttgggccgtgatgaccgaggactaccaactcgtgaaaaagaagatgcccatctacgggaacacggagaagaagaaaatcaagaagaacttctggggcgtccgactgttcgaggaggggcacaccgccgaggaccggcgcctgaagcgaaccgcgcgccggcgcatctcccgccgccggaatcgcctccgatacctgcaggcctttttcgaggaggccatgaccgacctggacgagaacttcttcgcccgcctccaggagagcttcctggtgcccgaagataaaaagtggcaccggcaccccattttcgccaagctggaggacgaggtagcgtaccacgagacttaccccaccatctaccatctcagaaagaagctggccgactcctcggagcaggccgacctgcggctcatttacctggccctggcgcacatcgtcaagtaccgcggccacttcctcatagagggcaagctgtccaccgagaacataagcgtgaaagagcagttccagcagttcatgatcatctacaaccagacattcgtgaacggggagtcccgcctagtcagcgcacccctaccggagtccgtcttaatcgaggaggagctgacggaaaaggcctcgcgcaccaagaagtccgagaaggtgctccagcagttcccccaggagaaggccaacggcctgttcgggcagttcctgaagctcatggtcggtaacaaggccgacttcaagaaggtgttcgggctggaggaggaggccaagatcacctacgccagcgaatcgtacgaggaggacctggagggcatcttagccaaagtgggtgacgaatatagcgacgtcttcctggccgccaagaacgtttacgacgccgtggagctgtccaccatcctcgccgactccgacaagaagtcccacgccaagctgagctcctccatgatcgtccggtttacggagcaccaggaggacctgaagaagttcaagcgcttcatccgggagaactgccccgacgagtatgacaacttattcaagaacgagcaaaaggacgggtacgccggatatatcgcccacgcggggaaggtgagccagctgaagttctaccagtatgtgaaaaagatcatccaggacatcgccggcgccgaatacttcctggaaaagatcgcacaggagaacttcctccgcaagcagcgcaccttcgacaacggcgttatcccccaccagatccacctggccgagctgcaggcgataatccaccggcaggccgcctactacccgttcctcaaggaaaaccaggagaaaatcgagcagttagtcaccttccgcatcccctactatgtggggccattatcaaaaggcgacgccagcaccttcgcttggctaaagcggcagtccgaggagccgattcgcccatggaacctgcaggagacggtcgacctggaccagagcgccaccgcattcatagaacggatgaccaacttcgacacctacctcccctccgaaaaggtgctgccgaagcacagcctgctctacgagaagttcatggtcttcaatgagctgacgaagatctcctacaccgacgaccgcggtatcaaggccaacttcagcggcaaagagaaggagaaaatcttcgactacctgttcaagacccggcgcaaggtgaagaagaaggacatcatccagttctaccggaacgagtacaacaccgagatcgtgaccctgtccgggctcgaggaggaccaattcaacgccagcttctctacctaccaggacctgctgaagtgcggcctgacccgcgcggagctggaccaccccgacaacgccgagaagctggaggatatcatcaagatcctcaccatcttcgaggaccggcagcgcatccgcactcagctgagtacctttaagggccagttctccgccgaggtgctgaagaagctcgagcgcaagcactacaccgggtggggccggctgagcaagaaactgatcaacgggatctacgacaaggagtccggcaagaccattctcgggtacctgatcaaggacgacggcgtgagcaagcactacaaccgcaacttcatgcagctgatcaacgactcccaactcagcttcaagaacgcaattcagaaggcccagtccagcgagcacgaggagacgctgagcgagaccgtgaatgagctggcgggctccccggccatcaagaaggggatctaccagagtctcaagatcgtcgacgagctggtggccatcatgggctacgcccccaagaggatcgtggtcgagatggcccgcgagaaccagaccaccagtacagggaagcggcgtagcatccagcgactgaagatcgtggagaaagcgatggccgaaatcggctccaacctcctaaaggagcagcccaccaccaacgagcagctgcgggacacccgcctcttcctgtactacatgcagaacgggaaggacatgtacaccggcgacgagcttagcctccaccggctgtcccactacgacatcgaccacatcattccccagagctttatgaaggacgactccctggacaacctcgtgctggtcggcagcacggagaaccgcgggaagtccgacgacgtgcctagcaaggaagtggtcaaggacatgaaggcctactgggagaagctgtacgccgcgggactcatctcccagcggaagttccagcgcttaaccaagggagagcagggcggcctgacgttagaggacaaggcccacttcatccaacgccagctggtggagacccgccagattacgaagaacgtggccgggatcctggaccagcggtacaacgccaacagcaaggagaagaaggtccagatcatcaccctcaaggcctcccttaccagccagttccgctccatcttcggcctgtacaaggtacgggaggtgaacgactaccatcacggacaggacgcgtacctcaactgtgtcgtggccaccacgctgctgaaggtctaccccaacctcgcccccgagttcgtctacggcgagtaccccaaattccaaaccttcaaggagaacaaggcgaccgccaaggcgatcatctacaccaacctgttgaggttcttcacggaggacgagccgcggttcaccaaggacggggagattctctggagcaacagctatctgaagaccatcaagaaggagctgaactaccaccagatgaacatcgtgaagaaagtggaggtacagaagggcggcttctccaaggagagcatcaaacccaagggtccctccaacaagctcatcccagtgaagaacggcctggacccgcagaaatacgggggtttcgacagccccatcgtggcctacaccgtcctgttcactcacgagaagggcaagaagcccctcatcaagcaggagatcctgggcatcaccatcatggagaagacccgcttcgagcagaacccaatcctgttcctcgaggagaagggattcctgcggccccgcgtgcttatgaaactccccaagtacaccctgtacgagttccccgagggacggcgccggctgctcgcctccgccaaggaggcacagaagggcaaccagatggtgttaccggagcacctcctgacgctgctgtaccacgcgaagcagtgcctcctgcccaaccagagcgagtccctggcctacgtcgagcagcaccagcccgagtttcaggagatcctcgagcgcgtggtggacttcgccgaggtacacaccctggcaaagagcaaggtgcagcaaatcgtgaaactgttcgaggcgaaccagaccgccgacgtcaaggagatcgccgcctccttcatccagctcatgcagttcaacgccatgggggcgcccagcaccttcaagtttttccagaaggatatcgagcgggcccgctacacgtctataaaggagatctttgacgccaccatcatttaccagagcaccaccggcctgtacgagacgcgccggaaggtggtggactga

SEQ ID NO: 7613 - RNA, 4017 nt, synthetic construct; identical to SEQ ID NO: 1813
  misc_feature 1..4017: note = Cas9 variant
  source 1..4017: mol_type = other RNA

SEQ ID NO: 7614 - RNA, 4017 nt, synthetic construct
  misc_feature 1..4017: note = Cas9 variant
  source 1..4017: mol_type = other RNA
atgaagcaggagtacttcctgggcctcgacatggggaccggcagtctggggtgggccgtaaccgactccacctaccaggtcatgcgtaaacacggcaaagccctgtgggggacccggctgttcgagagcgcgtctaccgccgaggagcgccggatgtttcgtaccgcccggcgccggctggataggcggaactggcgcatccaggtgctgcaggagatattcagcgaggagatctccaaggtggaccccgggttcttcctccggatgaaggagagcaagtactacccggaggacaagcgcgacgccgagggcaactgcccagagctgccctacgccctgttcgtcgacgacaactacacggataagaactaccacaaggactatcccaccatctaccacctccggaagatgctgatggagaccaccgaaatcccggacatccgcctggtgtatctcgtgctgcaccacatgatgaagcaccgggggcacttcctgctctccggcgacatcagccagatcaaggagttcaagtccacgttcgagcagctgatccagaatatccaggacgaggagctggagtggcacatcagcctcgacgacgcggccatccagttcgtcgaacacgtgctgaaggaccgcaacctgacccggtccaccaagaagtcccgcctcatcaaacagctgaacgccaagagcgcctgcgagaaagcgatcctgaacctccttagcgggggcaccgtgaagctgtccgacatcttcaacaacaaggagctcgacgagagcgagcggcccaaggtctccttcgccgacagcggctacgacgactacatcggcatcgtggaggccgagctggccgagcagtactacatcatcgcctccgcgaaggccgtgtacgactggagcgtcctggtggagatcctcggcaacagcgtgtcgatcagcgaggcgaagatcaaggtctaccagaagcaccaagccgacctgaagacgctgaagaagatagtgcgccagtatatgaccaaggaggactacaagcgggtgttcgtcgacaccgaggagaagctaaacaactactccgcgtacatcgggatgaccaagaagaacggcaagaaggtggacctcaagagcaagcagtgcacgcaggcggacttctacgacttcctgaagaaaaacgtgatcaaggtcatcgaccacaaggagatcacccaggagatcgagtccgagatcgagaaggagaacttcctccccaagcaggtcaccaaggacaacggggtgatcccctaccaggtgcatgactacgagctgaagaagatactggacaacctcggcacccgcatgccgttcatcaaggaaaatgccgagaagatccagcagctgttcgagttccgcatcccctactacgtgggccccctgaaccgggtcgacgacgggaaggacggcaagttcacgtggagcgtgcgcaagtccgacgcccggatctatccctggaacttcaccgaggtgatcgacgtagaggccagcgccgagaagttcatccgccggatgaccaacaagtgcacctacctcgtgggggaggacgtgctgccgaaggacagtctggtctacagcaagttcatggtgctcaacgagctgaacaacctgcgcctcaacggcgaaaagatctccgtggagctgaagcagcggatctacgaggaactgttctgcaagtaccgcaaggtcacgaggaagaagctggagcgctacctcgtgatcgaggggatcgcgaagaagggcgtggagatcaccggcatcgacggggacttcaaggccagcctcaccgcctaccacgacttcaaggagcggctgaccgacgtccagctctcccagcgcgccaaggaggccatcgtgctgaacgtggtcctgttcggcgacgacaagaagctcctgaagcagcggctgagcaaaatgtaccccaacctcacgaccgggcagctgaagggcatctgctccctgagctaccaggggtggggccgcctctccaagaccttcctggaggagatcaccgtgcccgcacccggcacgggggaggtgtggaacattatgaccgccctgtggcagaccaacgacaacctcatgcagctgctgagccggaactacggcttcaccaacgaggtcgaggagttcaatacactcaagaaggagaccgacctgtcctacaagaccgtggacgagctgtacgtgagcccggccgtcaagcgccagatctggcagaccctcaaggtggtgaaggagatccagaaggtcatggggaacgcccccaagcgggtgttcgtggagatggcgcgcgagaagcaggagggcaagcggagcgactcccgcaagaagcagctggtcgagctgtaccgcgcctgcaagaacgaggagcgggactggatcaccgagctcaacgcccagagcgaccagcaattgcgctccgacaagctgttcctctactacatccagaaggggcggtgcatgtacagcggcgagacgatccagctggacgagctgtgggacaacaccaagtacgacatcgaccacatctacccccagtccaagaccatggacgacagcctcaacaaccgcgtgctggtgaagaaaaactacaacgccatcaagtccgacacctaccccctgagcctcgatatccagaaaaagatgatgtccttctggaagatgctgcagcagcagggtttcatcacgaaggagaagtacgtccggctggtgcgcagcgacgagctctcagccgacgagctggcggggttcatcgagcggcagatcgtggagacccgccaaagcaccaaggccgtcgccaccatcctgaaagaggccctcccggacacggagatcgtgtacgtaaaggccggcaacgtctccaacttccggcagacctacgagctgctgaaggtgcgcgagatgaacgatctccaccacgcgaaggacgcctacttgaatatcgtggtcgggaacgcctacttcgtgaagttcaccaagaacgccgcctggttcatccggaacaaccccggacgcagctacaacctgaagcggatgttcgagttcgacatcgagcgctcaggcgagatcgcgtggaaggccgggaacaagggcagcatcgtgaccgtcaagaaggtgatgcagaagaacaacatcctcgtgacgcgaaaggcctacgaggtcaagggcgggctgttcgaccagcagatcatgaagaaggggaagggccaggtgcccatcaagggcaacgacgagcgcctggccgacatcgagaagtacgggggctataacaaggcggccgggacctactttatgctcgtgaagtccctggacaagaaggggaaggagatccggaccatcgagttcgtccccctgtacctcaagaaccagatcgagatcaaccacgagagcgccatccagtaccttgcccaggagcgcgggctgaacagccctgaaatcctcctgtccaagatcaagatcgacaccctgttcaaggtggacggcttcaagatgtggctcagcggccggacggggaaccagctgatcttcaagggcgccaaccagctgatcctctcccaccaggaggcggccatcctgaagggggtggtcaagtacgtgaaccgcaagaacgagaataaggacgccaagctgagcgagcgggacggcatgaccgaggagaagctcctgcagctgtacgacaccttccttgacaagctgtccaacaccgtctactccatccgcctgtccgcccagatcaagacgctcaccgagaagcgcgccaagttcattgggctgagcaacgaggaccagtgcatcgtgctgaacgagatcctccacatgttccagtgccagtccggcagcgcgaacctgaagctgatcggcgggcccggctccgccgggatcctcgtgatgaacaacaacatcacagcctgcaagcagatcagcgtcatcaaccagtcccccaccgggatctacgagaaggagatcgacctgatcaagctgtga

SEQ ID NO: 7615 - RNA, 4017 nt, synthetic construct; identical to SEQ ID NO: 1815
  misc_feature 1..4017: note = Cas9 variant
  source 1..4017: mol_type = other RNA

SEQ ID NO: 7616 - RNA, 4017 nt, synthetic construct
  misc_feature 1..4017: note = Cas9 variant
  source 1..4017: mol_type = other RNA
atgcgggactactacatcggcctcgacctagggacgggcagcctcgggtgggcagtcacagacagggaatacgaaataatgcgcgcacatggcaaagccctatggggggtgcgactattcgactccgctaacacagcggaagaaagacgaggattccgaacagctcgtcgacgcctcgaccggagaaactggcgaatcgaactactgcaagaactattcggagaggatattggaaaagtcgactccgggttcttcctccgcatgaaagaaagcaagtacatgcccgaagacaaacgggacgtgaatggcaactgccccaagctaccctacgcactcttcgtcgaagacggctacacggacaaagactaccacagacagttcccaactatctaccacctccgaaagtggctaatggaaaccgaggaaacaccagatatacgcctcgtctaccttgctctacatcacatgatgaaacaccgaggacactttctcttcagcggcaacatagagaaaattaaagagtttcaagaaaccttccgccaatatataggcaaaatacgggaggaagagctcgacttccacctgtgcatagaaggagaagaactcagggaaaccgagaacatactgaaggacaagaacctcacgagatcagcaaaaaaaactcgcctaataaagctgctcggggcccacacggcctgcgaaaaagcagcccttaacctggtcgcggggggaaccgtcaaactcagcgacatcttcggaaacagcgaactggacgcctgcgagaagccaaaactctccttcgccgacgctggatacgacgactatgccggcatgattgaggacgaactcggagagcaacacgtaataatagaaacggccaaggctgtctacgactggagcgtgctcgccgacatactaggagactaccggtgcataagcgaagcaaaagcagccgtatacgagaaacatcagaaagacctgcgacacctaaaagagctggtgaaggaaaacctcggacgcgacgtatacaaggaagtgtttgtgaaaaccaacgagaaattgccaaactacagtgcctacataggaatgaccaagaaaaacggagtcaaaagcgagatggagggaaagcgatgcgaccgcaaggccttctacgactacttaaagaagacagtcgtaaacgcgataccagacgaatcaaagaccgaatatctcagaaaggagatggaaacggaaacgttcctgccgagacaagtaacaaaagacaacggggtaatacctcaccaagtgcacctccaagaacttgacgcaatcctagaaaacctcagcggaagaatcccagcgctaaaagaaaacggatcaaaaatccgcgacattttcacattcagaataccgtactacgtaggcccacttaacggcatagtcaaaggaggcgaacgcacgaactgggtaagaagaaagaaagcaggccgaatatgcccttggaacttcgacgagatggttgacacgggcgcatcggcagaagaattcatacgaaggatgacctcaaagtgtacatacttgatccacgaggacgtgctacccaaaaacagcatgctctactcaaaattcatggtcctaaacgaactgaacaacgtccgcctcaatggcgaaccaatatccgtcgaactaaagcagaaaacatacgaggacctctttcagcgccatcgaaaagtcacccgccgccgactgaccgactatatccgacgagaaggcatagcaggccgtgacgccgacatcacgggcatcgacggcgacttcaagggtagtctgaccgcctaccacgacttcaaggagaaattaacagggtgcgagctgagccaagccgacaaagagaacataatcctaaacatcactctattcggggaagacaaggcactactaaaaaagaggctcggcgccctatatccagcgctaacagaaccccaaaaaaaagctatctgcgcgcttagctacaaaggctggggcagactcagccaaagactactggagggaatcacggcccccgcaccagaaacgggcgagatatggaccgtgattcgggccatgtgggaaacaaacgacaatctaatgcaggtgctatccgagaaatactgcttcgccgcagcgatcgacgaagagaacgccggcgaggagctcaaagagataacctacaaaacagtggaacaaatgaacgtcagtccggccgtccggcgacaaatatggcagagcctacaagtaatcaaagaaatatgtaaagtcatgggcggacccccgaaacgagttttcgtcgaaatggcaagggaaaaaatggaaagcaaaagaaccgaatcacgtaaaaaaaggctaatagacctgtacaaaaagtgccgcgaagaagaaagggactggatcgaagaactcgggaataccgaagaaacacgactcagatcagacaagctatacctctattacacccaaaaaggacggtgcatgtatagcggcgaggtcatcgagctggaagaactatgggacaaccggaaatacgacatcgaccacatatatccacaaagcaaagtcatggacgacagtctagataatcgcgtgctcgtcaaaaaggagtacaacgcagacaaaacggacgaataccccatacgtgcagacatacggggaaaaatgcgcgccttctggcggatactaagggaggaaggcttcatctccaaagagaagtacaaccgcctgacccgaggaacaggcttcgagccaagcgagctcgcaggcttcatcgcacggcagttggttgagacgcgacaaggaacaaaggcggtcgcgtcggtgctaaaacaagtcttcccggaaaccgacatagtctacgcgaaagcacgcgtcgccagccagtttaggcaagaattcgaccttatcaaggtacgagaaatgaatgacttacaccacgccaaggatgcatacgtaaatatcgtcgtcggcaatgtctactacaccaaattcacctcgaacgcagcgtggtacgtcaaagagcacccagggcgatcctacaacctaaagaaaatgttcacgagtgaacgagatgtagcaagaaacggagaaactgcatggcgtgcaggaaactcgggaacaatcgccaccgtcaaacgcgtcatgggcaagaacaatatactggtgacccgccgctcctacgaggttaagggcggactatttgaccaacaactaatgaagaaaggtaagggccaggtacctatcaaaggcagagatgaaagactggccgatatcgataagtatggaggatacaataaggcggcaggcacgtacttcatgctcgccgaaagcgaagacaaaaaaggagccaaaatccgctcggtggaatacgtaccgctatacctctgcaactgcatagagaaggacgaagaggcggcaaaaaaatacctccagaaagaacgaggactcaaaaaccccagggttctaatcgcgaaaataaaaatcgacacgctttttaaagtggacgggttctacatgtggctaagcggaaggacaggaaaccaactaatcttcaagggcgccaaccaactaatactcagcgagccagacatgagaatacttaagaaggtcctcaagtatgtaaatcggaaaaaggaaaacaaaaatgccgtactgggtgaacacgatcagctaccggaaacagacttaatccgattatacgacgtctttctagacaaaatagaaaacaccgtataccacgtaagactctcagcccaacaaggaactctaacaaaaaacaaagacaccttctgcgaactgtcaaatgaggacaaatgcatcgtcctctcagaaattctccacatgttccaatgccagtccggatcggccaacctaaaactcatcaaaggaccaggcagcgcaggcatactagtgctgaacaacataatctcgaagtgcaaccaggtcagtatcatccaccaatcacccacagggatatacgaacaggaaatcgacctcaaaaaaatatga

SEQ ID NO: 7617 - RNA, 4020 nt, synthetic construct
  misc_feature 1..4020: note = Cas9 variant
  source 1..4020: mol_type = other RNA
atgaacaaggcctataccctgggccttgacatcgggacaaacagcgtgggctgggccgtcgttacggacgactaccgactgatggcgaagaaaatgcccgtgcactccaagatggaaaagaagaagatcaagaagaacttctggggcgcacggctgttcgacgaggggcagaccgcagaggagcgccggaacaagcgcgccacccggcgccggctccgccggagaaagtaccggatcctggagctgcagaagatcttcagcgaggagatcctcaagaaggactcccacttcttcgcccgactggatgagagcttcctgatcccggaggacaagcagtacgctaggtttcccatcttccccacgctcctggaggagaaggcctactaccagaactaccccacgatctaccaccttcgccaaaagctggcagactccaccgagaaggccgacatccggttagtctacctggcgctcgcgcacatgatcaagtaccgtgggcacttcctgttcgaaggcgagctggacaccgagaacaccagcgtggaggagacgttcaaggagtttatcgacatatacaacgagcagttcgaggagggcatcatcttctacaaagacatcccgctcatcctgaccgataaactgtccaaaagcaaaaaggtggagaagatcttacagtactaccccaaggagaagaccaccggttgcctggcccagttcctgaagttaatagtcggcaaccaggggaacttcaagcaggccttccacctggacgaggaggtgaagatccagatctcgaaggagacgtacgaggaggatctggagaaactcctgcgcaagagcaacgaagagatgatcgacgtgttcctccaggtgaagaaagtgtacgacgccatcctgctgtccgacatcctgagcaccaagatgaaggacaccaaggcgaaactctccgccggcatgatcgagcggtaccagaaccacaagaaggacctggaggagctgaagcagttcgtgcgggcccacctccacgagaaggtcaccgtgttcttcaaggactcatccaaggacgggtacgccggctacatcgacggcaagacgacccaggccgacttctacaagttcctaaagaaggagctgaccggggtgccgggcagcgagcccatgcttgcgaaaatagaccaggagaacttcctgctgaagcagcggaccccgacgaacggggtcatcccccaccaagtgcacttgaccgagttcaaagccatcatcgaccagcagaagcaatactaccccttcctggagaagtccaaggagaagatgatccagctgctcaccttccggatcccctactacgtgggaccgctggcccaggacaaggagaccagctccttcgcctggctggagcgcaagacgaccgagaagatcaagccctggaacgccaaggacgtcatcgactacggcgcgagcgccaccaagttcatccagcgcatgatcaactacgacacctacttacccacggagaaggtgctgcccaagtatagcatgctgtaccagaagtacaccatctttaacgagctgaccaaggtggcctacaaggacgaccgggggatcaagcaccagttctccagcgaggaaaagctccgcatcttccaggagctgttcaaaaagcaacggcgcgtaaccaagaagaagctgcagcacttcctctccgccaactacaacatcgaggacgccgagatcctgggcgtggacaaggtgttcaacagctcctacgcgacgtaccacgacttcctggaactcgccaagccgtacaccgagaaaatcatcgagctgctggagcagcctgagatggaggagatgttcgaggacatcgtcaagatcatcaccatcttcgaggaccgggagatggtgcgcacccaactaaagaagtaccagcggattctgggggaggagatcttcaagaagctggtcaagaagaagtacacaggctggggtcgactctctaagcggctgatcaacggcatccgcgaccagaagaccaacaagactatcctggactacctcatcaacgacgacgactttccctataaccggaaccgcaacttcatgcagctgatcaacgacgaccacctgtccttcaaggaggagatcgccaaggagctcaccctgagcgacaagcagtccctgctcgaggtggtggaggccatccccggcagcccggcgatcaagaagggcatctggcagactctgaaaatcgtcgaggagttgattgccatcatcggctacaagcccaagaatatcgtgatcgaaatggcccgggaaaaccagacgaccaccgggggtaagaaccgttccaaaccccggctcaagtctctggaggaggccctgaagaacttcgactcccagctcctgaaggaacgccccgtggacaaccagagcctgcagaaggaccggctctacctatactacctgcagaacgggaaggacatgtacactggcgagtccctcgacatcgaccgcctgagcgagtacgacatcgaccacatcatcccgcggtccttcatcgtcgaccactctctggacaacaaggtgctcgtgtccagcaaggagaaccggctgaagaaagacgacgtccccgacagcaaggtggtgaagcgcatgaaggcctactgggagaagctgctccgggcgaacctgatatccgagcgcaaattcagctacctgacgaaattggagctgaccgacgacgacaaggcccggttcatccaacgccagctggtcgagacccgacagatcactaagcacgtggccgcaatcttgcaccagtacttcaaccaaacccaggagctggagaaggagaaggacatccgcatcatcacactgaagtcctccctcgtgtcccaattccggcaggtcttcggcatccacaaggtgcgcgagatcaaccaccaccaccacgcccacgacgcatacctgaacgccgtggtagccctagcactcctgaagaagtacccccggttggcccccgagttcgtgtatggcagcttcgccaagttccacctcgtaaaggagaacaaggccaccgcaaagaaggagttctactccaacatactgaagttctttgagaaggaggagcagttctgcgacgagaacggagagatcttctgggacaagcgcaagcacatccagcagatcaagaaggtcatctcctcccaccaagtgaacatcgtgaagaaggtcgaggtgcaaaccgggagcttctataaggagacggtgaacaccaaggaaaagccggataagctgatcaagcggaagaacaactgggacgtcacaaagtacggcgggttcggctccccggtggtggcctacgcggtcgtgttcacctacgaaaagggcaagaaccacaagaaggccaaggccatcgaggggatcacgatcatggagcaggccctcttcgagaaggaccccatttctttcctgatcgagaagggctactccaacgtgaaccagttcatcaagctgccgaagtacaccctcttcgagctggccaacgggcagcgccggatgctggcgagccaccaggagctccagaaggccaactccttcatcctgcccgagaagctcgtcaccctcctgtaccacgccaaccactacgacgagatcgcctacaaggacagctacgactacgttaacgagcacttctccaacttccaggacatcctggacaaggtgatcatctttgctgagaagtacacgagcgcgccccagaagctcaaccagatcatcgccacctacgagaagaaccaggaggccgaccgcaaaatcatggcccacagcttcgtcaacctgatgcagttcaacgccctgggcgcgcccgccgacttcaagttcttcgacaccaccatcacccggaagcgctacacgtcccttaccgagatctggcagagcaccataatctaccagtccgtgaccggcctatacgagacgcggcgccggatggccgacctgtgggacggggtgcagtga

SEQ ID NO: 7618 - RNA, 4020 nt, synthetic construct; identical to SEQ ID NO: 1818
  misc_feature 1..4020: note = Cas9 variant
  source 1..4020: mol_type = other RNA

SEQ ID NO: 7619 - RNA, 4020 nt, synthetic construct
  misc_feature 1..4020: note = Cas9 variant
  source 1..4020: mol_type = other RNA
atgagcctgaacacgaacaagaagtacaacatcggcctcgacatcgggaccacgtccgtgggctgggcagtcaccgacgccgacgggcagaagttgctgaaggccaagaacaagaacctctggggcgtgtcgctgtttgaggccgggaagaccgcggccgagcgccggggctaccgctccactcggcgccggctgaaccaccgcaagttccggctccgcttactggaggacatgttcgagaaggagatcctcagcaaggacccctccttcttcatccggctgaaggaggcctttcttagccccaaggacgaacagaagcagttcaagggcaacatcctcttcaacgacaaggactacactgacgcggactactacgagcagtacaaaaccatctatcacctccgctacgatctgatctcccagcaccgacaattcgacatccgcgaggtgtacctcgccatccaccacctgatcaagtaccgggggcacttcatatacgaggaccagaccttcaccacggatggcaaccagctgcagcaccacatcaaggccattatcaccatgatcaatagcatcctcaaccgcatcatcatccccgagaccatcgacattaacgtctttgagaagaccctgttggaccggacgatgaatcgctccagcaaggtgaagttcctcatcgagctgaccggggaggacaagcaggacaagcccctgctcaaggagctgtttaacctgatcgtgggcctcaaggcgaagcccgcgtccatcttcgagcaggagaacctggccaccatagtcgagaccatgaacatgagcaccgagcaggtccaactggacctcctgaccctggccgacgtgctcgccgacgaggagtacgatctcctgctcaccgcccagaagatctactccgcgattatcctggacgagagcatggacgggtacgagtacttcgccgaggccaaaaaggagtcctaccggaagcaccaggaggagttggtgctcgtgaagaagatgctcaagtcaaacgccatcaccaacgacgagcgcgccaagttcgagtacttttacaccgactacatcggcgcgaagtccagcaactacgaggagtccaagatcatcaagaagggcctgtcagctgcctacgggaagtacagcaaggaggaacggctgttcaagcacatcgagctgctgctcgccaaggagaacgtgctgaccactgttgagcatgacctgctcgagaagaacatcaccttcgcctccctgctgccgttgcagcgcagctcccggaacgcggttatcccctaccaggtgcacgaaaaggagctcgtcgccatcctggagaaccaggccacctattaccccttcctgctcgagcagaaggacaacatacacaagctgttaaccttccgcatcccctactacgtgggccctctcgccgaccagaaggacagcgagttcgcctggatggtgcgcaaacaggctgggaagataacccccttcaacttcgaggagatggtcgacatcgacgcctccagcgaggcgttcatcaagcggatgacaaacaagtgcacgtacctgatccacgaggacgtaatccccaagcactccttcagctacgccaagttcgaggtcctcaacgagctcaacaaaatccgcctggacggcaagcccatcgacataccgctgaagaagaggatcttcgaaggcctcttcttagagaaaaccaaggtcacccacacaagtctgaagaagtggctcgcggaatatgagcacatgacggtgagcgtggtccaggggacccagaaagagacggagttcgccacctccctgcaggccttccatcgcttcgtgaagatcttcgaccgggagacggtcagcaaccccgccaacgaggagatgttcgagaagatcatctactggtccaccgtgtttgaggacaaaaagatcatgcgccggaaacttagcgagtatccccagctcaccgagcagcagcaggtccagctggcccaggtgcgcttccggggctggggtcgcctgtcccagcggttgatcaaccgcatcaagacccccgtgagcggcgacgaggaccacaagctgtccatcaacgagatcctgtggcagaccaacgagaacttcatgcagatcatcaggaacaaggactacctcttcaagaagatcatcgaggagcagttcgagaacgagacggcgctgttgaacaagcagcgcatcgacgagctcgccaccagcccggccaacaagaaggggatttggcaggccatcaagatcgtgaaggagctggagaaggtcctgcagcagcccgccgagaacatcttcatcgagttcgcgcggtccgacgaggaaagcaagcgcagcacgccccgggacaagttcatcgagaaggcctacgcccagctcaagaaggagaccgacacgttcaacctggagcatctgaaggagctcaagcagcgctccaagcagctgagctcgcagcggctgttcctctacttcatccaaaacggtaagtgcatgtacagcggcgagcacctggacatagagcgcctggattcctacgaggtggaccacatcctcccccagagctacatcaaggacaactccatcgagaacctggccctggtgaaaaaggtcgagaaccaaagaaagaaggacagcctcttactgaactccagcatcatcaaccagaactactctcggtgggagcaactcaagaacgccgggctaatcggcgagaagaagtttcgcaacctcacccggaccaagataaccgaccgcgacaaggaggggttcatcgcgcggcagctcgtggagacgcgtcagatcaccaagcacgtgactcaactgctgcagcaggagtacaaggacaccacaaaggtcttcgccatcaaggcaaccctcgtgagcgacctgcggcgcaagttcgagttcatcaagaaccggaacgtgaacgattaccaccacgcccaggacgcgttcctggtcgcgttcctcggcacaaacatcacctccaactacccgaagatagagatggagtacctgttcaaggggtaccagcactatctgaacgaggtgggcaagagcgccgccaaacccaaattcacgttcatcgtggagaatctctccaagcagcagtacaactccaccacaggcgaggtcaagtggaaccccgaggtggacatagccaagctgaagcgcatcctgaacttcaagcagtgcaacatcgtgcggaaggtcgaggagcagtccggggcgctgttcaaggagaccatctaccccgtggaggaaagcagctccaagacaatcccgctgaagaagcacctggacaccgctatctacggcgggtacaccgccgttaactacgccagctacgccctcatccagtttaagaagggccgtaagctgaagcgggagatcatcggaatccctctggcggtccagacccgcatcgacaactccgagacgagcttgcagacctatatcgccgagcagatcaagtccgaggtggaaatactgaacggtcggattctgaagtaccagctgattagcaacaacggaaaccgactatatatcgccgggccccgcgagcgccacaacgcccggcagctgatagtgtccgacgaagccgcgaaggtcatctggctcatcagcaccaagcaggccgtcgaggccaccttcctgaaacactacacgctggagcacctggaggccgtgttcgaggagttgatccgcaagcaggcggccgactaccagatcttcgagaatttaatcaagaagatcgaggttaacaaggcctacttctactcctgcacctacaatgagaaggtcaaggtgatcgaggagctcctgaagatcacccaggccaacgccaccaacggcgacctcaagctcctgaagatgacgaaccgggaggggcggctgggcagtgtctccgtggcgctcgacttcaaaataatcaaccagagcgtgaccggcctgtaccagtccatcgaggactacaacaactga

SEQ ID NO: 7620 - RNA, 4020 nt, synthetic construct; identical to SEQ ID NO: 1820
  misc_feature 1..4020: note = Cas9 variant
  source 1..4020: mol_type = other RNA

SEQ ID NO: 7621 - RNA, 4020 nt, synthetic construct
  misc_feature 1..4020: note = Cas9 variant
  source 1..4020: mol_type = other RNA
atgaagaaggagtacaccatcggcctggatatcgggaccaatagcgtaggctggtccgtcttgacggacgactaccgcctggtgagcaagaagatgaaggtggccgggaacactgagaagtccagcaccaagaagaacttctggggcgtccggctgttcgacgaggggcagaccgccgaggcgcgccggtccaagcgcacggcccggcgccggctcgcccgccggcgccagcggatcctggagctgcagaagatctttgcccccgagatcctcaagatcgacgagcacttcttcgcccgcctgaacgagagcttcctggtactcgacgagaagaagcagtcccgtcacccggtgttcgcgaccatcaagcaggaaaagtcctaccaccagacctaccccaccatctaccacctccgccaggcactggccgacagcagcgagaaggccgacatccggctcgtctacctggcgatggcccacctcctgaagtaccgaggccacttcctgatcgagggcgagctgaacaccgagaactcctccgtgaccgagaccttccggcagttcctctccacctacaaccagcagttcagcgaggccgacgacaagcagacggagaagctggacgaggccgtggactgctccttcgtcttcaccgagaagatgagcaagaccaagaaggccgagaccctgctcaagtacttcccccacgagaagtccaacgggtacctgagccagttcatcaagctgatggtgggcaaccaggggaacttcaagaacgttttcggcctcgaggaggcgaagctgcagttctccaaggagacgtacgaggaggacctggaggagctcctggagaagatcggggacgactacatcgacctgttcgtccaggccaagaatgtgtacgacgccgtgctcctgagcgagatcctgagcgactccaccaagaacacccgcgccaaactcagcgccggcatgatccggcgctacgacgcccacaaggaggacctggtcttactcaagagattcgttaaggagaacctgcccaagaagtaccgcgccttcttcggcgacaactccgtgaacgggtacgccggctacatcgaggggcacgccacccaggaggacttctacaagttcgtcaagaaggagctgacgggcatccgcggcagcgaggtgttcctgaccaagatcgagcaggagaacttcctgcggaagcagcgcaccttcgacaacggggtgatcccgcaccagatccacctgaccgagctccgggccatcatcgcgaaccagaagaagcactaccccttcctgaaggaggagcaggagaagctggagtccctcctcacgttcaagatcccctactacgtcggccccctggccaagaagcaggagaacagcccgttcgcgtggctcatacgcaagtccgaggagaagatcaagccctggaacctgcccgaaatcgtggatatggaggggagcgccgtgcggttcatcgagcgcatgatcaacaccgacatgtacatgccccacaacaaagtcctgccgaagaactccctgctctaccagaagttcagcatctacaacgagctcaccaaggtgcggtaccaggacgagcgcggccagatgaactatttctccagcatcgagaagaaggagatcttccacgagctgttcgagaagaaccggaaggtcaccaagaaggacctccaggagttcctgtacctgaagtacgacatcaagcacgccgagctctccgggatcgaaaaggcgttcaacgccagctacacgacctaccacgacttcctgaccatgtccgagaacaagcgcgagatgaagcagtggctggaggaccctgagctcgccagcatgttcgaggagatcatcaagaccctgacggtgttcgaggaccgggagatgatcaagacccgcctgtcccaccacgaggccaccctcggcaagcacatcatcaagaagctgaccaagaagcactatacgggctgggggcggctgagcaaggagttaatccagggcatccgcgacaagcaatccaacaagactattctggactacctgattaacgacgacgacttcccccaccaccggaaccgcaacttcatgcagctcatcaacgacgacagcctgagcttcaagaaggagatcaagaaggcgcagatgatcaccgataccgagaacctggaggagatcgtgaaggagctcaccgggtcccccgccatcaagaagggcatcctgcagagcctgaagatcgtcgacgagatcgtggggatcatgggctacgagccggccaacatcgtggtcgagatggcccgggagaaccagacgaccggccgcgggctcaagtccagccggcctcgcctgaaggccctggaggagtccctcaaggacttcggcagccaactgctgaaggagtaccccacagacaactcctctctccagaaggaccgcctgtacctgtactacctccagaacgggcgggacatgtacaccggcgcgcccctggacatccaccgcctgtccgactacgacatcgaccacatcatcccgcggagcttcacgaccgacaactccatcgacaacaaggttctcgtgagctccaaggagaaccggctcaagaaggacgacgtccccagcgagaaggtggtgaagaagatgcggtccttctggtacgacctgtactcctctaagctcatctccaagagaaagctggacaacctgaccaagatcaagctcaccgaggaggacaaggccgggttcatcaagcggcagctggtcgagacgcgccagatcaccaagcacgtggccggcatcctccaccaccggttcaacaaggccgaagacaccaacgagcccatccgtaaggtgcggattatcacgctcaagagcgccctggtctcccagttccgcaatagattcggcatctataaggtgcgcgagatcaacgagtaccaccacgcgcacgacgcctacctgaacggggtggtcgccctcgccctgttaaagaagtacccccagctcgccccggagttcgtgtacggcgagtacctgaagttcaacgcgcacaaggccaacaaggccacggtgaagaaggagttctacagcaacatcatgaagttcttcgagtccgacacccccgtctgcgatgagaacggggagatcttctgggacaagagcaagagcatagcccaggtgaagaaggtgatcaaccaccaccacatgaacatcgtcaagaagaccgagatccagaagggcggcttctcaaaagagaccgtggagcccaagaaggactccagcaagctgctcccccggaagaacaactgggaccctgccaagtacggtggcctgggatcccccaacgtggcctatacggtcgccttcacctacgagaagggcaaggcccgcaagcggaccaacgccctggaggggatcaccatcatggagagggaggcgttcgagcagagccccgtcctgttcctgaagaacaagggctacgagcaggccgagatagagatgaagctgccgaagtacgcccttttcgagctggagaacggtcggaagcgcatggtggcgtccaacaaggaggcccagaaggcgaacagcttcctgctccctgagcacctagtcacgctgctctaccacgccaagcagtacgacgagatctcccacaaggagagcttcgactacgtgaacgagcaccacaaggagttctccgaggtgttcgcccgggtcctggagttcgccgggaagtataccctggccgagaagaacatcgagaagttagagaagatttacaaggagaaccagaccgacgacctggcgaagctggccagctccttcgtgaacctcatgcagttcaacgccatgggcgcccccgcggacttcaagttcttcgacgtgaccataccccgtaagcgctacacaagcctgaccgagatctggcagtccaccatcatccaccagagcatcaccgggctctacgagacgcggatccgcatgggcaagtga

SEQ ID NO: 7622 - RNA, 4023 nt, synthetic construct
  misc_feature 1..4023: note = Cas9 variant
  source 1..4023: mol_type = other RNA
atgaagaaggagtataccatcggcctcgacatcgggactaacagcgtgggctggtctgtactcaccgacgactaccgcctggtgtcgaagaaaatgaaggtggccgggaacaccgagaagtccagcaccaagaagaacttttggggcgtccgcctgttcgacgaggggcaaaccgccgaggcgcgacgctccaagcgcacggcccggcgccggcttgcgcgtcggcgccagcggatcctggagctgcagaagatcttcgcccccgagatcctaaagatcgacgagcacttcttcgcccgcctgaacgagtccttcctggtgttggacgagaagaagcagtcgaggcacccggtttttgcgaccattaagcaggagaagtcgtaccaccagacctaccccaccatttaccacctccgccaggccctggccgacagcagtgagaaagccgatatccgtctcgtctacctggcgatggctcacctcctgaagtatcgcggacacttcctgatcgaaggcgaactgaacacggaaaattccagcgtaaccgagaccttcagacagttcctttccacctacaaccagcagttcagcgaggccgacgacaagcagacggagaagctggatgaagccgtggattgctccttcgtcttcaccgagaagatgagcaagaccaaaaaggccgagacactgctcaagtacttcccccacgagaagtccaacgggtacctaagccagttcatcaagttgatggtgggcaaccaggggaacttcaagaacgttttcggcctcgaggaggaagcgaagctgcagttctccaaggagacgtacgaggaggacctggaggaactcctggagaagatcggggacgattacatcgatctgttcgtccaggccaagaatgtgtacgacgcggtgctcctgtcggaaattctaagcgactccaccaagaacacgcgcgctaagctatcagccggcatgatcaggcggtacgacgcgcacaaggaggacctcgtcctgctcaagcgcttcgtgaaggagaacctgcccaagaagtatagagccttcttcggcgacaacagcgtcaacgggtacgcgggctatatcgaagggcacgccacccaggaggacttctacaagttcgtcaagaaggagctgacggggatccgcggcagcgaagtgttcttgaccaagatcgagcaggagaacttcctgcggaagcagcgcacattcgataacggggtgatcccgcaccagatccatttaacagagctccgagccattatcgcgaaccagaagaaacactaccccttcctgaaggaggagcaggagaagttggagtctctcctgacgttcaagatcccctactacgtcggccccctggccaagaagcaggaaaatagcccgttcgcctggctcatccgcaagtccgaggagaagatcaagccctggaacttgccagagatagtggacatggaggggagcgccgtgcgtttcattgagcgcatgatcaacaccgacatgtacatgccccataacaaagtcttaccgaaaaactccctgctctaccaaaaattcagcatctacaacgaactgaccaaggttcggtaccaggatgaacgcggccagatgaactatttctccagcatcgagaagaaggagatcttccacgagctgttcgagaagaaccggaaagtcacaaagaaggacctccaagaatttttatacctgaagtacgacatcaagcatgccgagctctccgggatcgagaaggcattcaacgccagctacacgacctaccacgatttcctgaccatgtctgagaacaagcgcgagatgaagcaatggctggaggaccccgagttagccagtatgttcgaggaaatcatcaagaccctgacggtgttcgaggaccgggagatgatcaagacccgcctttcccaccacgaggccaccctcggcaagcacatcatcaagaagctgaccaaaaagcactacacgggttgggggcggctgagcaaggaactcatacaaggtatccgcgacaagcagtccaataagaccatcctggactacctgatcaacgacgacgacttcccccaccaccgcaatcgcaacttcatgcagctcatcaacgacgacagcctgagcttcaagaaagagatcaagaaggcgcagatgatcactgataccgagaacctggaggagatcgtgaaggagctcaccgggagccccgcaatcaagaagggcatcctgcagagcctaaaaatcgtggacgaaattgtggggatcatgggctacgagccggcgaacatcgtggtcgagatggcccgggagaaccagacaaccggccgagggctcaagtccagcaggccgagactgaaggcactggaggagtccctcaaggacttcggatcgcagctgctgaaggagtatccaaccgacaactccagcctccaaaaggacagactgtacctgtactacctccaaaatggacgggacatgtacaccggcgcgccactggacatccataggctatccgactacgacatcgaccacatcatcccccgcagcttcacgaccgataacagcatcgacaacaaggtgctcgtaagctcaaaggagaatcgactgaaaaaggacgatgtcccctcagagaaagttgtcaagaagatgcggtccttctggtacgacctatacagctccaagctcatctcgaagcgcaagctggacaacctgacaaagataaaactaaccgaggaggacaaggccggatttatcaagcggcagctggtggagacgcgccagatcaccaagcacgtggccggcatcctgcaccaccggttcaacaaggccgaggacaccaacgagccgatccgtaaggtgcggatcataactctcaagagcgccctggtctcccaattccgcaaccggttcggcatatacaaggtgcgcgagatcaacgaataccaccacgcgcatgacgcctacttaaatggagtggtcgctctcgccctgctgaagaagtacccccagctcgccccagagttcgtgtacggcgaatatctcaaattcaacgcacacaaggcaaacaaggcgacggtgaagaaggagttctacagcaacatcatgaagttctttgagtccgacacccccgtctgcgacgaaaacggggagattttctgggacaagagcaagagcatagcccaggtgaaaaaggtgattaaccaccaccacatgaacatagtcaaaaagacagagatccagaagggcggcttcagcaaggagaccgtggagcccaagaaggactccagcaagctcctccccaggaagaataactgggacccggcgaagtacgggggactggggtcccccaatgttgcctacacggtcgccttcacctacgagaagggcaaggcccgtaagcggaccaacgccttagagggcatcaccatcatggagcgcgaggcgttcgagcagagccccgtgctgttcctgaagaacaaaggctacgagcaagccgaaatcgagatgaagctgcccaagtacgccctcttcgaactcgagaacgggcggaagcgaatggtggcctcaaacaaggaggcccagaaggcgaacagcttcctgctccctgagcacctggtcacgctgctctaccacgccaagcagtatgatgagatttcacacaaggaatccttcgactacgtgaacgagcaccataaggagttcagtgaggtcttcgcccgggtcctggagttcgcagggaagtacaccctggccgaaaagaatatcgagaagctcgagaagatatacaaggagaaccagaccgacgacctggccaagctagccagctccttcgtgaatctcatgcagttcaacgccatgggcgccccagcggacttcaagttcttcgacgtgaccattcccagaaagaggtacacgtcactgaccgagatctggcagtccaccattatccatcagagcatcaccgggctctatgagactcggataagaatgggcaagtga

SEQ ID NO: 7623 - RNA, 4023 nt, synthetic construct
  misc_feature 1..4023: note = Cas9 variant
  source 1..4023: mol_type = other RNA
atgaaaacagactactttatgggactagacatgggaaccggcagcctcggctgggccgtgacagactccagctaccacctctgccgtgcccacggcaaggacctctggggcgtaagactgttcgagaccgcacagacagccgaagaacgcagagtcttcagatgcaaccgacgacgactagaccgaagaaagagacgcatccaactgctccaggacatattcgcaccagagatctacaagatcgaccctggatttttcctccggctgaaagaatcacgctacctacccgaagacaagaaaaacctagaaggcaaaaccccggaactcccctacgcgttattcgtagataagaaatacacagataaagacttccacaaagaatacccaacgatctaccacctcaggctcaggctcatgcaagaccgtacccctgccgatgtaagactcgtctacctagcgctgcatcacctcataaaacaccgcggccacttcctgttcgccggcatagaagcggacaaggtcaccgacttcagcgcagcattcagcgagttcctacgcatagtgcaagagcaggaactagacattagtttcaccccagatgaggaaagttctcagatcataaaagaaaccctacaaaataccaacttcacccggtccaagaaatccacagagttaatcaaaggcctaaaagcaagcaccgggtgcgaaaaagcactcctcaagctcatatcaggatgtaaagtaaaactctcagcagtattcgacgacccaggctgcgacgcctacgaaaaaccacaagtctgctttgccgagagctcatacgaggactacgcagcaatccttgaagacgagctcgaagatcgattcatcgtaatagctgccgccaaagcactatacgactggtccgtcctagtaaacatactaggagaggcttccacagtatccgaagccaaggtaggcatctatgaaaaacaccgcagagacctcaaatacctaaaacatctagtcaaaaccaatctaaccagagaagactaccaggacctgttcgtcaaggccggagcaaagaaaaacaactactgcgcctatataggcatgacaaagaaaaataataaaaaggtcgtgctcgaagagaaacgatgcacaaaagaagacttctacgcatacctcaagaaagaaatctacagcaaagtccaagaaaatcccgaggctgagtaccttctagaggaactagagaaagggactttcctgcctcgacaagtttccaaggacaacggagtaatcccctaccaactccaatttcttgaactccaaaagatcctcaaaaacgccgtagaatacctaccgttcctaaaagaggagtccgagaaaattcaacagatcatgacttttaggataccatactacgtcggccccctcaacggcaagaaagaaggacaaaatacgtttgcatgggcagtacgcaaaaacaacgaacccgtctatccatggaacttcgaagaagtcatcgataccgaggcatccgccgaacaattcataagacgaatgaccaacaagtgcacatacctgccaggcgaggacgtactaccaaaggaaagccttctatattcaaagttcatggtactgaacgaactaaacaatctgaggatcaacgggaccaaaatctccgtcgaactcaaacaagagctgtacgaaaagctgttccaaagataccgcaaagtgtccgcaaagaaactccgagattacctagttcgaaacggaataaccgaaaaagacgccgaaatctcggggatcgacggggactttaaaggcaccctccgcgcataccatgacttcaaagagaagctaacaggtgtggaactgacagaagcagagaaagaaaccatcatactaaacataactctcttcggcgaggacaaggtcctcctcaagaagcgaatgcaaagactactacccaacttgacagaaggccagaaaaaggccatcgtaaccctaaactattcaggctgggggaggctatcacgagagttcttagaagaagtgcaagcccccaacccggaatccggagaaatactttcaataatacgcgcgctgtgggaaaccaacgccaatctaatgcagctgctgtccaaccagtacggataccaagaaatccttgagcaaatgcgagccgactggacagggcataaattagactaccagacagtggaggaactgtacgttagccccgcagtcaaacgccaaatctggcaaacactacaagtcgtcaaagagctgaaaaaggtaatgggaggcgaaccaaagagggtatttctagaagtcgcccgggagaagatggagtccggacgcacggtatcccgaaagaaacacctaaaggacctctacctaagctgcaaatcagaggaacggaactggctcgccgaactagaccgacacgaggaacactcatacaggtctgaccgccttttcctgtactacacacagaaaggccgctgcatgtactgcgggaaaccgatcgacttaggacacctgtgggacgtcaacatgtatgacatcgaccatatctacccccagtccaaagtgatggacgactcaattcgcaaccgtgtactcacgtgcaggacctgtaacgccgagaaaacagaccactaccccctcaaagccgaaatcagacagaaaatgcggcccttctgggactcgctcaaggcgggaaacttcatagaagaggaaaagtggaaacgactaattcgctccgaagagtttacctccaccgagctggccgggttcatcgaacgtcagttagtagaaacccgccagagcaccaaagccgtggcggacatcctaaaacaagcaatgccagaaacggaaatagtttacgtgaaggccaaaaacgtatccgcgttcagacaagacttcaatttcgtcaagaaccgagacgtaaacgacttccaccacgcgaaggacgcctacctcaacatagtcgtcggaaacacatacttcgtcaaattcaccaagaacgcctcgtggttcatcgaaagaaacccaggacgatcctacaatctaaagcgaatgttcacctcagactacgacgtgatgtcaaatggagagatagcttggaaagccggcaattccggaacaatcaccacagtacgcaaaatgatgaaaaagaactctgtgctgttcacgcgacgctcctttgaggttagcggcggcttgttcgaccagcagcttatgaagaaaggaaaaggccaggtatacgtcaaatcaggggacgaacggctccgcagcatcgaaaagtatgggggctacaacaaagccaccggagcatacttcatgctcgtggagtcagaagggaaaaagggagtaaagaaacgcaccatagagttcgtccccctgtaccggaaagctgaacttgaagcctccgaagagaaaatgctcgaatacctccgcacagaaatcggcctcaaggagccccacgtattactacacaagatcaaaaccgacacgctattccaagcggacgggttcaagatgcacctgtcagggcgaaccggaaaacagctagtgttcaaaggcgcaaaccaattcctcgtagcagaagactacgaacgcctacttaagaaagtcggaaaagtgaccgaacaactaaaaacaaacaaaaactacaaaataaacgactacgatggcattacagaggaaggcctcaaagctctctactccgagttcctatcgaaactacagaaggcaccctacggaaaccgtctgggcacacaagcagagacgctcgaaaacggcaaggaaaagtttgacaagctcagtctcgaaaacaaatgccaagtgctctcagagattctccacctcttccagtgtaacagcagcgcagcagacctgtccaaactaggtggaccaggccacgggggaatacttgtcctgagcaacgagatcaccaagtgcaacaagatctccatcatacaccaatccccagccggcatatacgaacaagaaattgacctgaagacactatga

SEQ ID NO: 7624 - RNA, 4023 nt, synthetic construct
  misc_feature 1..4023: note = Cas9 variant
  source 1..4023: mol_type = other RNA
atggagcaggagtactacttaggcctcgacatggggaccggaagcgtggggtgggcagtcaccgactccgagtaccacgtgctgcgcaagcacggcaaggctctgtggggcgtgcgcctcttcgagtctgcgtccactgctgaggagcggcggatgttccgcacttctcggcgccggctggacagacggaactggcgcatcgagatcctccaggagatcttcgccgaggagatctcgaagaaggaccccgggttcttcctccggatgaaggagagcaaatactaccccgaggacaagcgagacatcaacggcaactgccccgagctgccctacgccctgttcgtcgacgacgacttcaccgacaaggactaccacaagaagttcccgaccatttaccacctccggaagatgttgatgaacacggaggagaccccggacatccgcctggtgtacctcgccatccaccacatgatgaagcacagaggtcacttcctgctgtccggcgacatcaacgagatcaaggagttcgggaccaccttcagcaagctcctggagaacatcaagaacgaggagcttgattggaatctcgagctgggcaaggaggagtacgcggtggtcgagtccatcctgaaggacaacatgctcaaccgcagcacgaagaagacacggctgatcaaggccctgaaggccaagtccatctgcgagaaggccgtactcaacctgctggccgggggcaccgtgaagctcagtgacatcttcggcctggaggagctgaacgagaccgagcgccccaagatctccttcgccgacaacgggtacgacgactacatcggcgaggtggagaacgagctcggggaacagttctacattatcgagacggccaaggccgtatacgactgggccgtgctggtcgagatcctcggcaagtatacctcgatctctgaggcgaaggtggccacctacgagaagcacaaaagcgacctccagttcctgaagaaaatcgtgcggaagtacctgaccaaggaggagtacaaggacatcttcgtctccacgagcgacaagctcaagaactactccgcctacatcggcatgaccaagatcaacggaaagaaagtagacctgcagagcaagagatgcagcaaggaggagttctacgacttcattaagaaaaacgtgcttaagaagctcgagggccagcccgagtacgagtacctgaaagaggagctggaacgggagaccttcctcccaaagcaggtcaaccgcgacaacggggtgatcccgtaccagatccacctgtacgagctgaagaaaatcctcggcaacctgcgcgacaagatcgacctgatcaaggagaacgaggacaaactcgtgcagctattcgagttccggatcccctactacgtcgggcccctgaacaagatcgacgacggcaaggagggcaagttcacctgggccgtgcgcaagtccaacgagaagatatacccctggaacttcgaaaacgtggtcgacatcgaggccagcgcggaaaagttcatccggcgcatgacgaacaagtgcacctatctgatgggggaggatgtgctcccgaaggactcgctgctgtacagcaagtatatggtcctcaacgaactaaacaacgtgaagctggacggcgagaagctctccgtggagctaaaacagcgtctgtacaccgacgttttctgcaagtataggaaggtaactgtgaagaagatcaagaactacctcaagtgcgaggggataatctctggtaacgtcgagatcacggggatcgacggggacttcaaggcctccctgaccgcataccacgacttcaaggaaatcctgaccggcacagagctcgctaagaaggacaaggagaacatcatcacgaacatcgtgctgttcggggacgacaagaagctgctcaagaagcggctgaaccgtctgtacccccagatcacccccaaccagctcaagaagatctgcgccctaagctacactggctgggggcggttctccaagaagtttctggaggaaataaccgcgcctgacccggagacgggagaggtgtggaacatcatcaccgccttatgggagagcaacaacaacctgatgcagctgctctccaacgaataccgcttcatggaggaagtcgagacctacaatatggggaagcaaaccaagacgctgagctacgagaccgtggaaaacatgtacgtaagccccagcgtcaagcggcagatctggcagaccctgaagatagtgaaggagctcgagaaagtgatgaaggagtcccccaagcgcgtcttcatcgagatggcccgggagaagcaggagagcaaacgcaccgagtcccggaagaagcagctgatcgacctgtacaaggcctgcaagaacgaggagaaggactgggtgaaggagctcggggaccaggaggagcagaagctgcgcagcgacaagctgtacctctactacacccagaagggccggtgcatgtactccggagaggtgatcgaactgaaggacctgtgggacaacacgaagtacgacatcgaccacatctacccacagagcaaaaccatggacgacagcctcaacaacagggtcctggtgaagaagaagtacaacgctaccaagtccgacaagtacccgctgaacgagaacatacggcacgagcgcaagggcttctggaagtccttgctggatgggggattcatcagcaaggagaagtatgagcggctgatccggaacacagaactcagccccgaggaactggcgggcttcatcgagcgccagatcgtggaaacgcggcagtcgaccaaagccgtcgccgagatcctgaagcaggtcttccccgagagcgagatcgtgtacgtgaaggccgggaccgtgtcccgcttccgcaaggacttcgagctcctgaaggtgcgggaggtcaatgacctgcaccacgcgaaggacgcctacctcaacatcgtggtgggcaacagctactatgtcaagttcaccaagaacgcctcctggtttatcaaggaaaaccccggccggacgtacaacttgaagaagatgttcaccagcggctggaacatcgaacgcaatggggaggtggcctgggaggtgggcaagaagggcaccatcgttaccgtgaagcagatcatgaacaagaacaacatcctagtgacgcgccaggtgcacgaggcaaagggcggcctcttcgaccagcagatcatgaagaaggggaaggggcagatcgcgatcaaggagaccgacgagcggctggcatccatcgagaagtacgggggttacaacaaggccgccggcgcctacttcatgctggtggagtctaaagacaagaaggggaagacgatccggactatcgagttcatcccgttgtacctgaagaataagatcgagtccgacgagtcgatcgcgctgaacttcctcgagaagggccgcgggctgaaagagcccaagatcctgctcaagaagattaagatcgatacgctgttcgacgtggatggcttcaagatgtggctctccgggcggaccggcgatcgcctcctgttcaagtgtgccaaccagctgatcctagacgaaaagataatcgtaaccatgaagaagatcgtgaagttcatccagcggcgccaggagaaccgggagctgaaactgagcgacaaggacggcattgacaacgaggtgctcatggagatctacaacacctttgtcgacaagctggagaacacggtgtaccgcatcaggctgtccgaacaggccaagaccctcatcgacaagcagaaggagttcgaacgcctgtctcttgaggacaaaagctccaccctcttcgagatcctgcacatcttccagtgtcagagctccgcagccaacttaaagatgatcggcgggcccgggaaggcggggatcctcgtgatgaacaacaacatcagcaagtgcaacaagatctccatcatcaaccaaagccctaccgggatcttcgagaacgagatcgacctgctgaagatctga

SEQ ID NO: 7625 - RNA, 4023 nt, synthetic construct
  misc_feature 1..4023: note = Cas9 variant
  source 1..4023: mol_type = other RNA
atgggtgaggagtactttttggggctcgacatgggcaccgggagcctgggatgggccgttacggacgacaagtaccagatcctgcgccggcacgggaacgccctctggggcgtccgcctgttcgagactgcgaacaccgccgaggagcgtcgcatgttccggaccaaccgccggcgcctggaccggcagggctggcgcatcaagatcctccaggagctgttcgccgaggagatctgcagggtggaccccgggttctacctgcgtatgaaggaaagcaagtactacccggaggacaagcgggacgccaacggcgagtgccccgccctcccctacgcgctgttcgcagacgcccagtacaccgacaaggactatcaccgcgagttccccacgatctaccacctccggaagatgctgatggagaccgagaccacccccgacatccgcctggtgtacctggccttccaccacatgatgaagcaccgggggcatttcctcctaagcggcgacatctcacaggtcacggagttccgcaacaccttcctgcagatgatcgcgaacatcaagagcgaggagctcgacttctccctggagatcgaagagacccagatggggcagatcgaagccgtgctgaaggaccacaagctcacccggagcgagaagaagcgccggctgacgcagatcctgaagcccgccaccgcctgcgagaaggccatctttaccctcctgagtggcgggaccgtgaagctctccgacatcttcgggaaggcggagctcgatgagggcgagcgccccaagatctccttcgccgacaacgggtacgacgactacagcgcctccgtcgaggccgacctgggcgagcagtactatatcatcgagagcgccaaggcggtgtacgactggtccgtgctgagcgacatcctcggggactccgtcagcatctccgacgccaaggtgaagctgtacgagaagcacaagaaggacctggcctaccttaagaaggtggtccgcgaaaaccttccccgggaagtgtacaaccaggtgtttgtcaacactgacgagaagctgtgcaactactgcgcgtacatcgggatggccaagaaaaacgggaggaaggtggcgctcgagggtaaacgctgcacccgcgaggagttcgagagcttcctgcggaagaagatcgtcaacaagatcgaggacaaggagatccaggagtacctgtccgaggagatcgagaagggcaccttcctcccgcgccaggtcaccaaggacaacggggttatcccctaccagatccacctgtacgagctgcggaagataatcgacaacctcagcccccgcatgcccttcatccgggacaacggcgacaagatcatccagctgttcacgttccggataccgtactacgtgggccccctggggaagggcgaggggagcgagaagttctcctgggccgttcggcgcaccgacgaggcaatctacccctggaactttaaagacgtgatcgatgtggaagccagcgctgagaaattcatctgccggatgaccaacaagtgcacctacttgtacggcgaggacgtcctgcccaaagactcgccgctatatagcaagttcatggtgctcaacgagctgaacaacctgaagctggacgggcagtccgtcagcgtggagctcaagcaacgcatctaccaggagctgttctgccacacgcggaaggtgacccagaagaagctggtctcctacctcgtgcgcgagggtatcaccggcaagaacgtggagatcagcgggatcgacggagacttcaaggcgtccctaaccgcctaccacgacttcaaggagaagctgacgggggtcgagctcagccagcaggagcaggaggagatcgtgcggaacatcgtgcttttcggcgaggacaagaagctgcttaagcagcgcctggaggggcggttcccccagctgacacagaagcagatctccgtcatcgccactctcagctacaagggctggggccgcctgtcccgcgagttcctggagaacataaccgtgcccgcccccgggacgggcgaggtgtggaacatcatcaccgcgctctgggagaccaacgacaacctgatgcaactgctctacggggagtacggcttccagacggagatcgagtgcttcaacgcaaaggagaagaagaagtccctcagctacgagacgatcgaggagagctacgtctccccgagcgtgaagcggcagatctggcagaccctccaagtggtcaaggagctgaagaaggttatgcgcggcgaccccaagcgtgtgttcatcgagatggcccgcgagaaccaggagtccaagcggaccgagagccgcaagaagaccctgcttgacctctacaagaactgcaagaaggaggagcccgagtggatcgccgagctaaccgagcacctggagaaacttgacgacagccagctgcggaaggacaagctgttcctttattacacgcagaaggggcgctgcatgtactccggcgagcggatcgaactggaagacctgtgggacaacacacgctacgacatcgaccacatctacccccagtcaaagaccatggacgactccgtcgacaaccgggtgctggttaaaaaggagtacaacgccaagaagaccgacgtctacccgatcgcggcagacatccgcgggaagatgtcgcccttctggaagaagctgctggacaataaactcataagcaagaagaagtacgaccggttggtgcgcacagaagaactgacccccgaggagctcgccggcttcatcgaccggcagctggtggagacccgccagagcactaaggtcgtggccgagatcctgaaggaggccttcccagacaccgagatcgtttacgtcaaggcggggaatgtgtccaacttccgacacatgttcgacatcgtgaaggtccgcgagctcaacgatctgcaccacgccaaggacgcctacttgaacatcgtggtgggcaacgcctactacgttaagttcaacaagaacgccgcatggttcatcaaggagaacccgggtcggagctacaatctcaaacgcatgttcgactacgacatccgccgcaacaacgaggtggcctggctggccgggtccacaggcaccatcagccaggtgaagaacatggtctccaagaaccacatcttggtgacccgcaagagctacgaggtgaccgggggcctcttcgaccagcaactgatgaagaaggggaagggccaggttcccgtgaagacgtccgacgagcggctgggcaacatcgagaagtacgggggatacaacaaggcctccggggcgtacttcatgctcgtgaagtccaaaaacaagaagggcgaggaacagcgcacaatcgagtacgtccccatctacctgaagcactacatcgaggaaagcaaggagaacgccctcgactacctcaagaacgagcggaagctgaacgagccggagatcctgctcgataagatcaagaaggacaccctgttccgcgtgaacgggttctacatgtgcctgagtaagcggacgggcaagcaactggccttcaagggggccaacgagctgctgctccccgaacccgagactctgctgctcaagaagatcaccaagtacatacagcgccggaaggagaacaaggacctgaagctgaccaagcaggataacatcacggagaaggagctcctggagctgtatgacgtgttcaccgaaaagctcaaccacagcgtctacgccgtgtgcctggggacccaaggcaagaccctggtgcagaagaagcccgcgttcgttgccctcccggtggaggagaagtgcatcgtgttaagcgagatcctgcacctctttcagtgccagtccgggagcgccaaccttaaacttatcggcgggcccgcctccgcagggatcctatacctgaacagcaacatttccgacgcgggcgagatcctgatcattaaccagagcccctccgggatcttcgaaaagcgcatcgacctcctgcgtctgtga

SEQ ID NO: 7626 - RNA, 4023 nt, synthetic construct
  misc_feature 1..4023: note = Cas9 variant
  source 1..4023: mol_type = other RNA
atgaagaaggaatacaccatcggcctggacatcgggaccaactcggtgggctggtccgtcctcacggacgactaccgcctggtgagcaagaagatgaaggtcgccgggaacacggaaaagtccagcaccaagaagaacttctggggcgtccggctgttcgacgaggggcaaaccgccgaggcgcgccggtccaaacgcacggcccggcgcagactcgcccgccggcgccagcggatccttgagctgcagaagatctttgctcccgagatcctcaagatcgatgagcacttcttcgcccgcctgaacgagagcttcctggtgccggatgagaagaagcagtcccggcaccccgtgttcgcgaccatcaagcaggagaagtcctaccaccagacgtaccccaccatctaccacctccgccaggcgctggccgacagctctgagaaggccgacatccggctggtctacttggcgatggctcacctcctgaagtaccgcggccacttcctcattgagggcgagctgaacacggagaactccagtgtaaccgagacgtttcggcagttcttatccacctacaaccagcagttcagcgaggccggggacaagcagacggagaagctcgacgaggccgtggactgctccttcgtctttaccgagaagatgagcaagaccaagaaggccgagaccctgctgaagtacttcccccacgaaaagagcaacggctatctgagccagttcatcaagctgatggtggggaaccagggcaactttaagaacgtgttcgggctggaggaggaggcgaagctccagttctccaaggagacgtacgaagaggatctggaggagctgctcgagaaaatcggcgacgactacatcgacttattcgtccaggccaagaacgtgtatgacgccgtgctgctcagcgaaatcctgagcgactccaccaagaacacccgcgccaagctgagcgccggaatgatccggagatacgacgcgcacaaggaggacctcgtcctgctgaagcggttcgtgaaggagaacctcccgaagaaataccgcgccttcttcggggataattcggtgaacggctacgccggctacatcgagggccacgccacccaggaggccttctacaagttcgtcaagaaggagttaacgggcatccgcgggagtgaggtgttcttaaccaagatcgagcaggagaacttcctccggaagcagcgcacctttgacaacggcgtgatccctcaccagatccacctgtccgagctgcgggcgatcatcgccaaccagaaaaagcactaccccttcctgaaggaggagcaggagaagctggagagcctgctcaccttcaagatcccctactacgtggggcccttagccaaaaagcaggaaaactcacccttcgcctggctgatccgcaagtccgaggagaagatcaagccctggaacctccccgagatcgtggacatggaaggctccgcagtgcggtttatcgaacgcatgatcaacacggacatgtacatgccgcacaacaaagtcctgcccaagaatagcctgctgtaccagaagttctccatatacaatgagctcaccaaagtgcgataccaagacgagcgggggcagatgaactacttcagttccatcgagaagaaggagatctttcacgagctgttcgagaagaacagaaaggtcaccaaaaaggacctacaggagttcctctacctgaagtacgacatcaagcacgcagagctgagcggcatcgagaaggccttcaacgcctcctacaccacgtatcacgacttcctcaccatgagcgagaacaaacgcgagatgaagcagtggctggaggaccccgagctggcctccatgttcgaggagatcataaagacgctcaccgtgttcgaggaccgggagatgatcaagacgcgcctgagccaccacgaggcgaccttaggcaagcatatcatcaaaaagctcaccaagaagcactacaccgggtggggccggttaagcaaggagctgatccaagggatccgcgataagcagagcaacaagacgatactcgactacctgatcaacgacgacgacttcccccaccaccggaaccgaaacttcatgcagctgatcaacgacgacagcctctccttcaagaaggaaatcaagaaggcccagatgatcaccgacaccgagaacctggaggagatcgtgaaagaactgaccggcagtccggccatcaagaaggggatcctgcagtccctgaagatcgtcgacgagatcgtgggcatcatgggctacgagcccgccaacatcgtggtcgagatggctcgggagaatcagaccacggggcgcggactcaaaagctcccggccccgcctgaaggcgttagaagagagcctgaaggacttcggttcccagctcctgaaggagtaccccaccgacaacagctccctgcagaaggaccgcctctacctgtactacctgcagaatggccgggacatgtacaccggggccccgctcgacatccaccgcttgtctgactacgacatcgaccacataatccccaggtccttcaccacggacaacagcatcgataacaaggtgctggtgtccagcaaggagaaccgcctcaagaaggacgacgttccctccgaaaaggtggtgaaaaagatgcggagcttttggtacgatctgtactccagcaagctgatctccaagagaaagctcgacaacctgaccaagatcaagctgaccgaggaggacaaggccggcttcatcaagcggcagctcgtcgaaacccgccagatcacgaagcacgtggccggcattctgcaccatcggttcaacaaggccgaggacaccaacgaccccatccgcaaggtgcgcatcatcaccctgaagtccgctctcgtcagccagttccgcaaccggttcgggatctacaaggtgcgcgagatcaacgagtaccaccacgcccacgacgcctatctgaacggtgtggtcgccctggccctcctgaagaagtacccacagctggctcccgagttcgtgtacggggagtacttgaagttcaacgctcacaaagccaacaaggccacagtgaaaaaggagttctactccaacatcatgaagttcttcgagagcgacacgcccgtctgcgacgagaacggcgagatcttctgggacaaatccaagagcatcgcacaagtgaagaaggtgatcaaccaccaccacatgaatatcgtcaagaagaccgagatccagaagggcgggttctccaaggagaccgtagagccaaagaaggacagctccaagctgcttccgcggaagaacaactgggaccccgcgaagtacggcgggctcggcagcccaaacgtggcctacaccgtcgccttcacgtacgagaaggggaaggcccgcaagcggaccaacgcgttagagggcatcaccatcatggagcgcgaggcgttcgaacaatccccggtgcttttcctcaaaaacaagggctacgagcaggccgagatcgagatgaagctgcccaagtacgctctgttcgagctcgaaaacgggcggaagcgcatggtggccagcaacaaggaggcgcagaaggccaactccttcctgctgcccgagcacctcgttaccctgctgtaccacgccaagcagtacgacgagatctcccacaaggagtccttcgactacgtgaacgagcaccacaaggagtttagcgaggtgttcgcccgcgttctcgagttcgccggcaagtatacgctggcggagaagaacatcgagaagctagagaagatctataaggagaaccagaccgacgacctcgccaagctggcctccagcttcgtgaacctgatgcagttcaacgccatgggggcgcccgccgacttcaagttcttcgatgtgacaatcccgcgcaagcgctacacatccctcacggagatctggcaaagcaccattatccaccaaagcatcaccggcttatacgagacccggatccgaatggggaaatga

SEQ ID NO: 7627 - RNA, 4023 nt, synthetic construct
  misc_feature 1..4023: note = Cas9 variant
  source 1..4023: mol_type = other RNA
atggaacaggagtactacctgggcctcgacatggggaccggcagcgtggggtgggcagttaccgacagtgagtaccacgtgctgcgcaagcacggcaaggccctgtggggcgttcgactcttcgagagcgcgtccacggccgaggagcgtcggatgttccgcaccagccggcgccggctggaccgccggaattggcgcatcgagatcctgcaggagatcttcgccgaggagatctccaagaaggaccccgggttcttcctccggatgaaggagagcaagtactacccggaggacaagcgtgacatcaacggcaactgccccgagctgccctacgccctgttcgtcgacgatgacttcaccgacaaggactaccacaagaagttccccaccatctaccacctccggaagatgctgatgaacacggaggagaccccggacatccgcctggtgtacctcgccatccaccacatgatgaagcaccgggggcactttctgctgtccggcgacatcaacgagatcaaggagttcgggaccaccttcagcaagctcctggagaacataaagaacgaggagctggactggaacctcgagctgggcaaggaggagtacgcggtggtcgagtccatcctgaaagacaacatgctcaacaggagcacgaagaagacgcggctgatcaaggccctgaaggccaagtccatctgcgagaaggccgtgctcaacctgctagccgggggcaccgtgaagctcagcgacatcttcggcctggaggagctgaacgagaccgagcgccccaagatctccttcgcggacaacgggtacgacgactacatcggcgaggtcgagaatgagctcggggagcagttctacatcatcgagacggccaaggccgtgtacgactgggccgtgctggtcgagatcctgggcaagtacaccagcatctccgaggcgaaggtggccacctacgagaagcataagagcgacctccagttcctgaagaagatcgtgcggaagtacctgaccaaggaggagtacaaggacatcttcgtctccacgagcgacaagttaaagaactactctgcctatatcggcatgaccaagatcaacgggaagaaggtggacctgcagagcaagcgctgcagcaaggaggagttctacgacttcatcaagaagaacgtgctgaagaagctcgagggccagcccgagtacgagtacctgaaggaggagctggagcgggagaccttcctccccaagcaggtcaaccgcgacaacggggtgatcccgtaccagatccacctgtacgagctgaagaagatcctcggcaacctgcgcgacaagatcgaccttatcaaggagaacgaggacaagctcgtgcagctgttcgagttccggatcccctactacgtcgggcccctgaacaagatcgacgacggcaaggagggcaagttcacctgggccgtgcgcaagtccaacgagaagatctacccctggaacttcgagaacgtggtcgatatcgaggccagcgcggagaagttcatccggcgcatgacgaacaagtgtacctacctgatgggggaggacgtgctcccgaaggactccctgctgtacagcaagtacatggtcttaaacgagctgaacaacgtgaaacttgacggcgagaagctctccgtggagctgaagcagcggctgtacaccgacgtcttctgcaagtaccgcaaggtgacagtgaagaagatcaagaactacctcaagtgcgaggggatcatcagcggcaacgtcgagattacagggatcgacggcgatttcaaggcctccctgaccgcctaccacgacttcaaggagatcctgaccgggaccgaactcgccaagaaggacaaggagaacatcattacgaacattgtgctgttcggggacgacaagaagctgctcaagaagcggctgaaccgcctgtacccccagattacccccaaccagctcaagaagatatgcgccctgagctacaccggctggggtcggttctccaagaagttcctggaggagatcaccgcgcccgacccagagacgggcgaggtgtggaacatcatcaccgccctctgggagagcaacaacaacctgatgcagctgctctccaacgagtaccgcttcatggaggaggtcgagacctacaacatggggaagcagaccaagacgctgagctatgagaccgtggagaacatgtacgtgtcccccagcgtcaagagacagatctggcagaccctgaagatcgtgaaagagctcgagaaggtgatgaaggagtcccccaagcgcgtcttcatcgaaatggcccgggagaagcaggagagcaaacgcaccgagtcccggaagaagcagctgatagacctgtataaggcctgcaagaacgaggagaaggactgggtgaaggagctcggcgaccaggaggaacagaagctgaggagcgacaagctgtacctctactacacccagaagggccggtgcatgtactccggggaggtgatcgagctgaaggacctgtgggacaacacgaagtacgacatcgaccacatctacccccagagcaagaccatggacgacagcctcaacaaccgcgtcttggtgaagaagaaatacaacgccatcaagtccgacaagtacccactgaacgagaacatccggcacgagcgcaagggcttctggaagtccctcctggacgggggcttcatcagcaaagagaagtacgagcgcctgatccggaacaccgagctcagccccgaggagctggcgggcttcatcgagcgccagatcgtggagacccggcagtccacaaaagccgtcgccgagatcctgaagcaggtcttccccgagagcgagatcgtgtacgtgaaggccgggaccgtgtcccgcttcaggaaggactttgagctcctgaaggtgcgagaggtcaacgacctgcaccacgcgaaggacgcctacctcaacatcgtggtgggcaacagctactacgtcaagttcaccaagaacgcctcctggttcatcaaggagaaccccgggcggacctacaacctgaagaagatgttcaccagcggctggaacatcgagcgcaacggggaggtggcgtgggaggtgggcaagaagggtaccatcgtcactgtgaagcagatcatgaacaagaacaatatcctggtgacgcggcaggtccacgaggccaagggcggcctcttcgaccagcagatcatgaagaaggggaagggacagatcgccatcaaggagacggacgagaggctggcctccatcgaaaagtacgggggctacaacaaggccgccggcgcctacttcatgctggtggagagcaaggacaagaaggggaagaccatccggaccatcgagttcataccgctctacctgaagaacaagatcgagtccgacgagagcatcgcgctgaacttcctcgagaagggccgcgggctaaaggagcccaagatcctgctcaagaagataaagatcgacaccctgttcgacgtggacgggttcaagatgtggctgtccggccggacgggcgaccgcctcctgttcaagtgcgccaaccagctgatcctcgacgagaagattatcgtcaccatgaagaagatcgtgaagttcatacagcggcgacaggagaaccgagagctgaagctgagcgacaaggacggcatcgacaacgaggtgctcatggagatctacaacacctttgtcgataagctggagaacaccgtgtatcgcatccgactgtccgagcaggccaaaacgctcatcgaccgccagaaggagttcgagcggctgagcctggaggacaagagctccaccctcttcgagattctgcacatcttccagtgccagagctccgccgccaacctgaagatgatcgggggccccgggaaggcgggtatccttgtgatgaacaacaacatcagcaagtgcaacaagatctccatcatcaatcagagccccaccgggatcttcgagaacgagatcgacttactgaaaatatga

SEQ ID NO: 7628 - RNA, 4026 nt, synthetic construct
  misc_feature 1..4026: note = Cas9 variant
  source 1..4026: mol_type = other RNA
atgcgcttccagaacaagaagaccggtgactacttcgtggggctggacatcggcacaaacagcgtcgggtgggccgtgacgaacgagaagtacgagatcctccgggccaagaaccaccgcatgtggggctcccggctgttcgaggaggggaagaccgcggaggagcgccgggtgcaccgtgccggtcggcgccggctgaaccgccggaacgaccgcctcatgatcctggaggacttgttcgccgaggagattagcaaggtcgacaaggcattctaccagcgcctccacgagtcccagtaccgccaggagcacaagaccgtgagcggcccctacttcctgttcaacgacaaggagttcaccgacgaggactaccacatagactacccgacgatctaccacctccgggtggcactgatgaaggcgcccgccaaggacgtccgcctgctgttcctcgccatccaccacatcatcaagtaccgggggaacttcctgcacgagggcgagaccttcaagaccaccgggggcctgacggacatcctccaacgcgtgctggcctgcaacgagttctcggggctgaagcagcacatcgacgacaccgcgctcgtgaagctgctgaccaacaagggcatcacacggagcgacatcgccaagcagatctccgagctcgccacggacaagctgtaccgcaagcaggccaaggccttcgcgagcctggtcctcggcttaaaggccaacctggacgacctcttcaacgagcccgaatacaaggagctggactccgagatccggaccgtggagttcagcgggaaggagtactgggaggagcgcgataaatacgagccctacctgggcgagtcgctgttcgccctggacggctgcaagaccttatacgacaccctcctgctgagcaatatcaagccggacggcaagtacctctcagaggccaaggtggagacgttcgagaagcaccacgagcacctggagagcctgaaggacctcctgaagtccaacaaggccctgtacaaccgcgtcctccgggacgacgagaagaacctgaacaactacatcacctacatcggcaagagcgagttcaacaagcgctgctcccgggacgagttctacaagttcctgaaacagaccatcaaggacatcagcgataacgagaacaaggcggagatcgtgcagctcatggagctggacagtttcctgcccctcctgcgcgtgcgggagaacggggtcatcccctaccagatccacgaggaggagctggagcagatcctgaacgtgagcagcgagaagtaccccttcctcaacaaggccgacggctccgggttcaccatcgcccagaagatcctgaagctgctcacgttccgcatcccgtacttcgtaggccccctgaaccccgcccacaaggaccgggacaacgggttcgcctgggtcgtgcgcaaggcgcccggcaaggtgtacccgtggaacttcgaggacaaggtcgacatcagcgcctccgccaccgccttcatcgagaatctgaccaacaagtgcacctacctgatcggcgaggacgtgctgcccaagtacagcctggcctactccaagttcagcttgctgaacgagctgaacaacctccggtacgatgggaagcccctgtcctacgagacgaagcagagcttcatcaaggactgcttcgagaaggagcaccgcaagatgaccgaaaagcggatccgcgagttcctgaagcacctcggagggaccgacggcaagggagcgctgactggcctggatgtggacatcaagtccgacctcaagagctaccgggacatggtccgcattctgggcgacgggttcgacgagacgatggccgagcggatcatccgctacgtgaccctgttcggcgaggccaagaaggtcctcctgtccaccctggagatagagttcggggacgacctcagcgacacacagaagaagcagatcctgaagctgcagtaccgggactggggccgcctctccgccactctgctgaaggggatcaagggcgtggcgggcgacaaccccgaatgcagcatcctcgagtgcatggagcagcagccgctgaacctgatggaggtgctctccagccacaacacctacctggccgctatcgaggagttcaacaaggaacggaccgagcccaccgacatcgtcgactacaagctggtggacgacctctacatctcccccgccgtgaagcgcagcgtctggcagacactgcgcatcctggatgagatcaccaagttacgggggtccgtgcccaagaaggtgttcgtcgaggtggcccgcacgaaccgggcggagaagaagaagaccgacagccgcaaggagcggctgctgcagctctacaaaaccatcaaggacgagggccgcaactggacggaggagatcaagcaacgggacgccggggacttcaacagcaagaagctgtttctgtactacacccagcagggacgctgcatgtactcaggcgagaagatcaccagcattggggacctcttcacctccaagtatgacatcgaccacatctacccgcggagcgtgacgaaggacaactcctgggacaacctggtcctggtgaaggccgagctcaaccgcgagaagaaggacatctacccaatcgagaaggacacccaggaccggtgcatcagcctgtggaagcagctgctcgagcagggcctgatctccgaacgcaagtacgagcggctggtgcgcaccacgcccctgaccgccgacgagctggccgacttcgtcaaccggcagctggtggagaccaaccagagcgtaaaggcggtcaccaacctcctgaagcgcctgtaccccgacaccacgatctgctacgtgaaggccgagaacgtgtccgacttcaggcaagagcgcgagttcgtcaagctccggagcctgaacgcccaccaccacgccaaggacgcctacctgaacatcgtcgtagggaatgtttaccacgagaagttcaccaacaacccgcgcaacttcatcaagaatgcgcggtccgacaagaagcgtccctacagcctcaatcacatgtttgactacctgctccaggtaggcaacaaggagatctggaaccccaagaccgacaacaacctggtgaagaagatgatgcgcaacaacgacgtccaggtgacccggatgctggtggagcagacgggagccctgtacgacgccaccatctacaaggcctccgtcaccaagagcgagtcctacgtgcccctcaagagctccgacgcgatcctgagcgacgtgaagaagtatggcggcttcaccagcatcaagatcgcctactactccatcttccgcttctacaagaagaacagcgaggagttcgagactcacatcatctccatcccggtcctgaaggccgggaccctcaacagcaaggaggactacgtggcctacggcgaggagatcatgaacaagcagaagttcgaccgggtggagctggtctacaagaagctgtgcatgaactccctcgtgcgcatcaacggggtgatgtactacctgggcgggaagaccaacaacagcctgtacatcgactccgccataagcctcgtcctgcccgacaacatcgcgaagaagatcaaggccgtggagaagtacatcgcccgggtggccgagaacggcaactacaagccccagccggaccaggtctcccccgagttcaacatgatcatctacaaggccctgaccgagaagatgaagcaacccgcgttcgtgggcctcaagacgaatcgcgagaatgagctggagaaggagaccaccatcaccgccttcatcgccatgacgctgatcgagcagtgcaagatgctcatggagattctgaacctgctcacccagcagaagaccacctacgccctgaagcccatcggggtaagcgcctcccggagcacgctaggcatgaacatcacagggctctccgagttcaccatcatcacccagagcgtcacgggcctgcaggagaaggagatccgcatcatctga

SEQ ID NO: 7629 - RNA, 4026 nt, synthetic construct; identical to SEQ ID NO: 1829
  misc_feature 1..4026: note = Cas9 variant
  source 1..4026: mol_type = other RNA

SEQ ID NO: 7630 - RNA, 4026 nt, synthetic construct
  misc_feature 1..4026: note = Cas9 variant
  source 1..4026: mol_type = other RNA
atggagaaggactactacctgggcctcgatatggggagcggctccgctgggtgggccgtgaccgacgaccagtaccacgtgctgcgcgcgcacggcaaggccatgtgggggacccggctgttcgagagcgccaacacggccgaggagcgccggatcaaccgcaccgcccggcgccggctcaaacgccgtaaccagcgcatcgagtggctgcaggagatcttcgcggaggagatcaacaccaaagactccggcttcttccggcgcatgaaggagtctcggtactgggccgaggacaagcgcgacgagaatggctcctgccccgagatgccgtacagcctgttcatcgacgaggacttcaccgacaaggagtaccacgagaagttccccacgatctaccacctcaggaagtatctaatgaccaccgaggagacccccgggatccgcctggtgtacctcgccttccaccacatgatgaagcatcggggccacttcctgctgaacgggaacatcgaggagatccgcaagttccggaagacgttcgaccagttcctcgaggtggtccgcaacgaggagatgggcttcgccggcgagatcgaggaggagacctacaagaagatcgagatgacccttaaggacgtgaacctgacccggtccgcgaagaagacgaccctcatcaagagcctgaaggtgacccgcgtcgaggagaaggagctgctcgccctgatctccggctgcacagtcaagctgagcaacatcttcaacgacaagtccctcgacgagacggagcgccccaagatcagcttcgccgacgccggcttcgacgactacgaggccgagatccagtccaacctgaacgagaagtactacatcattgagagcgcgaaggccgtgtacgactgggccgccctggccgacatcctcggggagtacagttgcatcagcgaggcgaaggtcgccttatacgagaagcaccacaaggacctgaagcggctcaaggacctggtgcgcaacaacatctccagcgaggtctacaaggagatcttcgtcgacgtgtccggcaagtacaagaactactgcgcatacatcgggaccaccaacatcaacggcaagaagaaggacttcgagggcaagaagtgcaccaaggaggacttctacgcctacctgaagaaatccgtgatcgagtgcatcaacgacagcgagaagaccgactggctcaagctggagctggagaagggaaacttcctcccgaagcaactgaccggcgagaatagcgtcatcccctaccaggtgcacctgtacgagctcaacgccataatcaccaacctgcaggagcggatccccctgctcaagcgcgacggggagaagatccggcagatcttcacctttcgcgtgccctactacgtcggcccgctgaacgggatcagcatcgacggcaagaagacgaattgggttaagcggaaggaaggcgtgatctacccctggaatttcagcgacatcgtcgacgaggagagctccgcggagagcttcatccgccggatgaccaacaagtgcacctacctgatccacgaagacgtgctccccaagtacagcctgctgtacagccgcttcgaggtgctcaacgagctgaacaacgtccggctgaacggtgagctcctgtccgtagagctgaagcagaagatctacgaggacgtcttccagagataccggaaggtgacccagaagcgcctgaagcggtacctcctgacggagggcatcatcgacgagaacaccgtgatcaccgggctggacggcgacttcaaggggagcctcaccgcctaccacgatttcaaggagaagctgacgggcctgaacctcaccgagcgcgagaaggaggagatcatcctgaacatcaccctgttcggcgacgctcggtccctcctgcgcaagcggatcgggaaaatctgcagccagctgtccgacaagcagaaggagaacctcagcaagctgtcctaccagggctgggggcgcctgagcaagaagttcctcaacggcatcgccatctccgtccagggggaggaggagtggaccatcatcaaggccctgtgggaaacgcaggacaaccttagccagctcatgggcgcgaagtacaccttccgcaacgccgtggagaaggagaacggcgagctggagaaccgggagatctcctacgagaccgtgaaggacctctcgatcagcccctccgtcaagcgccaggtgtggcagagcctcctgatcgtgaaggagatctgcaagatccaaaagaagccgccccggaaggtcttcgtggaggtggccaaggagaagaccaactccgggcgcaccgagagccggaagaagcgcctgcaggacttttacaagtactgcagtaagtacgagaaggagctctacgacgagagcatccagaacaaactggagaagtgctccgagagcgacctgcggtccgacaagttgttcctgtactacatgcagatgggccgctgtatgtacacggggcagcccatcgacttcgacgagctgtggaacaaccagaagtacgatatcgaccacatctacccccagagcaagaccatggacgactccatcgacaaccgggtcctcgtgaagcgcatcagcaaccaggagaagaccgacgtgtacccgatccgggccgacatacgcgagaagcggcgcggcttttggaaggagctgaagaacgtcggcctgatatccgaggaaaagtacaagcggctcacccgcgcaacggagttcgaacccgccgagctggcagggttcatcagccggcagctggtggagaaccgccagaccaccaaggtggtcgcatccatcctcaagcaggccatgcccgacaccgagatcgtttacgtgaaagcgcggacggtcagcgagttccgccacaagttcaacttcatcaaggtgcgggagatgaacgacttccaccacgccaaggacgcctacctgaacgtggtagtgggcaacacctacctggtgaagttcaccaagtcccccgtcaatttcatcgagaaccacagcaaccgctcgtacaacctcaaaaagatgtttaccgacgggcgcgtggagcggaacggcgagatcgcctggatctccggggagaacggcacgatcggcaccgtgcgcaacataatgaagaagaacaacatcctggtcacccggcgcgcccatgaggcgaccgggggcttcttcgaccagcagctgatgaagaaggggaagggccaggtgccggtgaaggggagcgacgagcggctcctggacatcgagaagtacggaggctacaacaaggagacgggggcctacttcgtcctggtggagtccgacgagaagaagggcaagaagaagcgcaccatcgagtacgtgcccatccggctcaagaagcagctggagaacaaccgcaaggcccttgagaactacctctgcgagcagcgggggctgaccaaccccgtcgtgctgatcgacaagatcaagatggacagcctcttccgcgtggacggcttcttcatgtggctgtccgggcggaccggcaaccagctcctcttcaagtgcgcgaaccagctggtcctgagcacggaggacgaggccaccctcaagaaaatcgtgaagttcgtgaaccgccggaaggagaacaaggagatcaagatctacgagtccgacaaacttaacgaggagatgctcaaccgcctctacaacaccttcctgtacaagctgcagaactccatctacggcaaccggctcggggagcaggcgaagaccctgtccagcaagaaggagaacttcgacaagctgcagatcgaggagaagtgcctcgtcctgtacgagatcctgcacatgttccagtgccagtccgccacgagcgacctccagctaatcgagggccccgggaaggccgggaccctgcgcctcaactccaacatcaccaaatacaagaacatcaacatcatcaaccagagcccgaccgggatctacgaacaggtcatcgacctgcagaagatctga

SEQ ID NO: 7631 - RNA, 4026 nt, synthetic construct
  misc_feature 1..4026: note = Cas9 variant
  source 1..4026: mol_type = other RNA
atgggaaaggggtactacgtggggctggacatggggacaggctcggtcgggtgggccgtgaccgacgagagttaccagatccttcgccggcacggtaaggccatgtggggcgtgaggctgttcgagagtgcgaagacggccgaggaacggcgcatgtttcggactgggcgcaggcgcctggaccggcgtggctggcggatcgagatcctccaggagatcttcgccgaggagatctccagggtcgacccggggttcttcctgcggatgaaggagagcaagtactacccggaagacaaacgcgacatccagggcaactgccccgagctgccctacaccctcttcgtggacaagacgttcacggacaaggacttccacaagaagtaccccaccatctaccaccttcggaagatgctcatggagaccgaggacaccccggacatgcgcctggtgtacctggctctgcaccatatgatgaagcaccgggggcacttcctcttgtccggcgacatcagccaggtcacggagttcaagaacaccttcaatcagttcatcgagaatatacgcaacgaagagatggacttcgagatcgagctggacgagtctgccgtgcagatgatcgaggaaacccttaaagacaagaacctgacccgcagcgcgaagaaatccaagttagtgaagggcctcaacgctaagaacgtccgcgacaaggccttcctgacgctgctcagcgggggcaccgtgaagctgtccgacctgttcgggatggaggagctcaacgagggcgagcggcccaagatcagcttcgccgacaacggctacgaggagtacgcggccgtggtcgagatggagctcggggagctgtactatatcgtggagtccgccaaggccgtgtacgattgggcaatcctcagcgacatactgggcgggtcgaccagcgtctccgacgcgaaagtccgcgcctacgagaagcacaaggccgaccttaagtacctcaaggccgtggtcaaggagtacttccccaaggaggtgtacaacgcagtgttcgtcgagagctccgataagctgaacaactaccccgcgtacatcggtatgaccaagaaaaatggaaagaaagtaagcctggagggcaagcgatgcagccgggaggagttcatggacttcctcaagaagaacatcgtggtgaagctcccggacgaggaggccaagatgtacttgcagtccgagctcgaaaaggacagcttcctgcccaagcaagtcaacaaggacaacggcgtgattccctaccaggtgcacaagtacgagctgaagaagatcctcgacaacttaggggataagatcccctttctgaaggagaacgccgagaagatcgagaagctgttttccttccgcatcccgtactacgttggccccctgcggacggggaacggcgagaatagcaagttcgcgtgggccgagcgcaagtccaccgagaagatctatccgtggaacttcgagaacgtcatcgacgtggagcagagcgcggagaacttcatccggcgcatgacaaacaagtgcacctacctgatcggggaggacgtcctccccaaagattcccttctgtacagcaagttcatggtcctcaacgagctgaacaatttacggctggacggccagaagatctccgtggagctcaaacagaagatataccgcgatgtgttctgccggagccgcaaggtcacgcagaagaagctgaagtcctatctgatccgggagggcatcgccgggaagaacgtggagctcaccggcatcgacggagattttaagggtagcctgaccgcctaccatgatttcaaggagaagctgatcgacgtagagctcacccagaaagagaaggaggagatcattctgaacatcgtgctgttcggggacgacaagaagctcctgaaacagcgcctgaagaagaagttcccgcagctcacggagaagcagatcaacaccgtgaccgccctgtcctacaagggctggggccggctgagcaagaagctcctggaagaagtgacagtccccgcgccagaaacgggggaagtgtggaacatcatcaccgcgctgtgggagaccaacgacaacttcatgcagctcctgtccaaggagtaccagttcagcgatcgcatcgaggagttcaacgaagagaaggccgaccccgaggtgtcctaccagaccatcgaggacctgtatgtatcgcccgccgtgaagcggcagatctggcagacgctccagatcatccaggagatcgaaaaggtgatgggcgagaaacccaagcgcgtcttcgtggagatggcccgggagaagcaggagaacaagcgcaccgagtcccgtaaaaagaccctatccgacctgtacacgaagtgcaagaaggaggagcccgagtggatcgaggcgctctgcacgagcctggagaagcacgaagaacaccagctgcgctccgacaagctctacctgtactacacccagaaggggcgctgcatgtacagcggcgagccgatcgatctggaggacctctgggacaacaccaagtacgacattgaccacatctacccgcagtccaaaaccatggacgacagccttaagaaccgggtgttagtcaagaaggagtacaacgccaagaaatccgacacctaccccatcgccgccgatatccagaagaaaatgatgcccttctggaaatccctcctcacgggcgggttcatccccaaggagaagtatgaccgcctggtgcgcaacaacccgctcgacgccaacgagctggcgggcttcatcgaacgccagatcgtggagacccggcagagcaccaaggccgtcgccgagatcctaaagaagatcctccccgacaccgagatcgtgtacgtgaaagccaagacagtcagcaagttccgccaggacttcgactttatcaaagtgagagacatgaacgacctgcaccacgccaaggacgcttacctgaacattgtggtggggaacgtgtacttcgtgaaattcaccaagaacgccgcctggttcgtcaaggagaaccctggccgcacctacaacctcgaaaagatgttcatctgggacgtggcccgggacggagagatcgcctggaaggcgggcaaatctgggagcattgtacaggtccgcgcaatgatggagaagaaccacatcctggtgacccgacgctcctacgaggtaaagggcgggctttttgaccagcagatcctaaagaaggggaagggccaggtcccggtgaaggagagcgacgaacggctgcgcgacatcgggaagtatggcggctacaacaaggctgcaggggtgtacttcatgctggtgtccagcaaagacaagaagggcaaagagcagcggacgatcgagttcgttcccatctatctcaaggatcgcgtggagaaggacatggagtccgcgcggaactacctgatggaggagcgcgggctgcgggaaccaaagatcctcatcaagaaaatcaagatcgacaccctgttcaaggtcgatggcttctacatgtggctgagcgggcgcacctccaaccagctcattttcaagggcgccaaccagctgatcctgtccaaggaggacatgaagaccctcaagaaggtggtcaagtacatccagcggcagaaggaagacaagaacgtcaagataagcatgcgtgacggcataacggaggaggaactgctgaagctatacgagacgtttctggacaagatccgccactcaatctacggggcccggctgtcctcccaggagaaaaccctcgtcaacggcaaggagaagttcatcgacctgagcgtcgaggccaagtgccaggtgctgtacgagatcctccacctgttccagtgccagtccggtgccgcgaaccttaagatgattggcgggcccgcgtccgccggcatcctggtgatgaacaacaacatctccaaatgcaaaaacatcagcatcgtaaaccagagcccgaccggcatctatgagaaggagatcgatctactgcgcgtttga

SEQ ID NO: 7632 - RNA, 4026 nt, synthetic construct; identical to SEQ ID NO: 1832
  misc_feature 1..4026: note = Cas9 variant
  source 1..4026: mol_type = other RNA

SEQ ID NO: 7633 - RNA, 4032 nt, synthetic construct
  misc_feature 1..4032: note = Cas9 variant
  source 1..4032: mol_type = other RNA
atgacctactatcttggcctcgacatgggaaccagctccgtgggctgggccgtcacggacgagaactataacctgatccaccgccaccggaaggacctgtggggcattcgcgagttcgaggaggccaagaccgcggtggagcggcggacgcagcgcatcagccgccggaggcggcaacgcgaggttgccaggatcggcctcctgaaggactactttcacgacgagatccagaaagtcgaccccaatttctatcagcgcctggacaactccaagtacttcccggaggacaaggaagaggtggtgaaggggaagaacggcatctttgccgatgagaactacaccgaccgggactacttcgccgagtacccgacgatcttccacctccgcagagagctgctgaacagcaaggagccccacgatgttcggctcctgtacctggccctcctgaacatgtacaagcaccggggccacttcctgaacaccaccctcggcaccgacggggagaaccgcaagctgtccgacgtctaccgggacttcgtggtcaagacggaggaggtgctggggctcaccttcccccaggagaccgacaacggcaagatgcaggagatcatgtgctcacgcgagttttcccggaagcgcaaggcggagctgctgtgcgccctcctggagatcgataagaaacagaagcagcaggtcgccttgatcgagtgcgtgctcggcctggacaagtcggtgaagcagatgtacggcaccgccgtgccggatgacttcgacaagtccgtcaaggtgaacttcagcgattcctccttcgaggagaaggtgtccgaagtagaagaactgctcgacgaggagaagtacgagctgatcctgtgcatgaaggaactctacgacacggcggtgctaaaccagatcatgggcgactgcaactacctgagcgaggcccgcgtgcaagagtacgagaagcacaaggaggacctcaagttgcttaagcgtaccgtcaagaagtacgggaccgccgaggagtaccagttcctcttccgctccagcgagaaagcctcctacaacgcctacgtgcacagcgtgaactccggcgagaagattcggcgcaacatggacgggcggtcgcgcgacgacctctacacagtcctgaagaagatgttaaagaactacccccaggaggacgcggactgcaagtacatcctggaggagatcgagaaggagcagttcctgcccaagcagcttgtgagcgacaacggcgtcatccccaaccagatccactacaaggagatgaagaagatcctggagaacgcagaacagtacctgcacttcctccgggagaaggacgagtccggatacacggtggccgagcgcatcctgaagctgttcgcatttcagatcccatactacatcgggccaaccagcgagaagtccggcaaaaacgggggcaacgggtgggtggtccggaaggagcagggccaggtgctcccctggaacatcgaggagaaaatcgacatgaaagccaccagcgagaccttcatctcccgcatggtgcgtcgctgcacgtaccttagcgacgagatggtcctgccgaaggcgtctctggagtacgagagcttctgcgtgctcaacgagctgaacaacctgcggatccgcggcgtgaagctaccgatcacagtcaagcaggacatctacaaggacctgttcgaacgggggaagagagtgacccggaagcagatagtgaactacctaaagggcgtcgggatcctccaggagggcgaggaggacgagctgactgggatgatggacacgttcaactccagcctggcctcctatggcaagttcaagagcatcctcggcgagaagatacaggaggactcctgcaagcgcatggtggagcaaattatcttctggtgcaccatctatggggacgccaagaaattcctgaaggagcagctggaggagaagtacggcgacgtgctcacccgggagcagatcaagcgcatcttagggtttaagctgaaggactggggcaacctcagcaagaagttcctggagctgaacgggtgcgaccgcaacaccggcgaggtcatgtccctcatccggatgctgtgggagagcgacgacaaccttatggagctcctcaaggactccagctacacctaccgcgccgagctggaggagcagcaggagaagctcaccaagaccctgaccgagatctgccccgaggacctggagggctactacttcagtgcccccgtaaagcggatgatctggcagacgctcttaatcctgaaggaggtggagaaggtcatgggggagcccccgaagagagtgttcgtggagatgacccgggagcacgacgagcgccgagagatgaaggacagccgcggcaagaagttccaggagctctacaagaacatcaaggatgaggagcacaattggaaggcagagattgaggacgccgagaaggacgggcggatccgcagcaagaagatgtacctgtaccttacccagcggggccgctgcatgtacaccggcaaccccatcgacctcgaggaactcttcacgaccaagtatgacatcgaccacatctacccccggcacttcgtcaaggacgacaatctggacaacaacctcgtgctggtggaaaaggagaagaacgcccacaagtccgaccaataccccctgggggacgacatttacaccggccgcctcagctggtggaaagagttacaccgggagaagctgatcaacgacgagaagtacaagcgcctcaccgggcgggccccgttctccgacgagcagaaggccggcttcatcgcccgacagctggtcgagaccagccaggggacgaagggcgtggcctccatcttgaaggaagtgttgcccgagaccaccaccatcgtctacgccaaagcccggaacgtgagcgactttcgcaacacgaacgagctgctgaaggcgcggtcggtgaacgacttccaccacgcccaggacgcctacctcaacatcgtggtgggcaacgtgtactacgtcaagttcaccaacaaccccctgaacttcgtgcgctcaggggagggctacaatctggacggggtgttccgcaaaaacgtcatccggggccaggagaacgcctggatagtgaagcccgagaagggggagaagatgaccctcgagaccgtgaagcgcgtcatggccaagaacaccccgctgctgacccggctctccttcgagggccgtggcgggctggcgaaccaaaccctgtacagtgccaaggaggccgccggtgaggggtacgtgcccctcaagtccagcgactcccggctgcaggacgtgaccaagtacggcgggttcacgagcgtcaccaccgcgtacttcatcctggtcgagcacgacatgaagaagaagcgcgtgcggaccatcgagtccgtccccatcctctggaaggagcgcattgagaaagagagcggacagctggagatctactgtcgggaggccctgggcctcgtgaaccccgacatccgcgtgcggaagatcctgatccagagtctggtcaagaaagacgggttttacatgcacctcagcggcaagacggggaaccgcttcatcatgcggaacgccgtggagctgtgcctgaagcaggagtggatcaactacagcaaaaagctcgagaaggaaggctgcgatgagtccatcaccaaggagaagaacgaggagctgtacgagatcctaaaggagaagcatatcaacgggatctatcgcaagcggcctaaccccatgggcgagaagctccacatacgccaagagacctttcggatgctgaccctggaggagcagaagaaagtgctcctgagcctgcttaacctgacgaagatcggccccgtcgaggccaacctggagctcataggcgagtccgcgcacacaggcaagatgttgatcagcaagaacatcaccgaggtgaaggagttttacttgatccaccagtccgtcactgggatctacgagaagcaagtcaacctcctgacggtgtga

SEQ ID NO: 7634 - RNA, 4032 nt, synthetic construct; identical to SEQ ID NO: 1834
  misc_feature 1..4032: note = Cas9 variant
  source 1..4032: mol_type = other RNA

SEQ ID NO: 7635 - RNA, 4035 nt, synthetic construct
  misc_feature 1..4035: note = Cas9 variant
  source 1..4035: mol_type = other RNA
atgagccagaacaacaacaagatctacaacatcggcctggatatcggggacgcctccgtgggctgggccgttgtggacgagcactacaacctcctgaagcgacacgggaagcacatgtggggcagtcggctgttcacccaagccaacaccgccgtagagcgccggtccagccgctccacgcggcgacggtacaacaagcgccgggagagaatccgactccttcgcgagatcatggaggacatggtcctggacgttgaccccaccttcttcatccggctcgccaacgtgagcttcctggatcaggaggacaagaaggactacctgaaagagaactaccactccaactacaacctcttcatcgacaaggacttcaacgacaagacctactacgacaagtacccgaccatctaccacctccgcaagcacctgtgcgagagcaaggagaaggaggacccccggctcatctacctggccttacaccacatcgtcaagtaccgcgggaacttcttatacgagggccagaagttctccatggacgtgagcaacatcgaggacaagatgatcgacgtgctacggcagttcaacgagatcaacctgttcgagtacgtcgaggaccgcaagaagatcgacgaggtgctcaacgtgcttaaggagcccctgtcgaaaaagcacaaggccgagaaggcgttcgccctgttcgacacgaccaaggacaacaaggccgcctacaaggagctctgcgcggccctggccggcaacaagttcaacgtgaccaaaatgctcaaggaggccgagctccacgatgaggacgagaaggacatcagcttcaagttctccgacgccaccttcgacgacgcgttcgtggagaagcagcccctgttaggggactgcgtggagttcatcgacctgctgcacgacatctacagctgggtcgagctccagaacatcctgggctccgcccataccagcgagccgtccatcagcgccgccatgatccagcgatatgaggaccacaagaacgacctgaagctcctgaaggacgtgatccgcaagtatctccccaagaagtacttcgaggtgttccgcgacgagaagtccaagaaaaacaactactgcaactacatcaaccaccctagcaagacccccgtcgacgagttctacaagtacatcaagaaattaatcgagaagatcgacgacccggacgtgaagaccatcctgaacaagatcgagctggagagcttcatgctcaagcagaactcccgcaccaacggggccgtgccctaccagatgcagttggacgagcttaacaagatcctcgagaaccaaagcgtctactactccgacctgaaagacaacgaggacaagatccgctccatcctgacgttccggatcccctactacttcggccccctcaatatcaccaaggaccgccaattcgactggatcatcaagaaggaggggaaggaaaacgaaaggatcctgccgtggaacgcgaacgagatcgtggacgtggacaagaccgccgacgagttcatcaagagaatgcgtaacttctgcacctacttccccgacgagccggtcatggcaaagaactccctgacggtgagcaagtacgaagtcctcaacgagatcaacaagctaaggatcaacgaccacctgatcaagagagacatgaaggacaagatgctgcacaccctcttcatggaccacaagtccatctcagccaacgccatgaagaagtggctggtgaagaaccagtacttctccaatacggacgacatcaagatcgagggcttccagaaggagaacgcgtgcagcacctccctcacgccatggatagactttactaagatcttcgggaagatcaacgaaagcaactacgacttcatcgagaaaatcatctacgacgttaccgtcttcgaggacaagaagatcctccgccggcgcctgaagaaggagtacgacctggacgaggaaaagatcaagaagattctcaagctgaagtactccgggtggagccgtctgtccaagaagctcctgagcggcatcaagaccaagtacaaggactccacgcgcaccccggagaccgtgctggaggtgatggagcggactaacatgaacctaatgcaggtcatcaacgacgagaagctggggttcaagaagacgatcgacgacgccaactcaacgtccgtaagcggcaagttcagctacgccgaggtgcaggagctagcgggctcccccgccatcaagcgcggcatctggcaggcgttgctaatcgtcgacgagatcaaaaagatcatgaagcacgaaccggcccacgtttacatcgagttcgcccggaacgaggacgagaaggagcgcaaggacagcttcgtgaaccagatgctgaagctctacaaggactacgactttgaggacgagaccgagaaagaggccaacaagcacctgaagggcgaggacgcgaagtccaaaatccggagcgagcgcctgaagctctactacacccagatggggaagtgcatgtacacgggcaagtccctggacattgaccggctggacacctaccaggtcgaccacatcgtgccccagagcctcctgaaggacgactccatcgacaacaaggtgctagtcctcagctccgaaaaccagcgcaagctggacgacctggtgatcccgagttccatccgcaacaagatgtacgggttctgggaaaagctgttcaacaacaagatcatcagccccaagaagttctactctctaataaagacggagttcaacgagaaggaccaggaacggttcataaaccgccagatcgtggagacccggcagataacgaaacacgtcgcccagatcatcgataaccactacgagaacaccaaggtggtgaccgtccgcgccgacctgagccaccaattccgggagcgctatcacatctacaagaaccgggacattaacgacttccaccacgcccacgacgcctacatcgcgaccatcctcggtacctacatcgggcacagattcgagtccctggacgctaagtacatctatggggagtacaagcggatcttccgcaaccagaagaacaagggcaaggagatgaagaaaaacaacgacgggttcatcctgaacagcatgcggaacatctatgctgacaaggacacgggcgagatcgtgtgggaccccaactacatcgaccgcatcaagaagtgcttctattacaaggactgcttcgtgactaaaaagctcgaggagaacaacgggaccttcttcaacgtaaccgtgctgcccaacgacacgaactccgacaaggacaacaccctggccaccgtgccggtcaacaaataccgtagcaacgttaacaagtacgggggcttcagcggagtcaattccttcatcgtggcaatcaaggggaaaaagaagaagggaaagaaggtgatcgaggtgaacaagctcaccggaatccccctgatgtacaaaaacgcggacgaggaaatcaagatcaactacctgaagcaggccgaggacctcgaggaggtccagatcggaaaggagatcctgaagaatcagctgatagagaaggacggcggcctctactatatcgtggcccccacggagatcatcaacgccaagcagctgatcctgaacgaaagccagaccaagctcgtgtgcgagatctacaaggccatgaaatacaagaactacgacaacctggactccgagaagatcatcgacctgtaccgcctcctgatcaacaagatggaactgtactaccccgagtaccggaagcagctagtcaagaagttcgaggaccgctacgagcagctgaaggtaatcagcatcgaggagaagtgcaacatcatcaaacagatcctggccaccctccactgcaactccagcatcgggaagatcatgtactccgactttaagatcagcaccacgataggccggctgaacgggcgcaccatcagtctggacgacatctcattcatagccgagtccccgaccggcatgtacagcaagaagtataagctctga

SEQ ID NO: 7636 - RNA, 4035 nt, synthetic construct
  misc_feature 1..4035: note = Cas9 variant
  source 1..4035: mol_type = other RNA
atgaagaagaccaacccctacatcctgagcctcgacatcgggaccgcctccatcggctacgcttgcatggaccttgatttcaacatcctgaagtaccacgacaaggacgccatcggtgtgctcacgttcgagggggccgacactgccgccgagcgccggggattccggaccagccggcgccggaaaaaccgccggatcaagcgcctaggtctgctccaagaggtcctagctccgctggtgaagaaccccaactactatcagctcctgaacctgcacaagtggaagaactccaacgaggatttcaagcaccggagcctctccgaggtgctgaagatcctgggcaagaacccaaagacctaccctaccatctaccacctccaacaggacattcagaaccacccggagaagaagttcgagcccgagctgatcttcctggcgctctaccacctggtcaagtatcgcggccattttctgttcaacaaccttagcttcgacaaggggaagaccgtggacaacgaggcccagctgtccgagctgctcgagcagtaccagagcatcaacccctacgaggactccatcagcaacaaggacattaacgtgatagttgacaccctgaaggacgatcagctgacccgtaacgacaagtccaaggagctcaagcgtaacgtgagcaagacgcacgccgagctgttcaagatgctggtgggcctcaagttcaagcaatccatcctgttcgagaacatggagaacgccgaggacatcaaggagagcgcgaccgggtccgacgctattagcctgtccgacgactactacgagaacctcagcgagttcctgaccgacgagcagctgaacttcatcgagtcggctaacaccttcttcatgggcattatgctcgaccggatcctgaagggggccacgagcatcagcgccgcgaaggtccgcgactacaagatctttaagaaccagttaaaaataatcaaggacatcgtgtaccagaacaagtacgacaagtaccacgagttcttcgtgacctccaaagaggacatgcgggcataccaggagaaccccgatgccaagaccttcggcaagctcagcaagttcgaccagtacctgatccacccgaaggaccagtacgccaagctgatgaaggacctcaagggcatcgtccccaagaaatacaccgaggtgctgaacctgattgacgagcagaagttccttgtagtacagaacacgaccgacaacgccagcataccctaccagaacaacgtcttcgaggcggagaacatcctgcgcaaccagcagaagtactaccccgagatcaccgaggagatgatcgggaaggtgatcaacctgatcagcttccggatcccgtactacgtcggccccctcaccaacaaaaacggccagtccgacttcgcctggatgatccgcaagagtgatgagcaaacgctgccctggaacttcgacaaggtgatcgacaagtccaagagcgccgagaagttcatccggcgcatgacctccaaatgcacctacctgctggaggaggacgtgctccccaagcactcactgctgtaccaggaaatggaggtcctcaacgagctgaacaacgtgcagctgcggggcgagaacgaaccgaagcaccgcatccaccgcctcgaccccaaggtcaagcagttcatctaccataacctgttccagaagaagaagaacgtcacccacaaggacctgatcacgcttctgcagaactccgaacaccggaacaccctgaacaaaactagcggccagaagctaaaggtgttcggtacccagaacgactccaagttcgccagcaagctgtccacctacaatgacatgaaagcaatcttcggcagcgtcgaaaacaagcgtcagatgatcgaggagctcgtgctctggatcaccatattcgaggacaaagcgattttaaagcagaaaatcggggagaagtaccccaacatcaccgaaaagcaactgaaccagatcgtgaagctcaactacagcgggtgggggcggctgagcgagaagctgctcacaaaggaggtgaacggccgctccttaattgacctgatgtacagcacggagaataacttcatggagatcatcactgacaagaccctcggcttcgactgcttcatcaagaacagcaacaaggtgaagaacgccaagatctcctacaaggacgtggccgagctgcggaccagccccgccctaaagaaggggatctggaacgccataaagatggtccgagagatttccgacctcttcggcgcgccggagaagatcatcatcgagttcgccacggaggaccaggtgaaggggaagcggcagaaaagtcgcagcgagctgtgggacgacctggtgaagaagaacaacctcaagcggaacaagaagttcaagggcctgttcgaggagctgaaggcctaccctgacctcgacttcagcaaccccaaactatggctgtacatccaccagaacgggaagtgcatgtacacgaagaagcccatcgacttagagcgcctgatgtccgacaccaacaaccagctgtacgagatcgaccacatcctcccgcggaccttcgtcaaagacgacagcatcaacaacaaggtgctggtgatccagtccgccaaccagaaaaagtccggtgacaagatgcccctggagattttcgacaaccacgtcctagtgcccttctggaagatgctgtacgaaaacgacctgatcagcagctccaagctcagtaagctgatgaagaaggagttcaatgatctggacaaggagggcttcatccagcggcagctcgtggagacccggcagattatctcccacgtctccgacttcctgacggaggagtacccctccaccaccgtggtgccgatgaaagccaacgtcgtatcagagctgcgccggaagttcgacataccgaagatacgccagctcaacgactggcaccacgccgtggacgcctacctgaacggattcgtctaccaggccgctagagtgttctaccccaaggtgaacctgttcgagttcaacttcaagtgggagaaggtgcgcgagaagtggcggcagctcggcgagttcaccgagaacaacaaaaagcgcgagtttttcctgttcaagcgcatggagaactacgtgaatgagcacggcgagggcatgatcagcaagctgatcttcgacctcgacaacttcaagttcaactactcccgaaaagtggagagcactgagtccgcgttctacaagcagagcgccttctccccgaagaacaccaccgcccaatacgacagcgacaagaacaagaccgccatctacaaggagatgaagaacaagcgcgggatcgtcgtttcctacacgtacgtgaagaaggaccaggaactgatcggctacggcgtcttcaacgagacggtgttcgagtacgtgaataacgcggacgtcgacatgaacacccgggcgctgaaaatcgtgcgcaaggctttccccaagctcgacatcaagaaggctcagtacctgttcagcatcaacaagggggacgccctgttggtgaacggccaccccttcctgttcgtctccgccaaggagcggatcaacgggaagcagctggagttcgacatcaacatgcagcgccggctcaagaaggcgctgcgcccctacaacaagatgaccgaacaggaaaaggtgggcgtgtacaatcagttcgccgagaaggtcgtgcaggagtacgagaacagtctgggcgccaagacgcggaacgagaagctcgagctgatccgcaaccagttcaacgagtccgacaagtcaaacgaggccctgatccagtgcatcctcgaggtgctgaagatgaccaaggtctccgcggagcggagcgtgaaactgaagatccgctggggctcccagaccccgaacacactaatcgacatcaacaacaaggcaaagatcatgtacaacagcatcacgggcctgaagcagacccggctgaagtccatctacaagctcgccgagagcaagaacgagctgtga

SEQ ID NO: 7637 - RNA, 4035 nt, synthetic construct; identical to SEQ ID NO: 1837
  misc_feature 1..4035: note = Cas9 variant
  source 1..4035: mol_type = other RNA

SEQ ID NO: 7638 - RNA, 4035 nt, synthetic construct; identical to SEQ ID NO: 1838
  misc_feature 1..4035: note = Cas9 variant
  source 1..4035: mol_type = other RNA

SEQ ID NO: 7639 - RNA, 4038 nt, synthetic construct
  misc_feature 1..4038: note = Cas9 variant
  source 1..4038: mol_type = other RNA
atgaagaagccctacagcatcggcctggacatcgggaccaactccgtgggctgggccgtcgtgaccgacgactataaggtcccggccaagaagatgaaggtcctcgggaacacggacaagagccacatcaagaaaaatctgctgggcgcgctcctgttcgactcagggaacaccgccgaggacaggcggctgaagcgcacggcccggcgccggtacacccgccggcgcaacaggatcctctacctgcaggagatcttcagcgaggagatgggcaaggtagacgactccttcttccaccgcctggaggacagcttcctggtgacggaggacaagcggggcgagcgccaccccatattcggaaacctggaggaggaggtcaagtaccacgagaacttccccaccatctaccacctccggcagtacctggccgacaaccccgagaagaccgatctacgcctggtgtacctcgccctggcgcacatcatcaagttcggagggcacttcctgatcgagggcaagttcgacacccggaacaacgacgtgcagcgtctcttccaggagttcctggccgtctacgacaatacgttcgagaactccagcctgcaggagcagaacgtccaggtggaggagatcctcaccgacaagatctcaaagagcgccaaaaaggaccgggtgctgaagctgttcccgaacgagaagtccaacgggcgcttcgccgagttcctaaagctgatcgtgggcaaccaggcggacttcaagaagcacttcgagctggaggagaaagcgcccctccagttctccaaggacatctacgaggaggagctggaggtgctgctcgcccaaatcggcgacaactacgccgagctgttcctgtccgccaagaagctctacgacagcatcctgctgtccgggatcctcaccgtcaccgacgtgagcacgaaggcgcccctgtccgccagcatgatccagcggtacaacgagcaccagatggacctggcccagctcaagcagttcatccgtcagaagctgtccgacaagtacaacgaggtgttcagcgacgtcagcaaggacggctacgccgggtacatcgacggcaagaccaaccaggaggccttctacaagtacctgaagggcctcctgaacaagatcgagggatccggctacttcctggacaagatcgagcgagaggacttcctccgcaagcagcgcaccttcgacaacgggagcatcccccatcagatccacctccaggagatgcgggccatcatccgccggcaggccgagttctacccgttcctggccgacaaccaggaccgcatcgagaagatcctgaccttccggatcccctactacgtgggccccctggcccgcgggaaatccgacttcgcctggctgagccggaagtccgcggacaagatcacgccctggaacttcgacgagatcgtggacaaggagagctccgtcgaggccttcatcaaccgcatgaccaactacgacctgtacctcccgaaccagaaggtgctgcccaagcacagcctgctctacgagaaattcaccgtgtacaacgagctgaccaaggtcaagtacaagacggagcagggcaagaccgccttcttcgacgccaacatgaagcaggagatcttcgacggcgtgttcaaggtctaccggaaggtgaccaaggacaagctgatggacttcctcgagaaggagttcgacgagttccgcatcgtggacctgaccgggctggacaaggagaacaaggccttcaacgcgtcctacggcacctaccacgacctccggaagatcctggacaaggacttcctggacaacagcaagaacgagaagatcctcgaggacatcgtcctgaccctgaccctcttcgaggaccgcgagatgatccggaagcgcctgaagaactactccgacctgctcaccaaggagcagctgaagaaactggagcggagacactacacgggttggggccggctcagcgccgagctgatccacgggatccgcaacaaggagtcccggaagaccatactggactacctcatcgacgacggcaacagcaaccgcaacttcatgcagctgatcaacgacgacgccctgtccttcaaggaagagatcgccaaggcccaggtgatcggcgagaccgacaacctcaaccaggtggtcagcgatatcgccgggtcccccgccatcaagaagggcatcctgcagagcctgaagatcgtggacgagctcgtgaagatcatggggcatcagcccgagaacatcgtcgtggagatggcgcgcgagaaccagtttaccaaccaaggccggcgcaactcccaacagcggctgaaggggctgacggacagcatcaaggagttcggcagccagatcctcaaggagcacccggtggagaactcccagctgcagaacgaccgcctgttcctctactacctgcagaacggccgggacatgtacaccggggaggagctggacatcgactacctcagccagtacgacatcgaccatatcatcccccaggccttcatcaaggacaactccatcgacaaccgtgtcctgaccagctccaaggagaaccggggcaaaagcgacgacgtgccctccaagaacgtggtccgcaagatgaagtcctactggagcaagctgctcagcgcgaagctgatcacccagcggaagttcgacaacctgacgaaggccgagcgcgggggcctcaccgacgacgacaaggccggtttcatcaagcggcagctggtggagacccgccagatcaccaagcacgtggcccggatcctggacgagcgtttccacaccgagacggacgagaacaacaagaagatccggcaggtcaagatcgtgaccctcaagtccaacctggtgagcaacttccgcaaggagttcgagctgtacaaggtccgggagatcaacgactaccaccacgcccacgacgcgtacctcaacgcggtgatcgggaaggccctgctgggcgtgtacccccagctcgagccggagttcgtctacggcgactacccccactttcacggccacaaggagaacaaggccaccgccaagaagttcttctactccaacatcatgaacttcttcaagaaggacgacgtgcgcaccgacaagaacggggagatcatctggaagaaggacgagcacatctccaacatcaagaaggtgctgtcctacccccaggtcaatatcgtgaagaaggtggaggaacaaacgggcggtttcagcaaggagtccatcctgcccaagggcaacagcgacaagctcatcccacggaagaccaagaagttctactgggacaccaagaagtacggcgggttcgatagccccattgtcgcgtactccatcctggtgatcgccgatatcgagaagggcaagagcaagaagctgaagaccgtgaaggccctcgtcggggtgacgatcatggagaagatgacattcgagcgcgaccccgtggccttcctggagcggaagggctaccgcaacgtccaggaggagaacatcatcaagctgcccaagtattccctcttcaagctggagaacggccgcaagcggctgctcgctagcgcccgcgagctgcagaaggggaacgagatcgtgctgcctaaccacctcggcaccctgctgtaccacgccaagaacatccacaaggtggacgagcccaagcacctcgactacgtcgacaagcacaaggacgagttcaaggaacttctggacgtggtgagtaacttcagcaagaagtacaccctcgccgaggggaacctggagaagatcaaagagctgtacgcccagaacaacggcgaggacctcaaggagctggcgtccagcttcatcaacctgctcacgttcaccgccatcggggcccccgccaccttcaagttcttcgacaagaacatagaccggaagcgctacacctccacgaccgagatcttgaacgccaccctgatccaccagagcatcaccggcctctacgagacgcggatcgacctgtccaagctgggcggggactga

SEQ ID NO: 7640 - RNA, 4038 nt, synthetic construct; identical to SEQ ID NO: 1840
  misc_feature 1..4038: note = Cas9 variant
  source 1..4038: mol_type = other RNA

SEQ ID NO: 7641 - RNA, 4038 nt, synthetic construct
  misc_feature 1..4038: note = Cas9 variant
  source 1..4038: mol_type = other RNA
atggtcgaaaaatacggtatcggactcgacatcggcacgagcacactcggctggacctccgtcgacgaaaacggcaaaatacaaagactgaaaggtcaaaccgcgcttggtacgcgacttttcaacgagggacaaaccgccgaggaacgtagaggcttccgcacgacacgccgacgaatacagaggcgtcggtggagactacgcctactccgagagatctttgacgaaccaatcggctccgtcgacgcgggcttcttcgcccgacagaaaatgtccagtctgtctccacaggacgaccgattcgaagacacgtacagactcttcaacaatcaaacagataaggctttccacgacgaatatcccaccacgtaccatctccgccaagctctaatgaactcagacagacagttcgacatacgcgaaatctacctcgcaatacaccatatcgtaaaataccgcggcaacttcctccgctcaggcaaacctgccgactttaaaacgggcaagctagatctcaaggaaaaattcgaggagataaacgccgattggcagaccctcatctccgaggatgcacctcagctgccagtcgatgacctcacgaccattaaagctgttctcgtcgacggcagccgatcgcgatcagatcgacaacgcggccttgtcaaactttggatggccaatgaaaccgtggagaaaaactggaaacccgtgatgacggaactcgccaaagctattctcggccttaaaaccaaactgtacctgctaacaggactcgatctgccgaaggaagaccagaaagcctggacatttagtctggacacattagaagaccaccaaggcgacatagatagcttcttcgacgatcacgcccagcaactaattgatcgcctagccgagctacgcgccatgatccaactgaccgaaatcataccatcagggctaaacttcagccaatcaatggttcagcgctacgaagcccaccgctcacacctagaaatgtacaagcaatatgcgctagaccaaaccgatcccaagcgcaccaaagccctcagagcggcctacaacgcctacatagaccaacacgagatagcggatgacttctacacggcagtaaaaagggtcacgaaagacgaccaatcagagacggccgaagagataaaccgcctgataggcctcgaacagttcatgcccaagcagcgcacaaaggaaaatggcgttatcccctaccaagtccatcagcaagaactcgaccaaatcatcgcccaccagaaaaagtactaccccttcctgggcaccgaaaaccccgtcatagaccaccgggaatcccaaccctacatgctcgacgagctagtgagcttccgcgtaccctattatgtaggcccgatggtcgcagcgaaccccgaactaaaaaccacggaaaaccctttcgcgtggatgatccgcaaagcacaaggtgaaatcacaccgtggaacttcgacgaaaaggtcgaccgcaaaggatctgccaccgcctttatagaacgcatgaagactaccgacacctatctcctcggagaagacgtactaccccaacaatcccttctctaccaacgattcatggtccttaacgagctaaacaacatccggatagacgacgaactcctcacaaccaatcaaaaacaatgggtattcgacagagtgttcaaaggtaaaggcaccatctccgcgaaacacctccaagatgcactaaaacaccacggagaaaccgacggcctaccaaaaatatccggcctagccgaccccacaaaatttaactcagcactgacctcctaccgcgacttccaaaaatggctgccaaacgacatcgataggaaagaccgcacagctgacattgagacaatcatcaactggagcacggtctttgaagacactcatatattcgtggaaaaactaaaagaaatcgaatggttgaccgcggaccaacgacgccgaatcgcgtccaatcgataccggggctggggccgactatccaaacacctcctgacggaaatcaaagatgagcaaggcctgtccatcatggaccaactctggcgaacgcagcacaacttcatgcaaatcgttcacgaacctgactacgccaaacaaatagaagccgcaaataccgtcggcatggctaaacaagacataggtactgtcataaacgacctgtacactagcccccaaaataagaaggccatccggcaggttctagccgtcgtcaaagacatccaaaatgctcaccatggagtcgcaccctcctggatcttcatggaagccgctcggggtgcagaccagaacccacaaagatcccgccagcgacagagacagctgcaggacctctatgcaaaaaccgccgccgacctcgtggacaccgaagtgcaacaggaactaaccgacaaaattaaagataaggccaacttcaccgaccgactaatgttatacttcttacagaacggtcaggatatgtatagcaaggaaaagctaaatatagaccgactaagcgaatacgacatagaccacatcctgccacaagccctaatcaaagacgacagtctcgacaaccgagttctagtacatcaaagcatcaaccgaaataaaagcgacaccttcgcatccgagaaatacggggccaaaatgcaaggcgcctggcaccaatggcgagcagccggactgatctccgcaagaaaactaagaaacctagaaatgcgacccgacgaaataagtaaatacgcaacgggcttcatacgacgtcaactcgtagagactcgacaagtgatcaaactggtcaccgaaatactctcacaccagtacaacccggaagagactaagctagtttcagtcaaagccggactaagccacgaacttcgccgggaagcaggtctcccaaaactcagagatctcaacgactatcaccatgcaatcgacgcctacttagccgcgagaatcggcacatacctactgaaacggtacccaagactagaacggttctttgtctacggacaatttcagacgtcccgcctcgacctccgccgcttcaacttcatacacgacctcgtaaaatcgaagcagggagtcatcgtcgactccgacaccggagaaatcctctgggatagacaaaaagatatagattacattaaacaccttatgggcctaaaacacctactggtgacacacgaagtgtacgactccgccgccgagatgtacgcacagacaatcttcaaagcgtcagacaacgactcgaaagtcctaatccctaccaagaacgacagaccgacagccatctacgggggctacaccaaacgccgcaacggttacttagccatcctcaaaatcacagagaaaaaggccgagacctaccgcgtagtcggagtccccaccctatacatgtcacagctggccactgcccgctcccactctgtcgaagccgaaaaagcattactaaaatcactaatggcaccagaaatattatcggaatcgaaagtagtttccttcgaagtcgtggtcagccacgtccacctcaaccagctagtccgagacaccgtgttcggaccagcgcactacttcggactcggcccattcagatacgttcgcaacttccaccaactcgtactacccttcaaagaccaggaaatcctcgtcaaacgcacccctacagacgaggaactcaacaccgtgtttgaagacatatgctggcaagtagaaaactactttgccgttttcgacattaacgggttcagaaatgccctcaaaaagtcaatagacaaattcgaacagctaccaatcgagaacgttttcaaagacaagaaattggtcacccaaggtaagaaagaggtgctggcgttcgttatgcaggggctccacgccaacgccagctaccggaacctgaaagtatcactcggcataaaaactccactaggacaactacagctcactaaatttatgctctcccgtgacgccgagctcatcgacgaatcgccaaccggtttattcagaagaatccgacgcctaaaagacctctga

SEQ ID NO: 7642 - RNA, 4038 nt, synthetic construct
  misc_feature 1..4038: note = Cas9 variant
  source 1..4038: mol_type = other RNA
atgggcaacaagctgcgcaacgtggacgattactacctcgggctggacataggcaccgagagcgtggggtgggccgtgaccgacaagtactacgtgattccgaaattcaagggcaacgccatgtggggcgtacatctgttcgacgagggagagacgtccgtgaagcggcgaggcttccggagcgcgcgccggcgcacccagcggaagcgcgagcggctggccctgctggaggccctcttcgacgaggagatctgcaagaaggattgcaccttcttccgccggctgcacgagtccgacctgtggccggaggacaagtctggggacgacaagtacgccgtgttcgccgacgagaactacacggacaaggacttccacaaggagtacccaacgatctatcacctccgctacgagctgatcaagaacaaggagccccacgacgtcaagctggtgttcctcgcgctgcaccacatcatcaagaaccggggccacttccttttcgactccctcagctccgccgaggacttcaactcggcctacgagaccatgtgctcctaccttagcgacaatgagatccagctgaactgctccgacatcgagcagttcaaggccatcctgaaggaccgccggcaggggaagatagagaaaaccaagaacctagcgagcctgttcggcataaccaagaagtccgaccccgtgagctacgccgttatggccgtgctctccgggagcacggtgaagatgtgcgacctgtttggcgacgacgaactgaagactgtcgagaagaacaacatctcattcgccagcggctacgaggagaacgaggagatctacgcctccgtgctcggagaccgcttcgagctggtgaagatcctgaaggcggtctacgactgggcagtgctcgcagacatcctggacgggaaaaagtatatatcggaggccaaagtggccgtctacgaaaaacacaagaacgacctgaagaccctcaagaagtacgtgaagacctacctgccggagaagtacaacgagatcttcaagataagcgacgggaagaaggacaactacgtggcgtactccggccacatcaaggagagcggcaagaccggggaactgaagaagacctgcaactccgagaacttctgcgcctaccttaagaagaccctcggcaagaatgccgacctgagctacaaggagatgttcgacgagatcgagaacaagaccttcatgcccaagcaggtcacgaagtccaacggcgtggtgcccatgcaggtcaacgaggaggagctcaaggccatcctggacaacgccaaggactacctgagctttctcaactcctgcgacgagaacggcgtgagcgtctacgacaagatcatcaagatcttcgagtaccggatcccctactacgtggggccgctgaacacacacaccgaaaactcctggctgaagcgcaaggacggcgttaagatctacccctggaacttcgacgacgtcgtggacatcgacagctcagcggagaagtttatcaacaacctcaccagcaagtgcacgtacctgcccgagtgcgacgtcatccccaaatgctcgctgctctacagcaaattcactgtgctcaacgagatcaataatctgaagctcaacggcgaggacatcccggttgagctgaagcagggtatctacaaggacctgttcatgacgcggcgcaaggtgaccgtcaagcagataaaggactacctgaaggcccggggctgctacgacaacaacgacgtgctctccgggatcgacacgaccgtcaagagctccctcaagagctacttcgatttcaagggcttcgagtccctgaccttcgacgacaaggagagcatcatagcgagctccgtaatcttcggggacgacaagaaactcctgaagaagaggctgaagaaactgttccccgagaagctgactgacgaggacatcaaaaagatctgtaagctgaagtacacgggctggagccgtctctccaaggagttcctgtgcgacgtggagttcacctacaagaagaccggcgaggtgatgaacgtcatcaccgccctgtgggagacgaactacaacctcatgcagatcctgtactccgaagacttctgctgcgacggggacgagaagaagaacctgaacgataagctcgacgagctgtcatacaccggcgaccagcacagcctgcggaaggccgtggacgcgctatacgtgtcccccaaggtaaagcgccccatcctgcgagccctgctcatcgccaaggagatcgagaagatccaagagcgcccgcccaagaagatcttcgttgaggtggctcgggggatcgataatcgcgaggagaggcaccgcgattcacggaaaaaccgcctgatggagctgtacaagaactgcaagaaggaagcggagaaattctgcccctacttcgatgccctctccaagaagctgagcgacgaggacgagtccaagctgcggcgcgacaagctctacttctattacatccagctgggcaaatgcatgtacaccggggaggagattagcctgggagagctcatgaacggcaacggtcggtttgacatcgaccacatctacccccgctcgaagatcaaggacgactcgctcaccaacaaggtcctggtgaacaagacggtgaacaacaacaagaccaacgtctacccgatcgacgccgccatccagtccaagatgagcccttactggcagatgctccggtccagcggcctgatcagcgaggagacctacaagagactgacccggaagacgcccctcaccgacgacgagctgtccgccttcgttagtcgccagctgaccgagacccagcagtccaccaaggcggtggcgcacatcctcgagcagctgtatcccaagccgaagacggagatcgtctacgtgaaggccgccctggtgcacgccttccgtcagagcaacgacatgctcaagtgccgcgaggtcaacgacctgcaccatgcgaaagacgcctacctgaacatcgtggtggggaacgcctacaacgtcaaggtgacccacaataaggtgaacttcataaagggcctccagaacaacgacaagggctatacagtcaaccccgagaagtttttctcccacgacatacccggggcctggagcgtgaaggactccatgaacaccgtgcgcaggttcatgaacaaaaacaacatccgctacacgcggttccccagaaagaagcagggcgggctgttcaagatcaacccgctgaaaaagggcaacgggcaggtccccctcaaggcctcgggagcgcggtcctgcatcgagaagtacggcgggtacgacaaggccaccagcgcctacttctcctatgtggaatacactgacaagaagggcaaggccgttcgccagatgttccccgttaacctgtacgaggtgaaagaatacgaggcggacatgcaggggttcgtgaccagccggatcgccgaggcctccaacgtcaaaatcctgatcccgtgcgtgaagtacgacgcctgcatcagcttcgacggctgcagaatgttcatcacgaagaagaccggaaaccggatcggctacaagccgggcatgcagctcgtgttggggtacaagtacgagaagtacatccgcaacatcgagaactacctgaccaagcacaaagacagggaaatcatcccccgcgataacatctcggccgaggagaacatcgagctctacgacatcctgaccggcaagatgctgaacacggtcctctccgtgaagttctccgggattggcaagaagctggagaagagacgcgagaagttcgtgctgtgcagccccgaggagcagtgctgcgtcctcaatgagatcctgaaaattctgcacgcgaacgtgctctccggggacctgtcactgataggcgaaagcccgaacaccggcaccatgaagaccaacgcgaagttctccgaaatcaaggacgtccacagcatcaagctcatcaaccagagtgtgacgggcctgttcgagcaagagatcgacctgctcaagtga

SEQ ID NO: 7643 - RNA, 4038 nt, synthetic construct
  misc_feature 1..4038: note = Cas9 variant
  source 1..4038: mol_type = other RNA
atgggaaagccctactcaattgggctggacatcggcaccaactccgtgggctgggccgtcgtgaccgacgactataaggtgccggctaagaagatgaaagtcctcggaaacacggacaagcagagcatcaagaaaaacctgctgggggcgctcctgttcgactcaggcgagaccgccgaggccacccgcctcaagcggaccgcccgccggaggtacacgcggcgcaagaaccggctccgctacctgcaggagattttcaccggcgagatgaacaaggtcgacgagaacttcttccagcggttagacgacagctttctcgtggacgaggacaagcgcggggagcaccaccctatcttcggaaacatcgcggcggaggtcaagtaccacgacgacttccccacaatctatcacctccggcgccacctggccgacacctccaagaaggccgacctgcggctggtgtacctggccctagcgcacatgatcaagtttcgcggacacttcctgtacgagggcgacttaaaggccgagaacacggatgttcaggccctgttcaaggacttcgtcgaggagtacgataagaccatcgaggagtcccatctgtccgagatcactgtggacgccctgagcatcttaaccgagaaggtctccaagagctcccggctggagaacctgatcgctcactacccgacggagaagaagaacaccctcttcgggaatctgatcgcgctgagcctcgacttgcacccgaatttcaagaccaacttccaactgtcagaggacgccaagctccagttcagcaaggacacctacgaggaagacctggagggcttcctgggcgaggtgggcgacgagtacgctgacctcttcgcctccgccaagaacctctacgacgctatactgctcagcggcatactgacggtggacgacaattccaccaaggccccgctgagcgcctcgatggtgaagcgttacgaggagcaccagaaggacctcaagaagctgaaggactttatcaaggtcaacgcccccgatcagtacaacgccatcttcaaggacaagaacaagaagggttacgcgagctacatcgagagcggcgtgaagcaggacgagttctacaagtatctgaaggggatcctcttaaagatcaacgggtccggcgacttcctcgacaaaatcgaccgggaggacttcctacgcaagcagcgcaccttcgacaacgggtcgattccacaccagatccacctccaggagatgcacgctatcctgcgccggcagggcgagcactacccgttcctgaaggagaaccaggacaagatcgagaaaatcctgaccttccgaatcccctactacgtggggcccctggcccgcaagggctcccggttcgcctgggctgagtacaaagcggacgagaaaatcacgccctggaatttcgatgacatcttggacaaggagaagtccgccgagaagttcatcacccgcatgaccctcaacgacctgtatctgccggaggagaaggtcctccccaagcacagccccctgtacgaggccttcacggtctataatgagctgacgaaggtgaagtacgttaacgaacagggcgaggccaagttcttcgacacgaacatgaagcaggagatcttcgaccacgtctttaaagagaaccggaaggtgaccaaagacaagctcctgaactacctgaacaaagagttcgaagagttccgcatcgtcaacctcaccgggctggacaaggaaaacaaggcttttaactcctccctgggcacgtaccacgacctccggaaaatcctggacaagagcttcctggacgacaaagccaacgagaagaccatcgaggacatcattcaaaccctcaccttgttcgaagaccgcgagatgatccggcagagactgcagaaatactccgacatcttcacgaaggcccagctcaagaagctggagcggcgccactacaccggctggggccggctgagctacaagctcataaacggcattcgcaacaaggagaacaagaagactatcctggactacctgatcgacgacggatacgcgaatcggaacttcatgcagctaattaacgacgacgccctttcctttaaggaggagatcgcgcgcgctcaaatcatcgacgacgttgatgacatcgccaacgtcgtgcacgacctgcccggctcaccggctataaagaaggggatcctccagtccgtgaagatcgtcgacgaactggtgaaggtgatgggccacaaccccgctaacatcatcatagaaatggcgcgggagaaccagaccacggacaaggggcgcagaaacagccaacagcggctgaagctcctgcaagactccctgaagaacctcgacaaccccgtcaacatcaagaacgtggagaaccaacagctacagaacgaccggctattcctctactacatccagaacggcaaggacatgtacaccggggaaaccctagacatcaacaacctgagccaatacgatatcgaccacattatcccccaggcattcatcaaggacaactccctcgacaaccgagtgctgacccgcagtgacaagaaccggggcaaatctgacgacgtgccaagcatcgaggtggtgcacgagatgaagtccttctggagcaagctgctatccgtgaagctgatcacccagcgcaagttcgacaacctgacgaaggccgaacggggcgggctcaccgaggaggacaaggccggattcatcaaacgccaactggtggaaacccggcagatcaccaagcacgtggcccagatcctggatgagcgcttcaacacggagttcgacgggaacaagcggcgcattaggaacgttaagatcatcactctcaagtctaacctggtaagcaacttccgcaaggagttcgagctctacaaggtgcgcgagatcaacgactaccaccacgcacacgacgcctacctaaacgctgtcgtgggcaacgctctcctgctcaagtacccccagctggagcccgagttcgtctacggcgagtatcccaagtacaactcctaccgcagccggaagtccgctacggagaagttcctgttctacagcaacatcctccgcttcttcaaaaaggaggacatccagaccaacgaggacggggagatcgcctggaacaaagagaagcacatcaagatcctgcggaaagtcctgtcctacccccaggtgaacatcgtgaagaagacggaggagcaaaccggcgggttcagcaaggagtccatactccccaagggcgaaagcgataagctgatcccccgcaagacgaagaacagttactgggaccccaagaaatacgggggcttcgacagcccggtcgtggcatactccattcttgtgttcgccgacgtcgaaaagggcaagagcaagaaactccggaaggtgcaagacatggtgggtataaccatcatggagaagaaacgcttcgagaaaaaccccgtcgacttcctggagcagcggggctaccgcaatgtgcggctggagaagattatcaagctccccaagtattccctgttcgagctggagaacaagcgccgacggctcctggccagcgcgaaagagctgcagaaggggaacgaactcgtgatcccgcagagattcacgaccctgctgtaccacagctaccgtatcgagaaggactacgagcccgagcaccgagagtatgtcgagaaacacaaggacgagttcaaggagctcctggagtacatatccgtgttcagccggaaatacgtgctggcggacaacaacctcaccaagatcgagatgctgttctcaaagaataaagacgccgaggtcagctccctggccaagagcttcatctccctcctgaccttcacggcattcggcgccccagccgccttcaatttcttcggtgagaacatcgacaggaagcggtacacctccgtgaccgagtgcctgaacgccaccctcatccaccagtccatcacgggcctgtacgagacccgcatcgacctgagcaagctcggtgaggactga

SEQ ID NO: 7644 - RNA, 4038 nt, synthetic construct; identical to SEQ ID NO: 1844
  misc_feature 1..4038: note = Cas9 variant
  source 1..4038: mol_type = other RNA

SEQ ID NO: 7645 - RNA, 4038 nt, synthetic construct; identical to SEQ ID NO: 1845
  misc_feature 1..4038: note = Cas9 variant
  source 1..4038: mol_type = other RNA

SEQ ID NO: 7646 - RNA, 4041 nt, synthetic construct; identical to SEQ ID NO: 1846
  misc_feature 1..4041: note = Cas9 variant
  source 1..4041: mol_type = other RNA

SEQ ID NO: 7647 - RNA, 4041 nt, synthetic construct
  misc_feature 1..4041: note = Cas9 variant
  source 1..4041: mol_type = other RNA
atgctgagcgccggcgtgatgctcggagacgtcagcgccctcaagagctcccgcaacagcctgttccagaagtccaagaagctgatcgagaacagcagtagcgacctgaccaaggtggactactccaagatgcgggagatccttctcagcatccgcaacatcgcgatccggttcttcaacaacgaggacttcaaggagtccgactactacaaggagttccccaccatctggcacctccgcaaaaacttaatggagagcgacaagaaggccgacatccggctggtgtacctagccctgcacaacatcgtcaaataccgcggcaacttcctccaggagaacaacaaggacctgcgggccgccaacgcgaacgccggggccgccgcgatagacctgtccaatgccctcgaggagtacttctctctgcacgaggacgagtccgccctgacgtgcgtgccgaacgtggctgacctccagatgaccctggagcagcccggcctgcgcaacggggagcggctcgaccgcatcgtcgccgcgctgaacatgccagaccgggcccgcgccaagctgttcgccaaggcctgcattggccagaaggtggagttcagcaagctcgcgctgggcatggagaagcaggaggggaccaacgcctacatctgggacgacgacaagtacgacgagctggtggccctctgccccgaggacttcttcccggtcctggagaccctgaagaacgcctactccgcctatgtgctcagcgacctgctggcgggcaagctctccatcagcgctagcctgatcgactcctacgagcagcaccagaatgacctgaagatcgtgaaggagctcgtccgggagtacctgggccagaaggagtacggccgcctgttccgggggcccaagttcgccaacggcgactacaacttcaacaaggtggccaagcccagctacacgtcctacatcctcggcgagagcctgtgcaacaagcaggggaccaccagagaggagctggtgaaggagctcaagcgggtcttcgacgactgctccgccatccaggcggacaagaggtaccagaagatcaagcagcggctggaggacgaccccaagttcctgatcaagcagaagacccgcgccaacggcgccatcccgtaccagctccacttggaggagatgcaccagatcattgagaagcaggggaagtactaccccttcctggtagagcagcaggacctcatcgagaagctggtgagctcccggatcccctactacgttggccccctgaacggcgggcacgacccgaaccacccctaccccacgaaccccatagacccgaaaaggaagttcgcctggagcgtgcgcaagcccggcatggagcacgagaaggcgtacccctggaacgtggatgaggtcatcgactccgaggagaccgccgagcggttcatccgccggatgaccgggacctgcacgtacctgtacggcgagcccgtggtgccgcgctgcagcctcctgtacgaggagttctgcgtcctgaacgagctcaacggggcccggtggggcgagggcaacggggacacccaccgctttgactccagcgaccggacagagatcctggagcaactgttcaagaagcgcaagcgggtgacgcataaggccatcgccacgtggctagagatcaaccacggcgtcaccaacgtgaagatctccgggacccaggcggagaacgccttcgagagcaagctctccagctacaacgacttctgcaacctgctcggcgtcgacgggctggaggacgtctgccccctgaccaaggacgacatcgaacagatcattctctgggtgaccgtgttcgaggacaagaagctgctgctccagaagctgcagcgcgccttcggcgacaagctgtccgagaagcagatcgcaagcatcatgcggaagccctacgccggctgggggcgcctctccagcaagctgctgaccggcatcaagcgggagacccccttcgggcgcattagcatcctcgacgtcatgcgggacggcgatccgcgccccgggcaccacctggacgcgatgaacttcatggagatcctgcgggagaaggacttcggcttccaggaccgcatcgacgagatcaacaaggagcggaccaaggagtccggcctcctgctgagcgtggaggacctccccgggtcccccgccctgcgccgcagcgtgaaccaggccatgcacattctgaaggagatcgtctccatcgccggcaaggagccgagccggatcgtgatcgaggtgacgcgcgaccccgacgaggagaaacgggggcaccgcaccgacacccggtacaagcagctctctgaggccctggcggccatcaagaccgacatcgtccagttcgacagctccctgctcgccgagctgaaggagcgcaaggacagcctggactccgagcggctcatgttatacttccagcagtgcggcaagagcctctactccggcaagcccctcgacataaatcgcctgagcgagtaccaggtcgaccacatcatcccgcagtgctacatcaaggacgactccctggacaacaaggccctcgtgttcgcgagcgagaaccagattaagctggattccctgctcctggacaagagcatcatccggagccagaaggggcgctggcaggagctgcaccgggccggcctcatctccaacaagaagttccgcaacctaacgtgcaccgagatcagcgaccggatgatgaaggggttcatcaaccgccagctggtcgagacctcccagatcgtgaagttcgtgcggcagatgtgcgagcagcgctacgagagctccgaggtcatcagcctccgggcctccctgagccacaacctgcgcgaccggtgcggcttcatcaagtgccgcgagctcaatgactaccaccacgcccacgatgcctacctggcgtgccagatcgcccggttcatcgggatccgctacccccgctggcaggacggcatctcccgggagttcatcaacaagtacatcaaacagctggtgaagaaggggaaaagctccgggaagttcttcgccggcaagagcgggtttatcatcgactcctttatgcacgacggcttcgaccgcgagaccggggagatcttccgggatggctgggacgccacgttcgagatcacccgcatgcggcgcgtgctcggctacaaggactgctttataacccggatgcccgaggagcagaccggggcctactgggaggagacgatctacagccccctggacgcgaagaacggcaagaacctgcagatcccgctcaagcagtccgggaaggagggctacctggaccccaagaagtacgggggcaccaacacagccttcaacgcctacttcttcgccttcgtcgccaaggacgcgcgcggccgggacaagtacttcttcgagggggtgcccgtgtacctggccaagcagctcaatgagcagccccagatcctggtcgacttcgccaacagcatcgccgcgacaaagaagtgctccaccgccaagatcctgcgcagcaaggtgccgctccggcagaagttcctgctggacggcacgtccttctacctcgggggccgcaccgggaacaagaacgtgatcctgagcggcgtcgagttcgcctgcggcatcgacatggccaagatgatcgacactgccatcaagcaccccgaggaactgagccagaaggagctcatcagcattatccagatgctggcggacaccatcgagcggaacagcgaccgccaggcctccctgatcaacttccggcgcttcgacgacaagctccggaacatcgacgccatcgcggccagccgcatcatcaagaacctgctgaactccatgaacggagtgaagcagagctgcgacctctccgacctgggcgggtctaagcagtccggcttcatgcagagcaacatcgcgacgttgttcgagcggatcacctggtgctactccagcatcaccggcatgttcgagcagcgcgtgtccttcgaggacctcaagaacgggatctga

SEQ ID NO: 7648 - RNA, 4041 nt, synthetic construct
  misc_feature 1..4041: note = Cas9 variant
  source 1..4041: mol_type = other RNA
atgaagaagcgcaaccgggaagagtactacgtaggcctagacatcgggaccagcagtgtcggctgggccgtggcgacccccgactaccgcatcccgaagttccgggggcacaagatgtggggcagccgcctcttcgcggaaggtaagcgtgccgccgagcgccggcagtttcgcacgaaccggcgccggctggcccgccggcgcgaccggctgcagatattagaggagctgttcgccgaggagatggcgaaggtggacaacacctttttcatgcgcttaaaagaatccaaattcttcctcgaggacaagaccgtaaaggaaaagcacatactcttcagcaccgacaagttcgacgccgaccggttctacaaggacaaccccacgatctaccacgtgcgcaagcggctgatggaggaggagccccaggacatccgcgagctgttcctcgccgtgcaccacatcttgaagtaccggggccacttcctcttcgctggctctctggagcaaaacggggacagcatcgaggagctcgtccgcaccctcttcggcaagcaggggttggcgatcctggacgacaccatcgactccaatgagatggtgaacatcctcaagaacaacgagaagaccaagtcagaccgcaagaaggccgtgcaggagttgtggaatccgctgaaggacaaggtcaagaaggcccaggccgccgagatggcgggcgtggtgttaggcttgaactccgacatcagcaaactgtttgacaactccgattacaaggatctcaagatcaacttcagctccggcgactacgacgagaagcgagacgactacgccaactcgatcggtgacgatatagtcctgttagacactatgaaagccctctacgacaccctgatcctgagccagatcctccaggggaagcaaagcatctccgaggccaaggtggaggactacaacacccacaaagagcaactgcgcgccctgaaggcgattctcaagccacacaagcggctgtacaacgagatgttccgcgagaataacaagaaggacctgagcaattacgtggcctacatctccagctacagcgagggtaagagggtcaaccgagaggggttctacaagtacgtacaggccgtgctgaaacaggtcgacgactctgacagcaagcaggccatcctggaggccatccggctggagaccttcttacccttgctgcgcgtcaaggacaatgccgtgataccccaccagatccaccaggccgagctggaggccatcttagagacggcccggaagaagtacaagttcctgaacgacgtctccgaaggcgtgagcgtgaaagacaaaatcatccagctgttcaccttccgtatcccctattacgtcggcccgctcaacccccattccggggagaccgtggccgaccggaagcagggcaccgggtgggtcgtgcgcaagcagcgaggtaaggtgtatccttggaatttcgcggacatggtcgacgtcaaggcctcagccgaggccttcatcacgaacctgaccaacaagtgcacctacctcatcggggaggacgtgcttcccaagaggtccctgctgtacagcgagttcatgctactgaacgagttgaacatgatcaaatacgacggccacgaactcccggtcgaaatcaagcgactttacatcgagcaggtctttaagcaggaacacaagaagcagaccaagggcagagtgctggatttcctcaagcggaacgggctgatcacaggctccgctaccgccgtgatcacggggatggacgacagcataaagggcgacctgcaatcctaccgcgacatggtgcggatcttcgggaccggcttcgaccacagcatggccgagcgaatcatcagatgggtgaccctcttcggcgaggccaaggacatcctggaaaacaagatccgggaggtctacggcaactccataagcgactcgcagatgagggccatcaagaaacttaagtacgcggactggggccggctgagccaggccttcttcatcaagatcatcgggtgcgacaagtccggcgtggagcgcaacatcataacgtgcctgcgggagagcagtcagaacctgatggaaatcctcagcgaccagggaacctacatcaagcagatcaaggcctggaaccaccagcacacaacaaatatgatggacacactggactaccagctggtggacgacctctacgtcgccccatcggtgaagaggtccatctggcaaagcctgtgcatcgttgaggagctggtaaagataatgggccaggcccccaagaagatcttcgtggaggtgacccgcactaatcaggcagagaagacgaagaaggactcccgcaagaagcgcctcgtcgagctgtacaccgcgatcggtaaggagggggccgcctggaagaaggaaatcgagaagcaccaggccggcgacttccgcagaaagaaattgtacctctactatacccagatgggacgctgcatgtacagtcacgagcccatcgccatggacgctctgttcacgtccgagtacgacatcgaccacatctatccgcagagcctgacgaaagacgattcctgggacaacctcgtgctggtcaagagccagctgaacaaggagaagtctgaccagtaccctctccggcccgccatccgcgagaagaacaaggcctactggcagtacctctgccgggcgggcttcatctcagaaaagaagtacgagcgcctgatgcggaccaccgagctcaccgccgaggagctgtccgggttcatcgcccgccaactggtggagacctcgcaggccacgaaggccgtgatcgggttactggagcggatctacaagcataccgatatctgcttcgtgaaggcggagacggtctcccagtttcgccaccagcacaacttcatcaagatccgcgagctgaacaactaccaccacgccaaggatgcctacctcaacatcgtggttggcaacgtctaccacgagaagttcaccaagaatccccgcgagttcatcgctcgcagcacagaacggcgcccgtacaacctaaaccggatgtacgacttcgatctgctcaagcaggggcgcgtgatctggcaagtgcccaagtccctggagaccgtgcaggccatgatgaagtccaacgacgtgcggatcacgaagaaactgctggtgcagaagggcgagctgtacgacgctaccataacgaaggcgcacaagacaaaggaggggatgtacttccccctgaagggcgccgacgcccgcctccgggacgtccaccgctacggcgggtacgaaaagatcaagatcgcctactacagcgtgttcagctgctgcgagaaggcgagcgacaccatccacaccctgatcatccccatcccggtgtacgccgccggcctattacagacagaggccgacctgaccgcgtacgcctggcagaccaagcagaagaccaagccgatcaaggacatttactccatgattacgcccatctacaagaagctgtgcatcaacaccgtcgtgaagatcgacgggtttaagtacttcttgggcgggcggaccgaagactacatctgcctgtacccagctatcccggtggtcctggacgagcaggctgccgcgtacctcaaggccgtcagcaaggtgggccgcgccgatgatgtcgagaacaccgcccaggctatcgacctcatcacggctgaggccaacgaggccttctacgacgtgcttctcaagaagatggaggccaagatcttcgtcaaggcctaccaggagcgggtcgaaaagctggcgtccgagacggcccgcgaacggtttcgcaaactgagcataggtgcccagtgttcctgcctccttgaaatcttgaacttactggccaacaacaaaaccaccagcaacttgaagaagtggctgggggtgacgatgtcccggcgcaagcagcccatggatctgaccaagctggaggagtgcatcgtgtacgagacctctatcaccggcctctacgagaaggccgtctccctgctgtga

SEQ ID NO: 7649 - RNA, 4041 nt, synthetic construct
  misc_feature 1..4041: note = Cas9 variant
  source 1..4041: mol_type = other RNA
atggtagagcactacgccataggcttcgacattggcaccggttcaacaggcttcgccggtgtcgatccaaacggaaaactcgtccgcatgcgaggcaaaaacgtgtacggagtgtaccgattcaagggaggcgaagctgccgcagacagacgcggatttagaaccacacgccgccgcataaaacgccgcaaatggcggctccgattccttaaatccttctttgaaccctacatagccccaatcgacccagaatttttcctacgccaaaaatactcggccgacagcccccttgatccgaaaggaatccgcgccgacaagggcctcttaagcgacatgagtgaccaagaatttcacgcaaagtaccccactatctatcacctcagataccaactaatgcacgagaagaggcaattcgacgtcagagagatctacttggccatgcaccacatcatcaaataccgaggacacttcctcatcgaagacggcgcggacaacttcgacgcaaagcaaatagactttttcgaccagttccaacgaatggccgcagtcacagccgggcttccggaactcgagaccctcgtagtcccagacgaaacgcaatccgacgccttcaaacgagtactgttcgatgaaagccaaactaaatccgacagacaaaaagtactggcatctcaactgctagacatacaagacaaccagtcaaaagcaataaaagactttatagcagctctcaccaaggctgtagtcgggatgaaagccaaccttgccacccttacatcgaccgcaatcgaatccaccgacaaaaacgattggacaaagcctctcggccagctcgacgactttttgctcaaacacgaggaagacctagacgaagatggttacgcgttgatcgacgccgcgaaccagatgtactccgccgccgtccttgctgccctagtgccagaaggcatgggcttctcggaagcaatgatggcaagatacgcacaacacaagaaacaactagcactatacaaacaggttatcgccagtctaccagataaaacccaacgacacgaactcaaagacgcttacgcagactacatagaacacgcagcccagaacccacgagacgccttctacaaacgtgtaaccaaagtactggaaggagtagactcagcggacgcacgcaccgtcatgaccgcaatctcccacgacgagttcctactcaaacagcgaactctctccaacgggaaaataccataccaaatgcaacagcacgagttcgacgcaatcatcgaaaatcagaaagcctactacccctggctcgcaacaccaaacccggtcgaagccgacgccaagcgtctcccatattacctcgacgaactaatcggattccgcgtaccctactacgtcggccccatggtcactgaaaagcagagtcaatttgcgtggatgatccgcaaagcagacggcgaactcaccccatggaacttcttcgatgtagtcgatagggagaaaacagcaaaccgctttatccagcgaatgcaaaccaccgataaatatatcctcggagaagacgttctcccaaaacattccatactatatcagcagttcgaagtcctcaacgaattgaataacatacgggtcgaaaagcaccccctgacaaccgaacagaagcaattcatctaccaaagactattcgttgaccagcaaagaaagactataaccaagaagaatctccaggacacgctcgtagcgatgggcgaatttgacaaagcacccgacataggtggcttagccaaagaagacgtcatgatgtcatcactggcgacatttgccgactacagcaaaattctcccagaagcaatatccgatcctacacggcagaatgacatcgaagacataatagcctggagtactatattcgaagacacgcaaatcttcttcgacaagttaaaaacagtcgactggctcactacccaacaaagaaaacggctcgctagcatccgctataccggctgggggaaactgtccaagcgcctactacagcaaataccaactagcaaacatacaaacgtaatggcggcgttatgggcgacatcagacaacttcatgcagatacttcaggacgaacagtttcaggaaggcttatacgacgcaaatcgcctccccgaagaaacactcacacccgacgaacaagtcgagaaaatactcgacgaagcctacctgagcccagcagacaagaaaggagcgcgtaaagtaataaaagtcatgaacgatatagtgcgcgccaaccacggcgtcctgccagaacaagtcttcctagaatcggccgatgacccacagaaaaacaagcgccgaagcgtctcccgatccaaacaactcgaagaaaagtaccgacaggccgcacaatcattcatcgatgaagcggtcaaagaagagttgaacgcccaaatcgtgaactccgccgagttcaacgatcgcctagtcctctacttcacccagaacgggcgagacatgtacacaggaaagcgtctagacatcgaaaatctgggctcctaccagatagaccacatcctgccgcaaagcctagtcaaagatgacagcctcgacaatcgcgccttaaccgcacgcgacataaacgctgagatgtcaaaccagttcgtatccgaacgatttggtctcggcccacgcgcattttggcaacaactgaagaacaacggcctaatatccggccggaaattccgtaacctagtgatgcagcgagacgaaatagacaaatatgccccgggcttcataaacagacaattagtagaaacaaggcaaataattaagaccgtggaacaaataatacaccggctgtggcccgacatacaaatagttactataaaagcaaacctcacccaccaagtccgcagcgaactcggattccccaaagtccgagaactaaacgactatcaccacgcattcgatgcattactcgcagcccgaatagggcagtaccttctcgagcactacgcaggcttgaaaccgttctttacctatggagagttcaagcgcggcgacacgaagaagtatggaacaacaaacttcctccgccggctcacaaaagataacaaggacaagaaaggcgaactactccccgaagtctcagactggatagactccattgactcaatctacaactacaaaaagataccagtcgtatgggaaaacacgaccaacatgtcggccctattcgaccaaaccatctaccctagacccgaccgagacaccacaaaacgcaaactgatccccacaaaactcgacaaacccaccgatatctatggtggctattcctcagccaagaccgcctacatggcagtcatgcgcgtccaaacgaagaaaggcaccgagtacccagtattcaatataccggtctccatcgcctcccagcttaaccgcatcaccgaccaaacgatgctcaaacaacaagtcaaacaattcattatcaacgccgaacaatccgcctccaagaagaaactctacgagagcggagacgtaattctctcccgcgtagcccttgggcaacggttcacggataaaaactacggcgaagttttcctaataagtaacatggaggtccagaacccacaatccctctggctcgggcgagctagccagcaaagactaacccgcgaaccagaagggaacgaaaaacccgaaacctctctcgcagacatataccagcaaatcctgaaacaagtcgacagatacttcttagcgttcaacatccgccaacaacgacaaaaactactcggcaccctcgaccaattcacctcactacccgtcggccgagtgaacgaacagacccggactgatcaaaatcaaaggtccatcatagctcgtgtcatgatagtgctgggcaaaggatcccgagaagaaaagttcccagagttcggactgtccgccctcggccgcctggtccgaacgggaggtatcaccctcagcgaagacgcacagataatctaccagtccccaacaggccttttcgaaaggcgtgtggctctcaaagacctttga

SEQ ID NO: 7650 - RNA, 4041 nt, synthetic construct
  misc_feature 1..4041: note = Cas9 variant
  source 1..4041: mol_type = other RNA
atggccaagatcctgggcctcgacctggggaccaacagcatcggctgggccgtggtcgacatcgagaacaacaacgagttcaccctgatcgagaagggggtacgcatcttccaggagggcgtgaagattgagaaggggatcgagggctcgaaggcggccgagcggacgacctacaggagcgcccggcgcatcaagtaccggcgcaagctccggaagatccagctactgggggtcctctccgagaacgggtactgccccttcctgagcaaggacgagctggactcgtggcgctacaagaaggtgtacccgaccaacaagagcttcctcaactggcagaagaccaacgagatccagctggagaacccctacttctaccgggccctgctcgtggagaagaagctgaacctgaacattgaggaggaccgcttcaagatcggccgggcgttctaccacctcgcgcagcgccgggggttcctgtccaaccgcatggagggcacgaaggagaacgacgggaccgtcatcaagagcatcacggagatctccaccgccaagggcgataagacgctgggccagtacttctacgagcggtacaagaagggggagaagatccgcgatacctacacccacagggaggagcactacctcgaggagttcgtgcgcatctgcgagttccagcagctggacaacaagttcgccgagaaagtgcggaaggccatcttctaccagcgccccctcaagagccagaagggcctcatcgggaagtgcgtcttcgagcccaagaagtcccggtgcagcgtgtcccgcccggagttcgaggagtaccgcatgctgtgcttcctgaacaacatcaagatcaagacccccagcgacgagaacctccggttcctgacggacaacgagaaggagaagctgaagcctcagttcttccgcaagtccaaggaccatttcgacttcgaggacctcgtgaagcagctggcgccaaagaaccagttcaagttctataagagccgggacatcctgccgggcaactggctgttcaactactccatgaacaccaccgtcagcggctgccccatctccgcccgcctgaaggacctgttcggggagaacttcatggacatcaagttcgactacatccgggagaaggacggcaagaagtccgtgatcgacatccacgacatctggcacgtcctcttcacctacgacagcgaggagaagctgaaggagttcgcccggaaccggctgaacctcgacgacatcaagattaaggagttccagcgcatccagctgaagaaagagtacgccgccctgagcctcaaggcgatccggaagatcctgcccttcctgcgcgaggggctcatctacagccacgcagtgttcatcgccaacatggagacggccatcccctccgagatctggaacaactacaccaaccggaacatcatcaagaacgagatctacaacatcatcagcaaccagaccgaggacaagcaggtcgtggacatcgtgaacggcataatcaagtccagccgcatcgagaactccgtatggagcaacgaggccgtggagttcttcaagaaggacctcaattccaagatcaagaactactacgggatcaagacctacaacgacttcccggaggagaagaagatccggatcgaaacgtacgcgttcaacctgttcaagcagcagatgatgaagaacttcggccgcggcgagttcgccgccgtccagcggatcgacgagcgcctgaagctgttcctgaccgacaacttcaacatcgaccccatcctcctgaagaagatctaccaccccagcgccatcgaggtttaccagcccccggtgcggaagaacgacgggaagctgtacctgggctcccccatggtcagctccatcaggaaccccatggccatgcgggcgctccaccagctgcgcaagctgatcaacgagctcatccgcaaggagctgatcgacagcaacaccaaggtgaacattgagatggcccgggagctgatgaacgccaatgagcgaaaggcctaccagaactggcagaacgaccgggagaagattcgcaaggagtacgccctcaagatcaagcagcacttagacgtcgacaaggagccctccgacgtggacatactgaagtaccaactctgggaggagcagaaccacaagtgcatctacacggggaaggagatcaacatcagcgacttcctaggctccaacccgaagttcgacatcgagcacacgatcccccggagcatctccttcgacaactcacagagcaacaagaccctgtgcgagaactacttcaaccgctccgtgaagaaaaaccggatccccgcggccctccccaaccacggggagatcatcgagcgcctggagaactggaagctgaagtacgaggagctcgagaagcagatccagtacgccgtccggcaggccaaaggcgcgggcgacaaggacagcaaggaccgtgccatccagaagcggcacaagctgaagttcgagtacgactactggaagaacaagtacgaccgattcgtaatggaggacgtgccggaagggttcaagaactcccagctggtcgacaccggcatcatcaccaagtacagccggatgtacctcaacacgctgttcgacaaggtgtacaccgtgaagggtaacaccgtcgccgacttccgcaagctgtggggcatccaggacgaatacgagaagaaggcccgcgtgaaccactcccaccactgcgtggacgccatcacgatcgcgtgcatcactaagagcaactacgagaacctcgccaagttctaccacgactgggaggagcttcacgtcaaggggatcgatcagctgccgcccatgaacaagccctggaagacgttcacggaggacatcaaagccatccaatacgagatcctcgtgtcccactacacccccgacaacttacccaagcagagcaagaagatcctgcgcaagaagggccggatccagaagaacgagaacggcaaccccatctacctcaaaggggacactgtgcgcggctcactgcaccagcaaaccttctatggggccatcgagaagaccgaggtcaacaagaagggcgagccggagaaagtgatcaagtacgtggtccgcaagagcctggacgtgctcgacgactccagcgtaaagaacatcgtcgacgacatcgtgaaggagatcgtgcagaacgcccggatcaaggagaaggacttcatcaaggagctggagatccaaaagcggaagctggcgaaggccgaggagaacaaggtcgtgcagatacaggccgagatcgacaagctcaacaagcaggtcgccgacctgtacaccatgcccaacaagaacggcaaccccatccccatcaaaaaggtccgcatcttccagacctccgtgacgaacccgatccacctgaagcagcagcgcgacaagagccagaagacctccaagccccacaaggagttctactacgccgcgaacgacagcaactacatgatggccatctacgaggggaaggacgagaagggcaaagtgaagcgggacttcaagctcctgaacaacctggaggccggagagttcttcaagtacagtgtccacaaggacctcaaggagaagaacctggagaacatccggaacgtgatccccgataaggtgagcgccggcaagatcgagatccccctgaaagcgatcatcaagaccgggaccatggtcatcctctgggagaacagcccggacgaggtgtgggacctgacgatctccgaagtggacaagcggctgtacaaggtcgtgggcatgagcgtgaaccgcatcaagtccgatgtcaagaccttcgagttcggcaatatcgtgctccggcacaacaaggaagccagccccgccaccctgctgaagatccaggacggggagttcaagagtgacgagaactacatagcccagcgcaagctcagccacaaccagttcaacgccctggtggagggcgtggacttctccctgtcagtgctcggggaaatcaagcggctgaagtga

SEQ ID NO: 7651 - RNA, 4044 nt, synthetic construct
  misc_feature 1..4044: note = Cas9 variant
  source 1..4044: mol_type = other RNA
atgggcgaggacgggaagcccgtgcgcgtcaagggcaagaccgctatcggggcgcgtctattccaggagggccacgtggcggccgaccgccggatgttccgcaccacgcggagacggctcaaccgccggaagtggcgcctgaagctgctcgacgaaatcttcgacccgtacatcacccccgtggacagcaccttcttcgcccggctgaagcagtccaacctgagccccaaggactcccgcaaggagttcaaggggagcatgctgttccccgacctgaccgacaagcagtaccacgaggactatccgacgatctaccacctccggcgcgctctcatgaccgaggacaagaagttcgacatccggatggtctatctggccatccaccacatcgtgaagtaccgcggcaacttcctgaactccgcgaccgtggacaccttcaaggccagcaaggtcgacttcaagaagtccttcaaccagctcaacgagctgtacagcgccatcaaccccgaagacgccttccaagtggacatgaacaagtccgacgagacgggccgactgttcctcgacagctccatccgcaagttcgacaagcagaagcagatcagcaagctcatccccgtggtcgtggaggacaaggaggcgaagaagctgaacgggaaaatcgccctcgagatcaccaaggccatcctgggctacaagtccaagctgaacgtggtcacccagaccgagcccgaggacccgaagaagtgggccgtgaagttcgacgacgaggacatcgatagcaagctcaacgacatcctgcctgagatggacgagaaccagcagtccatcgtggagatcatccaggacctgtacagccaggtcaccctcaaccaaatcgtgcccaacgggatgtccctgagcgactccatgatcaagaagtacaacgaccaccacgagcacctgaagctatacaagaagctgatagacaacatcagcgacaccaagaagcggagcgccctgaagaccgcgtacgacaagtacgtgggagacgacgggaagaccatagagcaggacgagttctactccaacgtcaagaagaacctcgacgacagcgacctgtccaagcagatcgccgatctgatcgaagccgagaagttcatgcccaagcagagaacgtcacagaacggcgtgatcccgcaccagctccaccagcgggagctggacgagatcatcgagcaccagtccaagtactacccctggttcgcggaggccaaccccaacaagcacgacctgcacctcgcgaagtacaagatcgaggagctggtggccttccgcatcccctactacgtcggcccgatgataacccccgaggaccaggagaagtcctcccagaccatattcgcctggatgaagcgcaaggagcccgggcagatcaccccctggaacttcgacgagaaggtggaccggatggagagcgccaaccgcttcatcaagcggatgacgaccaaggacacctacctgatcggcgaggacgtgctcccggaccagtccctgctgtacgagaagttcaaggtcctcaacgagctgaacatggtgcgagttaacgaccaccccctgaaggtgagcgagaagcaggccatctaccgggacctcttcgagaaccagaagcgcatctccgtgaagaacctgcagaactacgtcaagtctaagtccgggctacccaccggccccaagatcagcggcctctccgacccggaccacttcaacagctccctggggacgtacaacgacttcaagaagatgttcggcgacaaggtggacgatcccgacctgcaggacgacttcgagaagatgatcgagtggagcaccatcttcgaggacaagaagatcctgcgggcgaagctcgacgaagtggcctggctgtccgacacccagaagaacgagttcaaggagatccgctaccaggggtggggccggttaagcaagaagctcctgacggggatcgtcgacggcaacggccagcggatcatcgacgagctgtggaacacgaacaagaacttcatgcagatccagagcgacgactccttcgccaagcggatccacgaggccaacgccaaccagatgaaggcgaccgacgtggaggatgtgctcgccgacgcctacaccagcccccagaacaagaaggccatccgccaggtcgtgaaggtggtcgacgacatccagaaggcgatgggcggggtggcccccaagttcatctccatcgagttcacccggtctgaggaccgcaacccgcggcgcacgatctcccggcagcgccagctggagaacaccctgaaggacaccgcccaagccctcgtcaagagcatcaaccccgacatcttgtccgagctggacaacgccagcaagtccaagaaggggctcaccgaccggctgtacctgtacttcacgcagctcggcaaagacatgtacaccgggaagcccattaacatcgacgagatcagcaactacgatatcgaccacatcttcccgcaggcgttcatcaaggatgactccctgaacaaccgcgtgttggtgagcaaggccggcaacaacggcaagtccgccaacgtgcccctcaaacttttcggggccaagatgggcgggtactggaagcagctggccgacgcgggcctcatcgggcagcgcaagctgaagaacctgcagaccaaccccgacaccatcagcaagttcgccatgcacggcttcatccggcgccagctcgtcgagacctcccaggtgatcaagctggtggccaacatcctgggcgacaagtaccggaacgacgacacgaagatcatcgagatcaccgcccgcatgaaccaccagatgcgggacgagttcgggttcatcaagaaccgcgagatcaacgactaccaccacgccttcgacgcgtacctcaccgccttcctgggccactacttgtaccaccgctacatcaagctccgcccctacttcgtctatggggacttcaagaagttccgggaggacaaggtgaccatgcgcaacttcaacttcctgcacgacctgacggacgacaagcaggagcggatagccgacaccgagaccggcgaggtgatctgggaccgcaagcgcagcatacagcagctccgcgacgtctaccattacaagttcatgctgatctcccaggaggtgttcagcctgaacaaggagatgttcaagcagaagctgttcccggccaccctcgcgaagaagtccaagctgatccagatcaagaaggacaagcccgtggacatctacggcgggtacagcaacaacacggacgcctacctcaccgtcgtgaagctgaagggctctaaggaggacaagtacaagatcgtgggggtccccatgagagccctggacaacctcaaacacgccgagaaggagagcccccagagctacaccgccgagctgcgcaaggcgctggagccgcagttcaccaagatcaagaagaaccggaagacgggcgaggtgtccaaggtggtcaccaacttcgacatcgtgctcggccgcctattctaccggcagatggtgatagacggcagcgagaagtccctgatcgccagctccgtctaccagtacaacgccaagcagctggtgctgagcgaccaggccatccgcaccatctccgaccaggagggcatcgacgagttcgagctgagctcccagtacgacaaggtatacgacgagatcgtccagaaggtggagaagctcctgcccatcttccagcaccggcacttccaggagcgcctgaacaacggtaagagccttttcgtgaacctgcccgtccacgacgtgtacgaggggaacaagctggagcaggtcgggaaaaagcacataatcaactccatcctcggcgggatccacgccaacgcggaccgccccgacatcgacctgttcggcatcaagaacctgggccagtttagctccaccagcgggatcaacctctccagcgacgccatcatctgctaccagagcccgacgggcctgttcgagcggcgcgtcgtgctgaaggacctctga

SEQ ID NO: 7652 - RNA, 4044 nt, synthetic construct; identical to SEQ ID NO: 1852
  misc_feature 1..4044: note = Cas9 variant
  source 1..4044: mol_type = other RNA

SEQ ID NO: 7653 - RNA, 4044 nt, synthetic construct; identical to SEQ ID NO: 1853
  misc_feature 1..4044: note = Cas9 variant
  source 1..4044: mol_type = other RNA

SEQ ID NO: 7654 - RNA, 4047 nt, synthetic construct
  misc_feature 1..4047: note = Cas9 variant
  source 1..4047: mol_type = other RNA
atgaagaagccctacaccatcgccctggatatcggaaccaactcagtgggatgggtcgtggtgacggacgactaccgcgtgccgaccaagaagatgaaggtattaggtaacaccgagcggaagactatcaagaagaacctgatcggggccctgctgtttgactccggcgacacggcggaggggacccgcctgaagcggaccgcccggcggcgctacacccggcgcaagaaccgactgagatacctcaaggagatcttcacggaggagatggcgaaggtggacgacggcttcttccagagactcgaggacagtttctacgtcctggaggacaaagagggcaacaagcaccccatcttcgccaacctcgccgacgaggtggcgtaccacaagaagtaccccaccatctaccatctccgcaaggagctggtggacaacccgcagaaggccgacctccgactgatctacctggcagtcgcccacatcatcaagttccgcgggcacttcctcatcgagggcaccctgtccagcaagaacaacaacctgcagaagtcattcgaccacctcgtggacacctacaacctgctgttcgaggagcagcggttactgacggaggggatcaacgcgaaggagctgctcagcgccgccctgagcaagagcaagcgcctggagaacctgatctccctcatcccgggccaaaagaagaccgggatcttcggcaacattatcgccctgagcctcggcctgacccccaacttcaaggccaacttcgggctttccaaggacgtgaagctccagctggcgaaggatacctacgccgacgacctggacagcctcctggcccagatcggagaccagtacgccgacctgttcctcgccgcgaagaacctgtccgacgccatcctgctctcagacatcctgacggagtccgacgagatcacccgggccccgctgtccgcctccatggtcaagcgctaccgggagcaccacaaggacctcgtcaccctgaagaccctgatcaaggaccagctccccgagaagtaccaggagatcttcctggacaagacgaagaacgggtacgccggctacatcgaaggccaggtgagccaagaggagttctacaaatacctgaagccgatcctggcgcgcctcgacgggtccgaacccctgctgcttaagatcgaccgggaggacttcctgcgcaagcagcgcaccttcgacaacggcagcattccccaccagatccacctggaggagctccacgccattctgcggcgccaggaggtcttctaccccttcctgaaggacaaccggaagaagatcgagagcctcctgacctttcgcatcccatactacgtggggcccctagcccggggccactcccgcttcgcctgggtgaagcggaagttcgacggggccatccgcccgtggaacttcgaggagatcgtcgacgaggaggcgagcgcccagattttcatcgaaaagatgaccaagaacgacctctacctgccaaacgagaaggtgctgccgaaacactccctcctgtatgaaacgttcaccgtctacaacgagctcaccaaggtcaagtacgccaccgagggcatgacgcggccccagttcctctctgccgaccagaagcaggcgatcgtggacttactgttcaagaccaaccgcaaggtgaccgtcaagcagctcaaggagaactactttaagaagatcgagtgttgggactccgtggagatcacaggggtcgaggacagctttaacgcctccctggggacgtaccacgacctgctaaaaatcatccaggacaaggacttcctggacaaccccgacaaccagaagatcatcgaggacatcatcctgaccctcaccctgttcgaagacaagaagatgattagcaagcggctggaccagtacgcccacttgttcgacaaggtggtactgaacaagctggaaagacaccactacaccggctggggacggctctccggcaaactgatcaacgggatccgggacaagcagtcgggcaaaacgatcctggactttctcaaggccgacggctttgccaacaggaacttcatgcagctgatccacgactccgagctgtcattcatcgacgagatcgctaaggcccaggtcatcgggaagaccgagtactccaaggaccttgtgggtaacttagccgggagccccgccatcaagaagggcatctcccagaccatcaagatcgtggacgagctggttaagatcatggggtacctcccgcagcaaatcgtcatcgagatggcccgcgaaaaccagaccaccgctcagggcatcaagaacgcccggcagcgcatgaggaagctggaggagacggccaaaaagctgggcagcaacattcttaaggagcaccccgtggacaactcccagctgcagaacgacaagcgctacctgtactatctccagaacgggaaggacatgtacaccggagacgacctggatatagactacttaagctcctacgacatcgatcacattatcccccagagcttcatcaagaacaatagcatcgacaacaaggtcctcacctcccagggggccaaccgcggcaagctggacaacgtaccctccgaggccatcgtgcggaagatgaagggctactggcagtccctgctccgcgcgggggccatcagcaagcagaagttcgacaacctgaccaaggcagagcggggcgggctgacgcaggtcgataaggccggcttcatccagaggcagctcgtggagacccggcagatcaccaagcacgtggcacagatcctggactcccgcttcaacaccgagttcgacgaccacaacaagcggatccgcaaggtccacatcatcacgctcaagagcaagttagtgtccgacttccgcaaggagttcgggctgtacaagatccgagacatcaaccactaccatcacgcccacgacgcctacctgaacgccgtggtcgccaaggcgatcctcggcaagtacccgcagctggcccccgagttcgtgtacggcgactaccctaagtacaacagcttcaaggagcggcagaaggcaacccagaagatgctgttttactccaatatcctcaagttcttcaaggaccaagaaagcctgcacgtgaactccgacggggaggagatctggaatgccaacaagcacctccccattatcaagaacgtcctgagcatcccccaggtgaacatcgtgaagaaaactgaggtccagaccggcgggttctacaaggagtcaatactgagcaagggcaattccgacaagctgatcccccgcaagaacaactgggatacgagaaagtacggaggcttcgacagccccaccgtggcctactccgtgctcgttatcgcgaagatggagaagggcaaggccaaggtgctgaagccggtgaaggaaatggtcgggatcaccatcatggaacgcaccgccttcgaggagaatcccgtggtgttcctggaggcccggggctatcgcgaaatccaggagcacctcatcattaagctgcctaagtacagcctgttcgagttagagaacgggcggcgcaggctgcttgcaagcgctagcgagcttcagaagggtaatgagctgttcctgccggtcgactacatgacgttcctctacctggccgcccactaccatgagctgaccgggagctcggaagacgtgctccgcaagaagtacttcgtggaccggcatctgcactacttcgacgacatcatccagatgatcaacgacttcgccgagcgccacatcctggcgagctccaacctggagaagatcaaccacacctaccacaacaacagcgacttacctgtcaacgagcgcgccgagaacatcatcaacgtattcaccttcgtggccctcggcgcccccgccgcgttcaagttcttcgacgccacgatcgaccggaagcgctacacctccaccaaggaggtcctcaacgcaaccctgatccaccagagcgtgacgggtctgtatgaaacacggatcgacctgtcccagctcggggagaactga

SEQ ID NO: 7655 - RNA, 4047 nt, synthetic construct
  misc_feature 1..4047: note = Cas9 variant
  source 1..4047: mol_type = other RNA
atgaagtccgagaagaaatactacatcggcctggacgtggggaccaacagcgtcggctgggcggtgaccgacgagttctacaacatcctccgcgccaaggggaaggacctgtggggcgtgcggctgttcgagaaggcgaagacggccgccgacacacgcaccttccggagcgggcgccggcgcaacgacagaaagggcgttcgcctccagatcctgcgggagatcttcgaggacgagatcaagaaggtggacaaggacttctacgatcgcctggacgagtccaagttctgggccgaggacaagaaggtgagcggcaagtactccctcttcaacgacaagaacttcagcgacaagcagtacttcgagaagttccccaccatcttccacctccggaagtacctgatggaggagcacggcaaggtcgacatccggtactacttcttggccatcaaccagatgatgaagcggcgcggccacttcctgatcgacggccagatctcccacgtgacggacgacaagccgctgaaacagcagctcatccttctgatcaacgacctcctgaagatcgagctggaggaggagttcatggacagcatcttcgagatcctcgcggacgtgaacgagaagaagaccgagaagaagaacatcctgaaggaactgatcaacgcccaggacttcaacaagcaggagggcaagatcctctactccatcttcgagagcatcgtcaccgggaaggccaagatcaagaacatcatctccgacgaggacattctggagaagatcaaggaggacaacaaggaggacttcgtgctgaccggcgacagctacgaagagaacctccagtacttcgaggaggtgctgcaggagaacatcacgctgttcaacaccctcaagtccgcctacgacttcgtcatcctgcagagcatcctgaagggcaagtccaccctcagcgacgcccaggtggagcggtacgacgagcacaagaaggacctggagatcctgaagaaggtgatcaagaagtacgacgaggacgggaagctgttcaagcaggtcttcaaggaggacaacggcaacgggtacgtgtcctacatcggctactacctgaacaagaacaaaaagatcaccgcgaagaagaagataagcaacatagagttcacgaagtacgtgaagggcatcctggagaagcagtgcgactgcgaagacgaggacgtcaagtacctcctggggaagatcgagcaggagaacttcctgctcaagcagatctccagcatcaacagcgtgatcccccaccagatccacctgttcgagttggacaagatccttgagaacctggccaagtattacccctccttcaacaacaagaaggaggagttcaccaagatcgagaagatccgtaagaccttcaccttccggatcccctactacgtgggcccgctgaacgactaccacaagaacaacgggggcaacgcctggatatttcgcaacaagggagagaagatccggccatggaacttcgagaagatcgtcgacctccacaagagcgaggaggagttcatcaagcgcatgctgaaccagtgcacgtatctgcccgaggagacagttctcccaaagtcctctatcctgtactccgagtacatggtgctgaacgagctgaacaacctccggattaacggcaagccgatcgacacggacgtcaagctgaagctgatcgaggagctgttcaagaagaagaccaaggtaacgctcaagagcatccgcgactacatgatccgcaacaacttcgccgacaaagaggacttcgacaactccgagaagaatctggaaatcgtcagcaacatgaagtcctacatcgacttcaacaacatcctcggcgacaagttcgagctggagatggtggaggacctgattgagaagatcaccatccacaccgggaacaagaagctcctgaagaagtacatcgaggagacctaccccgacctgagctccagccagatccagaagatcatcaatctcaagtacaaggactggggcagactgtcccgcaagctgctcgacggtatcacgggcaccaacatcgagaccggtgagatcgacaccgtgatcaacttcctgcggaacagctccgacaacctgatgcagatcatcggcagccagaactactccttcaacaacgacatcgacaagctccgcaagaagtacatcccacaagagatcagctacgaggtcgtggagaacctgtacgtgtcccccagcgtcaagaagatgatctggcaggtcatccggatcacggaggagatcaccaaggtgatgggctacgacccggacaagatcttcatcgagatggccaagagcgaggaggggaagaagaccaccatctcccgcaagaacaagctgctcgcgctgtacaaggccatcaagaaggacgagcgcgacagccagtacgagaagctgctcacgggcctgaataagctggacgactccgacctccgcagccggaagctgtacctgtactacacccagatgggacgcgacatgtacaccggcgaaaagatcgacctcgacaagctgttcgactccacccactacgacaaggaccacatcatcccacaaagcatgaagaaggacgactccatcatcaacaacctggtgctcgtgaacaagaacgccaaccagacgaccaaggggaatatctaccccgtgcccagctccatccggaacaacccgaagatctacaactactggaagtacctgatggagaaggagttcatcagcaaagagaagtacaaccgcctgatccggaacacgcccctcaccaacgaggagctgggcggcttcatcaaccgccagctggtcgagactcgccagtccaccaaggctatcaaggaactgttcgagaagttctacaagaagtccaagataatccccgttaaggcgatcctggccagcgacctgcgcaaggacatgaacaccctcaagagccgggaagtgaacgacctgcaccacgcccacgacgccttcctgaacatcgtcgccggggacgtgtggaaccgcgagttcacctccaaccccatcaactatgtgaaggagaaccgggagggcgacaaggtcaagtacagcctctccaagtacttcacccgcccgcgcaaaagcaaggggaaagtgatctggactcccgagaagggcaggaagctgatcgtggacaccttaaacaagcccagcgtcctcatctccaacgagagccacgtgaagaagggcgagctgttcaacgcgaccatcgccgggaagaaggactacaagaagggcaagatctacctgcccctcaagaaggacgaccgcctgcaggacgtgtccaagtacgggggctacaaggccatcaacggggccttcttcttcctggtcgagcacaccaagagcaagaagcggatccgctccatcgagctgttcccactccacctcctgtctaagttctacgaggacaagaacacggtgctggactacgccatcaacgtgctgcagctccaggaccccaagatcatcatcgacaagatcaactaccggaccgagattatcatcgacaacttctcctacctgatcagcaccaagtccaacgacggcagcatcaccgtcaagcccaacgagcagatgtactggcgcgtggacgagatctccaacctgaagaagatcgagaacaagtacaagaaggacgcgatcctcacggaggaggaccggaagatcatggagagctacatcgacaagatctaccagcagttcaaggccgggaagtacaagaaccgccggaccaccgacaccatcatcgagaagtacgagatcatcgacctggacacgctggataacaagcagctctaccagctgctggtggccttcatatccctcagctacaagacctccaacaacgccgtcgacttcaccgtgatcgggctgggcaccgagtgcgggaagccccgcatcacgaacctgccggacaacacctacttagtgtacaagtcaatcaccggcatatacgagaagcggatccgcatcaagtga

SEQ ID NO: 7656 - RNA, 4047 nt, synthetic construct; identical to SEQ ID NO: 1856
  misc_feature 1..4047: note = Cas9 variant
  source 1..4047: mol_type = other RNA

SEQ ID NO: 7657 - RNA, 4047 nt, synthetic construct; identical to SEQ ID NO: 1857
  misc_feature 1..4047: note = Cas9 variant
  source 1..4047: mol_type = other RNA

SEQ ID NO: 7658 - RNA, 4047 nt, synthetic construct; identical to SEQ ID NO: 1858
  misc_feature 1..4047: note = Cas9 variant
  source 1..4047: mol_type = other RNA

SEQ ID NO: 7659 - RNA, 4047 nt, synthetic construct; identical to SEQ ID NO: 1859
  misc_feature 1..4047: note = Cas9 variant
  source 1..4047: mol_type = other RNA

SEQ ID NO: 7660 - RNA, 4047 nt, synthetic construct
  misc_feature 1..4047: note = Cas9 variant
  source 1..4047: mol_type = other RNA
atgaagaagccctataccatcgccctggacatcggcaccaacagcgtggggtgggtcgtggtgacagacgattacagggtaccgaccaagaagatgaaggtgctcggaaacaccgagcggaaaaccatcaagaagaacctgatcggggccttactgttcgattccggcgacacggcggaaggtacccgcctgaaacggaccgctcgcccccggtacacccgccggaagaaccgcctgcggttcctcaaggagatcttcacggaggagatggccaaggtggacgatggcttcttccagcgcctggaggatagcttttacgtcctggaagacaaggagggaaacaagcatccaatcttcgccaacctggccgacgaggtggcgtaccacaagaagtatcccactatctaccacttgcggaaggagctggtggacaacccgcagaaagccgacctccgcctgatctacctggccgtggcccacattatcaaattccgggggcactttctcatagagggcaccctcagtagcaagaacaacaacctgcagaagtccttcgaccacctcgtggatacctacaacctgctgttcgaggagcaacgcctcctgacggaggggataaacgcgaaggaactgctaagcgccgccctgagcaagagcaagcggctggagaacctcatctccctgatccccggccagaagaagaccggtatattcggtaatatcatcgccctgtccctcggcctgacccccaactttaaggccaacttcgggctgtccaaggatgtgaagctccagctggccaaggacacctacgccgacgacctggatagcctcctggcccagatcggcgaccagtacgccgatctgttcctcgccgccaagaacctgtccgacgccatcctgctctccgacattttaaccgagtcagacgagatcacccgtgcgcccctgagcgcctccatggtcaagcggtatcgcgagcaccacaaggacctcgtgaccctcaagaccctgataaaggaccagctcccggagaagtatcaagagatcttcctggacaagacgaagaacgggtacgccggctacatcgagggccaggtgagccaggaggagttctacaagtacctgaaacccatcctggcccggctcgacggctccgagccactgctgcttaagatcgacagggaagactttttacggaagcagcgcaccttcgacaacggcagcatcccccaccagatccacctggaggaactccacgccatcctgcgccggcaggaggttttctacccgttcctgaaagacaaccgcaagaagatcgagagcctcctgacctttaggatcccctactacgtggggcccctggcccgcggccactcacgcttcgcatgggtgaagcgcaagttcgacggagccatccggccctggaacttcgaggagatcgtcgacgaggaggcgagcgcccagatctttatcgagaagatgacgaaaaacgacctctatctgccgaacgagaaggtgctgccgaagcactccttgctgtacgagacattcaccgtgtacaacgaactgaccaaggtcaagtacgccaccgagggcatgacgaggccccagttccttagcgccgaccagaagcaggcgatcgtggacctgttattcaagaccaatcggaaggtgaccgtcaagcagctaaaggagaactacttcaagaagatcgagtgctgggattcggtggagatcaccggcgtcgaggacagcttcaacgcctccctggggacgtaccatgacctactcaaaatcatccaggacaaagacttcctggacaatcccgacaaccagaagatcatcgaggacatcatcctgaccctcaccctgttcgaggataagaagatgatcagcaagcgcctggaccagtacgcccacctcttcgacaaggtggtcctgaacaagctggaacggcaccactacaccggctgggggcgcctctccggcaagctaatcaacgggatccgggacaagcagagcggcaagacgatcctggacttccttaaggccgacgggttcgctaatcgcaacttcatgcagctgatccacgactccgagctgagcttcatcgacgagatcgcgaaggcccaggtcatcgggaagacggagtactcaaaggacctcgtgggcaacctggcaggtagcccggccattaagaagggcatctcccagaccataaagatcgtggacgaactggtcaagatcatggggtacctcccccagcagatcgtgatcgagatggcccgcgagaatcagaccacggcacagggcatcaagaatgcccgtcagagaatgcgcaagctggaggagacggccaagaaactgggcagcaacatcctgaaagagcaccctgtagacaactcccagctgcagaacgataagcggtacctgtactacctccagaacgggaaagacatgtacaccggcgacgacctggacatcgactacctgagctcttacgacatcgaccacatcatcccgcagagcttcatcaagaacaacagcatcgacaataaggtcctcacctcccagggggccaaccggggcaagctggacaacgtgccaagcgaggcaatcgtacgcaagatgaagggttactggcagtccctgctccgggcgggggctatcagcaagcaaaagttcgataacctgaccaaagccgagcgcggaggactgacgcaggtcgataaggccggcttcatccagctccagctcgtcgagacccggcagattaccaagcacgtggcgcagatccttgacagtcgcttcaacaccgagttcgacgatcacaacaagcggatccgcaaggtgcacataatcacgctcaagagcaaactggtgtccgacttccggaaggagttcggtctgtacaagatccgcgacatcaaccattaccaccacgcccacgacgcgtacctcaacgcagtggtagcaaaggcgatcttgggcaagtatccacagctggcccccgaatttgtgtacggcgactaccccaagtacaacagcttcaaggagcggcagaaggctacccaaaagaccctcttctactccaacatactgaagttcttcaaggaccaggagagcctgcacgtgaactccgacggggaggagatctggaacgccaacaagcacttaccaatcatcaagaacgtcctgagcatccctcaggtgaacatcgtgaagaagaccgaggtgcaaacgggcgggttctacaaggagtccatcctgagcaagggcaactccgataagctcatcccaagaaagaataattgggacacccggaagtacgggggcttcgacagcccgaccgtggcctactccgtgctggtcatcgcgaagatggagaagggcaaggcaaaagtgctgaagccagtcaaggagatggtcggcatcaccatcatggaacgcatcgcattcgaggaaaacccagtggtattcttggaggccaagggctaccgggagatacaagagcacctgatcatcaagctgcccaagtacagcttattcgagttggagaacgggcgccggcgcctgctcgcgagcgcatccgagctgcagaagggcaatgaactcttcctcccggtcgactacatgacgttcctgtacctggccgcccactaccacgagctcaccgggagctccgaggacgtgctacgcaagaagtacttcgtggagcgccacctccactacttcgacgacatcatccagatgatcaacgacttcgccgaaagacacatcctggcgagctccaacctggagaagatcaaccacacctaccacaacaactctgacctgcccgtcaatgagagagccgagaacatcatcaacgtgttcaccttcgtggccctcggcgcccctgccgcgttcaagttctttgacgctacgattgatcggaagcgctacacctccaccaaggaggtcctaaacgccaccctgatccaccagagtgtgacgggcctgtacgagacccgcatagacctctcccagctgggagagaactga

SEQ ID NO: 7661 - RNA, 4050 nt, synthetic construct
  misc_feature 1..4050: note = Cas9 variant
  source 1..4050: mol_type = other RNA
atgaagcagaagttctacgtgggcctggacatggggacggccagcgtgggctgggccgtgaccgacgacaagtacaacatcatcaagcgccacgggaaagcgctctggggcgtgcggctgttcaagacagccaacaccgccgaggagcgccggatcttccgcgccgcccggcgccggacccagcgccgcaagcagcgcatggagctgctccaggagatcttcggggacgaaatctccaagaccgacatcggcttctaccagcggatgaaggagagcaaatactggtttgaggacaagcgcgacatcaacggcaagcagcccgagctgccgtacgcgctgttcgtcgacgacgggttcacggacaaggactaccacgagcagttccccaccatcttccacttgcggaacgtgctggtgaacgagtggacccaaaagtacgacatccgcctggtctacctcgcaatccaccacatcatcaagcacagaggccacttcctgttcgaggggaagaagatgagcgaggtgaccgacttcggcagcgcctttgaggccttctgcaaggtggcgtccgacaacgacatcgagatcacggtcgacgaggagaagctgaaggacatcgaggacctcctcaagagccgccagaagtccaagaccgccaagaagcaggagctggggaagatcatcgccggcgccgacaagcagaagaaggcactcgcggccctggtgaccggctgcatggtgaagctgtcagagatcttcgccgacaagtccctcgacgacggggagcggaacaagatcagcttcgccgactccaactacgacgagtacatcgccaacgtcgaggagaccctggcggagcgcttcctgctcatcgccgccggcaaggccctgtacgactgggcagtgctgagcgacatcctcgaggggtctacgtacatcagcgaggcgaaggtgaagatctacaagaagcacggcgacgacctgcggaagctgaagggcctcctgaaaacccgtcccgacgagtacaagctgatctttggactccccgagaagcaggccaactactccgcctacatcggcatggtcaagaagaacgggaagaaggtgccgatcgacaagaagtgcaccaaggccgacttctacagcttcctgaagaagaccctgaataagatcaacttcgaggacgagaaggagcgggagatcgccgagtccatcatcaacgagatcgagaacgagacgttcctccccaagcaagtcatcagcgacaacggcgtgatcccctaccagctgcacgaggcggagctggaccgcatactcaagaacgccgccctgtactacccctttctgtccgagaaggacgacgaggggtacacgaacatggacaagatcaaggccatcttcaagttccgcatcccgtactacgtgggccccctcaacacctaccacagcgacaagggcgggaacagctgggcggtgcggaagcaggacggcaagatctacccctggaacttcgagtccaagatcgacgcgggggagagcgcccgcaagttcatcggccggatgaccaacaagtgcacatacctgatcggaaaggatgtcctgcccaaggagtccctcctttacagcaagttcatggtgctgaacgagctcaacaacctgcgcatagacggcgagaaggtttcggtcgagataaagcaggccgtgtacgagaacgtcttcaaaaagtaccagagagtgaccggcaagaaggtcaaggatttcctcatccgcagcggcatcatcggtcgggagcaggagctcagtgggttcgaccagaacttcaagagctccctgaaggcctaccacgacataaagcagatcgcgggcgacatcaacctgagccagaaccagaaggaggacatcatcaaggagatcaccgtcttcgccgactcccagaagatgctgaagaagcgcctcaagatcaagtacccagagctgagcgacaagcaggtcaccaagctggccgccaagaagtacacggggtggggccggctctcccgcgagttcctggaggaggtcgagagcgtgaacaaggagaccggcgaggtgctgaacatcatctccgctctctgggagaccaacgagaacctgatgcagctgctcagcaacaagtacgactacctgtccgagatcaagcggttaaacgacgaggcggaggacaagagcgaggtggtcacctacgacgacgtgcagaagttatacgtgtcccccgcggtcaagcgccccgtgtggcagacgctgaagatcgtggaggagatcagcaagatcatggggagcaagcccgagcggatcttcgtcgagatggcccgggaaccgggccagaagggggatgtgaaggtgtcccgcaagagcaggctgctcgagaagtacaagtactgcaagaaggaggccccagagatctacgagaacctggtcaaggaggacgacaacaagctgcggtccgacaagctgttcctgtactacacccagatgggccgctgcatgtacagcaacgaagtgatcgacatcgaagacctgttcaccaaccggtacgacatcgaccacatctacccccagtccaaggtgatggacgacagcctcgacaaccgcgtcctcgtgaagcgcgagctgaactccaacaagaccgacgtcttccccgtcccgaaagagtacatggacaaggccaagacgctctgggacatgctgaagaagaaggacctgatcagcaaggagaaataccaccggctcacccgccgggacggcttctccgagaacgagctgagcgggttcatcgcgcgccaactggtggagacccggcagtccaccaaggccgtgacgcagctcctgaccaaggcctaccccgagagcgagatcgtctacgccaaggcgaacgccgtgtccgagttccgacacaagttcggattcacaaaggtgcggagcattaacgactaccaccacgccaaggacgcctacctaaacatcgtcgtggggaacacctactacgtgaagttcaccaaggacgccgcgtggtttatccgcaacaaccccggccggacgtacaacctcaagaagatgttcgagcaggggaccgtctcccgcggcggcgagaccgcctgggtgagcggggaggatggcaccatcttcacggtgaagcgggtcatggggaagaacaacatcctgttcacccgcaaggcctacgaggtgcggggcgggttgttcgaccagcagatcatgaagaagggcaagggccagattcccgtgaagaacaactccgaggacgaccgactctgcgccaccgagaagtacggggcctacaacaaggcgagcggagcctacttcatgctggtcgagagcgaggacaagaaggggaacaagatccggactctggagttcgtgccggtgtacctcgccaaggagctggagaagtccgaggacgccgccatccgctactgcgtcgagaagctcgagctcaagaaccccgacgtgcgggtgcgcaagatcaagatggacagcctgttcaacgtcgacggcttccggatgcacctgtccggccgcacgggcaagcagctcatcttcaagtgcgcggagcagctggtgctggacgaggagagccagaagatcctcaagaagaccgccaaggtgtttgccgactacaaggagaacaagaacatcaagatcagtgacaagatcgagctgactgacgagatgctgatcaagctctacgagctgttctacaaaaagctgaaggacaccgtctacaacatccggctcagcacccaggtgaagacgctggagtccggcaaggagaagttcgagaagctgagcctcctggacaagtgcttagtgatcgaggagatcctccacctgtttcagtgccagtccgtcgccgcgaacctgagctccatcgggggcgccgccaccgccgggatcctcgtgctgaacaacgagatcagccgctgcggcaaggtcgagatcatcaaccagtccatcactgggttctacgagcaggtcatcgacctgaagaacatctga

SEQ ID NO: 7662 - RNA, 4050 nt, synthetic construct
  misc_feature 1..4050: note = Cas9 variant
  source 1..4050: mol_type = other RNA
atgcagaagtactacctgggcctcgacatcgggaccaacagcgtgggctgggcggtcaccgacgagaactacaacctgtgcaagttcgggggcaagcgcatgtgggggatccggctgttcgacggcgcacagacggcggaggagcgccggatgaaccgctccaaccggcgccggctcagccgccagaagcaacggatcgacctgttacaggagctgttcgccaaggaaatcgccaaggtggaccccaccttctttatccgcctgaatgagtcccggctgtacatggaggacaaaagtaccggcaccaagtttcccctcttcgccgacccgggatacacagacaaggagtactacaaggagtaccccaccatctaccacctccgccaggagctgatcaagaaccccgagtcccacgacatccggttggtgtacctggcctgccaccacatcctgaagaaccgcggccacttcctcatcaacgggagcttttccgaccttaagaacctgagcttcgtctgccgggagatgctcgacgctttcaacgagctatccaagtatcagctgatgattagtgacatcgacgccctcgaaaagatcctgtccgaccgcaagcaacagaagtccgccaaggtgaaagagctggtgcagatcttcgagtgcgtcccgcgagaggacaagagcgacgcgaagatctgcaaggagatcctcagcaacctatgcaagttcctggtaggcgccaaggggaacatcacccgcctattcgacaccgactttgacgagatggagacatcctcgttctccttcggggacagcaagtacgaagactccctgctgcccagcctcgaggagaactaccctgactacgccaacgtgatccagaagatcaaggctatgtacgactggagcgtcctggtggagatcatggccggagagaactacctgtccttcgctaaggttaatgcgtacaagaaacacaaggagaacctcagcatcctgaagtccctcatgaagaagtactgcacccccgacgtctaccagcggttcttctacgagaccgacgagaagtccagctacggtaactacatcggcgccatccacaacaacggacacagccacacaatgaagaagtgcgacgaggagactttctacaagtccctcagcaagatcctggacaagctggttgtccagaagacagaccaggacaccctagagatcctgaagaaggaggcgaagaaccagaccctgctcccgctggcccgcacgaaggccaacggcgtgatacccaaccagatccacatccaggagctgcgggcgatcctcgacaacgctaaaacctatctgagcttcctgaacgaggccgacgagtacgggacaatcgccgagaagatcatccgcatcgccaagttcaagatcccctactacgcggggcctctcagcactcgccacaaggagcagggcgccaatacgtggatagtgcggaagcaggagggacgcatctacccgtggaacttcgaggaaatggtggacctggagcgttccaacaacgagttcatccgccggatgaccaacaagtgcacctacctgatcggcgaggacgtcctgcccaaaaacagcctcctgtactccaagttcatggtgctgaacgagctcaacaacctgaagatccgcgggcacaagatcagcgtggagctgaagcaggagctctacaaggagctgttctgcaagaaggccaaggtcaccggcaaggccctgctcgtgtacctgaaaaagaaggacgccgagctgacactcgaggacatctccggcttcgacgcggattttaaaagcagcctgagcatctatatcgacttcaaaaaccacatcttacgggagcagatcgacgatgggaagtaccaatccatcgtggagaacatcatcaagtggaagaccattttcgacgtcgacagcaagatgatcgagaaacttattgcccgcgagtaccccaacatgttcagctccgagcagatcaagaagatctgccggctgaagtgccgcggctgggggaacttcagctccaggttcctgaacggcattcagggagagaacaccgagaccaaggagtgcttcacgatcatcgaggccctatggaagaccaactacaatctgatgcagctgctcagcaagcagttcactttcaaggacgcaatcgactgcattaacgcggacaaggtgggcaagatcgacaaggtcacatacgagaacacagtaaaggacctggtggtctcccccgccaacaagcgcgccatctggcagaccgtgcaaatcaccgaggagatcaagaaggtgatgaagtgcgagccggagaagatcttcgtcgagatggcccggggcggggaaaaggagaagaagcgcaccatcagccggaaggagcgccttctcaagctgtacatggactacaaggacgagaaccgggactggatcaaggagatcgagtcacgcgacgagcaggatttcacgaaccggaagctgtatttgtactacacccagataggacgctgcatgtacagcggggaggagatctccctggaggaactgatgcagaagaacagcaagtgggacaaggaccacatttacccccagtccaagatcaaggacgacagcctcgacaacctggtgctggcccgcaaggacatcaacaacaacaagtccaacaagctcttacccaccggcatccaggacaagatgaagaagtactggaagatgctgctcaagtacgggttcatctctaagaagaagtacgaccggctgatgcgcaccgaggacttctccgacgaggagttatccggattcatcgcgcggcagatcgtggagacccgccagtccagcaaggccgtcgccgagctcctggagcacctgaacgagcacacggagatcgtgtacgtgaaggccgagctggtcagcgacttccggcacgacaacaacatgctgaagtcccgccggatcaacgactatcaccacgccaaggacgcattcctgaacatcgtggtgggcaacgtctacaacgccaagtttaccgccaaccctcgcaactggatcaagaagaaccggaacaccaactacagcatccgccgggtgttcgactacaccgttaagcgcgggtccacaatcgtttggcagggcgtaaaggacgggggccacagcatcgacggtatcaagaagaccatggcccggaacgatatcctctacaccgagcgcacctactgcgagcagggggagctgttcaacgcgacgctgataaagaagggcaacccgaacgcgatcgggctcaagaagggcctggaccccatgaagtacgggggctacagcagccccaagacctccgccttcgccttcatagagtttgacggcaagaaggggagacagaaccacctggtggagatccccgtgtacatcgccaatatcgcggcccgccagccggagtacataaagaaccacctcgaggagaagaaaggctaccagaacgtgatcgtaaagaagtaccccatccagaagaacgccctgatcaagttagacgggtacccagcccggctccgcggcgccaacgagaaatccatcaccctgaagaacgcagtccagctggtgctcaagcccgagtaccacgaaacaattcggaacgtggagaagtacttagagtacatcgacaaggacgagagcgtcagcaaggccgctaggttctcccacacggagctggacaagctctacgacgagttgtgcttcaaggccgagaacagcatctataagaagcggcccgccaaccagtccgcgaccctgaagaacggtcagaaaaccttcctcgccatcaccaacctgaaggagaaggcccaggtgatcaacaacatcatcacgatgttccgctgcgacgccaccaccaccacgaacctgaaaaccatcgggggctcggccaacgcagggggcatgcaggtcaataagaacaccctcacctcccagaaggtcgtgctggtgcaccagagcatcacggggctgttcggcacagaggaggagttactgtga

SEQ ID NO: 7663 - RNA, 4053 nt, synthetic construct
  misc_feature 1..4053: note = Cas9 variant
  source 1..4053: mol_type = other RNA
atgaagaaaccctacagcattgggctcgacatagggaccaactccgtgggctgggctgtagtgaccgacgactacaaggtgccggccaagaagatgactgtcctcgggaacaccgacaagagccacatcaagaagaacctgctaggagcgctcctgttcgactccggcaacaccgccgccgaccgcagactgaagcgaaccgcgcggcgccgctacacgcgccgacgaaaccggatcctctacctgcaggagatatttgccgaggagatgagcaaggtggacgactctttctttcaccgcctggaggacagctttctcgttaccgaggacaagcggggcgagcgccaccccatcttcggcaatctcgaagaggaggtcaagtaccacgagaatttccccaccatctaccaccttcggcagtacctcgcagacaacccggaaaaagtggacctccgcctcgtgtacctcgccctggcccacatcattaagtttcgggggcacttcctgatcgagggcaagtttgacacccgcaacaacgatgtgcagcggctgttccaggagttccttgccgtgtacgacaacacgttcgagaactccagtctacaagagcagaatgtccaggtggaggagatcttaaccgacaaaatctccaagagcgcgaagaaagaccgcgtcctgaaactattcccgaacgaaaagagcaacgggagattcgccgagttcctgaaactgatcgtgggcaaccaagccgatttcaagaagcacttcgagctcgaggagaagacgccgctccagttctccaaggatacctacgaagaggagctggaggtcctgctcgcccagatcggagataactacgctgagctgttcctgtccgcaaagaagttatacgacagcatcttactgtccggcatcttgacggttaccgacgtcagcaccaaggcgccgctgtccgccagcatgatccagcgatacaatgagcaccagatggacttagcccagctgaaacagttcatcaggcagaagctgtccgacaagtacaacgaggtcttcagcgatgtgtctaaggacggctacgccggatacatcgacgggaaaactaaccaggaggccttctacaagtacctgaagggcctcctgaacaagatcgagggatccggctactttctggacaagatagagcgcgaagactttctccgcaagcagcggacgttcgacaacgggagcataccccaccagattcacctccaggagatgcgcgcgatcatcaggcgccaggccgagttctacccattcctggccgacaaccaggacaggatagagaaaatcctcaccttccgcatcccttactacgtgggccccctggcccggggcaagtctgacttcgcgtggctgtcacgcaagagcgccgacaagataaccccttggaacttcgatgagattgtagacaaagagagctccgccgaggccttcatcaaccggatgaccaactatgatctgtacctcccgaaccagaaggtgttaccaaagcacagcctgctctacgagaagttcacggtgtacaacgagctgaccaaggtcaagtacaagactgagcaagggaagaccgccttctttgacgcgaacatgaagcaggagatattcgacggcgttttcaaggtctatcgcaaggtaacgaaggacaagctgatggacttcctcgaaaaggagttcgacgagttccggatcgttgatctgaccggcctggacaaggaaaacaaagccttcaacgcatcctatggcacctaccacgatctccgcaagattctggacaaggacttcttagacaacagcaagaacgagaaaatcctcgaggacatagtgctgaccctgaccctctttgaggaccgggagatgatccgtaaacggctcgagaactactccgacctgctcaccaaggagcaagtgaagaaacttgagcgccgtcactacaccggctggggccgcctgagcgcagagctcatccacgggatcaggaacaaggaatcccgcaagaccatcctggactacctgatagacgacggcaacagcaaccgcaacttcatgcagctcatcaacgatgacgcgctgagcttcaaggaagagatcgccaaggcgcaagtgatcggggaaacggataacctgaaccaagtggtgagcgacatcgccggcagcccggccatcaaaaagggtatccttcagagccttaagatcgtggacgaactggttaagatcatggggcaccagcccgaaaacatcgtggtggagatggctcgggagaatcagttcaccaaccagggtcgccgcaattcccagcagcggctgaaaggattaaccgacagcattaaggagttcggaagccagatcctgaaggaacacccggttgagaactcgcagctccagaatgaccgactgtttctgtactacctccagaacgggcgcgacatgtataccggcgaggagctggacatcgactatctgagccagtacgatatcgaccacatcatcccccaggccttcatcaaggacaatagtatcgacaaccgcgtgctcacgagctccaaagagaaccgcggaaagagcgacgacgtgccctccgaagacgtcgtgaaccgcatgcgccccttttggaacaagttgttaagttccggcctgatcagccagcggaaatacaacaacctgacgaagaaggagctgaccccggacgacaaggccgggttcatcaagcgccagctcgtggagacccgccagatcaccaaacacgtcgcccgtatgttagatgagcggttcaacaaggagttcgacgataacaacaagcgcatcaggcgcgtgaagattgtgactttgaaatccaacctcgtcagctcgttccggaaggagttcgagctgtacaaggttcgcgagattaacgactaccaccatgcccacgatgcgtacttgaacgccgttgtcgtcaaggccctcctggtcaagtaccccaagctagagcccgagtttgtctacggggaatatccaaagtacaacagctaccgggagcgcaaaaccgctacccagaagatgttcttctactccaatataatgaacatgttcaagagcaaggtaaagctcgccgacgaccagattgtggagcgacctatgatagaggttaacgacgagaccggcgagatagcgtgggacaagacgaagcacatcaccaccgtgaagaaggtgctgtcctacccccaggtcaacatagtgaagaaggtggaggagcagaccatcggccagaacgggggcctgttcgacgacaaccccaagtctcccctcgaggtcatcccgagcaagctagtgcccctgaagaaggccctcaaccccgaaaagtatggtggctaccagaagccgacgaccgcgtaccccatcctactgatcgtggacaccaagcagctcatccccatctccgtcatggacaaaaagcggttcgagcaaaatccagtgaagttcctgaaggacaaagggtaccagcaaatcgagaaaaacaacttcgtgaagctgccgaagtacacactcgtcgacatcggtaatggtatcaaacgcttatgggccagctccaaagaggtgcacaaggggaaccagctggtcgtaagcaagaagtcacaggacctcctctatcacgcgcaccacctggataacgattacagcaacgagtacgtaaagaaccattatcagcagttcgacatcctcttcaacgagataacgtccttcagtaagaagtgcaagctgggcaaggagcacatccagaagatcgaggaggcttactccaaagaaagggactcagcctccatagaggagcttgcggatgggttcataaagctgctgggattcacacagctgggggccacgagccccttctccttcctcggcatcaagctgaaccagaagcaatacaccggcaagaaggactacctgctcccctgcatggaggcgacgctgatacaccaatccataaccgggctgtacgagacccgcattgacctaagtaagctgggcggggactga

SEQ ID NO: 7664 - RNA, 4053 nt, synthetic construct; identical to SEQ ID NO: 1864
  misc_feature 1..4053: note = Cas9 variant
  source 1..4053: mol_type = other RNA

SEQ ID NO: 7665 - RNA, 4053 nt, synthetic construct; identical to SEQ ID NO: 1865
  misc_feature 1..4053: note = Cas9 variant
  source 1..4053: mol_type = other RNA

SEQ ID NO: 7666 - RNA, 4053 nt, synthetic construct
  misc_feature 1..4053: note = Cas9 variant
  source 1..4053: mol_type = other RNA
atgaagcgtatcctgggcctcgacctggggaccgccagcatcggctgggccctggtgaacgagtccgagaatgagaaggaaaagtccgagattatcaagctcggggtccgggtgaaccccctgaccacggacgagcagacggacttcgagaagggccgcccgttatccgtgaacgcggaccggaccctcaagcgcggggcgcggcgcaacctgcagcggttcaagcagcgccggaagaatctgatcgaaatcctcatcaagaagggcttcatcactaacatcagcttactgacggagatcggctccaacaccacctaccagaccctcgagctgcgcgccaagagcgtcaaggagaagatcgagaaggaggagttcgcccgggtgctgctcacgatcaacaaaaagcgggggtacaagtccagccggaaggccaagaacgacgaggagggctccctgatcgacgggatgagcgttgcgaaggagctctacgacaacaacctcaccgtcggccagtacgtgtaccagcttctggagaagggcgggaagtacatccccgacttctaccgctccgacctccagaacgagttcgacgtgatctggaacttccagaaggagttctaccccaacatcctgaccggcgagctgtacaagaagctccaggggcaaggccagcagaacagccggaagctgttcctggctatccaccagatctacaccgccgagaacaaggggaagcgcgacacggtcaagaagcagcactacaagtggcggaacgacgccatcaacacccagctcctgatcgaggaagtggcgtacgtgctggtcgagatcaacaacaacctcaacaagtccagcggctacctgggcgccatctccgaccgcagcaaggagctgtacttcaacaaggagaccgtgggggagaacctatacaagcagatccaggagaacccccagacctccctgaagaaccaggtgttctaccggcaggactacctggacgagttcgaacagatctgggagacgcaggccaagttctacagcgagctcactaaggagctgaaggaggaggtccgcgatgtggtgatcttctaccagcggaagctgaagtcccagaagcacctcatcagcgagtgcgagttcgagaagcaccacaaggccatccccaagagcagcccccttttccaggagttcaagatatggcagatcctgaacaacatcgagttcaagcacaagaagaccaaggagctcaagatcctgagcgaggagctgaaggagacactcttcgaggagctgaacatccgcggcaacttcacgtccgacgccgtcctgaagttcgtgaagctcgacaagaaggagtgggagctgaactacaagaaggggatcgagggcaaccgcaccaacgaggtgctgtacaacgtctaccagaagatcgcggagtacgaggggtacggcttcgactggagcaagaagtccgccgtggagatcaaggaggagctgaacaccatcttcagcgagatcggtattaactccaagatcctcgacttcaaccccgagatcagcggaaacgactttgacaagcaggaatcctaccagctatggcacctcctctacagcgccgaggaggacggcttcctgaagcagaagctgcaggacaagtacgggttcaagtccgagtacgctaacatgctcgccaacgtgagcttccagtccgactacggcagcctgtccgcgcgggccatcaagaagatccttcccaacctaatcgccgggcacgagttcagcgaggcctgctccctgagcggctacaaccacagtaacagcctgaccaaggaggagctcgccaaccggccactgaagggcaagctggagctcctgaagaagaacagcctgcggaaccccgtcgtggagaagatcctcaaccagatggtcaacctggtgaaccaggttatcgagtcctacggggagatcgacgaggttcgaatcgagctggcgcgggagctcaagaagtccgcccaggagcgcgccctcatgacgaccaacatcaacgccagcaagaccaagtacgagagcttccggaagctgctccagaaggacttcggcatcaagaaccccacccgcaacgacatcatcaagtaccggctgtacgaggagctgaaggccaacaaataccacacgatctacaccaacaaatacatcccccgcgacaagctgttctccaaggaaatcgacatcgaacacatcatcccgaaggcgaaacttttcgacgacagcttctccaacaagaccctggccttccggaagcccaaccaggacaaggggaacatgaccgccatcgactacatcctcagctaccagtcgaaggacatcgacaactacaagagccggatcgagaacctgttcaagaacggcaagggggacatctctaaggccaagcggaacaagctgctcatggaggagaaggacatccccgacggcttcatcgaccgcgacctgcggaacagccagtacatcgcgaagaaggccaagcagctgctcgaggaggtgatccgcacggtgaacactaccaccggctccgttactaacaagctgcgggacgactgggggctgatcaacgtgatgcaggagctcaacatgcccaagttcaaggccatcgacgagagcctgatcgagcagatcgagaagaaggacggcaccttcaagacccgaattaaggactggagcaagcggaacgaccaccgccaccacgccatggacgccctgaccgtggcgttcacccgctacaaccatatccagtacctcaacaacctgaacgccaagagcgacaagaagggggccatctacggcatccaggagctggagacgtacgtcaactccaagggtaagcggaagttcatcaagccgatgcacaacttccgcgaggaggccaagaagcacatcgaggacatcctcatctcgttcaaggccaagaacaaggtggtgaccaagaacatcaacaagataaagagcaaggacgggttcatcaagaaagtccagctgaccccgcggggccagctgcacaaggagaccgtttacgggaagatcaacgaggtcgtagtgaaggaggagaagatcaacgcgaaattcgacctcgagaagatcaacaaggtgacgaagcccatctaccgcaacgccctgctgaaacggcttcaggagttcaatggcgagcccaagaaggccttcaccgggaagaactccctgagcaagaacccgatctacctggacgtcgcccagaccaaaaccctccccgaatccgttaaggtgcagttcttcgaggagaactacacgatccgcaaggagatcagccccgatctgaagatcgacaagatcatcgacaagggcatccagcggatcctgctcaagcgcctggacgagttcaacggcaagcccaaggaggccttctccaacctggagaagaaccccatctggctcaacaaggagaaggggatcgcgattaagcgggtcaagataaagggcgtgaagaacgtggagagcctgcacaacaagcgcgaccacctggggaacgagatcctccagaagggcaaatccgctcccaacgactacgtcagcaccgggaacaaccaccacgtggccatctaccaggacaagaacgggaagctgcaggagaaggtggtctccttctacgaggccgtggcgcgggtgaacaacaagctgcccatcatcgaccaggacttcaacaaggacctcggctggaagttcctgttcaccatgaaacagaacgagatgttcgtcttccccagcgaagacttcaagccgctggagaccgacctcatggacaagaagaacaacagtaagatcagcaagaacctgttccgcgtgcagaagctagggaacaaggactacacgttcaggcaccacctcgagaccaagatcgaggacatcaagaagctgcgcgacttcacctacatccggaagcgcaaccccgagtccatcaagaacatcatcaaggtgcggatcaaccacctgggcaacatcgtccacgtgggggagtactga

SEQ ID NO: 7667 - RNA, 4056 nt, synthetic construct
  misc_feature 1..4056: note = Cas9 variant
  source 1..4056: mol_type = other RNA
atgagcaagaagtactacctgggcctcgacatcgggaccaactccgtgggctgggccgtcaccgacgagaactacaacctgtgcaagtacgccgggaagcgcatgtggggcatccggctattcgagggcggggagacggcggagcagcgccggatcagccgctccaaccggcgccggctcagccgcaagaagcagcggatcgacctgctgcaggaactgttcgccgaagagatcgccaagatggaccccaccttcttcatccgcctgaacgagtcgcggctgcacctcgaggacaagagcaccggcgagaagttcccactgttccgcgacaaggactacaccgacatccagtactacaaggaataccccacgatgtaccacctccggaaggagctcatcgagaactccaaggtgcacgacatccgcctggtgtacctggcctgccaccacatcttaaagaaccgggggcacttcttaatcaacggcagcttctccgacgtcaagaagctgagctccgtgtgcgagagcatgctcaactccttcaacgggatcagcaagtaccagatcgagatcaacgacatcgagcgcctggaggagatcctgtccgaccggaagaagcagaagtccgtgaaggccaaggagctcatccagatcttcgagtgcggcccctgcgaggacaagaccgacgagaagacctgcaaggcgatagtcagcaacctgtgcaagtggctgaccgggctcaagggcaacatcaacagcatcttcgacatgcaattcgaggagatcgacacgtccagcttcagcttcaccgagcccaagtacgaggacaccatctccgccgccctggaggagaaatacccggattacgccgacgtgatccagaagatcaaggcggtgtacgactggagcgtcctggtcgagatcatggccggcgaggactacctctccttcgccaaggtgaacgcctacaacaagcacaaggagaacctgtgcatcctaaaggaggtcatccgcaagtactgcgacagtgagatctaccacaagtttttcaacgggttcgacgagaagaacggctacgggaactacatcggctccatctacaagaacggccacagctacgccatgaagaagtgctccaccgaagatttctacaagacgctcggaaagatcctggacaagatccagcccgagaaggaggacgagaacgtgctggaggagctcaaggtggaggtcaagaaccagaccctcctgcccctcgcgcggaccaccgccaacggcacgatccccaaccaggtgcacatccaggagctgcgcgccatcctggacaacgccaagaagtacctcccgttcctaaacgaggaggacgagtacggtaccgtggctgagaagatcatcagcatcgcgaagttccggatcccctactacgtcggccccctgtccacccgccacaaggagcagggggccaacagctggatcgtgcgtaagcaggaaggccggatctacccctggaacttcgaggagatggtggacctcgagcagagtaacaaggagttcatccagcgcatgaccaacaagtgcacgtacctgatcggcgaagacgtcctgcccaagaacagcctcctgtactcccggtacatggtgctgaacgagctcaacaacctgcgcatccggggtaacaagatcagcgtgaaactgaagcaggagctgtataaggagctgttctgcaccaaggccaaggtcaccggcaagggcctcttcaactacctaaagaaggaggacgaggagctcgccctggaggacatcagcgggttcgacatcgactttaagagctccctgacctcgtacctcgacttcaagaagcagatactgggggaggagatcgagaaggacaagtacaagggcatcgtggagaacatcatcaagtggaagacgatctacgacgacgactccaagatgatgaagaagatgatcgagcgcgagtacccaaacgtcttcagcaaggacaagatcaagaagatctgccgattcaagtacagcggctgggggaacttctccctgagcttcctcaacggcatccgcggggccgaccgggagaccggcgagagcttcaccatcatcgaggcgctgtggaagaccaactacaacctgatgcagctcctgagcaagcagttcacgttccgcgaggagatcgacctgatcaacgccgagaaggtggggaagatcaataaggtgtcctacgacaacaccgtcaaggacctcatcgtgagccccgccaacaagcgggccatctggcagaccgtgcagatcaccgaggagatcaagaaggtcatgaagtgcgagcccgagcgcatcttcatcgagatggctcggggcggcgagaaggagaagaagcgcacagtgtcccggaaggcgcgcctgctcgagctctacgccgcctgcaaggacgacgtgcgggactggaccaaggagatagaggaccgcgaggagcgggagttcaacagcaagaagctgtacctgtactacacccagatggggcgctgcatgtactccggcgaggagatcaacatcgacgagctcatgcagaagaacagcaagtgggatatcgaccacatctacccgcagtccaagatcaaggacgacagcctggacaacatggtcctggccaagaaggtgataaacaactccaagcagaacaagctactgagctccgacatccgcataaagatgaagaagtactggaacgcgctgtacaaggggaacttcatcagcaagaagaagtacgaccggctcacccgcacggaggacttcaccaacgaggagctgtccggcttcatcgagcggcagatcgtggagacccgccagagcagcaaggccgtcgccgagctgctcaaccggctgtacgagcactccgagatcgtgtacgtgaaggccggcctggtcagcgacttccgccacgacaacaagttactgaagtcccggcgcatcaacgactaccaccacgccaaggacgcgttcctgaacatcgtggtgggcaacgtctacaacgccaagtttaccagcaacccccggaagtggatcaaggagaaccgcggcaccaactactccattcggcgcgtgttcgactacaacgtgaagcgggggaacacggtcgtgtggcagggcgtggaggacgggggtcacagcatcgacgagatccgcaagaccatggcccggaacgacatcctctacacagagtacacctactgcgacaaaggcgagctgttcaacgccacgctgatcaagaagggaaacgacaaggccatcaacctcaagaaggcgctggactccgtcaagtacggcgggtacaactcgcccaagacctccgccttcgcgttcatcgagttcgacggcaagaagaaggagcgcaagaaccacatcgtggagatccccgtgtacatcgtcaacatcgccaagcggcagccggacaccataaaggagtacctggagcagaagaaggggtacaagaatgtggtggtcaagaagtaccccatcaagaagaacgccctcatcaagatcgacggctacctggcgcgcctccggggcgccaacgagaccgacatcctcctgaagaacgccgtgcagctgatcctcaacgacaagtactacgagatcattcgccgggtggagaagtacctggagtacaacgtccgctacgaggccgagagcatgttcgaggggttcgaccacgcggacctgaactccctctacgacgagctgacgagcaagctggagacctccatctacaagaagcgccccgccaaccagctcaacgccctggagaagggcaaggagaagttcaagaacatccagaccctgcgggagaaagcccagatcatcaaggagatgctcatcatgtaccgctgcgatgccgcgaccgtggccaacctgaaggccattgggggcagcgccaacgccgggtccatgaagatcaagaagaacacgctgaccagccggtccctcgtgttggtcaaccaaagcatcaccggcctgttcgagaccgaggaggagctcgtctga

SEQ ID NO: 7668 - RNA, 4056 nt, synthetic construct
  misc_feature 1..4056: note = Cas9 variant
  source 1..4056: mol_type = other RNA
atgtataagaaatacggaataggcctcgatatcggtacatcatcaatcgggtggtcagtggttgacgaatacggtcacatcatccgtgtaaaaggccagaccggtctaggcgttcgcctattccgcgaaggccagcctgcagcagacaggcgcactttccgcactacccgacgccggctcggtcgccgtcgatggcgcctccgactcctccgggaaatatttgacccatacatcgcagcacaggaccctaactttttcgcccgccaaaaggcaagcgcaatcgcccccggagactcccggttcaaagccgtctaccggttgttcaacgaccagacggaccgacaattctacgacaaatatccaaccgtataccatctgcgacagaaactaatgacagaaaagcgccaattcgacatcagagagatctacctagccgtgcaccacatcgtcaagtaccgcggacacttcctcaccggcggagcggccaagaacttcaaaccgggtaaacttgacctaaacacctacttcgccaccatcaacgcccagctagccgccatcttcatggactcgcaggtagaacttccccagctcgactgggacgccgtcgtcagcctcctcacgaacgaccaagagtcaccctctgatcgccaaaaagccctgaccaagatgctagtggcacaaggagacgccacccaaaaacgcttctacacggagttcagcaaagccctactcggcttaaaagcgaagctatacgtcctcaccggcttcgaaggcgacaaaacggatcagaaagcactaacactctccttagagacgctagacgaccaccaagacgatgtaacgcaactcctaggcgacgagcaaagacaactcgtcgaactcctagccagagtacagagcgcaatccagctcgccataatcatcccaaatggaaaaacgttctccggccaaatggtacaacaataccaaacacactacgaccaactacgcctcctaaaagactaccgcgaacaactaactgatcagaaacacaggcgagcgctaaaacaagcctacgccgactacctggctaacgaccaggatcaagacgcgctggtcaaggctgtcgaaaaagttctcaaacaaaaccagcccctctccacagtcggcgtcaggttacaaaccgccatagacgccggcgacttccttccgaaacaacgcacaaaagccaacagtgtaatcccgcatcaaatacaccaacaagaattagaccgcataatagaagcccagtcggtctactacccctggctagccgaagaaaaccccgtggcagcccatcgatcatacgccccatacaaactggacgagctcgtcgacttcagagttccatactacgtaggcccacttgtacaaccccaggccgataaggccgcaaaagaaaccaagttcgcatggatgacgcgcaaagaggcacagtccacgacaccaataacaccatggaacttcgaacaagaggtggacaggaacgcatcagcaaacgcttttatccaacgaatgaaaacaactgatacatacctcctaggggaggacgtcctgcctaaaaactctctactctaccaacggtttgaagtcttaaatgaactaaacaacgttcgggtcgacggcaaactcctaaccatcgcagaaaaacagcgccttttccaagacctattcgtcgatagaagccaggcttccgtcaccatagcacagctgcaggcaaacctaatagcccacggggccgcgaaggaccgcgttgaaatcaagggcctcgccgaccccaagcgattcctatcctcgctaacaacctaccacgactacgcacaaataattcccgaagcgctcgagcaaccagacaagcgcgcggacatcgagaaaatcataaactggagcaccatcttcgaagatacttcaatcttcaaagaaaaacttcaagaaatcgcctggcttacaccagaccaacgacgccaactcagtcagaaaaggtaccgaggatggggacaactgtctgacaaactcctcacccaattacgcgacgcgactggccaatccgttatggacctgctctggacggaaccaaacaacttcatgcaaatcatccgccgaacggagttccaacaagcaatagcgagagtcaaccaaacggaccttaagcaacaggacctcgcaaccacaattaacgacctctacacaagcccccaaaacaaaaaggctatccgacaagtcctcctcgtcgtcgccgacatacaaactgccatgcatgaagtcgcacccagctggctgttcatagaagccgctagaggacccgaacaaaatcccaagcgcaaactcgcccgacaacaacagctattagaagcatacaagaccagcgctaaagaaatcgtaaacgaagccgtcaaagagaaactcctatccgccatagatgaccaccaaaaatttgaggaccaagtcgtcctctactttcaacaaaacggcctagatatgtacaccggcaaaccactcgacttcgaacgactatccaaataccacattgaccacattatcccacagtctgtcgtcaaggacgacagcctcgataatagagtcctaaccacaccggaagaaaacgaacgcaaaggagcccgtgttcctggcccactttacgcttcccaacagggccgctggcggcttctgcagcgggccggcctcatatcacaacgcaagctcgaccacctactattgcgccccgaagaactcgaccaacaggccaccggattcgtcgccaggcagttggtagaaacaagacaagtcatcaaacttatcacaaatatcctctcccagcagtacgacccagaacagaccaagctagtgtccgtaaaagcaggcctgagccaccaattccggacccgcctcaacctgcccaagctccgggaactcaacgactaccaccacgcacacgatgcctacctcgccgcccgaatcggcacataccttctccaacgctacccgaaccttgaacggttcttcgtatacggccaataccaaaagactcgatttgacctgaaacgacacttcaacttcattggggagatgctcaagggcaaacccgaggacgccgtaatagtcaaggcccctcacagcgaaaccgtaatctgggataaacaagacgaagttaagcagctaaagaaaatcatggaatatcgccatctcctcgtgacacatgaggtgtatgacaatcacggagcccttttcaaccaaacaatacaccctgccaaaaaccccaaaaacagaaaactaatcccgcgtaaaaccacccaaagtaccgaactctacgggggctactctggtgaaacaaccggctacctagccatcgcacggaccgtgaccaaaaacaaaataagttatcaagtcctccgcgtccccacacgacttgtgggaaggctacaacgctcaagcgaatctgcccaaagacagattttaactgactggttcgccccctcgttcgtatcccgcggaaaacaacagcctttcgagatagtcctccgtcacgtcttcaaaaaccaaacagtcatcgacgacatccacgaacaaagccaccgcttcgggctgaggtccgacacatactattgtaaccaacaacaattagtcctatccctcgaacaacagcgaatgatcatcgaccagaaacttaacaacacaaacaaacttatggtcgtgtacgaagccgtgtgcgatcaggtagccaagtactttcccttataccgcatgaaccactttaaagaatcactacttgaagctggaccaaaactcgcagaactacccataaacacggtacaatccaaaaacggcaagttaaaactgggtcagcgttcagtgctcctccaaaccatgcaaggccttcacgcaaaccccgaaaccaaagacttgagcatcatcggctgccccaagtacttcggaaaactccaggtatccagcggaatcaaactcaccgagaacgctgtactcatccacgagtccccaaccggcctcttccagcgccgcgtacggctcagcgacctctga

SEQ ID NO: 7669 - RNA, 4056 nt, synthetic construct
  misc_feature 1..4056: note = Cas9 variant
  source 1..4056: mol_type = other RNA
atgaagatactaggcctcgacttaggcaccaactcaattggatgggccgttgtcaacgaggcagaaaacgaaagggagtcttccagtatcataagactcggagtaagggtaaatccactaaccgtggacgaacaaaacaacttcgaaaaaggaaaaccaatcacgaccaacgccgaccgcaccctgaaacggagcatgcgccgcaacctacagcggtacaaactgaggagagccaacctagtatccctcctcaagacccaaggctggataaccgacgagacgctcctcagcgaacaaggaaacaactccactttcgaaacgtaccgactacgtgcggaggcagccactaaagaaatcacattggaacaattcgcacgcgtcctgctaatgcttaacaagaaacgaggctacaaatctagccgaaaaatgaaacacgacgaagacggatcattcgtcaacaacctcgacattgcaagggaactctacgactctggactgacacccggacaatacgcctacaacctcctcaaagatggaaagaaatacataccagacttctacagatcggaccttcaggaagaactcgataaaatctgggcatatcaatacgaataccacgaaaatatcctcacccactcgctaaggtccgcgatcatcgatcagagcaaaaccgggacaaccaagatcttcctcaaaacccacggaatttttaccgcagacataaagggcaatcgcaacgaacgcaacaagcagctgttcgaactgaggtgtggtgcactggaacgagcgctcaccgcggaggaactcgcaactgtgatcgcggaagtcaacggacagatcaactcgtcctccgggtacctgggggccatttcagaccgaagcaaagccctattcatcaaccatcaaaccgtcggccaatacctaatgcaacagctagaccgggaccccaacaaatcactcaagaaccaaccgttctaccgccaggactatctagacgaatttgaacaactctgggaaacccaagctcactaccaccctgaactcaccgccgccctcaagcacgaaatcagggacataatcatattctaccaaagacgtctgaaaagccaaaaatggctcgtggccaactgccccttcgagcaccgcaaagtatgcccaaaatccagcccgctgttccaacactttagaatatggcaagtgctcaacaacgtcaccgtcaccgtcgacaacaaaacgtacgtactgaacgaagaacaaaaatcaatactcagcaaagagctcctatacaaggaaaagatatccaaacgcgatgcgttaaaaatgttattcgtgaaagcgaagggcgtagacatgaacttcgcctcgctggaaggcgaccgtacaatgagcaacctactcaaggcggcgcaggaaatcgtatcaatcagtggccacggcgattacgacttcgggaaaatgcccgcagacgacatacacaatatcatacggagcgtcttcggaggtctaggattcgcgaccgactggctcaaccttgacacggacgcggacgacctcgaacaagagtcgcaaatgcgtctgtggcacctaatttactcattcgaaggggacaattccaccaccggcgacaccaagctcgtcgaacgcttaatgtccctcctcaacttaccccaggagtacgcaagactcttcgccaacgtgcatctcgaagacgactactgcggaatctcctccaaagccctaaagcgtatactaccctttatgaaagcaggccacatatactcggaagcatgcgcacttgccggatacaagcacagtgaacaatcactgacaagagaggagaacaagaaccgtccgctgaaagaccaccttgaacaactgcccaaaaactccctgcgaaacccagtagtcgagaagatcctgaaccaaatggtaaatgtagtcaacagcatcatcgacacctacggccgccctgacgaaatccgcatagagctcgcccgcgaactcaaaaacaacgcactcggacgccaagccattttcgaagccattaaccgaaacaccaaggaatcagaacgcatccagcaaatactcaagaaagagttcggccttacgcacgtaagccggaacgacataatccggtaccgactataccaagaactctccggcaacggctacaaaacgctctacagcaacatttacatcccacaagaaaaactattctcaaaagaaatagacatcgaacatattatccctcaagcacgactcttcgacgacagcttcagcaacaagacgctcgaataccgggacgtgaacataaagaaatcaaatacaaccgccatagacttcgtcaggaatgaatacggcgaaaacgaagtcgaacaatacaaaaagagggtgaatgacttactcaagagcggggccatttcccaggccaaagccaaaaagctaaaaatgaccgaagcagagatccctaacgacttcatcgaacgcgacctacgcaacacacagtacatatcccgcaaggcccaggaaatgctgcgagacgtggcaagagtggttaccgcaacaacggggtctgtcacggatcgcctacggcaagactggcaactcgtcgacgttatgcaggagctcaactgggacaagtacgaaagacaaggccttacaacagtgataaatggcagagacggacaacagatccgcagaatcacagactggacgaaacgcaacgatcaccgacaccacgccatggacgccctcacaatcgcattcaccaaacccgcatacatctcctacctcaatcacctaaacgccaggtccgaagacgacatccgtagcattgaaaggcgattcctagagcgagacgcgaacggacatctaagattcattagcccaattgcacacaacttccgatctgaagctaaaagacacctagagatgatcctagtatcaataaaggccaaaaataaggtcgttacaagaaacaataacacaaccaaaaccaagggaggcagacgaaaccggatccaactcacaccacggggacagctacatgacgccacagtatacgggagtattctcctaccacacacaaagaccatagccgtagacggcaaaatgaccgccgaaatcataggtcaagtacaaaacccagtcttccgccaagccctcagccaaagacttgaagcctgcggaaacgatcccaaaaaggcattcaccggtaaaaacagcctagaaaaagcccccgtatggatcgaccaagcacacactgaacatgtcccggcagaagtaacaatccaacgcttggaacctcagcacaccatccgacgggcggtgaacaaggacctcaatatcaacaaagtcctggacaaaggaatccagcacatacttcaagcgcgcctcgacgcttacggcggcgacgcagccaaagcattcgccaacctggacaacaaccccatatggctcaaccaagagaaaggcatagccatcaaacgcgtcaccaccgcagaaaacatctccggagaacccctacatcacaagcacgataaggagggcagaccaatcctggacacgaacggcaaacccatgcccagcgacttcgtccgcctcatgaacaaccaccatgtcgccatatttcaagacgccgacggcaacctccaagaacacatcgttagcttctacgaagcggtagcccgagtcactgaactcgggctcccggtaatcgacaaagaatacaataaagacaaaggatggcaattcttattcacactaaaacagaacgaatacttcgtattcccgaatcccgcacaaggattcaaccccgacgagatcgacctcacggacgagcgcaattacagcagaatatcaccgaacttgtaccgagtgcagaaaatgtcaagcaaatactacgtattccgccaccatctcgaaacaacagtggaagataagaaggagcttcaaggcattacatggaaacgcatacaaagcctcaacaacctgaaaggtattgtaaaggtcaggatagaccacataggacgcatagtacaaataggggagtactga

SEQ ID NO: 7670 - RNA, 4056 nt, synthetic construct
  misc_feature 1..4056: note = Cas9 variant
  source 1..4056: mol_type = other RNA
atgttcagccagcagaacaacctgtattgcgagtccctaagcaagctgtactacaatattaccaagaactttctgtccaagaacgaggtgtgccgcatctacgagatattcttctgcagcatcctcacctacttcctgaaaaagtacaaccacgacatcttcaagaagtccagcacgatgaaaacgatcctgggcctcgacctgggggtcacctccatcggctgggccgtgatcgtgaccgacgacgacaatacgcccatcaagatcctggggatgggtagccggatcatcccgctctccaccgccgacaaagaggagttccagaaggggcaggcgatctcaaagaaccaatcccgcaccatcgcccggacccagagaaagggatataaccgaaagcagctgcgcaaggaggagctaaagaaaatcctcggggagctggggatcacgcccagtaaggagctgcttaacctgccatcgatcgagctgtggaagctccgggccgacgccgccagcggcaacgcgcccctgtccgccgagcagctggggcgcatcttctacatgctcaaccagaaacggggctacaagagcgcgcgctccgaggccaaccaggacaagaaggacaccgactacgtcgcggccgtgaaggggcggcaccagcagctgaaggagaagggccagaccatcggccaacatttttacaccgaaatgctgacgctcgaggaaaacagcggccacttccaggtgaagaacaacgtctacccgcgcgaagcatacctagaggagttcaacgccatcatcgccgcgcagaagccccagcacgccttcctgaccgacgacgtggtggaccggctccgcgacgaggtcatcttctatcagcggaagctgaagtcccagaagggcctggtgagcatctgcgagttcgagggtttcgagcgcaccttcttcgacaatgtgaagcagaaagacaagaccatcttcacgggccccaaggtcgcccccaagagctccccactgttccagctgtgcaagatctgggagaccgtgaacaacatcaacctgaaggtgaagaacaccgacggcagcaaaaacaagtgggccgactacgtccccaccctcgagcagaagcaagagataatcgagcacctgttcaagaacgccgggatctccctggacgccctccggaagatcctgggattcaataaggacgagatctttgtgaacaagcagatagagaagggactgcagggcaacacgacctatgccgagatccacaagattctcggggacagcaagcccgagctgctgggcttcaacataaacatcgagccctccaagcacagtgccctcctggtggacaagcgcaccggtgagatcctggccgagaaggaggggcagcaagtctccgcagagatcgagaaggagaacttctaccagctctggcacaccatctacagcatcaaggatctggacgagtgcgcggccgccctgatcaagcggttcaacatcgaccctaacgtggccgcccagctggcgaagatcgacttctccaagggcgccttcgggaacaagagcaacaaggccatgcgaaagatactgccctacctgatgcaggggtacaactacgccgacgcgtgttccctggccgggtacaaccacagcgactcccagactaagaaagagaaggaagagaacgtggtcgacgacaagctcaagttgctagagaagaatagcctccggcagcccgtggtggagaagatcatcaaccagatgatccacgtcgtgaacgcaatcattgataagtacggcaaacccgacgagatccgcgtcgagcttgcccgcgacctgaagaagtccaaggatgagcggaacgaggccgagctccagaacgcgtctaacaagaagctgaacgaggaggtggccaaccgcctgaaggagctcggcctgccggtgaccaagcggttcgtccaaaagtataagttcatcttccccgtgcgcgacaggaagatcaaggaggcccagctggtgaaccagtgcatatactgtggggagaccttcaacgtcaccgaggccctctccggcgataacttcgacgtagaccacatcatccccaaaagcatgctgttcgacgactcccagacgaacaaggtgctggtccaccgcaagtgcaacgcgaaagacaagagcaacaagaccgcgtacgacttcatcgccgccaagggtgagaacgagctcgccatctacctggaccgggtggacgactggttcaagcgcggcgtgctgagctacgggaagatgcagcggctcaaggtctcctacgagcagtacgccgagcgcaagcagctgaagaaggagaccgaggcggacatcaagctgtgggagaacttcatcgagcgcgacctccgacagacccagtacatcgccaagaagtccaaggacctgcttaagaagatctgcaacaacgtgacggtgaccgagggaaagatcaccgcccagctccggaatctgtggggctgggatgacgtcctgatgaacctccagttacccaagtacaaggccctggggcagaccgagatcaaggagtggactagcgagcacggccgccggctccacaagaaggaggagatcactaactggaccaagcgcgatgaccaccggcatcacgcaatcgatgccctcgtggtggcctgcaccaagcaggggtttatccagcgcatcaacaccctgaacagctccgacacgaaggatgccatggacagagagattaaggccgcgaaggagaagtacaacgagctctacgacaagaagctgctgaccgagaccaacgagcaggtcaagaaccacaccgagcgtttcaacaagctcgaaacgtacctcaaaagccagcagccgcccctgttcaccacccgctacgtagaacaggaggccgacaagatcttcgtgtccttcaaggcgggcaagaaagccgcgacctacggcatccggaagatcaagaaagacgggaagaaggtcgtggtgcaggagaagatcgtcgtgccccgcggcgcgctccacgagcagagcgtgtacgggaagatcaagacgcaggagaaggataagcctctgaagtacttgtttgagaacccggagaccatcgtagacaaccggatcaagattctcgtgaaggagcgcctggacaagttcgaaggcgatgtgaagaaggccctgacatccctcaagaaggagcccctgttcatcgacaacgagaagaataccctcctcgagaaggccgcctgctacacggacgcaaccgtcctgaagtacaaactgcaggcgctcaaggccaaccaggtgaacgatatcgtggatgagggggtcaagcggatcgtgaaggcccgattagcccagcacaaaaacgagaaggaggcgttcaaggacaccgtgtggttcaaccaggagaagcggatccccatcgtctccgtccgcgtgttcgcccggcccgacgcctccaagctggccatcatcaagaccgacgagaacaacaagccgatcggcttcgccctcacgggcaacaatcaccacattgcgatctacaaggacaacaccgggaagctggtccagcacatctgcaccttctggagcgccgtagagcgcaagaagttcggagtgcccaccgtcgtgaagaacacggggacgctgtggtccgagctcctgcacaaggacctgcccggcaccttcctcgacaagctgccgcaggatgggctggagttggaatacagcctgcagcagaacgagatgttcgtgctggggctcccaaaagagtccttcgaggacgccatcaagaacaatgacctccccctgctcagcaagcacctgtacctggtctggtccatcagcgacaacgactactggttccggcaccacttggagaccaagaacagcgagctgaagtccacgaccggcgccaaggagagcaagcgctactaccggttccagtccgtggggaccttcactaaggagaaccccatcaaggtgcagctgaaccacctcggcgagatcactaagatcggggagccgtga

SEQ ID NO: 7671 - RNA, 4059 nt, synthetic construct
  misc_feature 1..4059: note = Cas9 variant
  source 1..4059: mol_type = other RNA
atgaagaagcgcaaccgtgaggagtactacgtgggcctggacatcggaaccagctccgtcggctgggccgtcgcaacccccgactatcgcattccgaagttccgggggcacaagatgtggggcagcaggttgttcgcggaagggaagcgggccgccgaacgccggcagttccgcacgaaccggcgccggctcgcccgtcggcgcgaccggttacagatcctcgaggagctctttgccgaggagatggcgaaggtggacaataccttcttcatgcgcctgaaggagagtaagttcttcctcgaggacaagacagtcaaggagaagcacatcctgttcagcacagacaagttcgacgccgaccggttttacaaggacaaccccacgatctatcacgtgcgcaaaaggctgatggaggaggaaccccaagacatccgagagctgttcctcgcggtgcaccatatcctgaagtaccggggccactttttgtttgccggctccctggagcagaacggggcgagcatcgaggagctggtccgcaccctcctgggcaagcaggggcttgccatccttgacgatacaattgactcaaacgagatggtcaacatcctgaagaacaccggcgagaccaagagcgaccgcaagaaggacgttcaagagctgtggaaccccctcaaggacaaggtcaagaaggcacaagccgccgagatggcgggcctggtgctgggcctcaagtccgacatcagcaaactcttcgccaactccgactacaaggacctggacagctccataaagaacattaacttcagcagtggagactacgaggagaagcgggacgactacgcgaacagcatcggtgacgacatagtgctattggataccatgaaggctctgtacgacacactcatcctgagccagatcctgcaggggaagcgcagcatcagtgccgcgaaggtcgaggactacaacacccacaaggagcagctccgcgccctgaaggccatcctgaagccgcacaagcgcctctacaacgagatgttccgcgagaacaacaagaaggacctgagcaactatgttgcctacatcagctcctacagcgaggggaagcgcgtgaaccgggagggcttctacaagtacgttcaggccgtgctgaagcaggtcgacgactccgacagcaagcaggcgatcctggaggctatcagactagagactttcctgcccttactgcgggttaaggacaacgccgtgatcccccaccagatccaccaggccgagctggaggccatcctcgagaccgcgcgcaagaagtacaacttcctaaacgacgtctccgacggcgtcagcgtgaaggacaagatcattcagctgtttacattccggatcccatactacgtggggcctctcaacccccactccggcgagacggtcgccgaccgcaagcaggggaccggttgggtggtccggaagcagcgggggaaggtgtacccctggaacttcgctgacatggtggatgtcaaggcgtccgcggaggccttcatcaccaacctgaccaacaagtgcacctatctgatcggcgaggacgtgctcccaaagcggagtctcctgtacagcgagttcatgctactcaacgaacttaacatgatcaagtacgacggccacgagctgccggtggccatcaagcagctctacatcgagcaggtcttcaagcaggaacacaagaaacagacgaaagggcgcgtgctggacttcctgaagcggaacggcctcatcacaggtagcgccaccgccgtcatcaccggcatggacgacgcaataaagggggacctccagagctaccgcgacatggtccggatcttcggcgccggctttgatcactccatggcagagcgcatcatccgctgggtgacgctgttcggcgaggccaaggacatcctggagaacaagatccgtgaggtgtacgggaacagcatctcagacagccagatgcgcgctatcaagaagctgaagtacgcggactgggggcggctgtcccaggccttcttaatagccgtcaaaggctgcgacaagtcaggggtggagcgcaacatcatcacgtgcctgcgcgcctccagccagaacctgatggagatcctcagcgatcagggcacctacatcaagcagatcaaggcctggaaccaccagcacaccacaaacatgatggacaccctggactaccagctggtggatgacctctatgtcgcgccctccgtgaagagatcaatctggcaatccctgtgcatcgtggaggagctggtcaagatcatgggccaggcccccaagaaaatcttcgtggaggtcacacggaccaagcaggccgaaaagacgaagaaagacagccgcaagaagcggttagtcgagctgtacaccgcgatagggaaggagggcgcagcctggaagaaggagatcgaggcccaccaggccggggacttccgccgtaagaagctgtacctctactacacccagatgggacggtgcatgtactccaacgagcccatagccatggacgctctgtttaccagtgcttacgacatagaccacatctacccgcagagccttacgaaggacggcagctgggataacctagtgctggtgaaatcccagctgaacaaagaaaagtccgaccagtaccccctccggccggccatccgcgagaagaacaaggcccactggcagtacctgtgccgggccgggttcatcagcgagaagaagtacgagcgcctgatgagaaccactgaactcaccgcggaggagctgtctggcttcatcgcccgccaactggtcgagacctcccaggccacgaaggccgtgaccgggctcctggagcggatctacaccaacaccgagatctgcttcgtcaaagctgagacggtaagccagttccgccaccagcacaactttatcaagatccgggagctgaataactaccaccacgcgaaggacgcctacctcaatatagtggtggggaacgtataccacgagaaattcacgaaaaacccctgggagttcatcgccagatccaccgagagacggccgtacaatctgaaccgcatgtacgacttcgacctgctaaagcaggggcgggtgatctggcaagtgcccaagagtctggagaccgtgcaggccatgatgaagtccaatgacgtgcgcatcacgaagaagctgctcgtccagaagggcgagctgtacgacgcgaccatcaccaaggcccacaaggcaaaggagggcacctactttcccctgaagggggccgacgcccgtctccgcgacgttcaccggtacggcgggtatgagaagatcaagatcgcttactacagcgtgttcagctgccgcgagaaggcctccaatacgatccacaccctgatcatccccatccccgtgtataaggctggcctgctccagaccgaggccgacctaaccgcctacgcgtggcagacgaagcagaagaccaaacccatcaaggacatctacagcgccatcacccccatctacaagaagctgtgcataaataccgtggtgaagatagacgggttcaagtacttcctcggcggcaaaacgggggactacatgtggctggaccccgccatcccggtagtcctggatgagcaggccgccgcctacctcaaggcaatctccaaggtgggccgggcggacgacgtggagaacacggcccaggccatcgacctgatcaccgcggaagccaacgaggctttctacgacgtcctgctcaagaagatggaggccaagatatttgccaaggcctaccagaccatcgtggagaaactggccagcgagacggcccgcgagcggttccgcgagctgtccatcggggcccagtgcagctgcctcctggagatcttaaatctcctggcgaacaacaagaccaccttcaccttcttcaaggacaagatgggcgtgaccatgtcccggcgcaagcagcccatggatctgaccaaactagaggagtgcatagtctacgagaccagcatcaccgggctgtacgagaaggccgtgtccctgctctga

SEQ ID NO: 7672 - RNA, 4059 nt, synthetic construct; identical to SEQ ID NO: 1872
  misc_feature 1..4059: note = Cas9 variant
  source 1..4059: mol_type = other RNA

SEQ ID NO: 7673 - RNA, 4059 nt, synthetic construct; identical to SEQ ID NO: 1873
  misc_feature 1..4059: note = Cas9 variant
  source 1..4059: mol_type = other RNA

SEQ ID NO: 7674 - RNA, 4059 nt, synthetic construct; identical to SEQ ID NO: 1874
  misc_feature 1..4059: note = Cas9 variant
  source 1..4059: mol_type = other RNA

SEQ ID NO: 7675 - RNA, 4059 nt, synthetic construct
  misc_feature 1..4059: note = Cas9 variant
  source 1..4059: mol_type = other RNA
atgaagaagatcctgggtctggacctggggacaaccagcatcggctgggcctttatcaaggagcccgagaaggacgtggtcgggtccgagatcgtcgacatgggcgtgcgcatcgtcccgctgagctccgacgaggagaacgacttcgccaaggggaacacgatcagcatcaacgcggaccggaccctcaagcgcggcgcccggcgcaacctgcagagattcaagcagcgccgaaacgccctgctcgagatcttcaaggagaagaagctgatctccaccaacttcaagtacgccgaggacggccccagctccaccttcagcacgctgaacctccgcgccaaggcggccaaagagaagatcgagctgcaggacctggtgaaggtgttgctgcagatcaacaagaagcggggctacaagtcctcacgcaaggcgaagtccgaggaagacgacggtagcgcaatcgactccatggggatcgcgaaggagctgtacgagaacgacctcacccccggccagtgggtctacgaggccctgcagaaaggacggaagaacgtgcccgacttctaccgcagcgacttgcaggaggaatttaaaaagatcgtgaactaccagtccgagttctttccagacatcttcaacgccagcttcgtcgaagactggatgggcaaggcctccacccccacaaagcagtatttcaacaagaaaggcgtgcagctcgccgagaacaaggggaagcgggaggagcgccggctgcaagagtacaagtggcgcgccgaggccgtgaacttcaagatcgacctgtccgagatcgccctcatcctatcccagatcaacagccagatcagcaactccagcggatacctgggggccatctccgaccggagcaaggagctctacttcaagaacctgacggtcggccagtacctgtaccaacagatcaagaaaaatccccacacacgcctcaagggccaggttttctatcggcaggactacctggacgagtttgagcgcatctggtccgtgcagagctccttctacccccagctgaacgacgccctcaagcgggaggtccgggacatcactatcttcttccagcgccggctcaagagccaaaagcacctgatctccaactgcgagttcgaggaccaccacaaggttgtgcccaaaagccaccccgttttccaggagtttcgcatctggcagaacctgaacaatctgctgctaatcaagaaggacaacctgaacgagaagttcgacctcgagctcgagtccaagatcgcgctcgccaacgagctggctttcaagcgggagctcaacgtgaaggacgccttaaagatcctggggctcaagcccaacgagtgggagttcaacttcaccaagatcgaggggaaccgcacgaaccaggccttcttcgacgcgttcgccaagatcatcgagctggaggacggggagcccatcgacctgggcgacctcaaggccgacgatatcctggaccagttcagcgaggccttcctgcggatcgggattgacacagagctgctgcaggttaactccgacatcgagggcgccgagtacgagaagcagagctacatccagttttggcatctcctgtactccagcgaggacgaccaaaaactgaagttaaacctgatccgcaagttcggcttcaagccggagcacgcgaagatcctcgcctccatcagcctgcaggacgaccacgccagtctcagcagccgggccatcaagaaaatcctcccacacctccagtccgggctgatctacgataaggcgtgcacctacgccggctacaaccacagctcctcattcaccaaagacgagaacgagaagcgcgagctgcgggccgagctggagctgctcaagaagaactccctgcgcaaccccgtcgtggagaagatcctgaaccaaatgattaacgttgtcaacgccatcctcaaggaccccgagctgggtcggccggacgagatccgcgtggagatggcccgggagctgaaggcgaacgccgagcagcgcaagaacatgacgagcaacatcgcctccgccacccgggaccacgacaagtaccgcgagatcctcaagagcgagttcggcctaaagcgggtcaccaagaatgacctgctccgctacaagctgtggctagagactgacgggatctcgctctacacgggcaagcccatagaggccagcaagctgttctccaaggagtacgacatcgagcacatcatccccaaggcgcgactgttcgacgatagcttctccaacaagaccatctgcgagcgccagctcaacatcgacaaggccaacgtgaccgcctttagcttcctgcaaaacaagctgtccgccgacgagttcgagcagtaccagagccgcgtgaagtccttgtacggcaagttgtcgaaggccaagatccagaagctgctcatggcgaacgacaagataccagaggacttcatcgcacggcagctgcaggagacccgctacatcagcaagaaggccaaggaaatcttattcgagatttcccggcgcgtcagcgtgacgaccgggacgatcaccgacaagctccgggaggactggggcctggtggagatcatgaaggagctgaactgggagaagtatgacaagctcggactgacctataccatcgagggcaagcacggggagcgcctgaacaagatcaaggactggtccaagcggaatgaccaccgccaccacgccatggacgcgctcaccgtcgccctgaccaagccggcctacatccagtacctgaacaacttgaacgccaagggcctgaacaataagaagggcacggaggtgttcgccatagagcagaagtacctgaagcgggagaacgggaagctctgcttcatcccgcccatcgaaaacatccgcagcgaggcgaaaaagcacctgtcccggatcctggtgagctacaaggccaagaacaaggtcgtgaccataaacaagaacaagaccaagtccaaggccggcctcaacgagcagatcgccctgacgcccagagggcagctgcacaaagagaccgtgtacggcaagagcttccactactccaccaagttcgagaagatcggcgccagcttcaacgtccagaagatcaataccgtggcgaaaaaggaggagcgggaggctctcctgaagcgcctagccgagaatgggaacgacccgaagaaggccttcaccggcaagaacaccctaaacaagatgcccatctacctggacctggggaagaacataaagctctccgagaaggtgaagacggtcgtgctggagcagaactacaccatccggaagaacatcgacccagatctgaaggtggacaaggtcattgacgtgggcataaagcgcatcctcgagagcaggctggaggagttcgggggcaacgccaaattggcgttcagcaacctcgaggagaacccaatctggctgaataaggagaagggcatcagcatcaagcgcgtgaagatctccggtgtcagcaacgtggagtccctacatgtgaagaaggaccacttcggcgagccgatcctcgaccaggaggggaacgaaatccccgtggacttcgtgagcaccggcaacaaccaccacgtggccatttacgaggacgagaacgggaaccttcaggaggaggtagtgtccttcttcgaggccgtggtccggcagaaccagggcctgccaatcatcaagaagaaccacaccctcggctggaagttcctgttcacgctgaagcagaacgagtacttcgtgttcccgtccgacgacttcgtgcccgctgacgtcgacctcatggacgagcagaactaccacctgatcagccccaacctgttccgcgtgcagaagattgcgcggaagaactacgtgttcaataaccacctcgagacaaaggccgtcgacaacgacctgctcaagagcaagaaggagctgagcaagatcacctaccacttctaccagacccccgagcatctccgcgggatcatcaagatccgcatcaaccacctgggcaagatcatccagatcggggagtactga

SEQ ID NO: 7676 - RNA, 4059 nt, synthetic construct
  misc_feature 1..4059: note = Cas9 variant
  source 1..4059: mol_type = other RNA
atgaataagaagtactacctggggcttgacatcgggaccaacagcgtgggctgggccgtcacggacgagaactacaacctgtacaaatacgccgggaagcgcatgtggggcatccggcttttcgaggcggccgacacggccgcggagcgccggatgaagcgctccaaccggcgcagactcagccgcaagaaacagcggatcgacctactgcaagaactgttctccgaggagatcgtgaaaaaggacctgaccttcttcatccgcctgaacgagagccggctccatttcgaagacaagtccaccggggagaagtaccccctgttcgtggacaaggagtacacggacatcgactatcacaagcagtacccgacgatgtaccacctccgcaaggagctcatcgagaaccccgagcctcacgacatccggctggtctacctggcctgccaccacatcctcaagaaccgcggccacttcctgatcaacggcagcatctccgatgtaaagaacctgagcttcgtgtgcggggagatgatcaaggagttcaactccgtcagcgagtacgaaatctcactcaccgacatccgggagctggagcgcatcctgagcgacaagaagaccgctaagtccgtgaaggcaaagcaggtcgcccagctgttcgagtgcacacccgccgaggacaaagagcagcagaaatgcgcgaaggccatcatcacgaacctctcgaagctcatcgtgggcctcaaggggaacatctccaagatgttccaccagcccctggaggagatcagcaccaagtcctttaagttcaccgaggccaagtatgaagacgagatcatgcccgccatcgaggagaactatccggattacgccagcgtgattgaccgtatcaaaggagtgtacgactggtccgtcctggtggagatcttagacggggaagactatctgagcttcgcgaaggtaaaggcctacgagaagcacggaaagaatctgcacatcctcaagaacgtcatgaagaagtactgcaaggacgaggtgtaccaggccttcttcaacggcatcaacgagaagaacgggtacggcaactacatcggggccatccgcaagaacggtcacacctacaagatggaccggtgcaaaagcgaggaggacttctacaagggcctgcagaagatcttgtccacgatcgtgcccgatcaggaggacgaggagctcctggagaagctgaaagccgaggtggagaaccagaccctcctccctctggcacgctcgaaggaaaacgggaccatacccaaccaggtgcacctccaggaacttatgaagatcctcgacaatgccaaggagtacctggacttcctgaagaaggaggacgagtacggcaccatagctgagaaaatcatctccatcgccaagttcagaatcccctattacgtagggcccctgagtcgccgccacaaggaggagggctccaacagttggatgatccggaaggaggaggggcgcatctacccgtggaacttcggcgacaaggtcgatgtggagcagtccaataaggagtttatcgagagaatgacgaacaagtgtacctatctcattggcgaggacgtgctgcccaagaacagcctgctctactccaagtacatggtcctgaacgagctgaacaacctcaagatccgcggcaacaagataagcgtggagctcaagcagcgtatctacaaggacctgttctgcaccatggccaaggtcaccggcaagaggatcctggagtacttaaagatggaggacccagagatagtacaggaggacatctccgggttcgacatagacttcaaaagcgcgctggcctcctacctggacttcaagaagcaggtcgtgggcaacgagatcgagaaggaccactataaggagatcatagaggagatcatcaagtggaaaacgatctatgacgacgacagcaagatgatgcggcgcatgatcgagcgggagtatccggaggtgttcgacaaggagcagatcaagaagatctgccaacttaagtattcagggtggggcaacttcagcgaccgctttttaaacggcgtgcgtggcgccgacaaggagaccgaggagtcctacaccatcatcgaggccctgtggaagaccaactacaacctcatgcaattgctgagcaagcagttctccttcaaggaggagatcgaccagatcaacgccgagaaggccggcgatgtggggaagatcaactacgagaacacggtgaaggacctcatcgtgtctccgagcaacaagcgggccatctggcagacgatacagatcgccgaggagatcaagaaggtcatgaagtgcgagcccgagcggatctttatcgagatggcccgcggcggggagaaagagaagaagcggaccgtctcccgcaagactcgactgcaggagctgtacgctggctgcaaggatgacacgcgcaactggatgaaggagatcggggaccgggaagaacgcgagttcaacagccgcaagctctacctgtactacacccagatggggaagtgcatgtatacaggcgacgaaatcgacgtcgacgccctgatgaagggaaactccaattgggacatcgaccacatctacccccagagccggatcaaggacgactctcttgacaacatggtcctcgtacgtaaggatgtgaacaacaagaagcggaataagatcctgagccccaaaatccgcgaggatatgaagggctactggacgatgctctgccagaagggcctgatctccaagcgaaaatacgaccgcctgacgcggaccaccgatttcaccgacgaggaactcagcgggttcatcgagcgacagctggtcgagacacgacagtccagcaaggccgtggccgagctgctcaatcgcctgtataaagactccgaagtggtgtacgtgaaagccggcctggtgagcgactttcgccacgacaacgacctcctaaagagccgccgggtcaacgactaccaccacgcgaaagacgccttcctgaacatcgtggtggggaacgtgtaccacgtgcgcttcaccagcaacccgcggaagtggatcaaggacaaccgcgactccaactacagcatccggcgggtgttcaactacgacgtcaagcagggcgacaagatcgtgtggcacgggtccgagaacggcggccacagcatcgaccagattaagaaaatcatgagccggaacgacatcctctataccgagtacacatactgcgagaagggccagctgttcaacgaaactctggccaagaagggcaacgagaaggccatcgcactcaagaagaacctggaccccgtgaagtacggcggctatacgacccccaagacctcagcgttcgctttcgtcgagttcgacgggaagaagaaggagcgcaagaatcacatagtggagatccccgtgtacgtcgtgaatatcgccaagcgggagccggacgccgtgaagaaatacctggaggagcgcaaaggctatagcaacgtcgtaatcaagaagtaccccataaagaaaaactccctcatcaaaatggacggctacctggcacgccttcgcggggcgaacgaaaaggacatcatcctcaagaacgccgtgcagctaatcctgaacaaggacctgtacgagatcgtccggaagatcgagaagtacctggagtataatctgcaataccaggccgatgccaagttcgagggattcaccatgaaggacctcaacatgatctacgaggaactgtacctaaagctcaaggagtccatcttccagaagcggcccgcgcagcagatgaagaccctggagaaggggaaggaggccttcatctccatcgagaacctgggcgagaaggccaaagtgatcaacgaaatcatcgcaatgttccgctgcgacgcaaccaccgtggcgaacctcaaggtcatcaacgggagccaaaacgccggctccatgaaggtgaacaagaacaccctgacgtccaagtccctgaaactcgtacatcagagcatcaccggcctgttcgagaccgaggaggagctggtctga

SEQ ID NO: 7677 - RNA, 4062 nt, synthetic construct
  misc_feature 1..4062: note = Cas9 variant
  source 1..4062: mol_type = other RNA
atgaagaagaagtactacctgggcctcgacatcggtaccaacagcgtgggctgggccgtcaccgacgagaactacaacctgtgcaagttcaacgggaagaagatgtgggggatccgcctgttcgaggacgccaagacggcggccgagcggcgcaccaagcggtccaaccgccggcgcatcgcccggaccaagcagcgcatcgacctcctgcaggagctgtgcgagaagagtatcttcgagaaggacccaaccttcttcatacggctcaacgagagcagcctgcacctggaggacaagtccacgggggagaaatacccgctgttcgtggataaggagtacaccgacatcgactatcatcgcgagtaccccaccgtgtaccacctccggaaggaactgatcgagaaccccgagccccacgacccgcgcctcgtctacctggcctgctgccacatcatcaagagccggggccacttcctggtgaacgggtccatctctgacgccaaggacctctccttcatctgcgagaacatgatcaacagcttcaacgcggcctccgactacaagatcaacatccaggacatgaccgccctggagacgatcctgacggaccgcaagatggccaagagcgtgaaggcgaagcagatcgtccagctgttcaagtgcatcccctgcgaggacaaggaacagcagaagtgctgcaaggctatcatcaccaacctgtccaagctgatcgtggggctcaagggcgacatcagcaagatcttcaacgagtccttcgaggagatcaagagcttcaagttcgccgagaccaagtacgaggacgagatcctgcccacgatggaggagatctaccccgaccacgccgagatcatcgagaagatcaagtccatctacgactggagcatcctggacgagatcctcgatggggaggagtacctgtccttcgccaaggtgaaggcgtacgagaagcacaagaagaacctgcacgacctcaagatcctgatcaagaagtactgcgacgacgagacctaccagagcttcttcaacggcatgaacgagaagaacaagtactccaactacatcgggtccatccggaagaacggccacacctataaggtcgagaaatgcaagtcatccgaggacttctacaaggagctgctcaagctgctgagctccgtgaacccgggccaggaggacgagtccctcctggagcagatcaagttcgagaccgagaaccagacgctgctccccctgctgcgcaccaaggagaacgggacaatccccaaccaggttcacatgcaggagctcatcaaaatcctggacaacgcctccaagtacctggacttcctcaacgagaaggacgagtacggcaccacggccgacaagatcatcagcatcgccaagttcaagatcccctactacgtcgggccgctgtccgaccggcacaaggagaacggcagcaactcctggatggtgcgcaaggagaacggccggatctacccctggaacttcgatgacaaggtggacgccgagaagtccaacaaggagttcatccagcgcatgaccaacaagtgcacctacctgatcggggaggacgtcctccccaagaacagcctgctgtacagccggtacatggtgctcaacgagctgaacaacctgaagatccgcggcaacaagatctccgtggagctgaagcagcagatctacaacgacctcttctgcaccaaggcgcgcgtcacggggaagaacatccttaactacctgaagaaggaggaccccgagctcgccgccgaggacctgagcggcttcgacgtggacttcaagtccgccctgaccagctacctcgacttcaagaagcaggtcgtagggaacgaaatcgagaaggactactacaaggagatcatcgaggagatcatcaagtggaaaaccatctacaacgaggactcaaagatgatgaagcggatgatcggccgcgagtacccggagaccctgaaccaggaccagatcaagaagatctgccacctgaagtacaacggctgggggaacttcagcgagacgttcctcaacggcatcaaaggcgccaacaaggagaccggcgagtgctacaccatcatcgaggcgctgtggaagaccaactacaacctgatgcagctcctgagcaagcagttctccttcaaggaggagatcgaccagatcaacgccgagaaaacgggggccatcggcaagatcacctacgagaacctggttaaggacctcgtggtcagccccgccaacaagcgggccatctggcagaccatccagatcaccgaggagatcaagaaggtgatgaagtgcgagcccgagcgaatcttcatcgagatggcgcggggcggggagaaggagaagaagcgcacggtctcccggaagactcggctgcaggagctgtacaccggctgcaaggacgacacgcgcgactggatgaaggagatcggggaccgcgaggagcgggagttcagctcccgcaagctctacctgtactacacccagatgggcaagtgcatgtacactggggaggagatagacgtggacctgctcatgaccgccaacagcaagtgggacatcgaccacatctacccccagtcccggatcaaggacgacagcttcgacaatatggtgctggtccgcaaggacatcaacaataacgtgaagggcaacaacatcgtgccgtccagcatccagaaggagatgacctcctactggaagatgttactccaaaaggagctgatcagcaagaagaagtacgagcggctgacccgctccacggacttcaccgacgaggagctcagcggcttcatcgagcgacagctggtcgagacccgtcagtccagcaaggccgtggccgcgctgctcaaccggctgtataaaaactccgagatcgtgtacgtcaaggccgggctggtgagcgacttccgccacgacaacaagctcctcaaaagccgccgtataaacgactaccaccacgccaaggacgccttcctcaacatagtggtcggcaactgctaccgcaccaagttcacggccaatccccggcagtggatcaagaagaaccgcgacaccaactactccatccggcgcgtgttcgacttcgacatcaagcagggggacaagatcgtgtggtacggcaacaagaatgagaacggcaagcacaccattgaccagatcaagaaggcgatgagccggaacgacatcctctacaccgagtacacgtactgcgagaaggggaagctgttcgacgagaccctgaccaagaagggcaacaagaaggccatccccctcaagaagaaccttgaccccctgaagtacgggggctacacctccgtgaagacgtctgccttcgccttcatagagttcgacgacaagaagaaagagcgcaagaaccacatcgtggagatcccgatctacgtggccaacatcgcgaagcgggagcccgaggccgtcatcaagtacctcgaggagcagaaggggtacgtgaacatcgtggtcaagaagtaccccatcaagaagaactccctgctgaagatcgacggctacctcgcccgcctgcggggcggggacagctccataatcaccctgaagaacgccgtgcagcttgtgctggacaagaagtcctacgaaatcatacgcaaggtcgagaagtacctggaccacaacagcaagtacgaggccaacagcaaactcgagaagttcaacgagaacgacctgaacatcatctacaacgagctgtgcctcaagctgcggaactccatctaccagaagcgccccgtgcaccagctggagaccctcgaacagggcatcgacaacttccggagcctggagtccctgaaggacaaggctaagataatcaacgagctcctggccatgttccgctgcgacgccaagaccgggatggacctgcggctcatcggcggggccagcaactccggccgcatgcggatcagcaagtcccgcctgacgagcaagtccctgaagctcatcaaccagagcgttaccggcctattcgagaccgaggaggagctggtatga

SEQ ID NO: 7678 - RNA, 4062 nt, synthetic construct; identical to SEQ ID NO: 1878
  misc_feature 1..4062: note = Cas9 variant
  source 1..4062: mol_type = other RNA

SEQ ID NO: 7679 - RNA, 4062 nt, synthetic construct
  misc_feature 1..4062: note = Cas9 variant
  source 1..4062: mol_type = other RNA
atggccgccttcaagtactacctgggcctcgacatggggaccaactccgtgggctgggcggtcaccgaccccaactacaacttgctgaaggccaaggggaaggacctctggggcatccgcgagtttaacgaggcatccacggccgtcgagcggcgcacccaccggatcagccgacggcgccggcaaagggagcaggtacggatcgggctgctgaaggactacttccacgacgccatcggcgaggtggacccagacttcttccagcgcctcgcgaactctaagtaccacctggaagacaaggacaccgaggtgcggtacaagaacaacgtgttcaacgatgacgattacacagacaaggactacttcgatcagtaccccacgatctaccacctccgcaaggagctgatcgagagcaccgacaagcacgacgtccggctggtgttcctggccctcctgaatatgttcaagcaccgcggccacttcctgaactcggggctcggcgagaacagcggggaaaacaacatcaacaacgcctacctagagctgaccaacctcctaagtgagttcacccagtacaacctgaacgaaacgatcgacggcaagaagatcgaggacatcctcagccggcgtgacatgtcccgaacccgcaaggccgaggggctggcggagatcctgggcgtggactacaagaacaagccctacaaggagctcatccggggcctgtgcgggctgaagttcaacgcctgcgccatcttccctgagatccaaagcgacgaggtcccaaagctcgacatctgcctgtccgaggccagcttcgacgagaaatccgacgagatcgcaaacatcctgggcgaggactacttcgagatcatcatggcaatgaaggacatctacgacatcgggagcctcgcgggcatcatgaaaggccacaattacctgtcccaggcccgcgtgaccagctacgagaagcacaaggaggacctgcggctcctgaagaacgtgatccgcaagtactgctccaaagaagactacgacaacttcttcaatagcgaggccgacgggtcctatgccagttacgtcggcagctacaactccaagacaaagcagcgccgggtagggaacaagcgctcgtccgaggagctgtacaaggcgatcaagaagatcctcaagaacgtgcccgcggaggacgccgacgtccagcggatcctgatgagcatcgagaacgagaccttcctgcccaagcagctcactgcctccaacggcgtgatccccaaccaggtgcacgccaaagagatcaagaagattctgtcaaacgcggagcgatacctgccgttcctccgggagaaggacgagaccgggctgtccgtcagcgaaaagatcatgaagctgttctccttccagatcccctactacgtgggccccacgacggagaagtccagcaaggacggcggaaacggctgggtggtccgcaaggaggagggccaggtgctcccgtggaacattgacgagaagatcgacatgaaggccaccagcgaggccttcatctccaggatggtgcgccggtgcacctacatcagtggggagccggtcctgccgaaatccagcctggagtaccagtccttctgcgtgctcaacgagatcaataacatcaagatcgacggggagagaatcagcgtggagctcaagcaggacatctacaaggaggtcttccagaaaggcaagcgggttaccaagaagcagctatgcaagtacctgcacacgcgtggcatcatcgaggcagaggagcaggtcaccggaatcgacgttacaatcaacaacgccctcaccacatacggcaagttcaaagcgatcctgggggacgacatctccaaggatagcgtgcagaagatggtcgagaacatcgtcttttggtgcaccgtttacggcgacagcaagaagttcttgaaggacaggatcgaggagaagtacggggagaagctcaccaaggagcagatcaagcgcatcgtcggcttcaagttcaaagactggggcaatctgtccaagaacttcctggagctcagcggggccgacgtgtccacgggcgagagcgtgtccatcatccgggccctgtggaacaacaacctgaacctcatggagctgatcaacagccgcctgtataactacaaggagcggctcgccgaatatcagaatacgatgatgaaaaccctgtcggacatcgaagcggaggacctggatgagtactacttcagtgcccccgtcaagcgcatgatctggcagaccatcctcatcatcaaggagctggtgaaggtgctggggtgcgagcccgacaggatcttcgtagagatgacccgccgcccggacgagaggaaaatgcgcacggagtcccggcgtaagaagttcgaggagctctacaagaaggtgaaggacgaggacgtggactggatgaaggtcatcgcccacgccgacgagaccggcagcatccggtccaagaagatgtacctgtacttaacccagaagggccgctgcatgtacaccgggaagcacatcgagctcagcgacttatttaacaacaacctgtacgacatcgatcacgtttacccccggcacttcgtcaaggatgacaacatcgacaacaacctcgtcctggtctgcaaggagaagaacgcccacaaatccgacatctaccccctggaggacgagatcctcgcgagtcagaagaacatgtggtccgagctccgccggtccggcttcataacggaggagaagtacaaccgcctgatcgggcggaactccttcaccgacgagcagaaggctggcttcattgcccgccaactcgtggagaccagccaggggaccaagggagtcgctaacatcctgcagcagctgctccccgagagcaagatcgtgtacgccaaggcgtctaacgtgagcgagttccggaatacccgcgacatcccgaagtcccggctgatcaacgagttccaccacgcccacgacgcttacctgaacatcgtcgtgggcaacgtgtactacgtcaagttcacgcagaaccccctcaacttcataaagaacgactacgaccgcgacaagaccaagaacaactacaacctgagcaagatgttcgactgggacgtcgagcggaacggggaggtggcctggatcgcccagaagaaggacggcgaggcggggaccatcgcaaccgtcaagaaggtgctgggccgcaacacgcccctcatgacccgatacagtttcgaggggaagggtggcctgactaacgagaccctgtacagcgcgaagaaggccaaggaggagggctacattccctttaaaagtagcgacgagaagatgaaggacgtgacgaaatacggcgggttcacatccgtcaccggcgcgtacttcttcctcgtggaacacaccgagaaaaagaagcgcagccggatgatcgagtccgtgccgctctaccttgcgcagaagatcgaacagaacccccacgagctggagaagtactgtgagcaggtcctgggtctaatcgacttcgacatccgcgtgcgcaaaatcaaaataggcagcctcatcaagcggaagggctacttcttctacatcacggggaagacaggccaccgcctgatcctgcggaacgccgtgaacatgtgcctgaagaaggaatgggtcaagtacatatccaagctggagaaggccgtggataagaacaacgtggaggggatcatcaccaaagagaagaacgagctgctctacagcgagctgatcgagaagtttaagaactccatcttcagcaaccgccccaaccccgtcggtgacaagttggacgaggccaaagagaagttcatcaacctcgacatcgagaagcagtgtatcgtgctgtgccagatcctgcagctctccagcgtgctggggtccgagtgcgacatgaccctgctcggcgagagcgcgcactgtggcaagatcctgatcagcaagaagatcggggacgaggacatctaccttatcaaccagtccgtcacgggcctctacgagaagaagatcaacttgcggaccgtgtga

SEQ ID NO: 7680 - RNA, 4065 nt, synthetic construct; identical to SEQ ID NO: 1880
  misc_feature 1..4065: note = Cas9 variant
  source 1..4065: mol_type = other RNA

SEQ ID NO: 7681 - RNA, 4065 nt, synthetic construct
  misc_feature 1..4065: note = Cas9 variant
  source 1..4065: mol_type = other RNA
atgaagaagatcctgggcctcgacctggggaccaacagcatcggctgggccttcatcaacgaagccgagaacgagatcgaggtgtcgagcatagtgaacaccggggtgaggatcgtgccccttacgaccgacgaggagtccgacttcaagaagggcaacaccatcagcatcaacgcggaccggaccctcaagcgcggggcccgtcggggcctgcagcgattcaagcagcgccgggaggccctgctcgagacgttcaaccgaatcaagttcatcgcgacggacttcgtctacgccgagaccggcgcggccaccacgttctccagctaccagctgcgggcgaagtccgccgtggaggcggtgaccaaagaggaactggtcaaagtgttgctgatgctgaacaaaaagcgcgggtacaagagctcccggaaggccaagaccgccgaggagggcgacgccatcgacgggatgaagatcgccaaggagatcttcgagaacaaccttaccccgggccagtgggtgtacaacagcctgtccaagggcgggaagttcatccccgacttctaccactctgacctgcagaaggagctcgagaagatcgtccgcttccagaaccaattccactccgagcagatcaacgacaaactgctggcggacatccagggcaagagccggacgcagacctcccagcacttcagcaagaccctcaacatccccttagccgagaacaaggggacccgcgaggaaactaagctgcagcactaccagtggcggaacgaggccctcgccaacgagctggacatgaagatcctcgccttcatcatcaccgagatcaacaaccagatcaaccagtccagcggctacctcggggcgatctccgaccggagcaaggagctgtacttcaaccaggagaccgtaggccagtaccagtacaagcagctgcaggagaacgtacacgccaagctcaagaaccaagtcttctaccggcaggactacctggacgagttcgaaaagatatgggagacccaggccaagttccactcggaactgaatgagaagctcaaggccgagatcagagacatcacgatcttctatcagcgtaagctgaagtcccagaagcacctggtgtcgttctgcgagttcgagaagggccacaaggccatccccaagtccagccctctgttccaggagttccgcatctggcagaacctgaacaacgtggtcgtgaagaacgagaccaccaaggaggtgttcgagctgtccgaggagctcaagcagctgatcgcggaggagttacagttcaaggagagcatgaccgatgtccagatgctcacgttctgcgagctgaagaaggggacccacacagtgaacttcaagaagatagaaggcaaccgcaccaacacgtgcatctacaaggccttcgagaagatcctggaggtggaggggtacgagatggacttctccaagatgaagcccctcgagatcaaggagaccgtcgcccccatcttcgagaccctgaacattaacaccgtgatcctagacttcgaccccagcatccagggcaacgacttcgacaagcagccgtactaccagctctggcacctcctgtactccgctgaggacgacgacaaactcaaggaaacgctgaagaccaagttcgggtttaaggagaaccacctccccttcctgctcaacatcaacctgcaggccgattacggaagcctgtccgctaaagccatcaagaagatcttaccccacctgatggacggccacatctacgacaaggcctgcctgatggtcggttacaaccacagctccagcctcaccaccgcccagaacaacgaccgcgtccttaaggacacgctcgagctcttaaagaagaacagcctgcgcaaccccgttgtcgagaagatcctcaaccagatgatcaacgtgatcaacgcgatcatgaaagacccagccatgggcaagcccgacgaaatccgggtggagctggcccgcgagctgaaggccaacaacgagcagcggaaaaaggccaccagcgacattaacaccgcgaccaccgagcacgagcgaatccggaagctcctacactccgagttcaacattccacgcgtcacgcggaacgacatcatccgctacaagctgtggctcgagaccgggggcatcagcctgtataccgggaaccccatcaagggctccgacctgttcagcaaagactacgacatcgagcacatcatacccaagagccggctgttcgacgactccttcagcaacaaaacgctgtgcgagcgccagctgaacatcgacaagtccaacaagacggcctacagcttcctccaggagaagttgtccgagaacgacttcgccgcctacgagaaccgggtaaaggacctgttcaagaccggcaagattaagagctacaccaagtacaagaagctcctgatggccgacaacgagatcccggaggggttcatcgaccgccagctgcgggagacccagtatatcgcgaagaaggcaaaggagatcctcctggaggtgtcccgcaacgtcacagccaccatcggctcagtgaccgataagctgcgggaggactgggagttagtggacgtcatgaaggagctgaactgggagaagtacgacaagctggggctcacccatatcgaagagggcaaaaacggggagcgcctgtccaagatcaaggactggacgaaacggaacgaccaccgccaccatgccatggacgccattacagtcgcgttcaccaagcccgcctatatccagtacctcaacaatctcaacgccaagacccagggcgagaacaaggccaattcgatcatcggcatcgagaacaagcacctgtaccgggacaagaacaataagctgcgcttcatctcccccatgaagaactttcgcgaggaggctaagaagcagctcgagagcatcctgatctcctacaaggccaaaaacaaggtggtcacgaagaacaagaatactaccaagaaatccggagggaccaatcaaaagatccagctgacgccccggggacgcctccacaaggagaccgtttacggcaagctgcagcagtacgccaccaaggaggagaaggttaacgccagcttcacggaggattacatccagaaggtcgccaagaaggagtaccgggaggcgctgctcaagcgcctggaggaaaacgacaacgaccccaagaaggccttcacgggcaagaacgccctgaacaagacccccatctacatcagcctgaaggacaacatcatcgtgccagagaaggtgaagaccgtctggctggagaccgactacacgatcaggaaggatatcacaccggacctgaagatcgacaaggtgatcgacgtgggtatcaagcgcatcctccagaaccggctgaacgagttcaacggcgaccccaagaaggccttcgtcaacctgggggagtcccccatctggctcaacaaggagaagggcatcgccatcaagcgcgtcaccatcagcggggtgagcaacgcgcaggccctgcacaccaagaaggaccacctgggcaacgagatcctcgacaagaatggcaaccccatcccggtcgacttcatctccacgggaaacaaccaccacgttgctatctaccgggacgagaagggtaacctgcaggaggaggtggtctccttctacgacgccgtgatccgccggaacctggagctctccgtgatcaacaagaaccacgagaaggggtgggagttcctgttcagcatgaagcagaacgagttcttcattttcccctccgacggcttcaacccccacgagatcgacctgctcaacccgaacaactaccatctgatcagccccaacatctttcgcgtgcagaagatctccaccaagaactacatgttcaaccaccacctagaaaccaaggccgtggacggggagatgctcaagagtaaaaaggagctgtccaagaccagctaccacttcatccaaacgcccaccaacctgaatggcatcatcaaggtgcgaatcaaccacctcggcaagatcgtccacctgggggagtactga

SEQ ID NO: 7682 - RNA, 4065 nt, synthetic construct
  misc_feature 1..4065: note = Cas9 variant
  source 1..4065: mol_type = other RNA
atggccgacttcgccaagtaccagcccggcatggtggcggacgggcgtaagatcccgctggactggaccctctactacctacggaaaaaggccctgacccaggccatccgcaaagaggagctcgcctggatcctgctaaatttcaaccagaagcggggctactaccagctccgcggggaggaagaggaggagaacagtacgaagcacgaggagtactatgagctgaaggtagtgtccgtggaggccgccgaggagggcaagggagggaacacgtggtacaacgtcacactggagaacggctggatctaccggcgccagagcaagatcgagctcaacgactgggtggggaaggtgcggcccttcatcgtaaccacggagtacgagatcgacggagtgaccatcaagaaggacaaaaacggggaggtgaagcgctccttccgggcccccagcgagaacgattggggcctgcgcaaaaagaggaccgagtccctgttggaggagagcgggaagacggtcggcgccttcatctacaaccacatcctgtccgagcccgcagacaagatccgcggcaacttcatccggacgatcgagcgcaagttctacaagaaggagctggaagcgatcctccgagaacaaagcaagcaccagaaggagctcaaagacatcgacaccctgatcgcgtgcatcaaggagctctacccgaacaacaagccccaccaggatagtctgatcaagaaggacatgacctacctgctcataaccgacctgatcttttaccagcgccccctcaaaagcaagaagtccctcatcgccgactgcccctacgagtattatgagtacgtgatcaaagagacgggggagaacaagcggcagagcatcaagtgcattgccaagtccaacccgtactaccaggagtttcgcctatggcagtttatcatcaacctgcggctattcgaccgcaataacgacaaagaggtgactagcgagtacctgtccagcatggaggactacacccggctgttcacctacctcaacgacaggaaggatatcaaccaggaaacgctgctgaaggacttctttaagcagaagaaggtcaagcgaggcatggagaaggagttccccatccggtggaactacatcgaggacaaggagaagaagtacccctgcaacgagacgcgccatgagctcctgaccgctctggggaaggtgggcatcgaccactcctggctcgacgacaaggagctgttctaccggctgtggcacctcctgtacagcgtggagtcgaaggaggaggcggagggtgctctgcgcaaattagtcgacaacgacgacttcgtgaacgctttcttgaagatcaagcccttcaagaaggaatacggggcctacagcgagaaggccataaagaagctgctcgcggtgatgcggatgggcaacctgtggaacgaggtcgacatctgcgagcagacccgcgaccggatacagaatatcatcaagggggacatcgatgagaagatcaaggaccgcatgggcagaacgttctcccagctgtcagatttccaggggttaccggagtggctggcctgctacgtggtatacggtcagcacagcgaggccacagacatccagcgctggaccaagcccgagaacctgatggcctatatcaacggcttcaaacaacactcccttcggaacccaattgtcgagcagtgcatcctcgagaccctgaggacggtccacgacatttggaaagaggccgggcacatcgacgagatccacatcgaactgggccgggggatgaagtccaccgcggaccagcgcgcccggatgagcaaaagtatcatgcagaacgagaacaccaatttacgcatcaagagcctgctaatggaattaaagaacgccaaggaatttgagaacgtgcggccctacagcccgatgcagcaggaaatcctgcggatctacgaggagggcgccctgcaggagctcaccaaggaggacgcacagtacaacgagatctccaagatcagccagatggcacagccgtccgccaacgagctgcttaagtaccggctctggctggagcagaagtactgcagcccctacacgggaaagcccatctccctgtcgaagctgttcacctccgcctaccagatcgagcacatcatccctcagagccgctacttcgatgacagtttcaccaacaaggtcatctgcgaggccgaggtgaaccagctcaagagcaatatgctgggctatgaatttatcaagaagcacggcggggagatcgtcaggtgcaccatgatcggggacgtgaagctcctggacgcgaaggagtactacaattttgtgacggagcactacaccaacaaccgtcgcaagaaggagaaactgttgatggaggacatcccccaggagtttctgaatcggcagatgaacgactcccgctacataagcaagaaggttatggccatcctgtcaaacattgtgcgggaagaggacgagcaggaggccaagtccaagttcgtgatcgcatgctcagggggcatcaccgaccgccttaaacaggactggggactgaacgacgtctggaactccatcgtgtacccccggttcgaacgcttaaacaagctcaccaatacagagaacttcgggcggtgggaaaacaagaagggcaagcaggtcttccagacgagcgtgcccctggaactgcagaaggacttctccaagaagcgcatagaccaccggcaccacgccatggacgcgctcgtgatcgcctgcgccagcaacaacatcatcaactacctgaacaacgagtccgccaagagccaggagaagcgcgaggacctgcggaagaagctctgcgacaagaaccgaatcatccgaaagccgtgggaaacctttacccaggacgctcacaccgcgctggagaacgtggtcgtatccttcaagaactacatccgcgtgatcaacaaggcgacgaactattacgagaagtatgacaagaacgggaagaaagagatcgccgagcagaagggccaagacatgtgggccatccggaagcccatgcacaaggagacagtcttcggtcaggtgaacctgcgccggaagatcaccataaagctcaaggacgcactggagaagatccccgcgatctgcgacaaggagctgcgcgactacatcaacatcctcgtggccaagcagttcaacaagaaacagatccttgcccacttcaaaagcataaattaccggctgaatatgaaaagcgtcgacaaagtggacgtctggcagttcagcaacgagaaggaacccatggtcgccacccgcaagtccgtggacacgagtttcgatacaaagcgcatcgcgaccatcaccgacacggggatccagaaaatcctcttgaactacctgaaagcgaaaaacaacgacccgaacatcgcattcacccccgaaggcatcgcggagatgaataagcacatcaccgagtacaacaacgggaagcagcaccagcccatcctcaaagttcgggtctccgaaccgaaaggcgccaagtaccaggtcggcgagaccggcaacaagcgaagcaagttcgtagaggcgcagaaggggacgaacctgtatttcgctatctacgaggacaaggagggcaacaggtcctacaacaccatccccctgaacgaggtcatcgagcgcttgaagcagggcttaagcccagtgcccgacgccaacgagaagtccatccctctgaagttccacctcagccccaacgatctggtgtacgtccctaagacggacgaggagaacgagattaaaatggggcagatctacaagttcgtggacagctccggcaccaccgccaacttcgtaccccaccgtgtgagcaacctgatatacaacgtggacaagaagatcgccgagaatttctgcaaccacgaaataatacagaacgaatacgggatcggctccccacagagtaagaaccagaagtccatcaccggcgagatgatcaaagcggtgtgctggaagctcgaggtcgaccgcctgggcaacatccacaagatcatcaaatga

SEQ ID NO: 7683 - RNA, 4065 nt, synthetic construct
  misc_feature 1..4065: note = Cas9 variant
  source 1..4065: mol_type = other RNA
atgaagaagatcctgggcctcgacctggggaccaccagcatcggctgggccttcatcaaggagcccgagaaggacgtggtcgggtccgaaatcgtggacatgggcgtgcgcatcgtccccctgagctccgacgaggagaacgacttcgccaaggggaacacgattagcatcaacgcggaccggaccctcaagcgcggcgcccggcgcaacctgcagcggtttaagcagcgccggaacgccttgctcgagactttcaaggagaagaacctgatccccagcaacttccagtacgccgaggacggccccagctccaccttcagcacgctgaagctccgcgacaaggccgcgaaggagaagatcgagctggacgacttcgtgaaagtgctgctccagatcaacaagaagcgggggtacaagtccagccgcaaggccatgtccgaggaggacgagggcaccgccatcgacagcatggggatcgccaaggagctgtacgagaacgacctgacccccggtcagtgggtctacgaggcgctcaagaacgggcggaagaacgtgccggacttctaccgctccgacctgcaggaggagttcaagaagatcgtgaactaccagagcgagttctaccccgacatcctgaacacctccttcgtcgaggactggatgggcaaggccagcacgcccacgaagcagtacttcaacaagcggggcgtgcagctcgccgagaacaaggggaagcgcgaagaacggcgcctgcaggagtacaagtggcgggccgaggccgtgaacttcaagatcgacctgtccgagatcgcgctcatcctgagccagatcaactctcagatcagcaacagctccggctatctgggggccatcagcgaccgctccaaggagctctacttcaagaacttaaccgtcggccagtacctgtaccagcaggtcaagaagaacccccacacccggctcaagggccaggtgttctaccgccaggactacctggacgagttcgagaagatttggagcgtgcagtccagcttctacccgcagctgaacgacgagctcaagcaggaggtgcgggatgtgacgatcttcttccaacgcagactgaagtcccaaaagcacctgatcagcaactgcgagttcgaggagcaccacaaggtcgtgcccaagtcccaccccatcttccaggagttccggatctggcagaacctcaacaacctgaccctaatcaagaaggacaacctcaacgagaagtgcgagctggccctggaggacaagaccgccctcgccaacgagttggcgttcaagaaggagctgagcgtgaaggacgccctcaaggtcctaggtctgaagccatccgattgggagttcaacttcacaaagatcgagggaaaccgcacgaaccacgccttcttcgaagccttcgccaagatcatcgagctcgaggacggggagccgatcgacctgggcaacctgaaggcggacgacatcctcgaccagttcagcgaggccttcctgcggatcgggattgacaccgagctgctccaggtgaactccgacatcgagggcgccgagtacgagaagcagagctacatccagttctggcacctcctgtactccagcgaggacgaccagaagctgaagcagaatctcatccgcaagttcggcttcaagcccgaacacgccaagatcctggcctccatcagcctgcaggacgaccacgcgtccctcagcagccgggcaatcaagaagatcctgccccacctccagtccgggctgatctacgacaaggcctgcacctacgccggatacaaccactcttcgagcttcaccaaggacgagaacgagaagcgcgagctgcgggcggagctggagctcctgaagaagaactcccttcgcaaccccgtggtcgagaagatcctcaaccagatgatcaacgtggtcaacgccatcctgaaggacccgaacctggggcggcccgacgagatccgcgtggagatggcccgggagctcaaggccaacgccgagcagcgcaagaacatgacgagcaacatcgcgtctgccacccgggaccacgagaagtaccgcgagattctgaagaaagagttcggactgaagcgggtgaccaagaacgatctcctgcgctacaagctgtggctcgagaccgacgggatcagcctgtatacgggaaagcccatcgaggcctccaagctgttcagcaaggagtacgacatcgagcacatcatccccaaggcccggcttttcgacgactccttcagcaacaagaccatctgcgagcgccagctgaacatcgacaaggccaacgtcaccgcgttctccttcctgcagaacaagctcagcgccgacgagttcgagcagtatcagtcccgcgttaagagcctgtacggcaagctgtccaaggccaagatccagaagctgctgatggccaacgacaagatcccggaggacttcatcgcccgccaactgcaggagacccgctacatcagcaagaaggcgaaggagatcctcttcgagatcacgatgcgggttagcgtgactaccgggaccattacggacaagctgcgcgaggactggggcctggtggagatcatgaaggagctcaactgggagaagtacgacaagctgggcctgacctacaccatcgagggcaagcacggggagcggctcaacaagatcaaagactggaacaagcgcaacgaccaccggcaccacgccatggatgcccttaccgtggccctgacgaagcccgcgtacatccagtacctcaacaacctgaacgccaaggccatcggcaacaagaagggcaccgagatcttcgccatcgagcagaagtacctgaagcgcgagaacgggaagctctgcttcatcccgcccatcgagaacatccgggccgaggcgaagaagcacctgtccaagatcctggtcagctacaaggccaagaacaaggtggttacgatcaacaagaacaagaccaagaagaaggccggcttcaacgagcagaccgccctgacgcccagagggcagctgcacaaggaaaccgtgtacggaaagtccttccactacagcaccaagttcgaaaagatcggtgcctccttcgatgcgcagaagatcaacacggtggccaagaaggaggagcgggaggccctgctcaagcgccttgccgagaacgggaacgaccccaagaaggccttcacgggcaagaactcactgaacaagatgcccatctacctcgacctggggaagaacatcaagctgtccgagaaggtgaagaccgtcgtgctcgagcagaactacaccatccggaagaacatcgaccccgacctgaaagtggacaaggtcatcgacgtgggcatcaagcgcatcctggagagccggctcgaggagttcgggggcaacgcgaagctggccttctccaacctggaggagaacccgatctggctcaacaaggagaagggcatccccatcaagcgcgtgaagatctccggggtctccaacgtggagagcctgcacgtgaagaaggaccacttcggcgagaaaatcctggacgaggaggggaacgagatccctgtcgacttcgtatccaccggcaacaaccaccacgtggccatctacgaagacgaggacgggaacctccaagacgaggtcgtgaacttctacgaggcggtgatccggcgcaaccagggcgagagcatcatcaagtaccggcacgaggagggctggaacttcctgtactccatcaagcagaacgagttcttcgtcttcccgtcacaggacttcaaccccaacgacttcgacctgctcgaccccaagaactacgacctgatctcccccaacctgtaccgcgcgcagaagttcagcaaggtgatgtacgggaactccgccgtgcgggactacgtcttccgccaccacctcgaaacggtgctgaacgacgtgaaggagctgaaggacgtcgcctacaagcagctcaagtctctgcagtacctgaatggcatcaagaaggtgcggctcaaccacctggggcagatcatccaggttggcgagtactga

SEQ ID NO: 7684 - RNA, 4065 nt, synthetic construct
  misc_feature 1..4065: note = Cas9 variant
  source 1..4065: mol_type = other RNA
atgacgctgcattacaacgtgggcctcgacatcgggaccaacagcgtcggctacacgatcgtggacgacaatgggaagatcctccaggtgaagggcaagaacgggtacggcgtccgcgtgttcaaggagggcgccaccgccgcggagcggcgcatcttccgtaccactcaccgccggctgaagcgccggaagtggcgcctccgcctgctgcaggacttcttcgagccctacatcctcccgcaggacgacgggtttttcatccgccggaaggagtccaacctggtgctgaacgaccgcgacgaggacacggccagcctcttcaacgaccggtccgaccgcgacttctaccaggcctaccccaccatctatcacctccggcaggccctgatgacggagaagcgccaattcgatgtccgtgagatctaccttgccatgcaccacatcatcaagtaccgcggccacttcctactgaacggaaccgtaaacaacttcacgaacaacaagatcgacctccacagcgacttcgaggagctgaacgcactgctcttgaacgtgatccccgagttaaagttccaaatcgacctcgaccactccaccatgtttcagaccaccctgttgaacacgaccatcagccggtcgggccgccagcgggacctcgtaaagtctttctacaacgggtccgacgataaacagctggccaagcagcagaagtcggtggccaccgagcttctcaaggccatcctgggcctgaaggcgaagttccacaagttattcaacctggacctgctcgagaccacggaatgggagttcagcttcgacgccgaggacatcgacgacaagctggccaagctggagccccttatgactgagaaccagcagcaggtcatggatatcctgcagcgcatcttcgccgccattaccctgaacggcatcgtgccggaggggaagaccctcagtgcttccaaggtggacagctaccagaagcacaagcaggacctgaagctgctcaaggccatcgcccagcactcggataagaagacggccaccgtgctgcagaccgcctacaacgagtacatcaacggcatcgcgagcaaacctctgaagcaggaagatttctacaagcgcctcacaaacgccgttaagaagtccagcgacccccaggtggccgacatgctggccctgatcgaccaggagaagttcctccccaagcagcggacgaaggagaacggtgccatcccgcaccagctgcaccagctggagctggagcgcatcatcgacaaccagaaggactactacccctggctcgccgagctgaaccccaaccaggcccggcagaaggtggccaaatacaagctgtccgagctcgtcgcgttccgcgtgccctactacgtgggcccgctgatcgagcccgaggtccagcaggccaccagcaatgcgcacttcgcctggatggcccggaaggaggcgggccccatcaccccctggaatttcgaccagaaggttgaccgcaacgtgagcgctgagcggttcataaagagaatgaccacgaaggacacctacctgctcgctgaggacgtgctgccgctgcactccctcttgtaccagcggttcatcgtgctgaacgagctcaacaacgtccgcgtgaacggccagaagctgaccaagaagcagaagcaggccgtgtatcaggacctgttcaaacggcagccccacgtaaccaagaagcagttcaagagctatctcgtgcagacgggagagttcgccgagtccagcaagatcgaggggctggccaacgagacctccttcaactctggcctgaccaccgaaaacgagttgcgcaaaatcttcggggcgcagcttgacgaggcccggtaccaggtggatttcgagcaaatcattgagtgggccacgctgttcgaggacgcaaagatactccggaccaagctggccgagatcacctggctgaccaccgagcagatcgagaagctcgcgggcatccggtaccgcggctggggacggttctcccgcaagctgctggccgggctccgggaccagaacgggcagcagatcatcgacctgctgtgggatacgccgaacaacttcatggtcatcgtgagccaggccgccttctccgaggccataaccaaggagaacgagaagctcatcgaccgccgcggtgcgcaagacgtcatcaccgacctgtacacctcaccccagaacaagaaggccctgcggcaggtcctcgccatcgtggccgacgtgcaaaaggcgatgggcggggtcccgccccagcgcatcttcatcgagttcgcccgggaggacgagaagaacccccgcagaagtgtggagcgcagccggcagctggagaagctgtaccagacgatctccaacgagttcctcatcaacagcgaagtgcgccaggaactgaaggaagccgtcgaccagaaggtgaatttcaaggaccgtctattcctctacttcctgcagggcggggtggacctgtactccggcaagcggatcaatatcgaccagctctcccattacgacatcgaccacatcctgccccagtccttcatcaaagacgacagcctggacaaccgtgtcctcgtgtcccaaaaactgaaccgaagcaagagcgactccgtgcccctgagcgagtttgccaactacaagttcgggcccgccatgcaggcgaagtggctccagctgaaggaggctggtctactctccaagcggaagtatgacaacctgaccctggacccaaccaagctcagcaaattcgcgccgctggggttcgtcaaccgccagctggtggagacccgccaggtgatcaagctcgccgccaacctgctggcctccgaggagacaaaggtggtgaccatcaaggccaacatgacccaccaggtgcggaaggagctcgacttcccgaagaacagaaacgtcaacaactaccaccacgctttcgacgcctacctcaccgcctttgtgggcattttcctgagcaagcgctaccccaagctcaagccctacttcacgtacggtgacttccagaaggggaacaaacttccggacctgaagaatttcaacttcctctacgagttaaagaacaaggaccggtccatcgactcaaacaccggtgagatcatctgggataagcagcgcgacctggcgtacatgaacaagatctacaacttcaagaaggtgaccgtcgtgcacgaggtgctcaccaagtcgggtgccctgtacaaccagacgctgtacaaggccagcgaggacaaggcctccggccggggcaccaagcagctcatcagaaagaaggacaatatgcccaccgagctgtacggtggctacaccgggagcacgtccgccttcatgagcatcgtccgcctgtggaagaaggacaagccctactacaaggtggtgggcatccccacccggatggctgccaagctcgccaaccaggcccagctgctggactacctcaccaagaagttcaccacgcgcaagctggtcaagaagacaggggactacaagaccacggtggagcggttcgagctggtggtgcccaaagtgggcttcaaccagctcgtgatcgacggcgggcagcccttcatgctgggctccgcaacgtaccagtacaacgctcgcgagctgttcattagcaaggaggccgtcaaggctctcaacaagcagctgtctacccacgtggacttggtgcaagtcttcgatgagatcctcgtccaggtgaacaggtggttccccctgtacgacaccaacgggttccgcgagaagctgtcgcacggccgggataggttcatgaagctcaacgacagcttcgaggagaagtccgacacccagatcgacgtgttaaaccgcatcctgatcgggttccacgcaaacgcggcccgcacgaacctcaagatcctgggacttggaaccgacctggggttcatgacacagcaggccggcatccggctcaccgagaaggccatcctggtgcaccagagcccctccgggctgttcgagcgcaaggtggccctccgagacctgaaggggctgcgctga

SEQ ID NO: 7685 - RNA, 4068 nt, synthetic construct; identical to SEQ ID NO: 1885
  misc_feature 1..4068: note = Cas9 variant
  source 1..4068: mol_type = other RNA

SEQ ID NO: 7686 - RNA, 4071 nt, synthetic construct
  misc_feature 1..4071: note = Cas9 variant
  source 1..4071: mol_type = other RNA
atgaagaagttcgaggagtactacatcggcctggacatggggaccggcagcgtggggtgggcagtgaccgattccgcctacaatatcatcaagcgccacgggaaggcgctctgggggatccggctgttcgagagcgccaagacggccgaggagcggcggatcttccgcacttcccgcagacggaccgagcgccggaagaaccgcctgcacctcctgcaggagatcttcgccgaggagatcagcaagaaggacatgggcttctaccagcggatgaaggagtccaagtattggcacgaggacaagaaggacatcaacggcaacatgcccgagctgccttacgccctcttcgcggacgacgggttcaccgacaaggactactataagaagtatcccacgatcttccacctccgctacgccctcgccaccaacaccaccgacaagcccgacattcggctgctatacctggccttgcaccacatcatcaagcaccgcggccacttcctgttcgaggggaagaagctgagcgaggtgaaggagttctccacggcgatagaggccctcgtgcagcaggcggaggagcaggagatcgacctcaagagcctgacccaggaggaggtcctgacccagctggagcacatcatgtccgacgcacagtgcaccaagagcgacaagaagacccaggtgtcgaaactgatcgtgggcacggacaagcagaaacagaagcaggagaaggccatcgcggccctcatcaccgggtgcaccgtcaagttgagcgacatcttcgctgaccccgaactggacaaggaggagatctccaagatctgcttcagcgacaacggctacgaggagaaggaggtggaaatcgagtccgtgctggccgaccggttcctgctgatcgccgcggcgaagggcgtctacgactggacggtgctccacgacatcctgggggacgcccgcttcctgagcgaggccaaggtgaagacctacgagaagcatcgggacgacctccgcaaggtcaagcagctgttgcggatggacaaggaggtgtacgaggccgtgttcggcgtctccgagaagaacgaagcgaactactcagcctacatcgggatggccaagaagaacggaaagaagcagccaatcgagaagaagtgctcccaggaggacttctacaagttcctcaagaagcagctggaccgcctgagcgtggacgagatgggccaggagatcatagacgagctcaaggccgagatggatctggggaccctgttccccaagcagatgatccgggacaacggcgtgatcccctaccagctccacgagaacgagctgaacgccatcctggacaacgcgcagaagttctaccccttcctcctggagaaggaccaggacgggtacaccccggtcgagaagatccagaagatattccgcttccgtatcccctactacgtaggccccctgaacacggcccaccaggacaagggcggacactcctggtccgtgcggaagaaggagggcaagatctacccctggaacttcagtgagatgatcgacgaggaggagtccgctacgaagttcatcgagcgcatgaccaacaagtgcacctaccttatcggggaggacgtcctgccgaaggagagcctgctctacgccaagttcaacgtgctgaacgagttgaacaatttacggatcgacggcgagctcatcgcgcccgagctgaaacaggacatctacaacaacgtgttcaagaagtaccagcgcgtaacggggaagaaggtgaaggactacctgcggatcaacggcgtcatctccaaggagcaggagctcagcgggttcgaccagaacttcaagagcagcctgaaggcctaccacgacttcaagcagatcgtgggtacaggcgtgctgagtgagtccgagcaagaggacatcgtccgcgacatcaccttattcgccgactcccagaagatgctgaagcagcggatccaccgcaagtaccccatgctctcggacaagcagatcgcccagctcgccaacaagaagtacgcggggtggggacggctgtcccgcaccttcctggagaacatcgagtcggtgaacaaggagacgggggaggtgatgaacatcatcaccgccctctgggagaccaacgagaacctgatgaagctgctctccggcaagtacgactacaccaagcagatcgagcagtggaacgcgcggcagatgaagaaaggggagatcgagtaccaggacatcgaggagctgtacgtcagccccgccgtgaagcgcccgatctggcagacgatcaagatcgtgcgggagatcaccaacatcatgggcggcgctcccaagcgcatcttcgtcgaggtggcgcgggagcccggggagaagggcgtgcgcaaggtctcccggcgcaaccaactgctcgacctgtacaaggcctgcaagaaggaggcacccgagctgtacgaccggctcgccaacaaggagagcgacaacgccctgcgctccgacaagctgttcctctactatagccagatggggcgctgcatgtacagcggtgacgcgattgacctggacgagctgttcaccaaccggtacgacatcgaccacatctacccgcagtccaaggtgatggacgacagcatcgacaaccgcgtgctcgtcaagcgggacctgaactccaagaagaccgacacgttccccgtgagcgaggagtaccgcaaggccggcaaggcactgtggtccaccctcctgaagaaggggctgatcagcaaggagaagtacaagcggctcacccgcaccgagcccttcggcgaggacgagctggccgggttcatcgcgcggcaactggtggagacccgccagtccacgaaggccgtagcccacctcctggaggaggcctatcccgacgccgagatcgtgtacgcgaaggcgcgggccgtgagcgagttccgccacaagttcgacatgatcaaggtccgggaagtgaacgacttccaccacgcaaaggacgcctacctgaacatcgtggtcggcaacacctactacgtgaagttcaccaaggacgcggcctggttcgtgcgcaacaacccggggcggacctacaacctcaagaagatgttcgagaacgagacggtcaagcgcggcaacgagaccgcctggatccccggcgacaacgggaccatctgcaccgtgaagaagtggatgcggaagaacaacgtgctgttcacgcgccgtgcctacgaggtcaagggcggactgttcgaccaaaacatcctcaagaagggcaaggggcagatccccatcaagggcggcgccgacgagcgcctgcggtcccgcgacaagtacggggcgtacaacaaggccagcggcgcctacttcatgctggtggagtccgacgggaagaagggcgagcggaagcgcaccatcgagttcgtgcccgtctacctcgccaagagcctggaggagtccgtggagctgcgccggcgctactgcgaggaggagctcgggctggtgaacccggacgtccggctgagcaagatccgcaagaacgcgctcatcgacgtggacgggttcaagatgcacctggtgggccggaccgagaaccgcctgctcctgatcggggccacccagctggtcttgtccgaggacgaccagcagctgatcaagaagatcggcaaatactgcctggaccaccgggagaacaaggacgccgtgctcagcgaaaagtacgagctgacgatggacctgttcgagaagctctacgacatcttcgtgttcaagctggagcagaccgtctacgccgtgaagctgtccaagcaggccaaggacctcaaggaggtgaaggaggagttcctggcgctggacgacgaacagaagtgcctcctgctgatggagatcctccacctgttccagtgtagcccccagctggccaacctcaccaacatcgggggcggcaagagcgccgggtccctgaagatcctgagcgacatcaccaagcaacagtccgtcctcctgatcaaccagagcatcacgggcttttacgagcaggtcatcgacctgaagaccatctga

SEQ ID NO: 7687 - RNA, 4071 nt, synthetic construct; identical to SEQ ID NO: 1887
  misc_feature 1..4071: note = Cas9 variant
  source 1..4071: mol_type = other RNA

SEQ ID NO: 7688 - RNA, 4071 nt, synthetic construct; identical to SEQ ID NO: 1888
  misc_feature 1..4071: note = Cas9 variant
  source 1..4071: mol_type = other RNA

SEQ ID NO: 7689 - RNA, 4071 nt, synthetic construct; identical to SEQ ID NO: 1889
  misc_feature 1..4071: note = Cas9 variant
  source 1..4071: mol_type = other RNA

SEQ ID NO: 7690 - RNA, 4071 nt, synthetic construct; identical to SEQ ID NO: 1890
  misc_feature 1..4071: note = Cas9 variant
  source 1..4071: mol_type = other RNA

SEQ ID NO: 7691 - RNA, 4074 nt, synthetic construct; identical to SEQ ID NO: 1891
  misc_feature 1..4074: note = Cas9 variant
  source 1..4074: mol_type = other RNA

SEQ ID NO: 7692 - RNA, 4074 nt, synthetic construct
  misc_feature 1..4074: note = Cas9 variant
  source 1..4074: mol_type = other RNA
atggccgccaagaactacaacatcgggctggacattggtaccagtagcatcggctgggcgatcgtggacgacaactaccagctcatgcacgccaaggggaagtacggctacggcacccgcatctacagcgagggccagaccgccgccgacagacgaggcttccggaccacccgccggcgactgaaccggcgcaagtggcggctgcgcctcctgcaggacttctttgaaccgtatatcctcccgcaggacgaggcgttcttcattcggcagaagcaatccaacttggtcccccaggacaccaagaagcagtaccccgagagcgtgctgttcgacgacacgtcggacaaggacttctacacggagtaccccaccatctaccacctcaggcaggcgttgatgaccgagaaccggcagttcgacatacgcgaagtgtacctggccatccaccacatcgtcaagtaccgggggcactttctgaataacgcccctgttaagacgttcaagagcggcaacctcgacctggccatcaagttcaacgaactgaacgaggagttcaagagtgtgtaccccgacctcgagctgcaattcaacttagaccagatcgacgaaatcaagaagatcctcctggacagcaccaaatcccgcttcgaccggcaaggggaggcggtcaagctgatctatacagtgagcgaggtgaagaccatcgagaaactccagaacaagatcgtcaagcaattcctgtccggaatcctggggctcaatacgcgattcgacgtgctcaccaataccgagagtgatgactccatgtggaagttcagcctggactccgagagctccgacgacgccctcgacgagatcatcgcccagctggacgaccctgccatccacgtggtcgagctggtcaacgagatccacagctccatcaccctagccggcatcgtgcccgagggccaggggctgagcgagagcatggtcgagaagtacgaggcgcacaaagcgcacctccagctcctgaaagccgtggagaaacttgtggacaagaaggccgccgacaagctcgaagtcgcgtacgaccagtacatcaacggcaaagactccaagcagttcatcaaggaggacttctacaaggccgtgcagtcggagatcaagggcgttgccggcgacgaggtcgccgagatcaaccagttaatagagttagaccagttcatgccgaagcaacggacgaaggaaaacggcgccatcccccaccagctccaccagcacgaactggacgtgatcattgagaaccagtccaagtactacgactggctgggggagaaagtgggcaacgagtacaaactcgacaagctggtcagcttccgcgtgccctactacgtcgggcccctggtggacaccgcgtctaaggagaagaaggacgagactcggttcgcttggatggtgcgcaagaacccggagtctaccgaggccatcacgccatggaactttgaggacatagtcgataaaaatgcctccgccgagaacttcatcaagcgcatgaccaccaaggacaagtacctcctgaacgaggacgtgttacccaagtgcagcttgctgacgcaggacttcgaggtttacaacgagctgaacaacatccgggtcaacggcgagaagttcacggcggagcagaagcaactgatacacgacgagctgttcactaagcacgcctccgtgtcaataaagcagctgaaggacttcctggtgtccgagcttatgtacgtccgcgataacctgaaggtggagggcttggccgacgaaaagaagctcatgagctcgctgagcacccagttcgactaccagaagatcatcccagaccagatcaacgatgtaaagtaccgggaggatatcgagcagatcatcgagtggtccaccatcttcgaggacgccgcgatcttcaagacgaagttgaaagagatcgactggctcaccgacgagcagcgcaacaaactggccaacaagcggtaccgcggctggggcagcctctcaaagcggctcctggcctgcctggtcgacgagaacgggcagcgcatcatcgacatcttgcgggacagctccgacaacttcatgatgatcgtgaaccgaccggagttcaaacaggccatcttcgacgagaacgccaacctgacagagactaacagcaaaaaggacatgttcgagatgatcgacaacttctacacgagcccccagaacaagaaggccattcgccaggtgctgctcgtcgtgcaggacatccagaacgctatgggcggggtggcgccccagaagattttcatcgagttcgcccgggaagacgaagtcaacggccggcgcaccaactcccggtacagccaaatccgcgagatgtattccaaggtgacggacgacgtgatcaacaagaccgtgcgcggtgagctggaagccaacaagggcagcctgaacaaggagaagctgtttctgtacttcctgcagggcgggatcgacctctactccggcaagacgatcaacatcgacaacatcagctcctacgacgtggatcacgtgctgccccagagcttcatcaaggacgactccatcaacaacaaggtcctggttaacgccaaagggaaccgggtgaagaacgacaacgtcccgatggagctgttcggcgccaagatgtaccccacgtggaaacggatggtggacaccgggatcatgtccaaggccaagttcaagaacctgaccctgaaccccgacaacgtggacaagttcaaagccgaaggcttcatcaaccgccagctagtcgagacccgccagatcataaagctggtggcccagatcctgaacgacaagctcggggatgatacgaagatcgtgtctgtaaaggcgaacctcacccacgacatgcgggtgttcttcgacttccccaagaacaggaacgtgaacaactatcaccacgccttcgacgcgtacctgagcgctttcgtcgggacctacctctacaagcgctaccctaaacttcaaccctacttcgtatacggcgagtttaagaagatggacaagctgaagaacatgacctccttcgacttcctccgcgacctgaagcacacggacaaggtggtcgacaaggacaccggggagatcatcgcggacaagctggccgtgatcaccaacatgaacaagatctacgacttcaagaaggttctcgtcacccacgaggtgcacgagaacagcggcgccatgtacgaccagacgctgtaccctgccaagctggacaagtccctcggccgcaagggggcgaagcagctgattcccaagaaggatgacatgccgaccgcgctgtacggcggatatacgggctcaaaggatgcattcatgtccatcgtgcgccttaagaaaaaggacgaggtctactacaaggtgatcgggatccccgtgcggatcgccgacagcgtccaacacggcaaggaggtggacgttgaggccctgacccagtttatcgagacgaagttcaccaaggagaacctcaataagaagaccggcgaaatcacccgcaaggtcgaatggttcgagttagtgctgccgaaggtcttatttgggcaggccgtgttcgacggcgggcagccgttcatgttagggagctccacgtatcctcacaatctgagggagctggtgctcaccaaggacagcgtcaaaaagatagcggggaaggagtccaacaagagctacctggacgcctacgacgagatcatggaagccatgaacaagtatttccccttatacgacaccaacaagttcagggagaaggtgatcgagggccgatccaagttcatcgacctccccgacaaggacgagtacgagaataacaaactggtgcaagtaggaaagagcaccatcatcgaccgcatgtttatcgggctgcacgcgaacgcagcgcggacggacctcaagaacatcggcatcaccacccccttcgggttcatgcagcaggcctccggcatcaagctgaccaaggataccgtggtgctgttccagagctccaccggcctcttcgagcgcaaggtcgccctgaaggacctgtga

SEQ ID NO: 7693 - RNA, 4077 nt, synthetic construct
  misc_feature 1..4077: note = Cas9 variant
  source 1..4077: mol_type = other RNA
atgaaagaaccctacggggtcggcctcgacatcggcacaaacagtgttggatggaccgtagtagacgcgagcggccatgtacgaaaaattaaaggacagacgggcataggggtccgactattcaaggaaggtgccgctgccgcagacagacgcggattccgcacgacccgacggcggcttaaacgcgtaaaatggcgcctccgactcctccgggagtttttcgatcagcccatttctaaagtagatatcaacttcttcgcacgacgcaagtacagtgacgtcagcccccgagacccgaactataacggccttgagaagaccctcttcaacgaccgtagcgatcaagacttctaccacgactacccaaccatctaccacctccgcgaggccctgatgacccaacaccggaagttcgacgtccgtgagatctatctcgccatacatcacatcgtaaagtatcggggcaacttccttcgaaatgacgccgcgacagcctaccgctctggcaccctcgacttacagcagcatttcgaaacgctcaaccacctattctcccaagcggacctagaactcaacttaaacttaacaaccgacgtggctctcctcgactccataaagcaaaccctcgtccgcacagacatctcccgctcggacaggcaaaaactcatcatgccactgctagcagtactaacgggagctaccaccgcagaaaagaaaagacagaaggcggtagtcacagagttcgccaaagccctcgtcggaaacaaaaccaaaatcgacgtactgaccctcacagacatcgacgccactgaagccaaggactgggcattctcgctcgaggaaaaccaagacaagctccccgggatcgaggaccggttcagcgaagtcggtcagcaaatcatagacgaagttatacggctctacgcctcagtaaacttagcccaacttatcccagaaggtaaacggttcagccaaagcatggtggaaaaatataagcgtcatggagaagacctcaaactacttaaggcttacatccgcagccagagcgacgctaaacggggccgcgccatcagggcaacatacgaccaatacattgatggcgtcaaatcgaaacaagtgacacaggaggctttccaaaaagccctcgggaaattcgtagacgctgacgtcgacttaaactcatgggctgcccaaatcaaacaagcaattgacagcgaacaatttatgcccaaactacgaacaaagcaaaacggcgccataccctaccaagtccaacagaacgaactcgaccaaatcatctcaaatcaaaaagaatactacccttggctcggagaagaaaatcccgtcataaaacgcaggggcaagttcccttataagctagacgaactattcggcttccgcgtgccatactacgtaggccccctcattacaaaagaaatgcaagcggcaaccgccaacgccggcttcgcctggatggtccgtaaggcggacggcccaatcactccatggaactttgacgacaaagtggaccgcgtggctagcgccaccgcattcattcaaaggatgcaaaccaccgatacgtacctcataggcgaagaagtactcccagctcgcagcctaatctaccagcgcttcatggtgctcaatgaactaaacaacattcgcgtagacgacggacaactcacgccccgacaaaaacaacgactttacaaccaagtgttcaagaaacacaaacgagttaccgccaaaaacatccaagacaaccttgtcgcagcacgcgagttcccaacagcccccaggatcaccggcctggccgaccccaaagtatttaattcctcactgtctacctatcacgacctcaaacaagtcctcccagaagctatgtcagacgtaaggaaacaagcagacatcgagaaaattatactttggtcaacgatcttcgaagatagtaccatcttcaaacaaaaactcaccgaaattagctggctgaccgccgcacagctaaaacaactggggcaactccgataccggggatggggacaattactccgaaaactcctgactggcctaaaagacgacaataaccgcagcatcatggacggactatgggaaaccaatgccaacttcatgcaactccggagccagccagccatcgaaaaccagatcaaatctgcgaaccaagcaaacctcaccacagcagatctccaagacacaatcaatgaactttacacctcgccccagaacaagaaagccatacgcgaagtaatggtagtcctcgcagacattaaagatgctatgcacggacaaactcccaactggatctttgtagaagcagcaagaggaggaggcgtcgcaggccggcgcacccaatcccgtagcaaacaaatcgtcgccgcataccaaggcacggcccaagctatcgtccgagaccaagtccaacgcgaactaaaggaaaagattaaaaacaaagctaacttcaacacccgcctcgtactctacttccttcaaaacggacgggacctctacaccggagacgccataaacattgaccgtctgagcgagtacgacatcgaccacatattaccccaatcattagttaaagacgactccctagacaaccgggtactaacaaacgcacgcatcaaccgggagaaaaatgacaccttcgcctccgaaaaatttggcaaaaagatgggagccaaatggaaagaaatgcacaggatgggattgatgaccaaacgaaagctagaccacctactcatgcgacccgacgaaataagcaaatacgcaacaggcttcatcaacaggcaactggtcgagactcgccaagtcatcaaactcgtcgaagaactcatcaatgcagagtacccgtccacagcaatagttagcgtgaaagccaacctaacgcaccaattccgccaaacgttcgacttccccaaaatccgcgaagtcaacgattaccaccacgcgttcgacgcagcgttgaccgcattcataggaacctacctgcttaagcggtaccccaagctagaacgcttctttgtctacggtaagttcgcgaaacaaccagtaaacctcacccgcttcaatgtaatccggaaacttgcaaaaacggataccccaattaccgacatcgacacaggcgaagtcctctgggacaaactcacagacataaagtacttcgaaacgctatatgactacaaacgactactcgtcactcgagaagtctccgagaactatggagccatgttcgatcagacccttctaaaagctagcgacaacggcaaacgcctaatacggaagaaacaatccttcgacacagccatttacggcggatacaccgggaaaaccttggcctacatggcaatcgtaaaagtcagcaccaagaaagacgtacaataccaagtcgtcggagtaccgaccaccatggtcacccaaatcgaacaactagaacaacaaggtatgaccaacaaacaagccgtcactaaagtcatcgagcccctaatagccgcaaataacaagaaaatgctaacatacgaagttctgctccccaaagtacgcttcgaacaagtagtacgagatcgcattaaaggccaaactcaccggttcgcactaggcacggacacatactaccacaacatccaagaactatatctacccctaacactccaacgcgctttcctaggtaaacagaatgagagcgaggtccaactaaatcagaacctccttacggtgttcgacgctaccctcgcccaagtaaaccgctactttcccctctacgaaatgaacaaattcaagaaaatcctgaactccgcgcgggaccaaatagaacttctggaggcgaaaaaccagttcgtcaagaacaagctagtactggggaaacagggaatattaactaatatgttcatcggactacacgcaaacgcttcgtatggcgacctcaaagtcctcggggtaaagattgactttgggaaactccaagtccccggaggcataaaactcaccggcgacgccgagatcatctaccagtctcctaccggcctgttcgaacgaaagatcgccttaaaagacctctga

SEQ ID NO: 7694 - RNA, 4077 nt, synthetic construct
  misc_feature 1..4077: note = Cas9 variant
  source 1..4077: mol_type = other RNA
atgaatgagccatacggcgtcggcctggacataggaactaatagcgttggatggacggtagtcgatatgaacggtcgtgtacgaaaagtcaaaggaaaaacagctctgggagccagattgttcaaagaaggagcaactgcagaagacagacgcgggttccgcaccacccggcggcggctgaaaagggtcaagtggcgactaagactcctgagagagttctttgaccaacctataagcaaaatcgaccctaactttttcgccaggagaaaatactctgatatcagcccccgcgacccaaactacaatggactagcaaaaactctgttcaacgaccgaaccgaccaagagttctaccacgactacccaacaatctaccatctgcgggataagctaatgaccagcgacaggaaatttgacatccgcgaaatctacctcgccattcaccacatcgtcaaataccggggtaatttcctccgcacaggcccggcctcgcaatacggctccgcctccctccacctcgcaacctcctttcaaaaactaaacgacctcttcgcccaatcagaagaatcgctgaacttcaaattggtaaccgacgaagcgcaactccaacaaatacagcaaatcctcgtgcggacagacctctcccgctccgaacagcaaaggcaaatatggcccctgatggtagtactaatgggagcgaccgccgctgaaaagaaaagacagaaggacttcgcaaaggaactcgccaacgccctagtaggcctcaaagcaaaactaaacgtcgtgaccctcaccaatgtagataccaccgtggtgaaagactggactttcacactggaagaatcacaggacaaactccccgaaatagaggaacagttatccgaggtcgggcaacaaatcatggacgaagtcatccagctctacgcgagcgttaacctggcacaactcatccccgcaggcaaacgcttctcgcaacacatggtagaaaaatacaaccaccacgagaaaaatctagaattgctaaaggcttacatacactcccaatccgactcgaaacgcggacgcgaaatcagagccacatacgaccggtacatagacggcgtaaagtcaaaacccgtcactcaagaaatgttctacaaagacctcatgaaatacgtcgaagcagacgcaacgtcaaaccacctcgcggcagaaatcaaggatgaaattgacagcgaacagtttatgccaaaactcagaaccaaacaaaacggttcaataccctaccaagttcaacaatacgaactagaccaaatcataagccaccagaaaaagtattatccatggctcggcgaggagaaccccgtggcggaacgacgaggaaaatttccatataaacttgacgagctagtaggcttccgggtcccatattacgtagggccgctaatcacgaaagaagatcaacaggcaaccagcggggctggattcgcctggatggttcgcaaagcggacggacccatcaccccgtggaacttcgaccaaaaggtcgaccggatagcttccgccacagcctttatccagcgcatgcaaaccaccgacacatatctaataggagaagacgtcctgccagcccgatccctcatctaccaaaggttcatggtactcaatgaactcaacaatatgagagtcgaagatcaaaaacttgcccccagacaaaaacaacgcctctacaaccaagtatttaagcagcaccaacacgtctccgtcaaaaacatccagcaaaacctcatggacgcaggagaatacagagaaaccccaaaaataacgggactggctgaccccaaaggtttcaacagctccctaagcacttaccacgacttcaaaaagatcctcccagaagccatcgccgatgagcacaagagagccgacatagaaaagatcattctatggtcaaccaccttcgaggacagtgccatcttcaaacaaaagctcgaggaagtagcctggctcaccgacgcacagcgcaaacaattaagcgggctacgatacagaggttgggggcaattaagccacaaactcctgaccgccttcaaggacgacaatggcagaagcgtcatggacggactctgggagaccagcgacaacttcatgcaactcaggaagcaaccagcaatcgaaacacaaattaaggaggcaaaccaagccaacctaactgacgccgacatacaagacaccatcaacgaattgtacacctcgccacagaacaagaaagccatccgagaggtgatgctcgtgctagacgatatcaaaaatgcgatgcacggacaaacgccatcttggatattcatagaagctgccaggggcgggggcgtagcaggccgcagaacccagagccgctcaaaacaaatcgtcgaagcgtacaagagcactgccaaagaaatagtttccgaaaaggtgcagcacgaactcaacgagaaaatcaaggcaaaagctgacttcaacacccgactcgtactatacttcctacaaaacggcagagacctgtacaccaacgaagccatcaatatagaccgcctatcggaatacgacatagaccacatacttccgcagtcattagtaaaagatgactcacttgacaaccgggtactaacttccgcacgaattaacagagagaagaatgacactttcgcatccgaaaaattcggaagaaaaatgggcgcccaatggagagaacttcatcgcaacgggcttatgacccaacgcaaacttaaacacctcctaatgaggccagacgaaatctccaagcatgccaccgacttcatcaacagacaactcgtggaaacccgacaagtaataaagctcgtagaagaactcatctcctcagaatacccctccgccagtatagtcgcagtaaaagccaaccttacgcaccagttccgccaaaccttcaacttcccaaaactgagagaggtcaatgactaccaccacgcattcgacgcgagcctaacggctttcatcggaatgtacctcctcaagcaatacccgaaactggagcgattcttcgtctatggcaaattcgccaagcaacccatcaacctcacaagattcaacgtcatcagaaagctggcggtcgcagaagaaccaatcgccaatatagagaccggagagatcctatgggacaaaacagcagacatcaaatgtttcgaaaagctatacaactacaaaaggctgctagtcacccacgaagtgagagagaactacggcgcgatgttcgaccagactatcttcaaggcaaccgactcaaggaaacggctaatccaaaagaagaaaggattcgcgaccgaaacatacggcgggtacacaggtcgtaccctagcatacctagcaatagtaaaagtagtaacaaacaaagacacccaatatcaagtagtcggaataccaacaacaatggtaacacaaatccaacagctggaggcaagcggtctgacatccaagcaggccgtcacgaaagccataggggcaatgataaacgagaataataagaaactacaatcgtacgaagtccttttacccaaagtccgattcgagcaagtcgtacgcgacgaagtcaaagggcacatccaccggttcgccctcgggaccgacacctattaccacaacatacaggagctctacctaccgctaacaatccaacgcgcgttcctcggcaaacgcaacgacaccgacgcccagacagaacaaaatctgctaacagtatttgaaaccacgcttgcacaggtaaacagatatttccccctctacgaaatgaacaagtttaaacaaatacttaactcagcacaggagaagttcgccgccctcccaaccaaaaacaaaactgtcaaaaacaaattggttaccgggaaagacggtgtactaaacaacctattcatcggtctacacgccaatgcctcactgggggacctaaaaatcctaggcatgaagaccggattcggcaaactacaggtacccggtgggctgaaactaaccgaccaagccgaaataatataccaaagccccaccggactattcgagcgcaaagtcgcactcaaggatctgtga

SEQ ID NO: 7695 - RNA, 4077 nt, synthetic construct
  misc_feature 1..4077: note = Cas9 variant
  source 1..4077: mol_type = other RNA
atgaacgagccttacggtgtcggtctcgacatcggcaccaatagcgtcgggtggactgtggtagatatgaatggcagggtacggaaagttaaggggaagacggccctcggcgcacgccttttcaaagagggtgcgaccgccgaggacagacgcgggttccgtaccacgcgacgacgcctgaagcgggtgaagtggcgcctcagactgctgcgcgagtttttcgaccagccgatatccaagatcgaccccaactttttcgcccggcgcaaatattcagacatatcccccagggaccctaactacaacggcctcgccaaaacgctgttcaacgacagaactgaccaagagttctaccacgactacccgacaatctaccatctgcgggacaagctcatgacctccgaccgcaaattcgacatacgggaaatatatctggccatccaccatatcgttaagtatcgaggaaattttctgcgcacaggacccgcgtcccaatacggatctgcgtccctccacctggctacgagcttccagaagctgaacgacttattcgcacagtccgaagagagcctaaacttcaaactggtgaccgatgaggcgcagctccagcagatccaacagatcttagtgcgtacagacctgtccaggagcgagcagcagcggcaaatatggcccctcatggtagtgctgatgggcgccacagccgccgagaagaaacgccaaaaggacttcgcgaaggagcttgcgaacgctctcgtaggccttaaagccaagctaaacgtcgtgacactcacaaacgtggatacgacggtagtgaaggactggaccttcaccctggaggagtcccaagacaagctgcccgagatagaggagcaacttagtgaggtggggcagcagatcatggacgaggtcatccagctgtatgcctccgtgaacctggcccagctcataccggcgggcaagcggttcagtcagcacatggtggagaagtacaaccaccacgagaagaacctggagctgctcaaagcctatatccactcccagagcgactccaaacgtgggcgagagatacgcgccacctatgaccgctatatcgacggcgtcaagtcaaagcccgtcactcaggaaatgttctacaaggatctgatgaagtacgtagaggccgacgccaccagcaatcatctggcagccgagatcaaagacgagatcgactcagagcagttcatgcccaaactacggaccaaacaaaatggcagcatcccgtaccaggtccagcagtatgagctagaccagatcatcagccatcagaaaaagtactatccatggctcggagaggagaatcccgtagccgagcggcgcggcaagttcccctacaagctcgacgagttggtcgggttccgtgtgccatactacgtgggcccactgattaccaaggaggatcagcaggccacaagcggtgccggtttcgcgtggatggtaaggaaggcggacggccccatcacgccctggaacttcgaccagaaggtggatcgaatcgcctccgccaccgcgttcatacagcgcatgcagacaacggatacctacctcatcggcgaagacgtgctccccgcccggagcttgatttaccaacgctttatggtcttaaatgaattaaacaacatgcgtgtggaggaccaaaagctcgcaccgcgccagaagcagcggctgtataaccaggtgttcaagcagcaccagcatgtctccgtgaagaacatccagcaaaacctcatggatgccggcgagtatcgcgagacgcccaagatcactgggttagccgatcccaagggcttcaattcatccctatcgacgtaccacgatttcaagaagatcctaccagaagccatcgccgatgagcacaagcgcgccgacatcgagaagattattctgtggtccaccaccttcgaggacagcgccatattcaaacagaagctggaggaggtagcctggctcacagacgcacagagaaagcagctatccgggttacgctacagaggctggggacaattaagccataagctgctgacggcctttaaagacgacaatgggcgatccgtaatggacggcctctgggagacctcggacaacttcatgcagctgcggaaacaaccggccatagagacccagatcaaggaggccaaccaagctaacctgaccgatgcggacatccaggacaccatcaacgagctctacacatctccccagaacaagaaggccattcgcgaggtgatgctggtactagacgacatcaagaacgccatgcacggacagactccatcctggattttcatcgaggccgcccggggagggggcgtagcaggccgccggacccaatcccgttcgaagcaaatagtggaggcatacaaatcgaccgccaaggagattgtctccgaaaaggtgcaacacgaattaaatgagaaaatcaaggccaaggcggacttcaatacgcggctggtcctatacttcctccagaacggaagggacttatataccaacgaagccatcaacatcgatcggctgagcgaatacgacatcgaccatatactcccccaatccctggttaaggatgactccctggacaatcgcgtcctgacatccgcccggatcaaccgcgaaaagaatgacaccttcgccagcgagaagttcggccggaagatgggggcccagtggcgcgagctccaccggaacggactgatgacgcagcgcaagctcaagcacctccttatgcgaccggatgagatcagcaagcacgctaccgatttcattaaccggcagctggtggagaccagacaggtgataaagctggtcgaggagctgatcagctccgagtacccaagcgcttccatagtggccgtgaaggcgaacctcactcaccagttcaggcagacgtttaacttccccaagctacgcgaagtcaacgactatcatcacgcattcgacgcgagcctgaccgctttcatcggcatgtacctcctgaagcagtacccgaagctggagaggttcttcgtgtatgggaagttcgccaagcagcctatcaaccttacccgtttcaacgtgatccggaaactggctgtcgctgaggagccaatcgccaacattgagaccggcgaaatcctgtgggacaagactgccgacatcaagtgcttcgagaagctatataactataagcgcttgctggtgacccacgaggtgagagagaactacggtgccatgttcgaccagaccatctttaaggccacggactccagaaagcggctcattcagaaaaagaaaggcttcgcgacggagacctacggaggatacaccgggcgcaccttagcttacctagccatcgtcaaagtggttacgaataaggacacacagtaccaggtggtagggatcccgaccaccatggtgactcagatccaacagcttgaggcaagtggactgacttccaaacaggccgtcacgaaggctatcggagccatgataaacgaaaacaacaagaagctgcagagctacgaggtgctgctgccgaaggtgcggttcgagcaggtcgtacgcgacgaggtaaagggccacatccaccggtttgctctaggcaccgacacatactatcacaacatccaagagctgtacctgccattaaccatccagcgggcgtttctcggcaagcggaatgacacagatgcccaaaccgagcagaacctgctgaccgtctttgagaccaccctcgcccaagtgaaccgctactttcctttgtacgagatgaacaagttcaagcaaattcttaattcggcgcaggaaaagttcgccgccctccccacaaagaacaaaacagtgaaaaacaaacttgtcacgggaaaagacggggtcctgaacaacctcttcataggtcttcacgccaacgcaagcctgggagacttgaagatcctgggcatgaagatcggctttggcaagctccaggtgcccggcgggctgaaactgaccgatcaggccgaaatcatctatcagagccccaccggcctgttcgagcgaaaggtcgccctaaaggacctatga

SEQ ID NO: 7696 - RNA, 4077 nt, synthetic construct
  misc_feature 1..4077: note = Cas9 variant
  source 1..4077: mol_type = other RNA
atgaaagaaccatacggcgtcggtttggacatcggcacaaacagcgtgggttggaccgtagtcgatgcgtcagggcacgttagaaaaatcaagggtcaaacgggcatcggcgtgagactattcaaagaaggcgctgctgcggctgaccgcagagggttccgcactacgcgaagacgactcaagcgtgttaaatggcgtctacgtctcctgcgagaatttttcgaccagccaatctccaaagtagatatcaacttcttcgcccgccgcaaatacagcgacataagcccccgtgaccccaactacaacgggctggagaaaaccctcttcaatgacagatccgaccaagacttctaccacgactacccaaccatctaccaccttcgggaagcccttatgactcaacaccggaaattcgacgtgcgcgaaatttacctcgccatccaccacatcgttaaatacagaggcaactttttacgtaacgacgccgcaactgcatacaggagcggcacattagatctccaacaacacttcgaaacacttaaccacctattttcccaagcagatctcgaactaaacctcaacctcaccaccgacgtggcgctcctagattctatcaaacaaaccctggtacgcaccgacattagccgctcagacagacagaaattaatcatgcctctcctagcagtcctaacaggtgccaccaccgcggaaaagaaacgacaaaaagccgttgtgaccgagttcgcgaaagcattggtaggtaacaaaaccaagatcgacgtactcactctgaccgacatcgacgccacggaagcaaaagactgggctttctccttggaagaaaaccaagacaaactaccaggaatagaagaccgcttctccgaagtgggccaacagataatcgacgaggtcatccgattgtacgccagcgtgaacttagcccaactcatccccgaaggaaaaaggttctcccaatcaatggtcgagaaatacaaacgccacggcgaagaccttaaattactcaaggcgtacatccggtcacagtcagatgccaaacggggccgcgctatacgcgctacatacgaccagtacatcgatggtgtgaaatcaaaacaagtcacccaagaagcctttcaaaaggcgttaggcaaatttgtggacgcagacgtcgacctcaactcctgggcagctcaaatcaaacaagccatcgacagcgaacagttcatgcccaagctacgaacaaaacaaaacggcgcaatcccctaccaagtacaacaaaacgaactagaccaaataatcaataaccaaaaagaatactacccctggttaggcgaagaaaacccagtaatcaagcggcgagggaaattcccctacaaactcgacgaacttgtcgggttccgagtcccatactacgtcggcccactaatcacgaaggaaatgcaggccgccacagcgaatgctggctttgcctggatggtccgaaaggccgatggcccaatcaccccttggaactttgacgataaggtcgatcgcgtcgcttcagcaacggcgttcatccaacggatgcagacaaccgacacatacctaataggagaagaagtcctgcccgcacgctccctaatataccagcgattcatggtcctgaacgaactgaacaacatcagagtcgacgacggccagctcaccccgcggcagaaacaacgtctatacaaccaagtcttcaagaaacacaagagagtaaccgccaaaaacatacaggacaacctcgttgcagcaggagagttccccaccgcaccccgcataacggggctcgccgacccaaaagttttcaactctagcctctcaacctaccacgacctcaaacaagtccttccagaagcgatgagcgacgtcagaaagcaggccgacatcgagaaaatcatcctgtggtcaacgattttcgaagatagcacaatattcaaacaaaaactaacagagatctcctggctaactgcagctcaactcaaacaactcggccaactacgctaccgtgggtggggacaactctcccgaaaacttctgacaggactcaaggacgacaacaatcggtccataatggatggactctgggaaaccaacgccaacttcatgcaactcagaagccaacctgcaatcgaaaaccaaataaagagcgcaaaccaagccaacctaacaactgccgacctccaggacacaattaacgaactatacacttcgccacagaataaaaaggcaatccgcgaagtgatggtggtactcgcagacattaaggacgccatgcatggtcaaacacctaactggatcttcgtcgaagcagcgcgaggaggtggagtggccggccgacgtacgcaatcacgtagtaaacagatagtcgccgcttaccagggaacagcccaagtaattgtatcagaccaggtacagagagaactcaaggagaaaatcaaaaacaaagcaaactttaatacccgactcgtactatacttcctgcaaaacggacgcgacctatacacgggagacgccataaatatcgaccgcctcagcgaatacgatatcgatcacatcctaccccaatccctagtaaaagacgactccctcgacaaccgggtgctcaccaacgccagaataaaccgcgagaaaaacgacaccttcgcctccgaaaagttcgggaagaaaatgggcgcgaagtggaaagaaatgcacagaatgggcctcatgactaaacgcaaactagaccacctcctcatgcggccagacgaaatctctaagtacgccacgggattcatcaaccgccagctagtggaaactcgacaagtgataaaactcgtagaagaactcattaacgcagaatacccgtccaccgcgatcgtctctgtcaaagcaaatttaacccaccaattccgacagacattcgatttccccaaaatacgtgaagtcaacgattaccaccatgccttcgacgccgccctaacagcattcatcggcacctacctgctcaagcgctaccccaaactagaacgcttcttcgtttatggtaaattcgccaaacaacccgtcaacctcactagatttaacgtgatccgcaaactagcaaaaacagacacacccatcacagacatcgacacaggggaggtgctgtgggacaaactgacagacataaaatacttcgagaccctatacgactataagcgcctcctagtgaccagagaagtcagcgaaaattacggcgccatgttcgaccaaaccctactcaaggccagcgataacggtaaacgcctgatacgaaagaaacaatctttcgacaccgcgatatatggcggctacaccgggaaaaccctcgcctacatggctatagtcaaggtctcaacgaagaaggacgttcagtaccaagtcgtcggcgtccccacaacaatggtcacacaaatagaacaactcgaacagcagggcatgactaacaaacaagcagtcacaaaagtcatagaaccactaatcgccgcaaacaacaagaaaatgcttacatatgaggtactgcttcccaaagtacgattcgagcaagtagtccgggaccggataaaaggacaaacccacagattcgccttaggcacggacacgtattaccacaacatacaagagctgtacctacccctaacactccagcgagcttttctcggaaaacaaaacgaatcggaagtccagctaaaccaaaacctcctcactgtcttcgatgccacactcgcccaagtcaaccggtacttcccactgtacgaaatgaacaaattcaagaaaatactcaacagtgcaagagaccaaatcgagctcctagaagccaaaaaccaattcgtcaagaacaaactcgtactcggcaaacaaggcatcttgaccaatatgttcataggcctgcacgccaacgccagctttggcgacctcaaaagccttggtgttaaaacctctttcggacaactccaagtccccggcggcataaaactaacgggcgacgcagaaataatctaccaatcaccaacgggactcttcgagcgaaaaatagctctaaaggacctctga

SEQ ID NO: 7697 - RNA, 4077 nt, synthetic construct; identical to SEQ ID NO: 1897
  misc_feature 1..4077: note = Cas9 variant
  source 1..4077: mol_type = other RNA

SEQ ID NO: 7698 - RNA, 4077 nt, synthetic construct; identical to SEQ ID NO: 1898
  misc_feature 1..4077: note = Cas9 variant
  source 1..4077: mol_type = other RNA

SEQ ID NO: 7699 - RNA, 4083 nt, synthetic construct
  misc_feature 1..4083: note = Cas9 variant
  source 1..4083: mol_type = other RNA
atgaccaagctgggcaagccctacgggatcggcgtggacatcggaagcaactccatcggcttcgccgccgtcgacgaaaacagccacctcatccggctgaagggtaagaccgtgatcggcgcgcggctgttcgaggagggcaaggccgccgccgaccgccgggcttcccgcacgacccggcgcagactcagccgcaaccgatggcgactgtccttcctgcgggacttcttcgagagccacatcaccccgaccgaccccaacttcttcatgcgccagaagtactccgagatcagccccaaggacaaggcgcggtacaagtacgagaagcgcctctttaacgaccggacggacgccgagttctaccagcagtatcccaccatgtatcacctccgcacccggctgctgaccgacccgtccaaggccgacgtgcgcgagatctacttcgccatccaccacatcctcaagagccgggggcacttcctgacgtccggctacgcgaaggatttcaacaccaacaaggtcgccctgaacgagatcttccccgccctgcaggacgcctacgcccaggtgtaccccgacctggacatcaccttcgacgagaacaaggtgaacgagttcaaaaccgtcctcctggacgagaaggcgacgcccagcgacacccagcgcgccctggtgaacctcctgctggccgaggacggggataaggacatcctcaagcaacagaagcaggtcctgaccgagttcgccaaggccgtggtgggcctgaagaccaagctcaacgtggcgctggggacggaggtcgactccagcgaggccaccgcctggaacttctcccttggccagctcgacgacaaatgggccggcatcgagagcgccatgaccgacgagggaaccgagatcctcgaccagatccgggacctgtaccgcgcgcgcctcttaaacggcatcgtgccggccgggaaaacgctgtcccaggctaaggtggacgactacgagcagcaccacgaggacctcgagctgtttaaggactacctgaagcagctcgaggacgacggcatggccaaggccatccggcagttgtacgaccgctacatcgacggcgacgacgcgaagcccttcgtccgggaggacttcgtgaaggcgctgaccaaggaggtgaccgcacaccccaacgccaagagccccgagctcttagagcgcctggtccagccggacttcatgctcaagcagcggaacaaggcgaacggggccatccccgtgcagatgcagcagcgcgagctggaccagatcatcaagaaccagtccgtgtactatgactggctggccgcccccaacccagtcgagaagcaccggcagagcatgccttaccagttcgacgagctcctgaacttccgcatcccctactacgtgggccccctggtgaccgccaaggagcagaaggcggcccaaggcggggtcttcgcctggatggtgcggaaggaccccgacggcaacatcacgccgtacaacttcgacgagaaggtcgaccgcgaggccagcgccaacaccttcatccagcggatgaagaccaccgacacgtacctcatcggcgaggacgtgctgcccaagcagtcactgctgtaccagagctacgaggtgctcaacgagctgaacaacgtccgcgtgaacgacaacaagctgtctttcgatcagaagcagcaggtcctaggcgagctgttcgaacggcacaacaccgtgaccatcaagcagttcgtggacaacctgctcgcgcacggggactacgaccgcatccccgaagtgcggggcctggccgacgagaagcgcttcctgagttccctcagcacctacaaccagctgaaggggatcctgcacgaggccatcgacgactccgacaagcagacggacatcgagaagatcatcgcctggagcaccatcttcgaggacaaggccatcttcaagaccaagctcaacgagatctcctggctgaacgcgggcatgatcaacagcctggccaacatccggtaccgcgggtggggccagttctcccacaaactcctgaacgagctgaccctcagcacgggccggaccgtcttcgaggaactgctgatctccagccacaacctcatgcagatcctgaccgacgaggtgctgaagcaaaagatcgccgagctcaacgcccacgagctgaaggcgtccgggatctatgccgctatcgacgacgcctacaccagcccctccaacaagaaggccctgcgccaggtgctctccgtcatcgacgacatcaccaacgccgccgggcaggccccgaactggctgtacatcgagacggccgacggggacggcgtgcccgggaagcgcaccaactcccggcaacgcaaaatccaggagatctacgtgaacgccgcgcaggagctgatcaccggcagcgtccggggcgagcttgaggacaagatcgcgagccgcgccgacttcaccgaccggctggtcctgtacttcatgcagggcgggcgcgacatctacacgggggagcccctcaacatcgacaacctgtccagctacgacatcgaccacatacttccccagtccctcatcaaggacaacagcctggacaaccgggtgctggtccacccgctcgtgaatcgcgagaaggataccatcttcgcctccacccggttcgccaagcagatgaacggcatgtggcgccagtggcacgcggccggcctgatcagctcccggaagctgcgcaacctccagatgcggcccgacgagatcgacaagtacgccagcgggttcgtggcccgccagctggtcgagacccggcagatcataaagctgacggagcagatcgttgcggaccagtaccccgacgctaagatcatcgccgtgaaggccggcctctccagccagctgcgcaaggagctggacttcccgaagaaccgggaggtcaaccactaccaccacgcgttcgacgcgttcctcgccgcccgcatcgggacctacctgctgaagcggtaccccaacctcgagcccttcttcacctacggcaagttcaagaagaccgaggtgaagaagctgaagtccttcaacttcatccgcgacatgacgcacgccaaggacaagatcgtcgctaaggagaccggggagatcgtctgggacaacgcgagcgacatcaacgagttagacaggatctacaacttcaagcgcatgctcatcacccacgaggtgcgcttcgagaccgcctccctgttcaaacagacgctgtacgccgccaagaacagcaagaaccggggcggctcccgccagctcatccccaagaagaaggggtatctggtggatatctacggagggtacacccaggagaccggcagctacctgtccgtcgtgcggctcaccaagaaggcaatgtacgccgtggttaaggtgagtacgcgcgacgccgccaagctggccgtggccaagagcatctctgagcagaaggagaacgagacactgaagaagatcatcgacgggaagctcagtaagacctccaagaagggcaagaccacgcaccagctgttcgagatcgtcctgccgcgggtgggccagaagaccctcttcaagaacagcaaatacaaccagttcctggtgaactccgacacctacatgcacaattaccaggagctttggatgccccgagagtaccagcggatgtggaaggacatcctcctgagcaaccacggggacgcgcagctggagggccagctcgaccaaatcttcaagttcatcgtctcccaggtgaacagctacttcaacctgtacgacatcaaccaattccgcaagaagatcgccgacgccaccgacaagttcgccaagctgcccacgcacgacaccgacaacgcgcgggggaagatcgccaccatcggccagctcctgatcgggctgcaggccaacgctatgcgctccgacctccggaacctggacatcaagacccccttcggcctgctccagatcggcacggggattaccctggacctggacaccagcatcatctatcagtccccaaccggcctcttcgagcgcgaggtgcccctgacggacctgtga

SEQ ID NO: 7700 - RNA, 4083 nt, synthetic construct
  misc_feature 1..4083: note = Cas9 variant
  source 1..4083: mol_type = other RNA
atgaccaagctgaaccagccctacggcatcgggctcgacatcggcagctccagcatcggattcgccgtagtcgacgccaacagtcacctcctgcgcctcaagggcgagaccgcgatcggggcccggctgttccgcgagggcgaaagcgccgccggccggcgtgcctcccggacgacccgccggaggctgagccacaaccggtggcgcctccggttcctgcaggacttcttcgatccgcacatctccagcatcgaccccgacttcttcctgcgccagaagtactctgagattagccctaaggacaaggaacggtttaagtatgagaagcgcctctttaatgaccggaccgacgcgcagttctacaagcagtaccccaccatgtatcacctccgcctgcacctcatgaacgacgcctccaaggccgacccgcgggagatattcttcgccatccaccacatcctcaagagccgcgggcacttcctgacgcccggtgacgcgaagaatttcaacacggacgacgtggacctcaagcacatcttcccagcactgaccgaggcctacgcccaggcctaccccgacctgaccctctccttcgagccaagcaaggcggagaagttcaagtccatcctgctcgacgaggacgccacgagcaacgacacccagaaggccctcgtaaagctactgctctccgacgatggcgacaaggaggtcctaaagcagcagaagaaagttctgacagagttcgccaaggccgtggcgggccttaaggtcaagttcaacgtggcactggggatagaggtgaccgacgctgacgtcgagaagtggcatttcggcatggcccagcttgaggacaaatggagcgacatcgaaccctccctcacggaccagggcatggaaatcttcgagcaaatccaagacctgtaccgggctcgcctgctcaacgggatcgtgcccgcgggaaaaactctgagccaggccaaggtggacgactacgaccagcactgcaaggacctgaagctgtttaaagagtacctcaagcagttgaacgaccatgacctcgcgaagcggatccgcctgctgtacgaccgctacatcgacggggacgacgccaagcccttcctccgggatgactttgtcaaggccctgaagaaggaggtgacagcgcacccgaccgagctggccgagtccctcctggagcgcatggagcaagacaactttatgttgaagcaacggacaaaggccaacggctccattcccgtgcaaatgcagcagcgcgaacttgataagatcatcgccaaccaggcggagtactactcgtggctggccgccgagaaccccgtcaaggagcaccgggactccaaaccgtaccagctggacgagctgctcaactttcgcatcccgtactacgtgggccccatgatcaccaagaagcagcaggagaagtccgggcagaacgtgttcgcctggatggtccgaaaggaccccagtggcaacatcaccccctacaacttcgacgaaaaggtagaccgcgaggccagcgcgaacgccttcatccaacggatgaagacaacggacacctacctgatcggggaggacgtgctgccgaaacagagtctcctctatcagaagtacgaggtcctgaacgagctcaacaacgtgcgagtgaacggtgagagcctgtccaccgaccagaaaaagcggctgatccgcgaactcttcgagcggcacagcagcgtcaccctgaagcagttcgtggagaatttggtagctcacggggacgtggccaaacgccccgatgtgcggggcctcgccgacgagaagcgctttctaagctccctgagcacgtaccaccagcttcggggcatcctgcacgacgcgatagacgaccgcgggaaacagtccgacatcgagaacatcatcacctggagcacggtcttcgaggacgcctccatcttcaagagcaagctgggcgaaatctcctggctcgacagcaagacccggaccaccctgagcaacatccgctaccgcgggtggggccagttctcccgaaagctgctcgacgggctgaaactgggcaatggccacaccatcatccaggagctcatgctgagctcgcgaaacctcatgcagatcctcaccgacgagacgctgaagaaggagatggccaccctgaatcaagagcggctcaagcccgacagcatcaacgaggccatcgacgccgcgtacacctcccccagcaacaaaaaggccatccgccaggtgttaaaggtggtcgatgacatcaagcacgcagcgaacgaccaggcgccgtcatggctgtacatcgagaccgccgacgggggcgggcatccgggcaagcgaacgctcagcaggcagaagcagatccaggccatctacgagaataccgcgaaggagctgatcgattccgccgtgcgtggggagctgaaggacaagatcgcggacaagaccaacttcagcgaccggctcgttctatacttcatgcagggcggccacgatatctataccgggaccgccctgaacatcgaccagctctcaagctacgacatcgaccacatcctgccccagtccctgatcaaggacgatagtctcgacaaccgggtcctagtgcatgccaagatcaatcgcgagaaaaacgccgagttcgcctccacgctattcgcggccaagatggccagcacctggcaccggtggcgcgacgccggcctcatctccgggcgcaagctgaagaacctgctcatgcgccccgacgaggtggacaagtatgcgaagggatttgtcgcgcggcagcttgtcgagacccgccaaatcatcaagctgaccgagcagatcgtggctgcacagtaccccgacacgaagatcatcgccgtcaaagcgggcctcagccaccagctgcggcaggagctggacttccccaaaaacagagacgtgaaccactaccaccacgcattcgacgcattcctcgccgcccggatcgggacatacctgctgaagcgctatcccaacctcgcgcccttcttcacctacggcgagttcaccaagacgaatctgaagaagctgcagagcttcaacttcattggggccctcacccataccgacgggaagatcacctccaaagatacgggggaggtgctgtgggacaaccagcgggacatcgaggaactggaccagatctacaactttaagcgcatgctcatcacccacgaggtctacttcgagaccgcgggcctgttcaagcagaccgtgtacgccgccaaagacagcaaagagcgcggtggtagtcggcagctgatccccaagaaaaagggctacagcacggggatctatggcggttacacccaggagactggctcctacaacgcgctcgtgcgcctgaccaaggccggcaaggtcgtgtaccgggtgttcaagatcagcacgcagaacgccgctgagatcgccgctgcccgctccctcagcgccgaggaggggaacgagcggctctgccagatcctggagcagagcctactcaagaccaataaggacaagaagaacaccgtcgacctgttcgatgtcgtgatcccccgcttaggcaaggaggccctcttccacaactctaagtacggtctttttctggtcaactccgacacatactaccacaactaccaggagctctggctgagccgggagaaccagaagatcctgaagaagctgttctctacgaagtacgaccagagcgagatggaccgcgatgccctgcatctgttcgagaccatagcgaagcaggttgagcagttcttcaagctctacgacattaaccaattcaggacaaagatttcaagcgccttcgacgctttcgagaagttacccgtggagggggaggaggggaaggtcgagaccctgaagcagctcctgattggcctgcacgccaatcccgtgcgctccgacctcaagaacctaggcatcaagacgcccttcgggttcctgcaggcgggaaagggaatccatctcgacgacgacaccgagatcatccagcaaagccccgccggcctgtttaagaggcgcgtgcggctggccgacctgtga

SEQ ID NO: 7701 - RNA, 4086 nt, synthetic construct
  misc_feature 1..4086: note = Cas9 variant
  source 1..4086: mol_type = other RNA
atgaccaaactcggcaagccctacggtatcggtgtagacattggaagcaactcaataggcttcgccgccgtagacgaaaattcgcacctcataagactaaaaggcaaaaccgtaataggggcccggctgttcgaggagggaaaagccgccgccgacagacgagcgagtagaaccacaagacgccgcctctcccgcaatcgatggcgcctcagcttcctaagagacttcttcgaaagccacattacacccacaggccccaacttctttatgagacaaaaatacagcgaaataagcccaaaggacaaggcccggtacaaatacgaaaaacgtctatttaacgaccgcactgacgcggagttctaccaacaatacccaaccatgtaccacctccggaaccgcctgctaaccgacccctccaaggcagacgtccgggagatctacttcgcaatacaccacatacttaaatcaagaggtcactttctaacgtccggatacgcgaaagactttaacactaacaaagtagccctgaacgaaatcttccccgccttacaggacgcgtacgcacaagtatacccagacctagacataaccttcgatgaaaacaaggtcaacgaatttaagacagtactgctaaacgaaaaagcgacgccctcagacacccaacgagccctggtcaacctactgctcgccgaagacggggacaaagacatacttaaacagcaaaagcaagtgctaacagagttcgcgaaggccgtagtcggccttaaaaccaaactcaacgtagcgttggggacagaagtggactcctctgaagcaaccgtgtggaacttttcactcggacaactcgacgacaagtgggccgggattgaaagcgccatgactgacgaaggcacagaaatcctagaccaaataagggacctataccgcgcccgcctcttaaacggcattgtccccgccggcaaaaccctctcccaggccaaggtcgatgactacgcccaacatcatgaggacctagaactattcaaggactatctcaaacaactagaagacgatggcaccgcgaaagcgatcagacagctgtacgaccgctacatagacggcgacgacgcaaagcccttcgtcagagaagactttgtcaaagccctaaccaaggaagtaaccgcacaccccaatgccaagtccccagaactcctggaacggctcgcccaaccagattttatgctcaaacagagaaataaagcaaacggagccatccccgtccagatgcaacaaagagaactggaccagatcatcaaaaaccaatccgtatactacgactggctcgcggccccaaatcccgtcgaaaaacataggaagtccatgccctatcagctggacgaactactcaacttccggataccgtattacgtaggaccactcgtaacggctaaagaacagaaagcagcccagggcggagtttttgcctggatggtacgaaaagaccccgacggcaacatcaccccttacaacttcgacgaaaaggtagaccgggaggcatcagcaaacaccttcatccagcgcatgaagacaaccgacacctacctcataggggaagacgtcctcccaaagcaatccctcctctaccagcgctacgaagttctaaacgaactaaacaacgtacgagtgaacaacgaaaagctctcaattgaacagaaacaacaagtaataagagaactctttgaacggcacaattccgtcacgatcaaacaattcgccgagaacctaagggcccacggcgactacgcgcacatacctgaaatcaggggactcgccgacgagaagagattcctatctagcctctcaacatacaggcaactaaaaagtctcctaccggacgcaatcgacgaccccgccaaacaggccgacatagagaacatcattgcatggtccacagtatttgaagacgcggcgatcttcaagacaaaactaaaagaaatcaactggctcgattcgcaaaccatcacaaaactcagcaacatccgctatcgaggatggggccagttctcacacaaattcctcaatggccttacgctcggcaacggccacacaatcatacaggaactatttctaagcaacaacaacctaatgcaaatcctaacagacgagacccttcaaaagaaaatgacagaactgaacgcagacaaactcaaagctgcaaacataaacgacgcaatagatgatgcctacacaagcccctcgaacaagaaagcgctacggcaggtcctacgagtcatagaggacatcaagcgagccgcggatggccaagacccttcttggctctacgtagaaaccgcagacggaggcggaaccccaggcaaacgcacccgtgcgagacagcatcagttacaagaaatatacgcgaacgcagcccacgagctgatcgacagcgcagtccggggcgaactagaggacaagatcgccgacaaagccgacttcaacgacagacttgtgctatactttatgcaaggaggacgagacatctacaccggcaccccactaaatatagaccaactcagttcttacgacatcgaccacatactcccccaatccctcataaaagacaactcactcgacaatcgagtattagtccacgcaatcataaacagggaaaagaatgccacgttcgccagtacaatatacgcgcagaagatgaacgcaacgtggcgccaatggcatgaagccgggctcataagcggaaggaaactacgaaaccttcaaatgcgacctgaccagatcgacaagtacgcctccggcttcgtggcccggcagctggttgagacgcggcagataataaagttaaccgaacagatcgtagcagcacagtaccccgaaacaaaaatcatcgccgtcaaagcagggctatcacaccaactacgagaagaactagagttccccaaaaaccgggacgtaaaccactatcaccatgccttcgacgccttccttgccgctcgtataggaacctacctcctgaaacgttttcccaaccttcaggccttcttcacatacggcaaattcaagaaagcggacgtaaagaaactgagaggcttcaacttcatacgagacatcacccatgccgaagacaaaatcgtagtaaaggataccggagaagtcatctgggacaaaaagagagacgtggacgaactagacaggatctataacttcaaacgcatgctaatcacacacgaagtacacttcgaaaaagccgacctgttcaaacagacggtgtatggcgccaaagactcaaaagaggccgggggcaagaaacagctaatctctaagaagaaaggatatcccgtcgatatatatgggggctacactcaggagacaggcagttatctcagcgtagttagactcaccaagaaagcaatgtatgcggtagtaaaagtgtccaccagagacgcagcgaaactggcagtagccaaatctataagcgaacaaaaagagaacgaaacattaaacgacataatcgacgagaaactctccaaaatctccaaaaacgggaaaataacccacgaactcttcgaagttgtcctaccccgcgtcggccagaaaactctattcaagaactcgaagtacaacctatttttagtaaactcagatacatacatgcacaactaccaagaattatggatgccccgcgaatatcaaaagatgtggaaagacatctcactgtcaaagtatggcgacgcccaaactgaagatcaactcgaccaaatatttggcttcatcgtttcccaggtaaactcctacttcaacctctatgacataaaccaattccgcaagaaactaaacgacgcagccgacaaatttgcaaccctccccatgcgagataccgacgacatgcaaggcaaaatcgcgactatcggccaactcctgatcggtctccaagcgaatgccgcccgaagtgacctacgcaacctcgatatcaaaacacccctcgggcttcttcagatacccaacggcatctcgctagatagcgacacctccgtagtctaccaaagccccaccggactgctagaacgggaagtacatctcagcgacctatga

SEQ ID NO: 7702 - RNA, 4086 nt, synthetic construct; identical to SEQ ID NO: 1902
  misc_feature 1..4086: note = Cas9 variant
  source 1..4086: mol_type = other RNA

SEQ ID NO: 7703 - RNA, 4086 nt, synthetic construct; identical to SEQ ID NO: 1903
  misc_feature 1..4086: note = Cas9 variant
  source 1..4086: mol_type = other RNA

SEQ ID NO: 7704 - RNA, 4086 nt, synthetic construct
  misc_feature 1..4086: note = Cas9 variant
  source 1..4086: mol_type = other RNA
atgacgaaacttaaccaaccatacggcataggactcgacatcggctcaaacagtataggtttcgcagtcgtcgacgcgaacagtcacctactccggctcaagggagaaacggccatcggcgcccgcctattcagggagggacaatccgccgccgaacgccgcgaaagcagaacgaccagacgccgcctatcacgaacgcgctggcgactctcatttcttcgcgacttcttcgcaccccacatcaccaaaatcgacccggactttttcctaagacaaaaatacagcgaaataagtccgaaggacaaagaccgcttcaaatacgaaaagagactgttcaatgaccgaaccgacgctgaattttacgaagactacccttcaatgtaccacctcaggctgcacctcatgacccacacgcacaaagccgacccgcgcgaaatatttctagccatacaccacatactgaaatcacgtggccacttcctcaccccgggtgcagcaaaagacttcaacaccgacaaagtagacctcgaagacatcttcccggccctcaccgaggcttatgcccaagtctacccggacctcgagctcacatttgacctcgctaaggccgacgatttcaaagccaaactgctggacgaacaggccacaccctcagacacccaaaaagccctcgtcaaccttctgctatcaagtgatggcgaaaaggaaattgtcaagaaaagaaaacaggtactcaccgagttcgccaaagcaataaccgggctaaaaacaaagttcaacctagccttaggcacagaagtcgacgaagccgacgcatcaaactggcagttctccatgggacaacttgacgataaatggagcaacatcgaaacatcgatgacagatcagggaacagagatcttcgaacaaatccaagagctctaccgcgcacgtctgctcaacggcattgttcccgcagggatgagcctttcacaagcaaaggtcgccgactacggccaacacaaagaagacttagaactcttcaagacctacctcaagaagctgaacgaccacgaactggctaaaaccattcgcggcctttatgacagatatatcaacggggacgacgcaaaaccattcctccgcgaggattttgtcaaagccctcacaaaggaggtgactgcacatcccaacgaagtcagcgaacaactacttaaccgcatgggacaagccaatttcatgctcaaacaacggaccaaagcaaacggtgccataccagtccaactccaacaacgcgaactcgaccagataatcgccaatcaatcgaaatactacgactggctagcaaaacccaacccggtggagaaacaccgagcgagcaaaccctaccaacttgacgaactacttacgttccgaataccatactacgtcggccccctcataacaccgaaagaacaagccgagtcgcgggaaaacgtgtttgcctggatgatccgaaaggacccttcggggaacattaccccctacaattttgacgaaaaagtggactgccccgcttcggcaaacatgttcatacaacggatgaaaaacactgacacatatctcatcggggaggacgtcctcccaaaacgctcactactctaccaaaaatatgaagtacttaacgaactcaacaacgtgtccatcgatggccgacgcctaggagccgatcagaaacaacgactgatcagagaggtcttcgagcgacactcatcggtaaccataaagcaagtagccgaaaatttagtagctcatggcgacttcgcgaaacggccggaaatccgaggcctcgccgacgagaaaagattcctaagttccttatcaacctatcaccagctcaagaaaatcctccacgaagctatcgacgacccaaccaaagaacacgacatagagaatataataacctggtcaaccgtattcgaagacgcagccatatttaagaccgagctggctaaaatcagctggctcgactctgacacgataaaggcactgagtaacatcaggtaccggggttggggccaattttcacgaaaattactagacgggctaaagttaggaaacggacataccgttatccaagaactgatgctctcaaaccacaacctgatgcagatactcaccgacgaaaccctaaaaaccacaatggcagagctcaaccaagacaaactgaaggctgacgacattgaggatgtcataaacgacgcctacacctcacccagcaataaaaaggccctacgtcaagtcctacgagttgtcgaggacatcaaacacgccgccaatgggcaggacccatcatggctatacatcgaaacagcagatggtcccggaactgcgggcaagcgcacgcaatcacgacaaaaacaaatccagaccgtatacgccaacgcggctcaagaactcatagactccgcggtacgcggagagctcgaagacaagatcgcagacaaggccagcttcacagaccgcctcgtgttatacttcatgcaagggggacgcgacatctacaccggagctccactaaacatcgaccagctatcccattacgacatagaccacattctaccccaaagcctcataaaagacgattccctggacaacagggtactggtaaacgccaccataaatagagagaaaaacaacgtcttcgcatcaaccctattcgcctctaagatggccgcaacgtggcgaaaatggcacgaagccggactaatctcaggccgaaaacttaggaacctcatgctgcgtcccgacgaaatcgacaaattcgcccatggcttcgtcgcccggcaactcgtagaaacccgacaaatcatcaaactaaccgaacaaatcgcagcagctcaatacccgaacaccaagataatcgcagtaaaagcaggcttgtcacaccagctacgtgaggaactcgacttcccaaagaacagggacgtcaatcactaccaccacgcattcgacgcattcctagctgcgcgaatcggcacctacctcctcaagcgataccccaagctcgcccccttcttcacctacggagaatttgccaaggtcgacgtcaaaaagttcagagagttcaacttcatcggagcactcacccacgccaaaaagaacatcgtagccaaagacactggagaaattgtgtgggacaaagaacgcgacatacaagagctcgatcgcatatacaatttcaaacgaatgcttataacgcacgaagtttatttcgagacggccgacttattcaagcaaaccatttacgcggcaaaagactcgaaggaaagagggggatcgaaacagctcatcccaaagaaacaaggatatccaacccaggtgtacggcggatacacaagagaaaacaccgcgtatctagccgtagtgaaaacagtcgaaaagaaagcagacgtataccgggtggtacgtatagcaactagccaagtcgcagccctcaaggaagcacgtgcccagtccacggtaaaagaacgcgaactcctcaagaagtttctcaccaccaaattcacgaaaattggtaaaaacggcaagaaagccataacaccctttgacatcgttataccccgagtgccccgagaacagctgttccacaacaaacgatacggtttcttcatggtcaactccgacaccctaatgcataactaccaagagctatggatgtcccgctctgaccaacaaattctctctaaactcgttaaatcggccaaaacggtcgagaatggccaagtcggccgcctcttcgaaaatattgtcgagcaaatcaacaagtacttccccctatatgacatcaaccagttccggaaaaagctcgaccagtccaaggacatcttctctaaactacccctagaaggaaacggaactacctcagggaaacgcgaaaccatccaaaacatactcaccggcgccggaaccggcgccaaaaacggtgacctcaaaaacttaggcataaaaaccccattcggcttcctccaagtgccgagcggcatagtactggacgacgacaccacactgatataccaatccccaacaggaatgctcaaccggatagtgcgactatccgaactgtga

SEQ ID NO: 7705 - RNA, 4086 nt, synthetic construct; identical to SEQ ID NO: 1905
  misc_feature 1..4086: note = Cas9 variant
  source 1..4086: mol_type = other RNA

SEQ ID NO: 7706 - RNA, 4086 nt, synthetic construct
  misc_feature 1..4086: note = Cas9 variant
  source 1..4086: mol_type = other RNA
atgaacgagccgtacggagtcgggctggacatcggcactaacagcgtcgggtggactgtggtggacatgaacggccgcgtccggaaagttaaggggaagacggccctcggcgctcgcctgttcaaggagggcgcaaccgccgaggaccggcgcgggttccgcaccacccgtcggcgcttgaagcgggtaaagtggcgcctgcggctgctgcgcgagtttttcgaccagcccatctccaagatcgatcccaacttcttcgcccgcaggaagtatagcgacatctcaccccgggaccctaactacaacggccttgccaaaacgttattcaacgaccgcacggacaaggagttctacgacgactacgccaccatctaccacctccgggacaaattgatgacatccaatcgcaagttcgacatccgggagatctacctggcgatacaccacatcgtcaagtaccggggcaatttcctgcggacgggcccggcctcccagtacgggagcgcgagtctccacctggcaaccagcttccagaagctgaacgacctatttgcccagtccgaagagaccctgaacctgaagctcgtgaccgatgaggcgttactgcagcagattcagcagatcctcgtgcgcaccgacctaagcaggtccgaacagcagcggcagatctggcccctgatggccgtcttaactggcgcaagcgctgcggagaagaagcgacagaagaacgtagtggtcgaactgtcaaaggccctggtgggcttaaaggccaagatgaacgtggtcactctaaccgaggtggacgccgccgtcgtcaaggactggacgttcactatggaggagagccaggataagctgccagagatcgaggagcagctgtccgaggtggggcagcagatcatggacgaagtcatccagctgtacgcgagtgtcaacctggcacagctcatccccgccggtaagcgcttctcgcagcacatggtggaaaagtacaagcaccacgaaaagaacctggaactgctcaaggcctacatccacagccagtcagacagcaagcgcgggcgggagatccgcgccacctatgaccggtatatcgatggcgtggatagcaaaccggtgacccaggagatgttctacaaagacctgatgaagtacgtagaggcggacgcaacctctaaccaccttgccgccgagatcaaagacgagattgacagcgagcagttcatgcccaagctccgaaccaagcaaaacggctccatcccataccaggtacaacagtatgagcttgaccagatcatcagccaccagaagaagtactacccctggttaggggaggagaacccggtagctgagcggcgcggcaagttcccgtataaactggacgaactggtggggttccgggtcccctactacgtgggtcccctgatcaccaaggaggaccagcaagcgacctccggcgccggcttcgcctggatggtccgcaaggccgacggtccgatcacaccctggaacttcgaccagaaagtcgaccgtatcgcgagcgccaccgccttcatccagcgcatgcaaaccaccgacacgtacctcatcggggaggacgtgctccccgcccggtctcttatctaccagagattcatggttctcaacgaactgaacaacatgcgggtcgaggaccgcaaactggctccccagcagaagcagcggctgtacaatcaagtgtttaagcaacaccagcatgtgtcggtcaagaacatacagcagaacctcatggatgccggtgaatatcgcaagacgccgcagattacaggactggccgaccccaagggattcaacagtagcctgtccacctatcacgacttcaagaagatcctcctggaggctatcgccgacgagcacaagcgcgccgatatcgagaagatcatactgtggagcacgaccttcgaggactccgcgatcttcaagcagaagctagaggaggtggcctggctgacagatgcacagcggaagcagttaagcgggctgagatatcgaggctggggccagctgtcccacaagctgctaaccgcgttcaaggacgataagggaaggagcatcatggacggcctctgggagacctcagacaacttcatgcaactgaggaagcagcccgccatagagacccagatcaaggaggcaaaccaggcaaacctcaccgacgcggacatccaggacaccatcaacgagctgtacacaagcccccagaataagaaggcgatccgagaggtgatgctggtattagatgacatcaagaacgcgatgcacgggcagaccccgtcctggatattcgtggaggccgcacgtggcggtggggtggccgggcgccgcacgcagtctcgaagcagtcagatcgtcgaggcctacaaggggaccgctaaggagattgtgagcgagaaggttcagcacgagctgaacgagaagatcaaggcgaaggccgacttcaacacccggctggtcctctactttctgcagaatggccgcgacctgtacaccaatgaggccatcaacatcgaccggctctccgagtacgatatcgaccacatcttaccccaaagcctcgtgaaggacgactctctcgacaaccgcgtgctaacttctgcaaggatcaaccgcgagaagaatgacaccttcgcgtccgagaagttcgggcgaaagatgggcgcgcagtggcgagagctgcacagaaacgggctcatgacacagcgcaagctgaaacatctcctgatgcgacccgatgaaatcagcaagcatgccacggacttcataaaccgccaattagtcgagacccgccaggtgattaagctggtggaggaactaatcagtagcgagtaccccgccgccagcatagtcgccgtgaaggccaatctgacgcaccagtttcggcaaacgtttaacttccctaagctgcgggaggtaaacgactaccaccacgccttcgacgccagcctcaccgcgtttatcgggatgtacttattaaagcaataccccaaacttgagcggttcttcgtctacggcaagttcgccaagcagcccatcaaccttacccggtttaacatcatccggaagttagcagtggcagaaaagccgatcgccaacatcgagaccggggagattctttgggacaagacagcggacatcaagtacttcgagaaactgtacaattacaaacgactgctcgtgacgcacgaggtccgggagaactatggcgctatgttcaaacagactctgtttaaggcttcttacaacaagagcaagacactggtgcccaagaaaaaccacatggagaccagtgtctatggaggctacagcaatcaggagacggcatatctcgcaattgtccgcatacccttcaagtccgggttcaagttcattgtggtgggtatccccacccggatggtcgcgaagatcaagcactatcagagcctgggggccacgctgaaccaggccacccacaaggttatcgagccgaagttcacgaagatcagccgcaagaccaaacagaccgtgatcagcgactacgaagtcgtgctccccaaggtgtacctcgaccaagttgtccgtgaccaggtgaagggccagatgtaccgcttcagcctgggcagtgacaaggagtaccacaatgtccaggagctctacctgccactgtctatccagcaggccttcgttggacattacgacgaatccgatgaccagcggagcaacgacttagtgaaggtctacgacgcagcgctgaagcagctgcagcgatatttccccctacacttatcccggaacttcgatcaagtggccagccaggcccaccagagttttgagggtctgaagaacaatgtccaaacaagcgacaagcagctaggcaagaaggaagtgctgaactcactattcgtcggtctccacgcgaacgcgacgcgcagcaacctgtcggtcctggggatgagcaaggacttcggccggattaagtccaacggcatcaccctaaccgaccaggccgagatcatctatcaaagccccacggggctgttcgagcgcaaggttgccctgaaggacctctga

SEQ ID NO: 7707 - RNA, 4086 nt, synthetic construct; identical to SEQ ID NO: 1907
  misc_feature 1..4086: note = Cas9 variant
  source 1..4086: mol_type = other RNA

SEQ ID NO: 7708 - RNA, 4089 nt, synthetic construct; identical to SEQ ID NO: 1908
  misc_feature 1..4089: note = Cas9 variant
  source 1..4089: mol_type = other RNA

SEQ ID NO: 7709 - RNA, 4089 nt, synthetic construct
  misc_feature 1..4089: note = Cas9 variant
  source 1..4089: mol_type = other RNA
atgaacgaaccgtacggcgtcggtctagacataggaaccaactccgtcggctggaccgtcgtggacatgaacggacgtgtacgcaaagtcaaagggaaaaccgccctcggagcacgcctcttcaaagaaggggccaccgcagaagaccgacgtggctttcgaacgacgagaaggcgcctaaagcgtgtaaaatggcgtttaagactactccgggagttcttcgaccaacccatctccaaaattgaccccaacttcttcgcccgaagaaaatacagtgacatcagcccacgtgaccccaattataacggactagcaaaaaccctgttcaacgacaggacagacaaggagttctacgacgactacgccacgatataccacctccgcgacaaacttatgacatccaatcgcaagttcgacatacgagaaatctacctagccatccaccacatagtaaagtaccgcggaaacttcctgcgcacgggtcccgcatcccaatacggaagtgcctcgctgcacctggcaacttccttccaaaagctaaatgacttattcgcccaatccgaggaaaccctaaacctaaagctcgtgacggacgaagctctgctgcagcaaatacaacagatcctagtccgcacagatctgtcacgatccgaacaacagcgacaaatctggccactcatggcagttctaactggagcgtcggcagcagagaaaaagcgccagaaaaacgttgtagtagaattaagcaaagccctagtcgggctcaaagcaaagatgaacgtcgtcacgttaaccgaagtcgacgccgcagtagtaaaagactggaccttcaccatggaggaaagccaagacaaactgcccgagatcgaagaacaactcagcgaggtcggccaacaaataatggatgaagtcatacaactttacgcctccgtgaacctcgcgcaactaatccccgcgggaaaacgcttctcgcaacacatggtcgaaaagtataaacaccacgaaaagaacttggaactgctaaaaacctatatacattcacaaagcgacagcaaacgaggccgcgaaatccgagccacgtacgaccggtacatagacggcgtggacagcaaacccgtcacacaggaaatgttctacaaagacctcatgaaatacgtagaggccgacgcaacctcaaaccatctagccgcggaaataaaggacgaaatcgacagcgagcagttcatgccaaaactcagaactaagcagaacgggtccatcccctatcaggtgcaacaatacgaactcgaccagataatctcccaccaaaagaaatactacccctggctaggcgaagaaaaccccgtcgccgaacgcagaggaaaattcccatataaactcgacgaactggtgggcttccgcgtcccatactacgtaggaccgctaataacaaaagaagaccaacaggcaacctcaggcgccgggttcgcttggatggtccggaaggccgacggacccataacgccatggaattttgatcaaaaagtagatagaatcgcgagcgcaacagccttcatacaaagaatgcaaaccacagacacatacctaatcggagaagacgtactccctgcccgctcactcatctaccagcgcttcatggtactcaacgaactaaacaacatgcgagtcgaagataggaaactagctccacaacaaaaacaacgcctatacaaccaggtctttaaacaacaccagcacgtaagcgtcaagaacatccaacaaaatctaatggatgccggggaataccgagaagccccgaaaatcacaggcctagcggacccgaaaggatttaactcgtcactgtcgacctaccacgacttcaagaagatcctacccgaggccatcgccgacgaacacaaacgagcggacatagaaaagatcatcctatggagcaccacattcgaagattccgcaatcttcaaacaaaaactcgaagaagtcgcctggctgaccgatgctcagcgaaaacaactatctggcctccggtatcgaggatggggccaactgtcacacaagctcctcatagccttcaaagacgacaatggccgaagcataatggacggactatgggaaacaagcgacaacttcatgcaactacgcaaacagccggcaatcgagacccagataaaggaggctaaccaggctaacctcacggacgccgacatacaagacacaataaacgaactttacacgagccctcagaacaagaaagcaatacgtgaagtaatgctcgtcttagacgatatcaaaaacgcgatgcacggacaaaccccctcctggatatttgtggaagcagctcgcggaggcggagtggcgggccgccgaacccagtcacgctccagccaaatcgtcgaagcctacaagggaaccgcgaaagagatagtctctgaaaaagtacaacatgaattaaacgagaaaataaaagcaaaggcagactttaacacgcgactggtcctgtactttctccaaaacggacgcgacctgtacaccaacgaggccatcaacatcgaccggcttagcgaatatgacatcgaccacatcctaccacagtctctagtcaaggacgactccctagacaaccgggtactgacatctgcacgaatcaaccgagagaaaaacgacaccttcgcctcagaaaaattcggccggaagatgggcgcccaatggcgtgagctacacagaaacgggttaatgacacagcgcaaactcaaacacctactcatgaggcccgacgaaatctccaaacacgccacagacttcattaaccgacaactcgtcgaaacgagacaagtcataaaactcgtcgaagaactaatatcctccgaatacccagccgcatccatcgtggcagtaaaagcgaacctcacccaccaattcagacaaacgttcaacttcccgaaacttcgagaggttaacgactatcaccacgcgttcgacgcctccctaacagcattcatcggcatgtacctgctgaaacagtaccctaaactcgaacgcttcttcgtctatggcaaattcgccaagcagccaatcaacctcacccggttcaacataattcgcaagctcgccgtagcagaaaaaccaatcgcaaacatcgagacaggagagattctctgggacaagacggccgacatcaagtactttgaaaaactttacaactacaagcggctccttgtgacccacgaagtcagagaaaactacggcgcaatgttcaaacaaaccttattcaaggcgagcgacaacaaatcaaaaactctagtcccaaagaaaaaccatatggaaacctccgtatacggcggctacagcaaccaggagaccgcgtacctcgccatagtgcgcataccattcaaatcaggtttcaaattcatcgtagtgggcatacccacacgaatggtggcaaaaataaaacactaccaatctctcggggcaaccctaaaacaagccacacacaaagtcatcgagcccaaattcaccaaaatcagccgtaaaacgaagcaaacagtcatatcagactacgaagtcgtgttacccaaagtatatctggaccaagttgtgcgtgaccaagtgaaaggacagatgtaccgattttcactcggctctgacaaagaataccataacgtacaagaactctacctccccctcagcatccaacaagccttcgtaggccactacgacgaatcagatgaccagcggtcaaacgacctggtaaaagtttacgacgccgctctgaaacaactccaaagatacttcccgctacacctgagccgaaacttcgaccaggttgccaaccaagcacaccaatcctttgaaggcctgaaaaacaacgttcagaaaagtgacaaacaactaggaaagaaagaagtcctcaactcccttttcgtcggactccacgccaccgcgacaaggtccaacctatccgtccttggaatgtccaaagacttcggccgacttcaaagccggagcggtataacactaaccgaccaagccgaaataatataccaatcacccaccgggctattcgaacgcaaagtagctctcaaggacctctga

SEQ ID NO: 7710 - RNA, 4089 nt, synthetic construct
  misc_feature 1..4089: note = Cas9 variant
  source 1..4089: mol_type = other RNA
atgactaaacttgggaaaccatacggcatcggcgtcgacattggtagcaactccatcgggttcgccgccgtcgacgaaaacagccacctcatacgccttaagggcaaaactgtaataggcgccagactgttcgaagagggcaaagcggctgccaagaggcgggcaggcaggacaacccggcgcagactctcccgcaaccgatggcgcctcagcttcctcagagacttcttcgaatcacacataaccccaacagaccccaacttcttcatgcgacaaaaatactctgaaataagccccaaagacaaggcgcggtacaaatacgagaaaaggctattcaacgaccgcacagacgccgagttctaccagcaatactcgacgatgtaccaccttaggaaccgcctcatgaccgaccccagcagagcggacgtccgcgaaatatacttcgcaatacaccatattctcaaaagccgcggacacttcctgacacccggggacgctaaagacttcaatactaacgatgtcgccctcgacgaaatcttcccagcccttcaggatgcatacgcccaggtctaccctgacctaggcataacattcgacgaggacaaggccaatgagttcaaaaccatcctcctcaacgaaatcgcaacctccatcgatacgcagcgggccctagtgaaactcctcctagccgaagaagacgacaaggacatcctcaaacagcaaaaacaagtcctgaccgagttcgcaaaggccgtggtcggcctcaaaactaaacttaacctagcgctcggaacggaagtagacagcagcgaagcaacagcctggaacttctcacttggtcagctcgacgacaagtgggcgggcatagaaagcgctatgaccgacgaaggcaccgaaatcctcgaccaaatccgtgacctttatagagctaggctcctcaacggcatagtccccaccggcaaaacgctatcgcaagccaaggtagacgactacacacaacaccatgaagatctgcaactcttcaaagcatacctcaaacaactcgaagacgacgggaccgccaaagcgatccgccaactatatgaccgatacatagacggcgacgacgcggccccctttttacgtgaaaacttcgtcaaagccctaacaaaagacgtaactgcccaccccaataccaaaagccccgaacttctagaacgactagcacagcccgacttcatgttaaagcagcgcaataaggccaacggggccattcccgttcaaatgcagcagcgggaactagatcaaattattaagaatcaagcggtatactacgactggctagccgccccaaaccccgtagaaaaacatagaaaatcaatgccctaccaactcgacgagctcctaaactttcgcatcccctactacgtgggacccctggtcaccgcaaaggaacaaaaagcagcccagggaggagtcttcgcatggatggttcgaaaagacccggaaggaaacatcactccctacaacttcgacgaaaaagtcgaccgagaagcctccgccaacaccttcatacaacgaatgaaaactaccgacacatacctgataggtgaagacgtactccccaaacagtctcttctataccagaggtacgaagtcctaaacgagctcaacaatgtgcgggtaaataacgaaaaactaagcattgaacagaagcagcaggtaatccgcgagctgttcgagcggcataattcggtcaccattaaacaattcgccgaaaacctccgggcccacggagactacgctcacataccagaaataagaggactcgcagatgaaaagcgattcctgagctcgctctccacctaccgccaactaaaatccctactacccgaggcgatagacgaccctgcaaagcaagcagacatcgagaacattatagcatggtcaacagttttcgaagacgccgccattttcaaaaccaaacttaaagaaatatcctggctcggctccgaggccatcacaaagctaagcaacatccggtacaggggctgggggcaattctcccgcaaattcctcaacggtctcacactgggcaacgggcacaccatcatacaagaattactactctcaaccaacaacctaatgcaaatattaaccgacgaaaccctccaaaagaaaatgaccgaactgaacgccgataaactcaaaacggctaacatcaacgacgccattgacaatgcctacacctccccaagcaacaagaaagcactaagacaagtactacgcgtcgtcgacgacatcaaacgcgccgccgatggccaagatccaagctggctatacgtagaaacggccgacggaggcggaacccccggtaaaagaacccgcgcccgccaacaccaattacaagaaatatacgcaaacgccgcccacgaactaatcgataccgcagtccgtggcgagctagaagacaagatttccgataaagccgactttaacgacagactcgtcctatactttatgcagggcggacgagacatctacacgggagccccgctcaatatagaccaacttagctcctacgacatcgaccacatccttccccaatcactcataaaagataattcactcgacaacagggtgctcgtccacgcgatcattaaccgcgagaaaaacgccacattcgcgtccacaatttacgcacagaaaatgaacgcaacctggagacaatggcacgaagcaggactcatcagcggccgcaagctaagaaacctccaaatgcgacctgaccaaatcgacaaatacgcaagcggcttcgtagcccgacaattagtagaaacacgccaaattataaaacttaccgagcaaatagtggccgcccaatacccagacacgaagataatagccgtaaaagccggcctctcccatcaactccgcgaagaactcgaatttccgaaaaatcgtgatgtcaaccactaccaccacgccttcgatgccttccttgcagcacgaataggtacatacttactcaaacgattcccaaatttgcaagcattcttcacatacggaaaattcacaaaagccgacgtcaaaaagttacgaggctttaacttcatccgcgacataactcatgctgaagacaaaatagtagccaaagacaccggcgaagtggtatgggacaaacagcgggatgtagacgaacttgacagaatatacaatttcaaacgtatgctaatcacccacgaagtaagattcgagaccgcagacctcttcaaacagactgtatacggcgcccgagactccaaagaggcaggcggctccaaacaactcatcccaaagaagaaaggctacccagtcgacatatacggcggctactttagggaaaacactgcctacctcgccgtcgttaaagtcacaaagaaaactgaaacaatcttcaaagtggtcaaaatagccaccagccaggtagcagcactaaacaaagccagatcaaggtccaccgccgaagaactctctgttctcacggagttactaaaaccaaaattctcaaaagtcggcaaaaatggaaagataacagacacccccttcgaggtagtactgccgcgagtccctcgagaacaactgttctacaacgccaagtacggtttcttcatggtcaactccgacacaatgttccacaacttccaagaaatatgggtatctcgcagcgatcagaaaattctccaacaaattaggaaagcgaagatcgactacccgaacgttgaccaagacctagacaatcttttccacaacctcgccgaccaaatcgtcaagtacttcgatctttactcaatagccggcttcaaggagaaaatctcccaaagccaaaacacattcaacgacctcgccgtagacgacaccgatcaatcagtcggtaagattacagtcataaacgaactccttaagggggcccaagccaacggcatgacaggctccctaaaggtcctaaaaataagtacgccattcggattcacacaagacaagagcggcgtactaactaaagacagctccataatatatcaatcccctaccggcctcttcgaaagatcggtacgactcaccgacctctga

SEQ ID NO: 7711 - RNA, 4089 nt, synthetic construct
  misc_feature 1..4089: note = Cas9 variant
  source 1..4089: mol_type = other RNA
atgaccaagctggggaaaccctacgggatcggcgtggacatcgggtcaaactccatcggctttgccgccgtcgacgagaacagccacctcatccgcctgaaggggaagaccgtaatcggcgcgcgactgtttgaggagggcaaggccgccgccaagcgccgcgccgggcgcacgacccgccgacggctctcccgcaaccgttggcgactgtcattcctgcgggacttcttcgagtcccacataacccctaccgaccctaacttcttcatgcgccagaagtatagtgagatctcccccaaggacaaggctcggtacaagtacgagaaacgcctcttcaacgacagaacggacgccgagttctaccagcagtacagtaccatgtaccatctccgaaaccggcttatgacagacccctcccgggccgacgtgcgggagatctacttcgccatccaccacatcttaaaaagccgcggccattttctgacgccgggggacgcaaaggacttcaacaccaacgatgtcgcacttgacgagatcttccccgccttacaggacgcttacgctcaggtgtacccagatctgggcattaccttcgacgaggacaaggagaacgagttcaagaccatcctgctcaacgaaatagcgacctccatcgacacgcagcgggctctggtgaagctgctcctggcggaggaggacgacaaagacatcctgaagcagcaaaagcaggtcttaaccgagtttgccaaggccgtggtggggctgaagaccaagctcaacctcgcgctgggcacagaagttgacagctccgaagccacggcgtggaacttctcactgggacagctcgacgacaagtgggcagggatcgagtcggccatgacagacgaaggcaccgagatcctggaccaaattcgcgacctgtatcgagcgaggctgctgaacgggatcgtgcccaccggtaagaccctgtcccaggcgaaggtggacgactacacccagcatcatgaggacctccaactgttcaaggcctatctgaagcagctcgaggacgacggcaccgccaaagccatccgccaactgtacgacaggtacatcgacggggacgatgcagcaccgttcctccgcgagaactttgtcaaggcactcaccaaggacgtgacggcccacccaaacaccaagtcacccgagctgctggagcggctcgcgcagcccgacttcatgctgaagcagagaaacaaggctaacggcgccataccggtgcagatgcagcagcgagagctggaccaaattatcaagaaccaggctgtatactatgactggctcgccgcgcctaaccccgtggaaaagcaccgcaagagcatgccctaccagcttgacgagctgctcaacttccgaatcccgtactacgtggggcccctggttaccgccaaggaacagaaggccgctcaagggggagtatttgcctggatggtgcgcaaggacccagagggcaacatcaccccctacaatttcgatgagaaagtcgacagagaggcctctgccaacacgttcatccagcgcatgaagaccacggatacctacctgatcggcgaggacgtgctaccgaagcagtcactcctgtaccagcgatacgaggtgctgaacgaactcaacaacgtacgcgtgaacaacgagaagctgagcatcgagcagaaacaacaggtcatccgtgagctgttcgagcgccacaactccgtgacgatcaagcagttcgccgaaaacctccgggcacacggggactatgcccacatccccgagatccgcggcctggcagacgagaagcggttcttgagctccctatctacctaccgccagctgaaatcgctgctccccgaggcaatcgatgaccccgccaagcaggccgacatcgagaacattatcgcgtggagcaccgtgttcgaggacgcagccatcttcaagactaagctgaaggagatctcctggcttgggagcgaagccatcacgaaactttccaacatccgctaccggggctgggggcagttcagccgcaagttcctgaacggcttgaccctcggcaacggacacaccatcatccaggagctgcttctctccaccaacaacctgatgcagatcctgactgatgagacgctccagaagaagatgaccgagctaaacgccgacaagttgaagaccgcgaacatcaacgacgccattgacaacgcgtataccagcccgtccaacaagaaggccctacgccaggtcctgcgcgtggtagacgacataaagcgggccgcggacggccaggacccgagctggctatacgtcgagacggctgacggaggcgggacccccggcaagagaacccgggcccgccaacatcaactccaggagatctacgccaacgccgcgcacgagctgatagacaccgcagtgcggggcgagctggaagacaagatctccgacaaggcagacttcaacgacagactcgtgctgtacttcatgcaaggagggcgggacatctacaccggggcgcccctgaacatcgaccagttgtcttcctacgacatagaccacatcctgccccagagcctaatcaaggacaactctctcgacaaccgcgtacttgtgcacgcaattatcaaccgggagaaaaacgccaccttcgccagcaccatatacgcccagaagatgaacgctacctggaggcagtggcacgaagcaggactcataagcggccggaagctccgcaatctgcagatgcggcccgaccagattgacaagtacgcctccgggttcgtggctcgccaactggtcgagacgcggcaaatcataaagctcaccgaacagatcgtggccgcccaatatcccgataccaagatcatcgcggtaaaggccggcctgagccaccagctgcgagaggagctcgagttcccgaaaaaccgggacgtcaatcactaccaccacgccttcgacgccttcctggccgcgcgcatcgggacctatctgctcaagcgcttccccaacctgcaggcattcttcacgtatggcaagttcaccaaggccgatgtcaagaagctgcgggggttcaacttcatccgcgacatcacccacgccgaggataaaatcgtggcaaaggacacgggtgaggtcgtttgggacaagcagcgggatgtggacgagctcgaccgcatctataatttcaagcggatgctgattacgcatgaggttcgcttcgagaccgcggacctgttcaaacagaccgtgtacggcgcccgggattccaaggaggccgggggcagcaagcagttgatccccaagaagaagggatatcccgtggacatttacggcgggtatttccgcgagaacacagcctacctggcggtcgtgaaagtgacgaagaagactgagaccatcttcaaagtcgtgaagatcgcgacctctcaggtagccgctctgaataaggcccggagccgctccacggcggaggagctcagcgtcctgactgaactgctcaaaccgaaattctccaaggtgggcaagaacggcaagattaccgacacgcccttcgaggtggtgctgccccgcgtgccccgcgagcagctgttttacaacgctaagtacgggttcttcatggtgaactctgatacgatgttccacaacttccaggagatctgggtctcccggagcgaccaaaagatactccagcagatacggaaggctaagatcgactaccccaacgtggaccaagacctggacaacctgttccacaacctcgccgaccagatagtgaagtacttcgacctctactccatcgccggcttcaaggagaagatcagccagtcccagaacacgttcaacgacctggcggtcgacgacacagaccagagcgtggggaagatcaccgtgattaacgagctcttgaagggcgcccaggccaacgggatgacgggatccctcaaggtcctcaagatcagcacaccgttcggcttcacccaggacaagagcggggtgctgacaaaggactccagcattatctatcaaagtcccaccggcctgttcgagcggagcgtgcgtctcacagacctgtga

SEQ ID NO: 7712 - RNA, 4089 nt, synthetic construct
  misc_feature 1..4089: note = Cas9 variant
  source 1..4089: mol_type = other RNA
atgaccaagctgggcaagccctacgggatcggcgtggacatcgggagcaactctatcggcttcgcagccgtcgacgagaacagccacctcatccgactgaaggggaagaccgtgatcggcgctcggctgttcgaagagggcaaggccgccgccgaccgccgggcctcccgcacgacaagacgcaggctcagcaggaaccggtggcgcctgtccttcctgcgggacttcttcgagtcgcacatcaccccgaccgaccccaatttcttcatgcgacagaagtattcagagatcagccccaaggacaagtcccgctataagtacgagaagcgcctatttaacgaccggacggacgcggagttctacaagtatgagaactgcccaaccatgtaccacctacgcaaccggctgatgacagacccgagcaaggctgacgtgcgcgagatatacttcgccatacaccacatcctcaagtcccgggggcacttcctgacccccggcgatgccaaggacttcaacacgaataaagtagcggtgaacaagatcttccccgcactgcaggatgcctacgcccaggtgtaccccgacctagacatcaccttcgacgagaacaaggttaatgagttcaagactgtcctgctgaacgagaaggccaccccgagcgacacgcaacgcgcgctagtcaacctcctcctcgccaaggagggggaccgcgacatcctgaagcagcagaagcaggccctgaccgagttcgccaaggccgtcgtgggcctcaaaaccaagctgaacgtggcactggggaccgaggtcgactccagcgaggccacggcctggaatttctccctcggccagctggacgacaagtggaccggcattgagagcgccatgaccgacgaagggaccgaaatcctggaccagatccgcgacctataccgcgcccggctgctgaacgggatcgtgcccgcggggaagacgctctcccaagcgaaggtggacgactatgcacagcaccacgaggatctggagctgttcaaggactacctcaagcagctggaggacgacggcaccgccaaagccatccgccagctgtacgaccggtacatcgacggcgacgacgcgaagccctttgtccgcgaagacttcgtgaaagccctcaccaaagaggtcaccgcacaccccaacgccaagagcccggagctgctggagcggctcgctcagcccgacttcatgctgaaacagcgcaacaaggctaacggggccatccctgtccaaatgcaacaacgggagctggaccagataatcaagaaccagtcagtctactacgactggctcgccgccccaaacccggtggagaagcaccgcaagagcatgccctaccagctggacgagctgctcaatttccggatcccctattacgtcggacccctggtaacggcaaaggagcagaaggccgcccagggcggggtattcgcctggatggtccgcaaggacccggatgggaacataaccccctacaacttcgacgagaaggtggatcgggaggccagcgcgaacacgttcatccagcgcatgaagaccacggacacctacctgatcggcgaggacgtcttaccgaaacagtccctgctgtaccagtcgtatgaggtgctgaatgaactcaacaacgtgcgggtgaatgacaacaagttgtccttcgaccagaagcagcaggtcctgggggaactcttcgagcgccacaacacggtgaccatcaagcagtttgtggataacctgttagcccacggggactacgaccggatcccagaggtgcgcggccttgccgacgaaaagcggttcctgagctccctgagcacgtacaaccagctcaaggggatactgcatgaagccatcgacgacagcgacaagcagaccgacatagagaacatcattgcctggtctaccatattcgaagacaaagcgatcttcaagacgaaattaaacgagatctcttggctcaacgccggcatgatcaacagcctggccaacatccgctacagagggtggggacagttcagtcacaagctgctaaacgagctgacgctgtctaccggccgcaccgtctttgaggaactcctgattagtagccacaacctgatgcagatcctcaccgacgaagtcctgaagcagaagatcgccgagctgaacgcgcatgagctcaaggcctccggtatctacgccgccattgacgacgcctacacctctccttccaacaaaaaggcgctgcgccaggtcctgagcgtgatcgacgacatcacgaacgctgccggccaagcgcctaattggctctacatcgagaccgcggacggggacggcgtccccgggaagcgcaccaactcccgccagcggaagattcaggagatctacgcgaacgccgcccaggagctgatcaccggcagcgtgcgcggcgagctggaggacaagatcgcctcgcgggccgactttacggaccgcctcgtgctgtactttatgcaaggagggagggacatctacaccggcaaaccccttaacatcgacaacctttccagctacgacatcgaccacatcctgccgcagtccctaattaaggacaacagcctcgacaatcgcgtgctggtccacccgctggtgaaccgggagaaggacaccatcttcgcgtctactcgcttcgccaagcagatgaacggcatgtggcggcagtggcacgccgccggcctcatcagctcccgcaagctgcgaaacctccagatgcgccccgacgagatcgacaagtacgcgagcgggttcgtcgcccgacagttagtggagacgcgacagatcattaaactgacagagcagatagtggccgaccaatacccggacaccaaaattatcgccgtcaaggccggcttatctagccagctgcggaaggagctggacttccccaagaaccgagaggtgaaccactaccaccatgcgtttgatgcattcctggccgccagaatcgggacctacctcctgaagcgctaccccaacttagagcccttcttcacgtacggcaagttcaagaagacagaggtgaagaagctcaagtccttcaactttatccgggatatgacccacgccaaggacaaaatcgtagcgaaggagaccggggagatagtttgggacaacgccagcgacatcaacgagctggaccgcatctataacttcaagcgcatgctgatcacgcacgaagtgcggttcgagaccgcctccctcttcaagcagaccctttacgccgccaagaatagcaagaaccgcggaggctcccggcagctgatccccaagaaaaaggggtacctggtcgacatctacggcgggtacacacaagagacgggaagctacctgtccgtggtgcgcctaacaaagaaggcgatgtacgcagtcgtaaaggttagcacccgagacgccgccaagctcgccgttgccaagagcatctccgagcagaaggagaacgaaaccctgaagaaaatcatcgacgggaaactgagcaagacgtccaagaagggcaagaccacccaccagctgtttgagatcgtcctcccccgcgtgggccagaagaccctgttcaagaactccaagtacaaccagttcctcgtcaactccgacacgtacatgcacaactaccaggagctgtggatgccccgggagtatcagcgcatgtggaaggacatcctgctcagcaaccacggggacgcgcagctggagggccagctggaccaaatcttcaaatttatcgtgtcccaggtgaacagctacttcaacctctacgacatcaaccagttccggaagaagatcgccgacgccaccgacaagttcgcgaagctgcccacgcacgacactgacaacgcgcgcgggaagatcgccacgatcggccagctgctcatcggtctgcaggccaacgccatgcggtccgacttgcgcaacctcgatatcaagactccgttcggtctgctgcaaattggcaccgggatcaccctcgacctggacacaagcatcatctaccaatcccccaccggcctgttcgagagggaggtccccctcaccgacctgtga

SEQ ID NO: 7713 - RNA, 4089 nt, synthetic construct
  misc_feature 1..4089: note = Cas9 variant
  source 1..4089: mol_type = other RNA
atgaaccaggaaccctacgccatcggtcttgatataggaacctccagcctcgggtgggccaacgctgacatggacggctacatcgcacgcgtcaagggacagaccggcctcggcgtccgcttgttcgaggaaggccagcccgctgcggaccgtcgatcattccgaacaaccagaagacgactttcgcgtaggcgctggcgcctccgcctactacgagaaatcttcgacgagcccatcagcagcatcgaccctaacttcttcgcacgccagaaggcttcatccatcagcccaaaagacgatcgattcgaaaccacctaccaactcttcaacgacaaaacggaccaagagttctacagcaaatacccgacaatataccacctccgctgggcactcatgaccgaacaccgcaagtttgacctcagagaaatatatctagccgtgcatcacatcgtaaaatacagaggaaacttcctgcgatccggcaaccccaagagcttcaaaccgtcagaactagacttttcacaaaggttcaaagaagtgaacggactctggcacctaatattcgacgaagtagcaccccaactgccgaccgataacctagaagaaataacaaaactcgtactggacaccacgcgaaccagagcagaccggcagcgcgaaagcgtcaaactcctaatggccgccaccgacaaccataaagactggaagccatacctaacagaatttaccaaagcaatactgggcttaaaaactaaactttacctactaaccggcgtcgacgtcgctaaggcagatcagaaaacttggacattctcactcgaagatatagaggaccaccgtgcagatctcgagaccgccttcgacgatcgctccctcgagctaatcgagaaactcgtagacctccaagccgccattcaactaacggagataatgccgtcaggtcaatactttagccaaagcatgatctaccggtacgaccaacacaaggaacaccttaggtggctaaaagattacgccgaacagcagaccgacgccaataaacgcaaagccgtgcggctcgcctacgaccactacatcgagggggacgccaaaggcaaaccagagatagccgatgacttctacaaagaactcaaccgcatactgaagggcgacaccagcgaactagccaagaaaatcaaccacgaaatagcactcgagcacttcatgccaaaacaacgaactaaagaaaacggagtcattccataccaaattcatcaacaagagctggactcaattatagacaaccaaaagaaatactaccagtttcttggcgaagacaatccagtggtctcgcaccatggatcccaaccctataaaatcgacgagctcgtctccttccgcgtaccttactacgtgggcccgatgataacagcagaccaacaaaagaaaaccgccgcaggccaattcgcctggatggttcggaaagattccggagacatcaccccctggaacttcgacgataaagtagaccgcaccgcttccgcaacaaacttcatacagcgaatgaaaaccaccgacacctacctaatcggagaagatgtactcccactccagtcccttacctaccagaaattcatggtgctcaacgaactcaacaacatccgcatcaacggcgaactcctcacaagagagcagaaacaacgcacatataacgacgtattcaaaggccacggaaccgtcaacgtcaaatcattgataaaaagtctcgagtgccactcagaagttaccggagcgattaaagtcgagggtctagcggacccgaaacgctttaactccgccctaaccacctaccgcgacttcaagaaaatactgcccgtcgcaatcgaccagccgcagcgccaagcggacatagaacgaatcatcaactggagcacaatattcgaagacgcagacatttttaaagccaaattacaagaaatagactggctgacagacacacaaagagacaggctaagcaccaaacgataccgcggctggggtcgactaagcgcaaaacttctcctaaatataaaggacacacaaggtctctcgatcatggaccaactatggaacacccagcacaatttcatgcagatagtacacgaaccagattacgctgagaaaatcgagaaaaccaacgccaagggactcaagcaacaagatattttcgaaactatcaatgaaatgtacaccagcccacaaaacaagaaagcgctaagacaaatactcgcagtcgtaagagacatccagaaagcccatcacggacaagccccgtcccgcatcttcatcgaagcagcacgcggagccgaacaaaatccccaaaggacccgacaacgccagaaacaactcgcagacctcttcgccgaccaggccaaagaaatcgtgaatgaaaccgtagctcaggaacttaacgacgaaacagataacaaagcaaggtttaccgaccgccttatgctatacttcctccaaaacggccaagacatgtacacaggcgaaaaactaaacatcgacaagctaagcacctacgatattgaccacatcctgccacaatcgttagtcaaagatgacagcctcgacaacagagtcctcgtgagcaaagtagaaaacctcaagaaaaacgatcacttcgccagcgaactctacgccaggaaaatgcagggcacttgggaattatggcgatcagcaggccttatttccgccagaaagctcaagcacctactcatgcgacccgatgaaatcaataaatacgcaaccggcttcatccgccggcagctcgtcgagacccgacaagtaattaagctagtcactgacgtcctcagcaacgagtacgatagcgacaaaacaaaaattatcagcgtcaaagcagggctcagccaccagttacgcatggaactcgacctcccaaaagttagggagcttaacgactaccatcacgcattcgacgctttcctggcagtcagaatcggaacctacctcctaaaaagatacccgaaattagagcggttcttcgtatatggccaatatcaagtagcacctcaactggacctcaggcgcttcaacttcatccacgacctagtgtccggcaaacaggagaaaatagtggctgaagaaaccggcgaaattgtctggaaccgcgaaaaggacgtatcatacatgaagcatctactcagcctgaagcatctcttagttacgcacgaagtcaaagaagatcacggagcacttttcaaccaaaccatctacaaggccaagaaagacaacggcaacgtaggaggcaaaatgaagctattacccacgaaatctaacagacccaccgaaatctacggcggccattcatcgcaagcgatagcatacctcgccatcgtaagagtaaatggcaaagaaccgtcatatcgagtaatgggagttcctattcggatactcgaccaactcaagcaagcgaagaaacagggggaatatgccgaacgcctcgccctcaaacaattcttcacaccagacttcacaaaaggaaaaggaaaaatcgtttctgatttcgacgtagtcatcccccacatacccctcctccagcctgtaattgatgaaataagcggccaatcacaccgcttcgccctcggaacaaacacatactaccgaaacctccagcaactaatacttaccctggcggaccagaaagtcctaatcagcaaggaaacgggcgtggacgaagagaaaaagctcgtagaagtgtacagccacatatgccaacaggtaatgaaattcttcccgctgtacgatcgaaacaaattccgcgaactcctagtagactcacgatcacactttgagcaactaccaatcgtaaacagatactccgacgccggcaaactcgagattgctggcaaacgagggatcctccagcagataatggtaggactacacgccaatgccacacccggcgatttaaaagaactcggcgttaaaacccccttcggcaaactgcaagtaccgggcggaatcaaacttacagaaaacgcaaaactcatctacgaatcgccgaccggcctattcaaaagagaagtaaagattaccaccgagtga

SEQ ID NO: 7714 - RNA, 4089 nt, synthetic construct
  misc_feature 1..4089: note = Cas9 variant
  source 1..4089: mol_type = other RNA
atgaagaagaaggccgagaagatctacctgggcctcaacgtggggaccaacagcatcggctacgccgttaccgacgagcagtatcgcctgctgaagttcaatgggaacgacgcgtggggctcaatagtattcgacgccgcgagctccaacgaggaccggcgcaaccaccggctcgcccgcagaaacctggaccgccggcagcagcgcatcgtgtggctgcaggagatctttgcaaaggagatcagcaaggtagacgaccggttcttcatccgcctctccgagagcttcaggtggcgcgaggacgtgcaggatcggtatgtgttcttcaacgacaaggagtacacggacgtccagtacatgaaggagtaccccaccatccaccacctgatctgcgagctgatggacaataagaccccgcacgacgtgcgcctcgtatacctggcgtgcgcctggttgatcacccaccgggggcatttcttaaacaacctaaacgtcgaaaagctggatgagatcatggacttctccagcgtgtaccagaacttcatcaactatttcacagagaatggctacaagagaccctggggcgagatcgacgtgtccgctctcagcgaggtcctgaaacagaagaccgggatcaccgtgaagaacaaggagctgcagaacatcttactggagggcaagaagcccgagaagtccggaaccgaggagtttcccttcagccaggactccatcatccggctgctcgccggcgggcaatgcaagctgaaagacgtgttctgtaaggaggagtatctggacctcggtagcgtctccctgggaatggatgaggagaagttcgacgagatcagcgggtccatcggcgaggattatgacctgctcatcgcgctgcgcgggctgtacgattggagcgtgctcgccaaccttctgaacggccactccgagactatcagcatggccaaggtgcagatgtacgagcagcacggcaaggacctccagatcctgaagtactttgtacggaagtatgtgccggacaagtacaacgaggtgttccgcaaggccaaggccgacaattatgtcgcgtacaccgggcacatggacaaggacaccgccagccaaatcaagaagaaggccaaggccgaggagttctccaagtacgtcctgaagctcatgagccccatcaaacccgagaagaccgacctgcagtcctacgaggacatgtgcgagcggctcaagctcaatcgcttcctgcccaagcagaagaacacggacaacagggtgatcccccatcagctgtacgagtacgagctcatccagatcctcaagaacgccagcgtatacctgcccttcctcaacgacaccaacaacggcatttccgaggcggacaaggtgctgagcgtcttccggtacaagatcccctactacgtggggcccctgaacgaggagtccagcttcgcctggatctcccgcaagcaaggcaagatcactccctggaacttcaaggagatggtggacgaggacgccagcgagaacgccttcattcgtcgcatgaccaataagtgcacgtacctccccaccgaggacgtcctgcccaaggactccctgtgctatcagaagttcatggtgctgaacgagatcaataacctccagatcgacgggctgaagatccccgtgaaggccaagcagggcatctaccacgagctgttcgagaagaacaagaaagtcaaacggaaggacatcgaggagtacctcatccgcaacaactacctggacaaggacagcaccgaactgatctcaggcatcgacgagcagatccacagcgggctctccagctactgcgcgttcttcaacctgctgaacaagaaaatcctctccgaggacgacgtggagcggatcatcgaacgcgcctcgtacgccgaagacaagtcccgggtgatcaagtggctgcgcaaggagtacccggggctgagcgaagacgacatccggtacatcgcccgcatcaagatccgggacttcggccgcctcagcaagaccttcctgacggggctgaaggggtgcgacgtgtccaagggcttcgacggacaggacgtggagatgatcagcatcctccagaccatgtgggagaccaacgacaatttaatggagatcctgtccgacaagtacaccttcttggaagccctggaggcgttcacgcaggagtactacaccgggaaaaagaagtccctgaaggagcggctcgacgagatgcgcgtgtcaaacagcgtcaggcgccccgtgtaccggaccctggcggttgtcaaggacatcgagaaggccttcggcaagcccaacaagatcttcgtggagatgacccgcgggggccaagccgaccagaaggggaagcgcatcaagtcccgtaaacagcagatcctggacctttacgacaagtgcaaggacgacgtgcacgacctgatgtggcagctggagagcctcggcgaatatgcggactcccgcctgcagagcgaccggctgtacctctacttcatgcagttcggcaagtgcgcctactccggcgctcacatcggcttcgagcagctgatggccgggagcgtcgagtatgatatcgaccacatctacccgcagtcctacgtgaaggacgacagcctgaacaacaaggtgctcgtcttatccgacctgaacggcacgaaggacaacatttaccccgtgagccccgagatccgcggcaagatgcaggggctctggtcatggtggaaccacgtgggagccatcagcgacgagaagtacaagcggctgatccgcagcgcgcccttcacagacgaggagaaaatggggttcatcaaccggcagttgaccgagacctcccagtccacgaagttcatcgccgacctcctgaaggagcgctttcccgacgccgaggtcgtgtacgtgaaggccggcctggtctccgacttccggcacgagttcgacctccccaaaagccgctcctacaacgacctacacaacgccgccgacgccttcctgagcgtggtagccggtaacgtctacgacatgcgcttttccaaaaagtggttccgcatcgacgagaagtacagcgtgaaggtgaagaccatcttcacccacgaagtcaagtgccggggcgacatcatttgggacggcatgccgatgctcgagaaggtggaggacaccgcccgcaaaaacacggcgcacttcgtgaagtacgcggccttcaagaccggtggcctgtttgaccagaaccccgtcaagaaggggaccggcctgatccccctcaaggcggggctgccgaccgagaagtacggcggctataataaggccgggatcatgttcctgatccccgtgcggtacaacatcggcaagaagtccgagatcctcatcctgccggtggagctgatgcacgggaagcacttcttggaagacaaggtcttcgcgcgcaactacaccttcacgcgtctggagaacatcctgggcaagaaggtgggcgaggtgagcttcccgatgggcatgcgcccctggaagatcaacaccatgctctccttcgacggcttcagagtatgcctgaccgggactagcggccgcgggaagtgcctggtggcccagcccgtgatgcagttttccgccgacgagcactggagattctacgtcaagcgcctcgagcgcttcgtggagaagatcggcatcaacccggacctgctctacgacaaggaccacgacaaggttagcaaggacgagaacctcaagctctacgagctgtacgtcgacaagctccagaacacaatttacaagaagcgggtgaactccccggtgcagaccctgctgaaggggaaggaggaatttaagaagctatcaatcgaggagcagtgccaggtcctgttgaacatccagtcagtgttcggccgcatgaccggcgggtgcgacctcaccctgatcggcgggagcgcccactccgcagcgacgggcagcctgagcaccaccatatccaactggaagaagaagtacagcaccgtccggatcatcgaccagtccccctctggcatgtgggagaagtccagcgagaacctcctagacttcctgtga

SEQ ID NO: 7715 - RNA, 4092 nt, synthetic construct
  misc_feature 1..4092: note = Cas9 variant
  source 1..4092: mol_type = other RNA
atgacaaaactcggaaagccgtacggaatcggcgtcgacatcggatcaaactcaataggcttcgcagcagtagacgaaaacagccatctaatccggctcaaaggtaagacagtaataggcgcccgactcttcgaggaaggaaaggccgccgcagacagacgagcatccagaacgacacgacgcagactcagccgaaacaggtggcgccttagcttcctaagagatttcttcgaatcacacataacaccgacagaccccaacttcttcatgagacagaagtactcagaaatttctccaaaagacaaagcaagatacaaatacgagaaacgccttttcaacgaccgcactgacgcagagttctaccaacaataccccacgatgtaccatctgcgcaacaggctgctcacagacccatccaaggccgacgtcagggaaatctactttgccatccaccacatcctcaaatcccgcggacacttcctgaccagcggctacgccaaagacttcaacacaaacaaagtcgctctaaacgagatctttcccgctctgcaagacgcctacgcacaagtgtacccagacctcgatataaccttcgacgagaacaaggtcaacgaatttaaaacggtcctactcgatgaaaaagccaccccctccgatacccaacgcgccctcgtcaacttactcctggccgaagacggagacaaagacattctaaagcaacaaaaacaagtactaacggagttcgccaaagcagtcgtaggattaaaaatgaaactgaacgtcgctctaggcaccgaggtcgacagctctgaagccacggcatggaatttctccctaggccaattagacgataaatgggccggcatcgaatccgcaatgactgatgaaggcaccgaaatcctagatcaaatacgggacctctaccgtgctagactcctcaacggcatcgtcccagccggcaaaaccctctcacaagccaaggtagacgactacgaacagcaccacgaagacttagagctgtttaaggactacctcaaacagttggaagacgatggcatggccaaagtcatccggcagctatacgatcgctatattgatggagacgacgctaaaccattcgtgcgagaagactttgtcaaggccctcaccaaagaggtgaccgcgcacccgaacgcaaaatcccctgaactccttgaacgacttgtacaaccagactttatgctaaaacaacgcaacaaagcaaacggggccatcccagtccaaatgcagcagcgagaactagaccagataattaaaaaccaaagcgtctactacgactggctagccgcccccaaccctgttgagaaacaccgacaatccatgccctatcaactagacgaacttctcaattttcggatcccatactatgtcggcccgctagtcacagcgaaagaacagaaagccgctcaaggcggcgtcttcgcctggatggtcagaaaagaccccgacggcaacatcaccccctacaatttcgacgagaaagtcgacagagaagcctccgctaacaccttcatacaacgcatgaagaccaccgacacttacctgattggtgaggacgtgttgcccaaacagtccctactgtaccaaagctacgaggtcttaaacgaactaaacaacgtccgggtcaatgacaacaaactctcgttcgaccaaaagcaacaagtactgggggagctattcgaacgacacaacacagtcacaatcaagcaattcgttgacaacctcctcgcacacggcgactatgaccgcatccctgaagtacgaggtctcgcggatgaaaagcgattcctgagctctctatccacatataatcaattaaagggcatcctacacgaagcgatcgacgactcagacaagcaaacagacattgagaagatcatagcctggagcacaatattcgaagacaaagctatctttaagacgaaactcaacgaaatcagctggttaaccgcaggaatgataaactctctcgcgaacatccggtaccgaggctggggccagttcagccacaaactcttaaacgagcttacactctcgaccggacgcacagtcttcgaggagctcctcatctcctcacacaaccttatgcaaatcctcactgacgaagtactcaaacagaaaatagccgaactcaatgcgcacgaactcaaggcctccggcatctatgccgcaatcgacgacgcctatacgtcaccctcaaataagaaagcactcagacaagtcctatcagtaatcgacgacatcaccaatgccgcgggccaagcacccaactggctctacatcgagacagccgacggggatggagtcccgggaaaacgtactaattcccggcaaagaaaaatccaggagatctacgcaaacgccgcgcaagaactcattaccggatcggtccgcggggaactggaagacaaaatcgcatctcgcgcggactttacagaccgcctcgtcctgtacttcatgcaaggcggaagagacatttacacaggcgaacccttgaacattgacaacctctcatcatacgatatagaccacatcctcccccagtctctaatcaaggacaattccctagataaccgggtactcgtccacccactcgtaaaccgcgaaaaggacacaatcttcgcctccacgcgcttcgccaagcaaatgaacggaatgtggcgacaatggcacgcagctggactaataagcagccgtaagttaaggaatcttcaaatgaggcccgacgagatagataaatatgctagcggattcgtagcccggcaacttgtcgaaacccgccaaataatcaagctcacggaacagatagtcgctgaccaatacccagacgcaaaaattatcgcagtcaaggccggcctcagctcacagctccgaaaggaactcgacttccccaagaaccgcgaggttaaccactaccaccacgccttcgacgccttcctagcggcacgcattggaacctacctcctaaagcgctacccgaacctcgaaccgttcttcacctacggcaagttcaaaaagacggaagtcaagaaactcaaatcactcaagagcttcaacttcatcagggacatgacccacgccaaagacaaaatcgtcgcgaaggaaaccggagaaatagtctgggataacgccagcgacataaatgaactcgaccgcatctacaactttaagcgaatgctcattacgcacgaagtccggttcgaaacagccagcctctttaagcagaccctatacgcggccaaaaacagtaaaaaccgaggcgggtctcgtcaactcataccgaagaagaaggggtaccttgtagacatctacggcggctacactcaggaaactggctcttacctaagtgtagtgcgactaacgaaaaaggcaatgtacgccgtggtaaaagtaagtacacgggacgctgccaaactcgctgtcgcaaagagcatctccgaacaaaaagagaacgaaacactcaagaaaatcatcgacggcaaactttccaaaacaagcaagaaaggaaaaaccacccaccaactctttgaaatcgtcctccctcgcgtcggacaaaagaccctcttcaaaaacagcaaatacaaccagttcctcgtaaacagcgacacgtacatgcacaactaccaggagctttggatgccccgcgaataccaacgcatgtggaaagacattctactcagcaaccacggcgacgcccaactcgaaggccagcttgatcagatattcaaattcatagtgtcacaagtcaactcctactttaacctttacgacataaaccaattccgaaagaaaatcgccgacgccactgacaaattcgccaagctacctacccacgacacggacaacgcgagaggcaaaatcgcaacaatcggccaactcctcatcgggctgcaagcaaacgcaatgcgctccgacctaagaaatctagacataaagacacccttcggcctcctgcagatcggaaccggcatcacgctcgacctcgacactagcatcatataccagtcccccacaggcctgttcgagagagaggtgccattaacagacctctga

SEQ ID NO: 7716 - RNA, 4092 nt, synthetic construct
  misc_feature 1..4092: note = Cas9 variant
  source 1..4092: mol_type = other RNA
atgcgcggcaactaccacatcgggctggacataggcacgtcctccatcggttgggccgttatagacgacaacgccaaggtcatgcgggcgaagggcaagaccgccatcggagcacgcctctacaacgagggccagacggcggcagaccggcgcctgttccggaccacgcgccggcgcctgaaccggcgcaagtggcggctcaagctgctagacgagatcttcgacccctacattaccccggtggacgcggccttcttcgcccgcctcaagcagagcaacctgtcccccaaggaccagaaccgggactggacgggcagcatgctgttccccgaccgcactgaccggaagttccacaaggactaccccaccatctatcacctccgtcacaagctgatgaccgaggaccaccagtttgacatccgggagatctacctggccatccatcacatcgtgaagtaccgcgggaacttcctcaacaccaccccggtctcctctttctccgtgagcgacgtgaagttcgacgagcagttcgaccggctgaacgagctgtacgcggccgtctcgcccgacgaacccttcgccatcaacggcgataacagcaaggcaatcgagaccctcctgctgtccgacgagaccaagaagttcgataagcagaagcagagcgccaagctcatcctgtccgagacaggggacaaggcgcttgacaaggagaacaccaaggtggccacccagatcagcaaggccatcctcggctacaagacccagctggacgtgctgctcaagtacgacgccattaactccagcgcctggaagatcgaactggacgacgagaacatcgacgacacgctgcccgggctcctgtcccagctggacgagaatcgccaggagatggtcagcataatccaaaacctctacgcacaggtgaccctgaaccagatcgtgccgaacggcatgtccctgagcgagagcatgattgagaagtacaacgcgcaccgggaccacctcaagctgctgaagcagcttgaggacaagatagacgaccccaaaaagaagaagggcctggaggccgcctacgacgcctacgtcgggaagaacatgaaggtggcgaaccaggacgtgttctacgcctccgtaaagaagaacctggacgacagcgacctcgccaagcagatcgccgacctgatcgaggcccagaagttcatgcccaagcagcgcacctcccagaacggcgtgatcccccaccaactgcaccagctcgagctggaccagatcatcgagaaccagtcaaagtactacccgtggctgaccgcggccaatccgaaccccaagcgcatccaccaggccaagtacaagctcgacgagttggtggccttccggataccctactacgtcgggccgctggttacgcccgaggaacaggagaagtccgcgaaccaggtgttcgcctggatgaagcgcaagcagcccggcaccatcaccccctggaacttcgaccagaaggtcgaccggatggccagcgccaaccgcttcatccggcgcatgaccacgaaggacacgtacctcatcggcgaggacgtgctgcccgacgcctccctgatctacgaacggtttaaggtgctgaatgagctaaacctggtcaaggccaactaccaccgcctggcccccgcccagaagcaggccgcctaccgggatctcttcgagaaccagaaaagcatctccaccaagaagctgcagaactacttagtggaccagggatatttcaccgcgaagcccaagatcacgggcctctcggaccccgagcgcttcaactcaagtctggggacctacatcgactttaaagagatcttcggcgaccaggtcgacaatccggaccggcaggacgactacgagaagatcatcgagtggtccaccgtgttcgaagaccgccagatctacgaggcaaaacttcggaccctcgactggctgacggaagatcagatccaggccctgaagaccaagcgctacaacgggtggggccggctgagcaagaagctgctgactgggatcgtggacgagaacggggagaggatcatcgatgtcttatggaacaccaaccaaaacttcatgcaggtccagtcccaggagagtttcgccaagcggatccacgaggccaacgcgaagcagatgaaggtgacaggcgtggaggacatcctggccgacgcctacaccagcccccagaacaagaaggccatccgacaggtgatccgggtagtcgacgacatccagaaggctatgggcggggtggcccccaccagcgtgtccatcgagttcaccagaagcgaagaccagaacccccgccggacccagagccgcgagtcccagctgcagaacacgttcaaggtcgacgccaaggagatcgtggacagcgacctcgtgaccgagctggagaccgtctccaagagcaaaaaggggctgaccgaccggctctacctgtacttcacacagctgggcaaggacatgtacaccggcgacccgctcaatatcgacgagctttccacctacgatattgaccacatcctaccccaagcgtttatcaaagacgacagcttagacaaccgcgtgctggtgtccaaggccgtcaacaatggaaagtccaataatgtgccagtgaagttgttcggcggtaagatgggagggttctggaaggagctcgcggaccaccggctgatcagcaagcgcaagctgaagcatctccttaccgacccggacacgatcgacaagtacaccatgaggggcttcatccgccggcagctagtcgaaaccagccaggttatcaagctagtggcccagatactgggcgacaagtaccagaacgacgacaccaagatcatcgaggtcacggccaagatgaaccaccaaatgagagagaactttaagctaatcaagaatcgggaggtcaacgactaccaccacgccgtggacgcttatctcaccgcgttcgtcgggcagtacctgtacaagcgctaccccaagctgcggccctacttcgtgtacggcaacttcaagaagttcaacgaggaccacgtgtcattccgctattttaacttcctgcacgagctgatggacgagaacaacaagcgcatcgtcgagcccgagaccggggaggtggtgctggagcgcgagccggccatcgcctacatgaagcgggtctaccacttcaagttcatgcttatcagccaggaggtgtacacccgccgggacgccatgttcaaccagacaatctaccccgccaaggaggcgaaccgccggaagctgatcgccatcaagcacggcaagcccgtggacgtctacggcgggtactccgggagcgtggacgcctacatggccatcgtgcgcatccacgacaagaagggggacaagtacaaggtcgtcggcgtgcccatgcgcgcgctggagatcctcaacgccacccacgacaagaaggactacgatgccaaactgaaacagatcctggtcccgaagttcaccaaggtgaaaaagtcccggaagaccggagagatcacgaagaaggtggaggacttcgagatcgtcctcggcaaagtgatgtaccgccagctggtgatcgacggcgacaagaagttcatggttggaagctccacctacctgtacaacgcccggcaactcgtgctgagcgacagctccctagacaccctcgccagcaaggggaccctggactccgacgcggactcaaagcgattggtggctgtctacgacgagatcgtggagaaggtcgacaagtacttccccttgtatgacaagaacgccttccggtccgggctgcacaaaggccgcgacaagtaccttctcctgcccaatcggagcacgttcaacggggccaagaaggtgcactccggcaagcgcgagatcctgaacgagatcctcaacggcctgcatgccaacgcgaccctagggggcctgaaggacctaaaaatcagcacccccttcgggaagatgcagggccagtccgggatcccgctgagctccaacaccatcatctgctaccagagccccacgggcctctttgagcaccgggtgtccctgaaggatctgtga

SEQ ID NO: 7717 - RNA, 4092 nt, synthetic construct; identical to SEQ ID NO: 1917
  misc_feature 1..4092: note = Cas9 variant
  source 1..4092: mol_type = other RNA

SEQ ID NO: 7718 - RNA, 4092 nt, synthetic construct
  misc_feature 1..4092: note = Cas9 variant
  source 1..4092: mol_type = other RNA
atgaccaagctgggcaagccctacggaatcggcgtggatattggaagcaacagcattgggttcgccgccgtagacgagaacagccacctcatccgcctgaaggggaagaccgtgatcggcgcgcgactgttcgaagagggcaaggccgccgccgaccgccgggcctcacgcacgacccgtcgccggcttagccgcaaccgatggcggctgtcctttctgcgggacttcttcgagagccatatcacaccgaccgaccccaacttctttatgcgacagaagtactccgagatctcccccaaggacaagtcccggtacaagtatgagaagcgcctcttcaacgaccggacggacgcggagttctataagtacgagaactgccccaccatgtaccacttaagaaaccggctgatgaccgacccgagcaaggccgacgtgcgagagatctacttcgccatacaccacatcctgaagtccagggggcactttcttaccccaggcgacgcaaaagacttcaacacgaacaaggtcgcggtgaacaagatcttccccgcactgcaggacgcctacgcccaggtgtaccccgacctggacatcaccttcgacgagaacaaggtcaacgagtttaagaccgtgctgctcaacgagaaggccaccccgtctgacacgcagcgcgcgcttgtgaacctgctgctcgccaaggaaggggaccgggatatactgaagcagcagaagcaggccctgaccgagttcgccaaagccgtcgtcggcctcaagaccaagctgaacgtggcgctggggaccgaggtcgactccagtgaggccacggcctggaacttctccctcggtcagctggacgacaagtggaccggcatcgagagcgcaatgacagacgaggggaccgaaatcctggaccaaatccgcgacctctaccgcgccaggctgctgaacggcatcgttcccgccggaaagaccctctcccaagccaaggtggacgactacgcccaacatcacgaggacctggaactgttcaaagactacctcaagcagctggaggacgacggaaccgcgaaggcaatccgccagctgtacgaccggtacatcgacggcgacgatgcgaagcccttcgtccgagaagactttgtgaaggccctcaccaaggaggtgaccgcccaccccaacgccaagagcccggagttactggagcggctcgcgcagcccgacttcatgctgaagcagcgcaacaaggccaacggggccatccccgtccagatgcaacagcgagagctagaccagatcatcaagaaccagtccgtgtactacgactggctcgccgcgcccaacccggttgagaagcataggaaaagcatgccttaccagctggatgagctgctcaactttcggatcccctactacgtcggccccctggtgacggcgaaggagcagaaggccgcccagggcggggtgttcgcctggatggtccgcaaggatccggacgggaacatcaccccctacaacttcgacgagaaggtggaccgggaggccagtgccaacaccttcatccagcgcatgaagaccactgacacctacctgatcggcgaggacgtactccctaagcagtctctgctgtaccagcggtacgaggtgctgaacgagctcaacaacgtgcgcgtcaacaacgagaagctgagcatcgagcaaaagcaacaggtgatccgggagctgttcgagcgccacaactccgtgacgattaagcagttcgccgagaacctccgggcccacggagactacgcccacatgcccgaaatacgcgggctggccgacgagaagaggttcctgagctccctcagcacctaccgccagttaaagtccctgctcccggaagcgattgacgaccccgccaagcaggccgacatcgagaacatcatcgcctggagcacggtcttcgaggacgcggccatcttcaagactaagttgaaggagatcaactggctagactcccagaccatcaccaagctcagcaatatccgctaccggggatggggtcagttctcccacaagttccttaacggcctgacgctcggcaacggccacacaatcatccaggagctttttctgtcgaacaacaacctcatgcagatcctcacagacgagaccctgcagaagaagatgaccgagctcaacgccgataagctgaaggcagccaacatcaacgatgccatcgatgacgtgtacacgtcccccagcaacaagaaggccctgcgccaggtgctgcgggtaatcgaggacatcaagcgcgccgccgacggccaggacccttcgtggctgtacgtggaaacagccgatgggggcgggaccccgggcaagcggacacgggctcggcagcaccagctgcaggagatctacgcaaatgccgcccacgagctcatcgacagcgccgtgcgcggggaactggaggacaagattgcagacaaggccgacttcaacgatcggctggtcctctacttcatgcagggcggtcgagacatctacaccggcacgcccttaaacatagaccaactgtcctcgtacgacatcgaccacatcctcccccagtccctgatcaaggacaacagcctagacaaccgagtcctcgtgcacgcaatcatcaaccgcgagaagaacgccaccttcgcgagcaccatctacgcccagaagatgaacgccacctggcggcaatggcacgaggccggcttaatctccgggcgcaagctgcgcaacctccagatgcgcccggaccagatcgataagtacgccagcggcttcgtcgcacggcagctggttgagacacgccagatcatcaagctgaccgagcagatcgtagcagcccagtaccctgagaccaagatcatcgctgtaaaggccggcctctcccaccagctgcgggaggagctggagttccccaagaaccgcgacgtgaaccactatcaccacgccttcgacgccttcctcgccgcaagaatcgggacgtaccttctgaagcgcttccccaatctccaggccttcttcacctatggcaagttcaagaaggcggacgtgaaaaagctgagagggttcaacttcattcgggacatcacccatgccgaagacaagatagtcgtgaaggacactggcgaggtgatttgggacaagaagcgcgacgtagacgagcttgatcgcatctacaacttcaagagaatgctcatcacgcacgaggtgcactttgagaaggccgacctgttcaagcagaccgtgtacggggccaaggatagcaaggaggccggtggcaagaagcagttgatctccaagaagaaggggtaccctgtcgacatctacggcgggtacacgcaggagaccgggagctacctctccgtggtgcgcctgacgaagaaggcgatgtacgcggtcgtgaaggtgtccacccgggatgccgccaaactggcggtcgccaagtccattagcgagcagaaggagaacgaaaccctcaacgacatcatcgacgagaagctgtccaagatcagcaaaaacgggaagatcacccacgagctgttcgaggtggtgctcccccgcgtcggccagaaaacgctgttcaagaactccaagtacaacctgttcctcgtgaacagcgacacctacatgcacaactatcaggagctgtggatgccccgcgagtaccagaaaatgtggaaggacataagtctcagcaagtacggcgacgcccagaccgaggaccagctggaccagatcttcggttttatcgtgagccaggtaaacagttatttcaacctgtacgacatcaaccagtttcgtaagaagctgaacgacgccgccgacaagttcgcgaccctccccatgagggacacggacgacatgcagggcaaaatcgccacaatcgggcagctgctgatcggcctacaggccaacgccgcccggtctgacctgcgcaacctggacatcaagaccccgctcgggttgctgcagatccccaacggcatctctctcgacagcgatacctccgtggtgtaccagagccccactggcctgctggagcgggaggtccacctctccgacctgtga

SEQ ID NO: 7719 - RNA, 4092 nt, synthetic construct
  misc_feature 1..4092: note = Cas9 variant
  source 1..4092: mol_type = other RNA
atgaccaagctgaaccagccctacggcattgggctcgacatcggcagcaactccatcgggttcgccgtggtcgacgccaacagccacctccttcgcctcaagggcgagaccgcgatcggggcccggttgttccgcgaggggcagtccgccgccgaccggcgcgagagccgcacgacccgccggaggctgtcccggacccgctggcggctcagcttccttcgcgacttcttcgccccgcacatcaccaagatcgaccccgacttcttcctgcggcagaagtactccgagatcagccccaaagacaaggaccgcttcaagtatgaaaagcgtctgttcaacgaccgcacggacgcggagttctacgaggcctacccctccatgtaccacttacggctgcgcctgatgaccgacgcgagccaggctgacccgcgggagatcttcctggcgattcaccacatcctgaagtcccgcggccatttcctcacccccggggccgccaaggacttcaacaccgacgaggtggacctgaagcacatcttccccgccctggccgaggcgtacgcccaggtgtacccggacctcgagctgaacttcgacagcgccctggccgacgacttcaaggccaagctcctggacgaggacgccaagccgtccgacatccagaaggccctggtcaacctcctgctgagctccgacggcgagaaggagatcgtgaagaaacggaaacaggtcctcacggagttcgccaaggccatcaccggcctgaagaccaagttcaacctggccctcggcaccgaggtggacgaggcggacgccagcaactggcagttctccatggggcagctggacgacaagtggagcaatatcgagacgtccatgaccgaccagggcaccgagatcttcgagcagatccaggagctttaccgcgcccgcctcctgaacggcatcgtgcccgccgggatgagcctgagccaggccaaggtggcggactacggccagcacaaggaggacctcgagctgttcaagacctacatcaagaagctgaacgaccacgagctcgccaagacgatccgggggctgtacgaccgctacatcaacggcgacgacgccaagcccttcctgcgggaggacttcgtcaaggccctcacgaaggaggtgaccgcgcaccccaacgaggtgtccgagcagctgctgaaccgcatgggccaggccaacttcatgctcaagcagaggaccaaagccaacggggccatcccggtccagctgcagcagcgcgagctggaccagatcatcgccaaccagagcaagtactacgactggctcgcgaagcccaaccccgtggagaagcacagggcctccaagccctaccagctggacgagctgctgacgttccgcatcccgtactacgtgggccccctcataacccccaagcagcaggccgagagcggggagaacgtcttcgcctggatggtacggaagaacccctccggcaacatcaccccgtacaacttcgacgagaaggttgaccgcgaggccagcgcgaacaccttcatccagcggatgaagacgaccgacacctacctgatcgacgaggacgtcctgcccaagcagtccctcctgtaccagaagtacgaggtgctgaacgagctcaacaacgtgcgcatcaacaacgaggccctgagcaccgaccagaagcagcggctgatcagagaggtctttgagcggcactccagcgtgaccatcaagcaggtcgccgacaacctcgtggcccacggggacttcgcccaacgccccgagattcggggcctggcggacgagaagcgcttcctgtccagcctctccacctatcaccagctgaaggagatcctgcacggcgcaatcgacgaccccaccaagctccacgacatcgagaacatcatcacctggagcacggtgttcgaggacgccgccatcttcaagaccaagctggcggagatcgactggctggacccggctaccatcaagaagctctccaacatccggtaccgcgggtggggccagttcagccgcaagttactggacgggctcaagctgggcaacgggcataccgtcatccaagagctgatgctctccaaccacaacctgatgcagatcctggccgacgagacgctcaaggagaccatgaccgagctgaaccaggacaagctgaagaccgacgacatcgaggacgtgatcaacgacgcctacaccagcccctccaacaaaaaggccctccgccaggtgctgcgggtcgtggaggacatcaagcacgcggccaacggccaggaccccagctggctgtacatcgagacggcagacggccccgggacagccggcaagcggacccagagccgccagaagcagatccagactgtgtacgccaatgcggcccaggagctcatcgactccgccgtcagaggggagctggaggacaagatcgccgacaaggccagcttcacggaccggctggtgctctacttcatgcagggcggccgggacatctacaccggcgcgccgctgaacatcgaccagctgtcccactacgacattgaccatatcctcccccagagcctgatcaaggacgactccctggacaaccgcgtgctcgtgaacgccaccatcaaccgggagaagaacaacgtgttcgccagcaccctgttcgccggcaagatgaaggcgacgtggcgcaagtggcacgaggccgggctgatatccgggcggaagctccgcaacctgatgctgcgacccgacgagatcgacaagttcgccaaggggttcgtggcacgccaactcgtcgagacccggcagatcatcaagctgaccgaacagatcgccgcggcccagtacccgaacaccaagatcatcgccgtgaaggccggcctgagccaccagctccgcgaggaactggacttccccaagaaccgggacgtgaaccactaccaccacgccttcgacgcgttcctggccgcccgcatcggcacgtacctcctgaagcgataccccaagctgacccccttcttcacctacggggagttcgcaaaggtcgatgtgaagaagttccgcgagttcaacttcatcggcgccttaacccacgcgaagaagaacatcatcgccaaggacacgggggagatcgtgtgggacaaggagagagacatccaggagctggaccgcatctacaacttcaagcgcatgctgatcacccacgaggtgcacttcgacatggccgacctcttcgaccagacgatctacgccgccaaggactccaaggagcggggcgggagcaagaacctgatccagaagaagcagggctacctgaccggcatctacgggggctactccacggagcgtgggagctacgtctccatcatccggaccttcaagaagggcgctccgatctacaacatcgtgaacatcagcaccgccgacgtctccttactgtcagacaagcagcgcgtgtccgaggccagcgccgacgtgctgctcaaagagctgatcaagaagaagctcgcgaagcgcaagtccggggagaacaccaagtccggcgccttcgagatcgtcctcccccgggtgggcaagaacacgctgttcaagaacaagaagtacgggctgttcctcgtagagagcaccaccgagttccacaactaccaggagctgtggctgccccggaacgatcagatgctcatcaagtccatccagagccacaagatcgaggaatcgaaggccgactacgagctgacccgcatgtaccggaacatcgccagccaggtcgaccactactttggcctgtacacgatccgcaagttctccgagaagctcaccgccagcatcaacgactacggcgcgctgcccgtgtacaagagtgagaccaccgacggcaagtacgaggtgctgagcaacctcttcgaggggctgggctccggcacgagcaccgggaacctgaccgccgtcaagctccagccgaacttcggcagggtgtacctgacctccgggatagtgctggaggacgacacgagcatcatctaccagtcccccaccggcctcttcgagcgcagcgtcaagctggccgacctgtga

SEQ ID NO: 7720 - RNA, 4092 nt, synthetic construct
  misc_feature 1..4092: note = Cas9 variant
  source 1..4092: mol_type = other RNA
atgaccaaactgaaccagccctacggcatcgggctcgacatcggcagcaactccatagggttcgcagtggtcgacgccaacagccacctcctgcgcttgaaaggggagacagcgatcggggccaggctgttccgcgaggggcaatccgccgccgaccggcgcggcagccggacgacccgccggcgcctgtcccggacccgctggcggctcagcttcctacgcgatttctttgccccgcacatcaccaagatagaccccgacttctttctccggcagaagtattccgagattagccccaaggataaggatcgctttaaatacgaaaagcggctgttcaacgaccgcacggatgcggagttctacgaggactacccctccatgtaccatctgcggctgcacctaatgacccacacacacaaggccgacccgcgcgagattttcttggccatccaccacatcctaaagtcgagagggcacttcctcacacccggcgcagcgaaggacttcaacacggacaaggtggacctggaggacatcttccccgccctgaccgaggcctacgcccaggtgtaccccgacctcgagttaaccttcgacctggcgaaggccgacgacttcaaagccaagttgctggacgagcaggccaccccgtccgacacgcagaaggccctggtcaacctcctgctgagctcagacggggagaaggagatcgtgaagaagagaaagcaagtcctcaccgagttcgccaaggctataaccggtctgaagaccaagttcaacctggctctcgggacggaggtcgacgaggctgacgccagcaactggcagttctccatgggacagcttgacgataagtggagcaacatcgaaacctccatgaccgaccagggcaccgaaatcttcgaacagatccaggagctgtaccgggctcgcttgctgaacgggatcgtgcccgccggcatgagcctgtctcaggctaaggtggccgactacggccagcacaaggaggacctcgaactgttcaaaacgtaccttaagaagctgaatgaccacgagctggcgaaaaccatacgcggcctgtatgacagatacattaatggggacgacgccaagccctttctccgtgaggatttcgttaaggcactcaccaaggaggtcaccgcccacccaaacgaggtaagcgagcagttgctaaaccggatggggcaggccaactttatgctgaagcagcgcactaaagccaacggcgcgataccgatccaattacaacagagagagctcgaccagatcatcgccaatcagagcaagtattacgactggttggccgcccccaaccccgtcgaagcccaccgttggaagatgccgtaccagttagacgaactgctcaacttccatatcccttattacgtgggtcccctgatcacccctaagcaacaggcggagtccggcgagaacgtgttcgcctggatggtccgcaaggatcccagcgggaacatcaccccgtacaacttcgatgagaaggtggaccgggaggcatccgctaacacctttatccaaagaatgaagactaccgacacctacctaataggggaggacgtgctccccaaacagtctctgctgtaccagaagtacgaggtcctcaacgagctgaacaacgtgcggataaacaacgaatgcctgggaaccgaccagaagcagcgcctcatccgcgaggtgttcgagcggcactccagcgttacgataaagcaagtcgccgacaacctggtggctcacggggacttcgcgcgcaggccggagatccgcggcctggcagacgagaagcggtttctgtccagcctgtctacatatcaccagctaaaggagatcctccacgaggccatcgacgatcccaccaagctgctggacatcgagaacatcataacctggagcaccgtattcgaggaccataccatcttcgagaccaagttagccgaaatcgagtggctggacccgaagaagatcaacgagctgtccggaatccgctaccggggctggggtcaattcagcagaaagctgctggacggcctgaaacttggaaacgggcacaccgttatccaagagcttatgctgtccaaccacaacctcatgcagatcctggcggacgaaacgctgaaggagacgatgaccgagctcaatcaggacaagctgaagaccgacgatatcgaggatgtgatcaatgatgcctacacaagcccctccaacaagaaggccctgcgacaggtgctccgggttgtagaggacatcaaacatgccgcgaacggtcaggatcccagctggctgttcatcgagacggccgacgggacgggcacggccggaaaacgcacccagtcacggcagaagcagatccagacggtgtacgccaacgcagcgcaagagctgatcgatagcgccgtccgcggcgaactcgaagacaaaatcgcagacaaggcctccttcactgaccggttagtcctatacttcatgcagggcgggcgcgacatctacacgggggcgcccctaaacatcgaccagctgagccactacgacatcgaccacatcctgccacaaagcctcattaaggacgactccctggacaaccgggtgctggtgaacgccaccatcaaccgcgagaagaacaacgtcttcgctagcactctgttcgccggaaagatgaaggccacctggcggaagtggcacgaggccggccttataagcggccgcaagctgcggaacctcatgctgcgccccgacgagatcgacaaattcgcgaaggggttcgtggcgcggcagctggttgagacacgccagatcatcaaactcaccgagcagatcgccgccgcccagtaccccaacacgaagattatcgctgtcaaggccggcctgagccaccagctgcgggaggagctcgacttcccgaagaaccgcgacgtcaaccactaccaccacgcctttgacgccttccttgcggcgcggatcggtacctacctgttgaagcgctaccccaaactggcaccctttttcacctacggcgagtttgccaaggtagacgtcaaaaagttccgggagttcaacttcatcggggccctgacccatgcgaagaagaacatcatcgccaaggacacgggcgagattgtctgggataaagagcgcgacatccgggagctcgaccgcatctacaacttcaagcgcatgttgatcacccacgaggtgtacttcgagaccgccgatctgtttaagcaaaccatttatgcagccaaagactccaaagagcggggcgggagcaagcagctcatccctaagaaacaggggtacccgacacaggtctacggcgggtacacccaagaatccgggtcctataacgcgctggtgagggtggccgaggccgatacgaccgcctaccaggtcataaagatctccgcccagaacgcatcaaagatcgcctccgccaacctcaagagcagagagaaggggaagcagctactaaacgagatcgtggttaagcagttagcaaagcgccggaagaactggaaaccctccgcgaacagcttcaagatcgtcatcccccgcttcggcatggggacgcttttccagaatgccaagtacggcctgtttatggtgaacagcgacacctattacagaaactaccaggagctgtggctcagccgcgagaaccaaaagctgctgaagaagctgttctccatcaaatacgagaagacccagatgaaccacgacgccctgcaagtgtacaaggccatcatcgatcaggtcgagaagttcttcaagctgtacgacatcaaccagttccgggccaagctgagcgatgcgatcgagcgcttcgagaagttaccgatcaacaccgacgggaacaagattggaaagacggagaccttgcggcagatcctcatcgggctgcaggccaacggcacccgcagcaatgttaagaacctgggcatcaagaccgacctcgggctgttacaagttggctcagggatcaagctggacaaggacacgcagatcgtttaccaaagcccgtccggcctgttcaagcggcgtatacccctggccgacctctga

SEQ ID NO: 7721 - RNA, 4095 nt, synthetic construct
  misc_feature 1..4095: note = Cas9 variant
  source 1..4095: mol_type = other RNA
atgggcgacaggaagtataacctggggttggacatcgggacgagctccatcggatttgccgccgtggacgaaaacaaccagccaatccgggttaagggcaagaccgcgatcggggtgcgcctgttcgaggagggcaagacagccgccgaccggagaggcttccggaccactcgccggcgcctgtcccggcggcggtggcgcatcaatctgctgaacgagatattcgacgcacacctggccgaggttgaccccaccttcctcgcgcggctgaaggaatccaacaggtcaaacctggatcccaaaaagtcctttcagggatcgctcctgttcccggagcgaaaagactaccagttctatgaggaataccccacgatctaccaccttcgcaaagccctgatggagaaagatcggaagttcgacttccgcgagatctatcttgccgtccatcacatcatcaagtatcgtggcaacttcctgaacgggaccccgatgcgctccttcaaggtggagaacatcgagctggacaccctgttcgaccagctaaaccagctgtacgcggagatagtgcccgacaacgaactggctttcgatctggcccaggtggccgacgtgaaagatgtcctcagctccaccaccatctacaagatggacaagaagaagcagctggtgaagatgatgctgctccccgccagcaacaaggccctacagtccgagaataagaagatcgtcacacaattcgtgaacgcgatcctgaactacaagttcaagctcgacgtcttattgcaagtggaaaccgacgcagactggagcctgaagctgaacgacgagggtgccgacgataaactggaggagttcaccggggacctcgacgagaaccggctggagatcatagacctactccagcgcttgcacaactggttctctctaaatgagatcacgaaggacggcaatagcctctccgccgccatggtggaaaagtacgagaatcaccatcaccacctgggccttctcaagaaagtcatagagaatcaccccgacgcgaagaaggccaaagcactgaaggagacctacaccgcctacgtgggtaagacagacgataagacacagaaccaggacgacttctacaaggccgtggagaagaacctggacgacagcccagacgcgaaggagattaagcgcctcatccagctggaccagttcatgcccaagcagcggaccggccagaacggggcaatcccccaccagctccaccagcaggagctcgaccagatcattgaaaagcagtccaagtactaccccttcctggccgagccgaatcccaatgtcaaacgccggaaggatgcgccgtataagctggacgagttaatcgctttcaagatcccctactacgtgggcccgctcgtgaccccggaggagcaggcgcagaacggcgagaacgtgtttgcctggatgaagcgcaaggccgccgggcccatcaccccctggaacttcgacgagaaggtggaccggatggagagcgcaaatcgcttcatccgtcgcatgacgactaaggacacctacctgttcggcgaggacgtcctgccggccgaatcaatgatctaccagaagttcgtagtgctcaacgagctgaacaacttaaagatcaacgggcggcacctctccctgaaggacaagcaagacgtctacaacgatctgtttaagcagcagaagaccgttagcatcaaggccctccaaaattactacgtgacgaagaagaaagccgccaccgcgcccaccgtcggcgggctggccgatcccaagaagttcctgtccagtctctccacgtacatcgactttaagaacatgtttggcgagcgtgtaaacgatccccagtttcaggaggacctggaacagattgtggagtggtcgacgatcttcgaagacagaggcatctttaaggcgaaattgcaggccctcgggtggctgtccgaaaagcagatccaacagcttgtcgccaagcgctataagggctgggggcggctcagcaaaaagctgctgaccggcctcaagaacgcggaagggtactcaatcctggatgagatgtggcgcagtaccggcaactttatgcaaatccaaagtcggccggagttcgccgccctgatacaacaggccaacgaaaagcagttcgaaggcaacgaccccgacaacgtgtgggaaaacatcgagaacatcctcggagacgcctacaccagcccccagaacaaaaaggcgatacgccaggtggtcaaggtggtgcaggatatcgagaaggccgtcggcaaccctcccgagaagatcgccatcgagtttacgcgagaggctgcggccaacccccaacgcactcaatcccggctgcgcaccctggaaaagttgtacgagagcgccgaggaggtcgttgacgctgggctgaccgccgagctggcggagttcaaggaaaacaaacacgttctctccgataagtactacctgtacttcacgcagctgggacgcgacgtgtacacaggggacaccatcagtctggacaagctgaacgactacgacgtagaccacatcctgccccaatccttcatcaaggacgactctctcgacaaccgcgtcctgacaataagagcagtgaacaacggaaaaagcgacaacgtgcccgctaagatgttcggcaagaagatggggtcattctggcggtacctactcgacaacggcatgatctccaagcgcaaatacaacaacctgataaccgaccccgacaacatcagcaagtatgcgcagaagggcttcatcaaccgacagctggtcgagacgtcccaggtcatcaaattgaccgccaatatcctgaatggaatttacgacaaggacacggagatcatagaggtgcccgcgaagatgaacagtcaaatgcgcaagatgttcgacctggtcaaggtgagggaggtaaacgactaccaccacgcgttcgatgcctacctcaccatcttcatcggaaactacctgtacaagtgctaccccaagctgcaaccgtacttcgtctatgacaacttcaagaaattcgggaacaaagaggatatcggtcacaagcgcttcaactttctcgggaagatcgagcgggagaagaaagtggtggccccggagacgggcgaaatcctctggagtaatgtcgcccccaacgagaccatcaagcaaatcaagaaagtgtacgactacaagttcatgatagtatcccgcgagatcaccacccggcgcgcggagctattcaaccagacagtctaccccaagaactatcacgggaagctcattccgatcaaggaggaccgacccaccgacctgtatggcggatacagcgggaacaccgacgcctacctggccatcgtggccctagaggacaaaaagaagggcaagtacttcaaggtggtcgggatccccacccgcgttgcggcaaagctggagaagctgaagcagcaggactcccagcagtacctccaggccctccacaaggtgatagcgccccagttcaccaagtcgacgaagaaaggcatcaaaaagaccgagttcgagatcgtcctggacaaggtgcactaccggcagctggtgcaggatgggccggtcaagatgatgctgggctcaagtacctacaagtacaatgcaaagcaactggtgctctccgagaaggcccttcaggtgatcgccgacgaccgcaagttcgatgaaacacagaaggatgacaatctgatcgccgtctacgacgagatactgtctatcgtcaatcaatctttcgacttgtacgacatcaatggctttcggaagaagctaaacgacaatcgcgaccagtttatagatttgcccgccgagaccaagtacgagggacggaaggtggtagcccacggcaagcgcgagatgatcctcgagatcctgaaggggctccacgcgaacgccgccttcggtaacctgaagcccatcgggttctccactgcgttcggccaactccaggtgcccaacggcattatcctgtccaaaaacgccatcctgattcaccagagcccgtccgggctgtttgagcggaagatcaagctcagcgacctgtga

SEQ ID NO: 7722 - RNA, 4095 nt, synthetic construct; identical to SEQ ID NO: 1922
  misc_feature 1..4095: note = Cas9 variant
  source 1..4095: mol_type = other RNA

SEQ ID NO: 7723 - RNA, 4095 nt, synthetic construct
  misc_feature 1..4095: note = Cas9 variant
  source 1..4095: mol_type = other RNA
atgaacaagcgctacaacatcggcctggacatcgggaccaacagtatcggttggagtgtggtaaacgaccagagccagctcgtgcgcattaaggggaagctaggctacggtgttcgcttatatgacgagggccaaaccgctgaggaccggcgcctcttccggacgacccgccggcgcctgaagcgccgcaagtggcggctgggcctcctgcgcgagattttcgagccttacatcacgccccaagacgccaccttcttcctgcggcagaagcagtccaacctcagccccaaagacctgcagaagcagcagcctcaaattgggcttttcaacgaccgactcgactcggacttccactaccagtaccccacgatctaccatctccgatacgcgctgatgactgagaaacgccagttcgacctccgggagatctacctggccatgcaccacatcgtcaagtaccgaggccacttcctgaacgcagccgccgcgagctccttcaagtcgggtgagattgacctcgccaaggacttcgccgccctaaaccagatcttcggcaccatcttttccgaggtggggttctctctgtcggagtctaacttggacgagatcaagtccatcctgctagacaacaacctcagcgcgtccgtgcggcaacggaaggccctgccgctaatatatcagaccgcagccagcaaggactccgagaaacagtacaaggccatcgcgacggagctccttaaggccatcctgggcctcaaggcaaagttcaacctgatcaccggcattgaggtcgaggacgtgaaagcctggaccctgagcttcaacgccgaggacttcgacgcgaagctctccgacctgaacatcgccgacaacgacgatgctgtgcagatcatcgagatcctgcgggcgctctattctggggtcctgctgaccggaatagtgccggaggggcagagcatttcccaggccatgatcgacaagtacgaggcgcacaaagcccaccttatcatgctgcgcagcatccgtgaacaactgtccgacaaggagaataaggcgctcgagaaggcctacgacgactacatcgaccaccccgaggacaagcagcacggcagccgtgaggacttttacgccgcgatcacgaaggtgctgaagaaggattcagaggacaccaacatcatcgagatcctgaagctcatagagctcgaccagttcatgccgaagcagcgcacaaaggacaacggcgccatcccgcatcagcttcatcagcaagagctcgaccaaatcatagagaaccagaagcagtactacccctggctcgcagacatcaaccccaacgagcagcggcagaaaatggccccctacaagctggacgagctggtcacctttcgcgtgccgtactacgtcgggcccatgatcacggcggaggagcagttccagaccagcaacaagaagttcgcctggatgatccggaaggagccaggcgccataaccccctggaactttgaccagaaggtcgaccgccaggcctccgccaacgagtttatcaaacggatgaccacgaccgacacctacctcctagcggaggacgtgctgccgaaacagagcttactgtaccagcgcttcgaggtgctgaacgagctcaacggtatcaagattgacgaccagcccatcacagtcgagcagaagcaagctatcttcaacgacaagttcatgcagcaggcacacgttacagtcaaaaacatccaggcctacctggtatccgagggccagtacgcaagccgaccaaacatcaccgggctgtctgatggcgagaagttcaactccagtttaagcacctaccatgatcttaagaagatcttcggcgacatgatcgacgaccccaacaagcagaccgactttgagaagatgatcgagtggagtacgatcttcgaggacgggaaaatcttcgctgataagctgcgcgagatcaactggctaaccgacgagcagcggcagcgcctgagcaacaagcggtaccgcggctggggacagctatccaccaagctcctgaccaagatcgtggaccagaacggccagcggatcatcgacatcctgtggaacactaatgacaatttcatgcgcatcatccacagcgacgacttcgaccaggccgtgacccaggccaaccagatgctcctggccgacaacgacacgcaagacgtcatcaacgagctgtacacctccccgagcaacaagaaagccctccggcagatccttctcgtcgttgctgacatccagaaggcaatgaaggggcaggcccccgcccgcatcctcatcgagttcgcgagagagaaacaggccaacccccgcctgagcacgcagcgccggcgccaggtggagcaggtctaccaggagctgaacaacgaccagctcaacaaagagctggcagacccccagtacgccaacctgtccaaagaccggctgttcctgtacttcatgcagggcggccgcgacatgtacacgggggagagcctgaacatcgaccggctcagcgagtacgacatcgaccatattctgccgcaggccttcatcaaggacaactctctggacaaccgcgtgttagtgtccgcgaagatgaaccggtcgaagtccgaccacgtgcccctggacttcaccgaggagcgcttcggccagaagatgaggtcacagtgggagcagatgctccgcgccgggctcctgacccggcgcaaatacaacaacctgaccctcaaccccgactccctcaacaagtacacgatgagcggatttatcaaccgccagctggtcgagaccagacaggtgatcaagctcgccaccaacctgctggtagaccagtacgccgacgaggacgtccaactcgtgaccgtcaagtccgggctgacgcaccagatgagagaggacttcgacttcccgaaaaaccgcaacctgaacaactaccaccacgcttttgatgcctacctcaccgcctttgtcggcctgtacctcctcaagaagtacccaaaactagcccactacttcgtgtacggccagtaccagcaggggttcaaggccaacgaccagtggcggaacttcaacttcctgaatggcctccgccaggagcaacaggtcgacgccgagaccggggagctgatctggcagaaggaccacgacctggcctacatgaacaagatctacgacttcaagaagatcttggtgaccagggaggtccacacgaaccacggcgcgctctacaaccagacgctgtacaaagccaaggacgacaaggcatctggtcagggcgggagacagctaatcgccgccaaggagaaccggcccaccgccatctatggcggctactccgggaagaccgtggcatacatgtgcctggtccgcatcacagaaaagaagggtgacttctaccgcatctgcggtgttcagaccgcctgggtggatgagctggaacacatcgaagacgcaaccatcaagctccagcggctgaccgccctgctcacgccccagttcagcgccaccaagaagcagaaggacgaggtagtgaccgtggtcaagccgttcgaagtactgctgccgaagatcctcatcaaccagcggttttatgacgggggccaggagctgaccctggcgtccgccacgtacaagaacaacgcgcaggagttggtgctggacaagaaggccgtccaggtgctgaacgggcagctccccaaggccgagctggaggcccaagccaccgtggtctatgaccaaatcctggagcgggtacagaagtatttccccctctacgacatgaactcattccgcgagaagctgttcgtgggccgggacaagttcaacgagttgccgtggcaggaccagtgggagaaccacaagctcatacaggtgggacagaagacaatcttggaccgcatcctgatcggcctccacgcgaacgctgctatgggcgaccttaaggccctgaacatgtccacccccttcgggaagctccaaaagtccaacggcatcagcttaagccccgagacgcagatcatctaccagtcgcccaccgggctgttcgaaaggcgcgtggcgcttaaggacttatga

SEQ ID NO: 7724 - RNA, 4095 nt, synthetic construct; identical to SEQ ID NO: 1924
  misc_feature 1..4095: note = Cas9 variant
  source 1..4095: mol_type = other RNA

SEQ ID NO: 7725 - RNA, 4098 nt, synthetic construct
  misc_feature 1..4098: note = Cas9 variant
  source 1..4098: mol_type = other RNA
atgtacaagaaggactacaccgtgggcctggacatcgggagcacctccgtcggcttcgccgccatcgacgacgactaccagcccatccgcctcaaggggaagcgggtgatcggcgtgcggctgttcgaggaggggaagacggcggccgagcggcgcaacttccggaccacccgccggcgcctgaaccggcgaaagtggcggctcagcctgctggaggagatcttcgacccgtacatggcgaaggtcgacccgaccttcttcgcccgcctcaagcagtccaacctgttcccaaaggacaagaacaagaagttcacgggcagcctcctcttccccaagaccaccgactccaagttctacgatgaatacccgaccatctaccacctccggtaccacctgatgaacgacagccgcaagttcgacctccgggagatcttcctggccatccaccacatcgtgaagtaccgcggcaacttcctgaactccgcgcccatcgccagcttttccacggacaagatcaacctcgtggacgacttcgagaccgtcaacgccgcctacctgcagatcaacagctccaaccccgtgcagctggacaccgaccaggcggaccaggtgagccggatcctcctggacaataagctgtccaacctcgacaagcagaagcaggccgccaaggccctggcccagaagtccggggacaagaagcaggacaagatcaacaacaccactatcaaacagatctgcaaagcgttgctcggctacaagttcgacctggccgtcgtgctgaacatcgacagcgacgaccacaacaagtggaagctccagctgagcgacgagaacatcgactcccgcctcgccgagctcaccggggagctgaacgaggcccagctggacatcctcaatgtgctgagccggctgtactcccagatcacactcaacgacatcgtccccagcggcatgaccctgagcgaggccatgatcgagaagtacaaggcgcacaagaagcacctgaagatgctgaaggacttcgcccgctcgctgtctaagaaagactatggccaagtgatggaggcctacgccgagtacatcgggaacatcccggagtccgccagctccaaggcgcagaagaagatcagccaggacgacttctacaagaagatcaagcggtacctggacgactccaagctcggccagaagatcgccgagctgatcgccaagaacgagttcatgcccaaacagcgcacgaatcaaaacggggtgatcccctaccagctgcacctcaaggagctgaaccagatcatcgagaaccagagcaagtactacccctggctggccgagctcaacccgaacgagaagcgccggggaaaggccaaatacaagctgtccgagctggtcgcgttccgcatcccctattacgttgggcccctgatcacgcaggaggagcagcagaagaccagcaacgccaacttcgcctggatgatccgtaagtcggagggccgcatcaccccctggaacttcgacgagaaggtggaccgtatcgccacggcgaaccgcttcatcaagcggatgaccaccaaggacacctacttgatcggcgaggacgtcctgccggcccactcactcctctacgagcgcttcaaggtgctgaacgagctgaacatgatccgggtgaacaaccaccgactctccgtcgggcagaagcaagacgtgttcgagaagctgttccagaagcacaagacggtgaagacccgggagctgatcaagcagctcatggccagcggcctacccacccagccccgcatcacggggctgtccgatcccgccaagttcaacacgagcctcggcacctacaacaacttcgccaagatcctgggggacgagatcaaccagccggaccggcaggaggacttcgagaagattatcgagtggatcaccatcttcgacgacaaggacatcctgaagaccaagctctccgagctgagctggctggacgagaagcagatcaacgcgctcatcaacaagaactactccggctggggccgcctgagccggaagctgttaacggagctgaccaacaagaaggggcagagcatcatcgaccgcatgtggaacacccagaagtcctttattgaaatcatcaacgagcccgtcttcgccgagcagatcaaggacgccaaccaggaccagctggacgaggacgactacgagaccgtgctccacgacgcctacacgagcccccagaacaagaaggccatccggcaggtcatcaaggtggtcgacgacatcgtcagggcggccggccgggcccccaagttcatttccctggagttcgcccgcgaggaccaggagagccgccggacccagtcccgcctgagccggatcaagaagatctacgagaccaccaccaaggagctcgtggccaacgaccagatccgggaggagctggggaatgtgaaggacctgaacgaccggctgttcctgtacttcacgcagctgggccgcgacgcatacacaggggagcggatcaacatcgacgacatctccaccaagtacgacatcgaccacatattcccgcgcgccttcatcaaggacgacagcctcgacaacaaggtcctggtgaagagagccgtgaacaacggcaagtccaacaacgtccccctgaagctgttcggcgccaagatgaaacccatctggaagatgtggaaggaccaccagctgatcagcaagcgcaagtacgagcacctgatgaccaaccccgatgcgatcgacaagtacaaggccaacgggttcatcaaccggcagctcattgagacgcgccagatcatcaagctcgctgccaacatcctggccaaccggtactccaccgaggacaccaaaatcatcgaggtgaaggcgaacctcaaccaccagctgcgccagagcctgcacctctacaagaaccgccaggtgaacgactaccaccacgccgttgacggctacctctccgccttcgtggggcagtacctgtaccatcggtacccgagcctccagtcctacttcgtgtacggccagtaccagcggttcttcgacaagcaggtccaggagaacatgaaattcaaccgcttcaacttcctgtacgacctgaccgaccgggacaacgaccagatcgtggtcaagagcacgggggagatcgtgggcgagaagtccaagctcatcgagcagatcaagtgggtgtacagatacaaattcatgctggtgagccaggaggtcttcaccaagaccggccccctgttcgaccagaccatctaccccgccgggagcaacaagtcccggctcatcccgatcaagaaggaccgccccacggacatctacggcgggtacagctccagcaccgacgcctacatgtccctgatacgcgtgccggacaagaaggaggacaagtacaaggtggtcggcgtgcccagccggtccctggcgagcctcaaccgcgccgagaaacggggccacgacgcctatctggaccaactgcgtcaggtgatcgccaagtctcagaagaaggagttccagatcatcatcccgaagctcaggtaccgccagctgatcatcgacgggggcctgaagtacaccctcgggagctccgcctaccagtataacgcgcggcagctggtcctgagcgagaagtccatggaggtgctagtgaccgacttcagcaaggtcacgaccgacttggacaagcagaaccagaagctgatcgccgtgtacgacgacatcctcgacaaagtgaaccgctgcctgcccctctacgacaagaaccagttccggaaggccctcaacggcgcccgcgacaagttcgtccagctgcccatcctgcccaagttcaacgggaacaagaaggaggaggcgggcaaggtggagatcctcaacgagatcctgttaggcctccacgacgacgcctccaccgggaacctgaagccgctgggcatcaagacccccttcgggatgctccagacgcagagcggcatcaccatgtcgagcaacgccgtgatcgtcaaccagtcccccaccgggctgttcgagcaccggatctacctgaaggccctcctgaacaagctgaacaagtga

SEQ ID NO: 7726 - RNA, 4098 nt, synthetic construct
  misc_feature 1..4098: note = Cas9 variant
  source 1..4098: mol_type = other RNA
atgaccaagctaaatcagccctacggcatcgggttagacatcggcagcaactccatagggttcgccgtagtcgacgccaatagccacttactgcgcctaaagggcgagaccgcgatcggtgcccggctgttccgcgagggccagagtgcagccgaccgacgcggcagcagaacgacccgccggcgcctgtcccggacccggtggcggctcagctttctgcgcgacttcttcgccccgcacataaccaagatcgaccccgacttcttcttgcggcagaagtactctgagatcagccccaaggataaggataggttcaagtacgagaaacggctgtttaacgaccgcacggacgcggagttctacgaggactacccctccatgtaccatctacggctgcacctaatgacccacacccacaaggccgatccgagggaaatcttcctggccatccaccatatcctcaagagccggggacacttcctgacccccggcgccgcaaaggacttcaatacggacaaggtggacctggaggacatcttccccgccctgaccgaggcctacgcccaggtgtacccggacctcgaactaaccttcgacctcgccaaggcggacgacttcaaggctaagctcctcgacgagcaggccaccccgtctgacacgcagaaggccctggtcaagctcttgctgagcagcgacggggagaaggagatcgttaagaagcgcaagcaggtcctcaccgagttcgcgaaggcgatcaccggcctgaagaccaagtttaacctggccctcggcacggaggtggatgaggccgacgccagcaattggcagttctccatgggccagctggacgacaagtggagcaacatcgagacctccatgaccgaccaggggactgagatcttcgagcagatccaggagttgtacagagcccgcctcttaaacgggatcgtgccggccggcatgagcctgtcccaggccaaggtagccgactatgggcagcacaaggaggacctcgagttgttcaagacgtacctgaagaagctcaacgaccacgagctggccaagaccattcgcggcctgtacgaccgctacatcaacggtgacgatgccaagcccttcctccgcgaggacttcgtcaaggccctgaccaaggaggtgaccgcccaccccaacgaagtcagcgagcagctgctcaaccggatgggacaggccaactttatgctgaagcagcgcacaaaggccaatggcgctatcccggtgcagctgcagcagcgggagctcgaccagatcatcgccaaccagagcaagtactacgactggctggccaagcccaaccccgtggagaagcaccgcgcctccaagccctatcagctggacgagctgctcacctttcggatcccgtactacgttggtcccctgatcacccccaagcagcaggccgagagcggagagaacgtcttcgcgtggatggtgcgcaagaacccctccgggaatatcaccccatataacttcgacgagaaagtggacagagaggccagcgccaacacgttcatccagcgcatgaagaccaccgacacctacctgatcgatgaggacgttctcccgaagcagtccctgctgtaccaaaagtacgaggtgctcaacgaactgaacaacgtccggatcaataacgaggccctgagcacggaccagaaacagcgcctcatccacgaggtcttcgagcgacactccagcgtgacgatcaaacaggtggtggacaatctggtggcccacggcgactttgcgcagcgccctgagatccggggcctggccgacgagaagcgattcttgtcgagcctatccacgtaccaccagctgaaggagatcctccacggggccatcgacgatagcacgaagctgcacgacatcgagaacatcatcacgtggtccaccgtcttcgaggatgccgccatattcaaaaccaagctggctgagatcgattggctcgacccggccaccatcaagaagctgtctaacatccggtatcgcggctgggggcaattctcccggaagctactcgacggcctgaagttagggaacggccataccgtgatacaggagctcatgttgagcaaccacaacctgatgcagatcctcgccgacgagacgctgaaggagaccatgaccgagctgaatcaggacaaactaaagaccgacgatatcgaagacgtgatcaacgacgcctacacttccccgtcgaacaagaaggcgctgcgccaagtcctgcgcgtggtggaggatatcaagcacgccgccaatggccaggacccctcctggctctacatcgagaccgccgacgggaccggcaccgccgggaagcggacgcagtcaagacaaaagcaaattcagaccgtttacgcgaacgccgcccaggaactgatagacagcgccgtgcgcggggagctggaagacaagatcgccgacaaggcgtccttcaccgaccggctcgtgctgtacttcatgcagggcgggcgcgacatctacaccggcgcgcccctgaacatagaccagctgagccactacgacatcgaccacattttgccccagtccctgatcaaggacgactcattggataaccgcgtcctggtgaacgccacaattaaccgggagaagaacaatgtatttgcctccaccctgttcgccagcaagatggccgccacctggcgcaaatggcacgaggccgggctcatcagcggccggaaactgcgcaacctgatgctccggccggacgagaccgacaagttcgcccacgggttcgtagcgcgccagcttgtggagacgcggcaaatcatcaagctgacggagcaaatcgccgccgcccagtaccccaacaccaagatcatcgccgttaaggccggtctcagccaccagctgcgcgaggagctggacttccccaaaaaccgggatgtcaaccactatcaccatgcctttgatgccttcctcgccgcccgcatcggcacctatctgctcaagcggtacccgaaactcgcacccttcttcacgtacggggaatttgcaaaagtggacgtgaagaagttccgcgagttcaacttcatcggcgccctgacgcacgccaagaagaacatcatcgccaaggacaccggggagatcgtttgggacaaggagcgggacatccaggaactggaccgcatctacaacttcaagcggatgctcatcacccacgaggttcacttcgagaccgcagacctgttcgaccagactatctacgccgccaaggactccaaggagcgcggcggaaggatgagcctgatacccaagaaactcggctacctgaccggcatctacgggggctaccaaacggagcgggggtcctacgtgagtattattcgcacgttcaagaagggagagaccatctacaaggtcgtgaacatcctgaccgccgacgtgtccctcctgagcgagaaggagaaggtctctaagaccctggccgacatttacctcaaggagcttatcgcgaagaagctgagcaaggggaagtcaggcaagaatatcgccagcgagcccttcgagatcgtgctcccgcgggtgggcaaggacagcctgttcaagaacaagaagtacggactgtttttgatcgagtccgccactgagctgcacaactaccaggagctgtggctcccccgcaacgaccagctgctgatcaagcggatccaggcccgccagatcgaggagtcaaaggcggactatgagctcacacggatgtaccgcaacatcgcatggcaggtagatcactatttcagactgtacaaaatacgcaagttcgccgagaagctgcaggccagcgtcgaggacttcgctggcctcccagtgtacaagaacgagacctcagacgggaaggtagaggtgctggcgtccgtgctgaagcggctcaacggcgccgccgacaaggggcgcaccaaccccacgaccgtcaagctgcagtcagacttcggccggaccttgctcaccaatggcatcgtgctggaagacgactccagcatcgtgtaccagtccccgaccgggctgtttaagcgcagcgttaagctcgtggacctgtga

SEQ ID NO: 7727 - RNA, 4098 nt, synthetic construct
  misc_feature 1..4098: note = Cas9 variant
  source 1..4098: mol_type = other RNA
atgactaaggagtactaccttggcctcgacgtggggaccaacagcgtcggctgggccgtgacggactcccagtacaacctgtgcaagttcaagaagaaggacatgtgggggatccgcctgttcgagagcgccaacaccgccaaggatcggcgcctgcagcggggcaaccgccggcgcctagagcggaagaagcagcgcatagacctgctccaggaaatcttctcccccgaaatctgcaagatcgacccgaccttcttcatccggctgaacgagagccgcctgcacctcgaggacaagtcaaacgacttcaagtaccccctattcatcgagaaggactacagcgacatcgagtactacaaggagttccccacaatcttccacctccggaagcacctcatcgagtccgaggagaagcaggacatccgcctgatctacctggccctccacaacatcatcaagacacggggacactttctgattgacggcgacctgcagagcgccaagcagctccgccccatcctggacaccttcctgctctccttgcaagaggagcagaacctgtcggtgtccctcagcgagaatcagaaggacgagtacgaggagatcctgaagaatcggtccatcgccaagagcgaaaaggtcaagaagctgaagaacctcttcgagatctccgacgagctggagaaggaggagaagaaggcccagagcgcggtcatagaaaacttctgcaaattcatcgtgggcaacaaaggggacgtctgcaagttcctgcgcgtgtccaaagaagagttggagattgacagcttctccttctccgagggaaagtacgaggacgatatcgtgaagaatctggaggagaaggtcccagagaaagtgtaccttttcgagcaaatgaaggccatgtacgactggaacatactggtggacatcctggagacagaagagtacatcagcttcgccaaggtaaagcagtacgagaagcacaaaaccaacctgcggctcctgcgcgacatcatcctgaagtactgcacgaaggacgagtacaaccgcatgttcaacgacgagaaggaggccgggtcctacaccgcgtacgtggggaagttaaagaagaacaacaagaagtattggattgagaagaaaaggaatcccgaagagttctacaagagcctggggaagctgctcgacaagatcgaacccctgaaggaggacctggaggtgctaacaatgatgatcgaggagtgcaagaaccacaccctgctccccatccagaagaacaaggacaacggcgtcatcccgcaccaggtgcacgaggtggagctcaagaagatcctggagaatgccaagaagtactactccttcctgacggagaccgacaaggacggctactccgtcgtgcagaagatcgagtccatcttccggttccgcatcccctactacgtggggcccctgagcacccgccaccaggagaagggctccaacgtctggatggtgcggaagcccggaagggaggaccggatctacccgtggaacatggaggagatcatcgacttcgagaagtctaacgagaactttatcacccgcatgacgaacaagtgcacctacctcatcggcgaggacgtgttgcccaagcacagcctgctctacagcaagtacatggtcctaaatgagctgaacaacgtgaaggtacgtggcaagaagctccccacctccctgaagcagaaggtgttcgaggacctgttcgagaacaagagcaaggtgaccgggaagaacctcctggagtacctgcagatccaggacaaggacatccagatcgacgacctctccggcttcgacaaggacttcaagacgtccctgaagtcctacctggacttcaagaaacagatcttcggggaggaaatagagaaggagagcatacagaacatgatagaggacatcatcaagtggatcaccatctacggcaatgacaaggagatgctcaagcgcgtcatccgggccaactactccaaccagctgaccgaggaacagatgaaaaagatcaccgggttccagtacagcggctggggcaatttctccaagatgttcctgaaggggatcagcggcagcgacgtgtccacaggggagaccttcgacatcatcaccgccatgtgggagaccgacaacaatctcatgcagatcctgagcaagaagttcacattcatggacaacgtggaggatttcaactccggcaaggtcgggaagatcgataagatcacctacgacagcaccgtgaaggaaatgttcctgtcccccgagaacaagcgcgccgtgtggcagaccatccaggtcgcggaggagatcaagaaggtgatgggatgcgagccgaagaagatcttcatcgagatggcccggggcggggagaaggtgaagaagcgcaccaagtcacggaaggcccagctcctggagctctacgccgcctgcgaggaggactgccgcgagctcatcaaggagatcgaggaccgggacgaacgcgacttcaactccatgaagctgttcctgtactacacgcagttcggcaagtgcatgtactcaggggacgacatcgacatcaacgagctcatccggggcaactccaagtgggaccgcgaccacatctacccccagagcaagatcaaggatgactccatcgacaacctggtcctggtgaacaagacctacaacgcgaagaagtccaacgagctcctgtcggaggacatccagaagaagatgcacagtttctggctgtccctcctgaacaagaagctgatcaccaagagcaagtacgaccggttaacgcggaagggggacttcaccgacgaggagctgtctggcttcatcgcccggcagctggtggagacccgccagagcaccaaagccatcgccgacatattcaagcagatctacagctccgaggtagtatacgtcaagagctccctcgtcagcgacttccgcaagaagcccttaaattacctgaagtcgcggcgcgtgaacgactaccaccacgccaaggacgcgtacctcaacatcgtggtaggcaacgtgtacaacaagaagttcactagcaaccccatccagtggatgaagaagaaccgggacacgaactactccctgaacaaggtgttcgagcacgacgtcgtgatcaacggggaggttatctgggagaagtgcacctaccacgaggacaccaacacctacgacggcgggacactggaccgcatccggaagatcgtcgagcgcgacaacatcctctacaccgagtacgcctactgcgagaagggcgagctgttcaatgccaccatccagaacaagaacggtaacagcaccgtgtccctgaaaaagggattagacgtcaagaagtacggcggctactttagcgccaacacgtcctacttcagcctgatcgagttcgaggacaagaagggcgaccgggcccgacacatcatcggggtcccgatctacatcgcgaacatgttggagcattcccccagcgccttcctcgagtactgcgagcagaaaggataccagaacgtgcggatcctggtggagaagatcaaaaagaactccctgctcatcatcaacggctaccccctgcgcatccgcggcgagaacgaagtcgacaccagcttcaagcgggcgatccagctgaagctcgatcagaagaactacgaactggtgcggaacatcgaaaagttcctggagaaatatgtggagaagaaaggcaactaccccatcgacgagaaccgcgaccacatcacccacgaaaagatgaaccagctctacgaggtcctcctgtccaagatgaagaagttcaacaagaaggggatggccgatccgagcgacagaatcgaaaagtccaagcccaagttcatcaagctcgaggacctgatcgacaagatcaacgtgatcaacaagatgctgaacctcctgcgctgcgacaacgacaccaaggcggacctgagcctcattgagctgcccaagaacgccggcagcttcgtggtcaaaaagaacacgattgggaagtccaagatcatcctggtgaaccaatctgtgaccggcctctacgagaaccggagggagctgtga

SEQ ID NO: 7728 - RNA, 4098 nt, synthetic construct; identical to SEQ ID NO: 1928
  misc_feature 1..4098: note = Cas9 variant
  source 1..4098: mol_type = other RNA

SEQ ID NO: 7729 - RNA, 4098 nt, synthetic construct
  misc_feature 1..4098: note = Cas9 variant
  source 1..4098: mol_type = other RNA
atggtgaagaagaagtacgctataggcatcgacatagggaccaacagcgtcgggtggtcggtggtgaccgacgactacaaggtccccagcaagaagatgaaggtgttcgggaacacggagaagcgctacatcaagaagaacctgctcggcaccttactgttcgacgaggggaataccgcggagaaccggcgcctcaagcggaccgcgcgccggcgctacacgcggcgccgcaaccgcatcctgtacctgcaggagatcttcgcagaggagatcaacaagatcgacgactccttcttccagcggctcgacgatagcttcctgatcgtggaggacaagcagggctccaagcaccctatcttcggcaccctgcaggaggagaagaaataccacaaacagttccccaccatctaccacctccgcaagcagctagccgacagctcccagaaggctgacatccggctgatctacctcgcccttgcgcacatcatcaagtaccgcgggcacttcctgttcgagggcgacctcaagagcgaaaacaaggatgtccagcacctgttcaacgacttcgtggagatgttcgacaagaccgtggaggggtcctacctgagcgagaacctccccaacgtcgccgacgtactggtggagaaggtctccaagagccggcgcttagagaacatcctccactacttccccaacgagaagaagaacggcctgttcgggaacttcctggccctcgcccttgggctgcagcccaacttcaagacgaacttcgagctcgccgaggacgccaagatccagttctccaaggaaacctacgaagaagacctggaggagctgctcggcaagatcggggacgactacgccgacctgttcatcgcaaccaagagcctgtacgacggcatcctcctggccgggatcctgtccaccacggacagcaccaccaaagcgcccctctccagctccatggtgaaccggtacgaggaacacaagaaggacctggctctgctcaagaacttcatccaccagaacctgagcgacagctacaaggaggtgttcaacgacaaactgaaggacggctacgccggctacatcgagggcaagaccacgcaggagaacttctatcgcttcatcaagaaggcaatcgaaaagatcgaaggctccgactacttcatcgataaaatcgaccgggaggacttcctccgcaagcagcggaccttcgacaacgggagcattccccaccagatacacctccaggagatgcacgccatcatccgacgccaggcggagttctaccccttcctggtcgagaaccaggacaaaatcgagaagatcctcaccttccggatcccgtactacgtgggcccattggcccgcggcaagtccgagttcgcctggctgaaccgcaagagtgacgagaagatccggccctggaactttgatgagatggtggacaaggagacctccgccgagaacttcatcacgcggatgaccaactacgaccagtacctccccgaccagaaggtcctgccgaaacacagcctgctgtacgagaagttcgccgtctacaacgagctcaccaaggtgaagttcatcgcggaaggcatgcgcgactaccagttcctggactccggacagaagaaggacatcgtcaagacgctgttcaagacgaagcggaaggtgaccgcaaaggacatcaaggcctacctcgagaacagcaacgggtacgccggcgtggagctaaaggggctggaggagcagttcaacgcttcactccccacttaccacgacctgctgaagatcctccgcgacaaggcgttcatcgacgccgaggagaaccaggagatcctggaggacatcgtcctgaccctgacgttattcgaggaccgggagatgatacgcaagcggctggaaaagtacaaggatatcctgaccgaggagcagcgaaagaagctggagaggcgccactacaccggctgggggcggctatcggccaaacttataaacggcattttagacaaggtgacccgcaagacgatcctcggctacctcatcgacgacgggacctccaacagaaacttcatgcagctgatcaacgacgacaccctgagctttgtcgacgagatccgcttagcccagggctccggggaggcggaggactaccgggcagaggtgcagaacctggccggcagccccgccatcaagaaggggatcctgcagtccctcaagatcgtggatgagctgatcgaggttatgggctacgaccccgagcacatcgtcgtggagatggcaagggagaaccagttcaccaatcaaggtcgccggaacagccagcagcgctacaaaaagatcgagaacgcgatcaagaacctagactccaacctcaacagcaagatcctgaaggagtatcctacgaacaaccaggcacttcagaacgaccggctgttcttgtactaccttcagaacgggaaggacatgtacaccgacgaggaactcgacatcgaccagctttcccagtacgatatcgaccacatcatcccccaggccttcatcaaggacgacagcctggataataaggtcctgaccaagtcggcaaagaaccgcggcaagtccgatgacgtgcccagcctggagatcgtgcataagaagaagaacttctggaagcagctgctcgactcccagctgatctcccagcggaagttcgacaacctgaccaaagccgaacgcggaggcctcaccaacgaggacaaagcgcggttcatccagcgccagctggtcgagacgcggcagatcaccaagcacgtggcccgcatcctggacacccggttcaacaccaagctcgacgaggcaggcaaccgcatcagggatcccaaggtaaacatcatcacgctaaagagcaacttggtcagccagttccgcaaggactaccagctctataaggtgcgggagatcaacaactaccaccacgcccacgatgcgtacttgaacgcggtggtcgccaccgccctactcaagaagtacccgcaactggcccccgagttcgtgtacggggactaccccaagtacaactcctacaagagccgcaagtccgcgaccgagaaggtgctgttctacagcaacatcatgaactttttccggcgcgtcctcgtgtacagcaagaccggcgaggtgcggatccgcccagtcatcgaggtgaacaaggagacgggggagatcgtgtgggacaagaagtccgacttccgaaccgtcagaaaggtgctgagctacccccaggtaaatgtcgtgaagaaggtggagatgcagaccggcgggttcagcaaggagtccatcctgcagcatggcgacagcgacaagctcatcccccggaagaccgagaagttctacctggacacgaagaaatacggcgggtttgactcccccaccatcgcctacagcgtcctgctcatcgccgacatcgaaaagggaaaggccaagaagctgaagcgggtgaaggagctgatcgggatcaccatcatggagcgcatggccttcgagaagaaccccattgagttcctcgagcacaaaggctacaagaacatccttgagaagaacatcatcaagctgccgaagtatagcctcttcgagctggagaacgggcgccggcggctgctcgcgtccgctaaggagctgcagaagggtaacgagatgatcctgccgccccacctcgtgaccctgctgtaccacagctccaacatccacaagatcactgaaccgatccacctcaactacgtcaacaagaacaagcacgagttcaaggagctgctgcgccacatcagcgacttttccacccggtacatcctcgcccaggaccgcctgagcaagatcgaggagctgtacgacaagaacgacggcgacgacatctccgacctcaccagctccttcgtgaatctgctgaccttcacggccatcggggcccccgcggccttcaagttcctcggaagcgtgatcgatcgtaagcgctacacctccatcgccgagatcctcgaggcaaccctgatccaccagagcgtcaccggcctctacgagacgcggatcgacttatccaagctgggcggggactga

SEQ ID NO: 7730 - RNA, 4101 nt, synthetic construct; identical to SEQ ID NO: 1930
  misc_feature 1..4101: note = Cas9 variant
  source 1..4101: mol_type = other RNA

SEQ ID NO: 7731 - RNA, 4101 nt, synthetic construct
  misc_feature 1..4101: note = Cas9 variant
  source 1..4101: mol_type = other RNA
atggacaagaagtacaacatcggcctggacatcgggaccagctccatcggcttcgtggccactgacgaggacaatcacgtcatccgcgccaaggggaagaacgtgatcggcgtgcggctgttcgacgaggggcagagcgcggccgagcgccggggcttccgcacgacccggcgccggctgaaccgccgcaagtggcgcctgaacctcctgcgggagatcttcgagccccacatctacccgatcgacgcctccttcttcatgcggcagaagtatagcaacctgtctaagcaggaccccaaccagaagatcgagttcaaggacatcctcttcagcgacaagtccgacgccgagttctaccggcagtaccccaccatctaccacctccgccaggccctgatgaccgagaagcggcagttcgacctccgcgagatctacctggcgatccatcacatcgtcaagtaccggggccacttcctggacgaaacgcccaccgacaagttcagcttcgaccaactcgacctgacccaggagttcgagcgactgaacgtcctcttctccgagcagaacccagaggagcccttcgagatcgtggtgaaccagaaccagagcatcgaggacatcctgtccaaccagagcatgaccgcctccgaccggcgcaagcaggccctggtggtgttctaccagcagtcggagaacaaggagaacgagaagcagtacaaggccatcgctacggagatcctcaacctcctgctcgggaacaaggccaagctgaacgtaatcctggcccaggaggtggacaaggaggccgccaaggactggtccctcagcctatccagcgagaccttcgacgacgacctggagaaggcgtccagcggcctcaacgacagccagctggagatggtggggatcttcgagcggatctactccagcctgatcctcaagtccatcatcggcgaccacaacagcttatccgccgccatggtcgacaagtttaagacccacgcccagcaccgcgacctgctcaaggacgtgatcaagaacagcgacgccaccaagggggagcagctgcagttcgcgtacgaccactacctgcaacgccactccgccgacggcaaggcctacggcaaagacgacttctacaaggaagtcaagaagaacctcgacgatagcgacgccgcccagcagatccagcaactcatcgacacggaccagttcatgcccaagcaacggaccaaggcgaacggggcgatcccccaccaggtccagcagaaggagctggacctcatcatcgagaatcaatgccagtactacccgtggctggccgaggagaaccccaactccgagcgccacaacgtggccaagtacaagctggacgagttggtgtccttccgggtcccctactacgtgggccccctgatctccccggccgacgacgagaccgatccccaggcgatccagaacaccaagttcgcctggatgatccgcaaggacgcccaggggcggattacgccctggaacttcgacgacaaggtggaccgcgagaagtccgccgacaagttcatcaagcggatgaccaccaccgacacgtacctgatcggcgaggacgtcctccccgaccagagcctgatctaccagcgctacaaggtgctgaacgagctcaacaacgtgcggatcaacggccgcccgatcgaggtccagatcaagcagaacatctacaccgacctcttcaagaagttcaagagcgtgtccgtcaagaagctgcggagctacctggaggagatgtcctactaccccgggagcttcaagatctccggcctaaccaaccccgggaagttcgacaacggcctgaccagctacctggactataagaacatcctcggggacagcgtggacgcgaacgacaagcgcgccgacatcgagcagatgatcgagtggtccacgatcttcgaggacaacaagatcttcgcccagaagctggagtccatgacctggctgaccgccgagcagcggaaggccatctcccgcaagcggtacaccggctggggccgcctcagcaacaagctgctgacgcagctcaaaaaccaggacaaccggtccatcatggacctgctgtgggagaccgaggagaacttcatgaagatccagagcgcgcccgacttctccaaaatgatcgaggcacacaaccagcagttcatcaagaacgaggccaacatccaacaggtcatcagcgacctctacacctccccgcagaacaagaaagccatccgccaaatactgctggtggtggacgacatccagaaggccgttgggcacgcgcccgagcacatagccatcgagttcgccaagggcgaggacaagaacccgcggcgcaccatcagccgcgagatgaagatccaggacgtctaccagcagatctccgacgacatcctcgtgagccccgaggtgcgggcccagctgaacgagaaaatcgagaaccgccacgggcggctgtccgaccgcctcttcctgtacttcatgcagggcgggcgggacatgtacacgggcaagccgatcaacatcaacaacatcagccactatgacatcgaccacattctgccccaggccttcatcaaggacgactccctcgacaaccgcgtcctggtgagcgacaagctgaaccgggagaagtccgacaccgtgccccgcgacctcttcggccgggagatgatgagcacctgggagaagatggcggaccgcgggctgatcaccaagcggaagctggccaacctcaagacgatccccggcagcatcgacgcccacaaggcccaggggtttatcaaccgccagcttgtagagacccgccaggtgatcaagctggcggtcggcatcatgatcgaccagtacccggagacccagatcgtgtccgtgaaggccaacctcacccacgagatgcgggaaatgttcgacttagtgaagaaccgggacgtcaacgactaccaccacgccttcgacgcctacctgacagccttcgtggggaactacctcctgcaacgctaccccaagctggagccctacttcgtttacgacaagttcaagaagctcaaggatcagaacatcagcatgcgggacttcaacctgctgtacgacctcaagaagaacgaggacgtctacgaccagcgcacgggccactccgcgcacaagatctgggaccagcacggcagcatagactacatccggcacctgttcgcctataagaagatcctggtgtcccacgaggtgcaccagaacggtggcgccctctacaacatgaccgtctacgggaaggccgacgacgccaagcgcaagctgatcccgataaaggcggacaagcccaccgagctgtacggcgggtacaccagccggaagctcgcctacatggctatcgtgaagacgaaaaaggggaagaaggagcagtaccaggtgaccggcgtccccgtgtccgccctgaccaccctgcgccagttcaaggaggacagccccgagcagaagcaggccctcgaggagattgtgcgccggaacttcgacgagaagacggaggtcgagatcatcgtgccgaaggtgctgttcaaccagctgatcgtcgacgagaaatgccgcttcatggtggggtccgacacctaccggtacaacgcgcagcagctcgtgctgagcgcggacgacctggagatcatcaacgcctcccacaaggacatccagaccatcgacagctccgactacagccagcagctcgaccaggtctaccagaacatcctgacgattgtggacaagcacttccccatgtacgacatcaacaagttccgcacgaagctccacgacatctacgagcagtacatcgagctccccaacgaggacgtgtgggagaacaacaagctgacgaccctgggcaagcacaccatcatcatccggatcctccaggggctgcacgccaacgctacggtcgtggacctgaagcagctcggcatcaagacccccttcggcttcatgcagcaggcccgcggtatagtggtctccccggacgcccagctgatctatcagtcgcccaccggcctgtacgagcggcgcgtgcggctcggggacctgtga

SEQ ID NO: 7732 - RNA, 4101 nt, synthetic construct; identical to SEQ ID NO: 1932
  misc_feature 1..4101: note = Cas9 variant
  source 1..4101: mol_type = other RNA

SEQ ID NO: 7733 - RNA, 4101 nt, synthetic construct
  misc_feature 1..4101: note = Cas9 variant
  source 1..4101: mol_type = other RNA
atgaccaagctgggcaagccctacggaatcggggtggacatcggtagcaactcgatcggcttcgccgccgtcgacgagaacagccatctcatccgcctgaaggggaagaccgtgatcggcgcgcggctgttcgaggagggcaaggccgccgcgtaccggcgtgcctcccgcacgacccggcgccggctaagtcgcaaccggtggaggctgtccttcctgagagatttctttgagagccacataaccccgaccgaccccaacttcttcatgcgccagaagtactctgagatcagcccaaaggacaaggcgcggtacaagtacgagaagaggctgttcaacgatcggacggacgccgagttctaccagcagtacccaaccatgtaccacctccgaacccgactcctgacagacccgtccaaggccgacgtgcgcgagatctacttcgcgatccaccacatcctcaagagccgggggcacttcctcacgcctggctacgcgaaggacttcaacaccaataaggtcgccctgaacgagatctttcccgcccttcaggatgcctacgcccaggtgtaccccgatctggacataaccttcgacgagaacaaggtgaacgagtttaagaccgtcttgctgaatgagaaggcgacgcccagcgacactcagcgcgccctggtgaacctcctgctggccaaggagggggaccgggacatcctcaagcagcagaagcaggtcctgaccgagtttgctaaggccgtcgtgggcctaaagaccaagctcaacgtggcgctggggacggaggtcgacagctccgaggccaccgcctggaatttcagcctgggccagctagacgacaagtgggccggaatagagtccgccatgaccgatgaggggaccgagatcctcgaccagatcagggacctgtaccgagcgcggctcctgaacgggatcgtgcccgccgggaagacactcagccaggccaaggtggacgactacgcccagcaccacgaggacctcgagctgttcaaggattatctgaagcaactcgaggatgacggcaccgctaaggctatacgccagctgtacgaccggtatatcgacggcgacgatgccaagcccttcgtcagggaagacttcgtgaaggcactaaccaaggaggtgaccgcccaccccaacgcgaagagtccggagctcctggagcgcctggcccagcccgacttcatgctcaagcaacgcaacaaagccaacggggccatccccgtccagatgcagcaacgggagctggaccagataatcaagaaccaggcggtgtactacgattggctggcggcccccaacccggtggagaagcaccgccagagcatgacgtaccagctcgatgagctgctgaacttccggatcccctattacgtcggccccttggtgaccgccaaggagcaaaaggccgcccagggcggggtctttgcgtggatggtccgcaaggaccccgacgggaacatcaccccttataatttcgacgagaaggtggaccgggaggcctccgctaacacgttcatccagagaatgaagacgaccgacacctacctgatcggggaagacgtcctgccaaagcagagcttactctaccagagctacgaggtgctgaacgagctgaacaacgtgagagtcaacgacaacaagctctccttcgatcaaaagcagcaggtcctgggcgaattattcgagcgccacaacaccgtgacgatcaagcagttcgtagacaacctcctggcgcacggggactacgaccggatccccgaggtgcgagggctggccgacgaaaagcggttcctcagctctctgagcacctacaaccagctgaaggggatcctccacgaggcgatcgatgacgccgacaagcagaccgacatcgaaaatataatcgcctggtcgactatattcgaggacaaggcaatcttcaaaacgaagctgaacgaaatctcttggctgaacgcgggcatgatcaacagcctggcgaacatccgctaccggggctggggccagttcagccacaaattactgaacgaactcaccctgtccacgggtcgcaccgtgttcgaggagctgctaatcagctccaggaacctgatgcagatcctgaccgacgaggtcctcaagcagaagattgccgagctaaacgcccatgaacttaaggcctctgggatctacgcggccatcgacgacgcctacacgtcccccagcaacaagaaggcacttcgccaggtgctgagtgtgattgacgacatcacaaacgccgcgggccaggcccccaactggctgtacatcgagaccgccgacggggacggcgtcccggggaagcggaccaacagccggcagcgcaagatccaggagatctacgccaatgccgcacaagagctcattacgggctccgtgcgcggcgagttcgaggacaagatcgccagccgcgctgatttcaccgatcggctggtgctgtacttcatgcagggtgggcgtgacatctacaccggggagcccctcaatatcgacaacctatcgagttacgacatcgaccacatcctgccccaaagcctcatcaaagacaactccctggacaaccgggtcctggtgcacccgctcgtcaaccgcgagaaggacacaatcttcgccagcacccggttcgcgaagcagatgaatggcatgtggcgccagtggcacgccgccggcctgatctccagccggaagctgcgcaacctccagatgaggcccgacgagatcgataagtatgcctcggggttcgtcgcccgccagctggtggagacacggcaaatcattaagctgaccgagcagatcgtggcggaccagtaccccgataccaagattatcgcggtcaaggccggactcagctcccagttgcgcaaggagctggacttcccgaagaatcgggaggtgaaccactaccaccacgccttcgacgccttcctagcggctcgcatcggtacatacctgctgaaacggtacccaaacctcgagcccttcttcacctacggcaagttcaagaagaccgaagtgaagaagttaaagagcctgaagtccctcaagagcttcaacttcatccgcgacatgacccacgccaaagacaaaatcgtcgcgaaggagacgggggagatcgtatgggacaacgcttccgacatcaacgagctagacaggatctataacttcaaacggatgctgatcacccacgaggtgcgcttcgagaccgcgagcctgttcaagcaaaccctgtacgcagccaagaacagcaagaatcggggcggcagccgccagctgatccccaagaagaaggggtacctcgtagacatctacgggggctacacgcaggaaaccggctcctacctgagcgtagtgcggctgaccaagaaggcaatgtacgccgtcgtcaaggtgtccacccgtgatgcggccaagttagccgtagcaaagtccatcagcgaacagaaggagaatgagacgctgaagaagatcatcgacgggaagctgtccaagacaagcaagaagggcaagaccacccaccagcttttcgagatcgtgctgccgcgggtgggccagaagacgctattcaagaactccaagtacaaccagttcctcgtcaactctgacacctacatgcacaattaccaagaactgtggatgccccgcgagtaccagagaatgtggaaggacatcctgctctccaaccacggggacgcgcagattgagggccagctggatcagatcttcaagttcattgtcagccaagtgaactcctacttcaacctgtacgacatcaaccagtttcgcaagaagatcgccgacgccaccgacaagttcgccaagctccccacccacgacacggacaacgcccgggggaagatcgcgaccatcggccagctgctgatcgggctccaggccaacgccatgcgcagcgatttgcggaacctagacatcaagacccccttcggcctcctgcaaatcggcacggggatcacccttgacctcgacacctccataatctatcagagcccgaccggcctgttcgagcgcgaggtacccctgaccgacctatga

SEQ ID NO: 7734 - RNA, 4101 nt, synthetic construct
  misc_feature 1..4101: note = Cas9 variant
  source 1..4101: mol_type = other RNA
atgaccaaggactacagcctgggcctcgacattgggaccggctccgtggggttcgccgccctggacacgaactaccgcctgctccgggcgaagggcaacaacgtcatcggggtccgcctgttcacccccgccgagaccgccgaggagcgtcgcggcttccggaccgcccgccggcgcctgagccggcgtcggtggcgcctcggcgccctgaacgggatctttgcgccggagctggccaaggtggaccccaacttcctccaccggctgaagtacgcctgggtccaccccgccgaccagcagaacaagggcaagtactccgcggcgcccttattcaacgacgccgccctcgaccgccaattccacgacgactacccgacgatctaccacctccggctgaagctgatgacggacaccagccagcacgacctgcgcgaggtgtacctggcaatccaccacatcatcaagtttcgggggaacttcctccgcggcgaggggcctatcaacgcctccgaggccttcgacataaacaccttcatcgaccagatgacggccttctacgaccaggccttccccgacttcaagatcgtggaccaggtcgaccagcagatcatcttcaagggcctgaccgacatgaccctgagccccgccgaccgggcgaacaaggctttaatgggcttcaacaacgccgcccagcagccgaacaagcgcatcttcaaggccatcctgtccggtctggtgggaaaccaggtggacctcatggcgatcttccaactggacgggatccccaaggaggaccagaaggaatttaagttcaagttcgtcgacaacgacatcgaggagaagctggccgccctcggcgacaaccccgccctgagcgacgagcagaacgagttcctgaccacgctctatgccgcgttctccggcctgaccctgaaggggctcctgggagacgccaccagcatcagtgccgccatggtggcccggtacgctagccaccgcaccgactggacgtacatcaaggaccacgtgctgacgccccagaacaatcgcgagctccggctggcctacgccgacctgatgactgacaacgaggacgtccgactcaaagccgggaagaagttcgcgaaggccatcgaggccgccgacatacccgccgcgaagaagtccgagttcagcctgaagatcgacaacaacgagttcctgccccggcagcgcaccaaggccaatggcaccatcccccaccagctccacctgaacgagctgcagcagatcatcgagaaccaggggcagtactaccccttcctcaaggccaccttcgagcaggacggccacaccctaaacaagatcgagggcctggtgaagttccgggtgccgtactacgtcgggcccctagtgcccaagcacaaggtggccggaaacaatgccaatcactggatggtccccaaggaaccgggggcgatcaccccctggaactatacggagaaggtggaccgcgacaagtccggcaacgagttcatccggcgcatgaccgggaccgacacctacctgctgggcgaacccacgctgcccaagaacagcttagtgtaccaggagttcaacgtcctgcaggagctgaacaacctccggatcgagaagcgccggctggacatcgccgtgaagcaggacatcttcgagcacgtgttcaagaccaacaagaccgtcaccgtgaagcgcatcgaggagtacctgacgaccgagttcggctccccggtcaccctcagcgggttcgccaacgtgaacgagcggaagctgaactccagcctgagcacctaccactacttcgtgggcatcttcggggccgagttcgtcgacgatcccaaaaatctcacgttgctggagcagatcgtggagctccaaaccgtattcgaggaccgcaaggcgctgcagcggcagttgaagctccgccccgagctgtccgagaagcaggtcaagcagctggcccggacccactacaccggctgggggcgcctcagccaaaagctgctgacctccaagatcgtgcacgtggccctcgagggcgagcgggagcccggccagtactcgatcctggagacgctgtacgggacccagatgaacttcatggagatcgtcaacgacatgaaggaccgctacggcgtgaagtcctggctcgaccaggagaacagcgggtccgagaacaacctaagcctgaagcagcgcatcctcgacatgccgggccccaagaacatcaagcggggcatcaaccaggccttccacatcatcgacgagatcacccgcgccgtggggaacgctccctcccgaatctacatcgagttcgcccgcgagagccagcagtccaacctgaccaacgcccgggtcaaccgcctgaagcagctctacagcaaccaggccctgaagaaagagttcgccaagctggcgtccgagatcaaggacctcaccaaggaacagctgaaggacgaccggctgtacctctactacctgcaacagggcaaggacatgtacacggagaccgacatcgacatcaccaagattagctccaactaccagatcgaccacatcatcccgcaggcctacacaaagaacaacagcctggacaaccgcgtgctcgtgaactcggagatgaacgcccgcaagagcgactcccccacgttcctacccagcctgatccaggagcggaaggcctggtggcggcagctccgcgacaccgggctgatgagcaccatcaagtacaacaacctgacgcggacctccgacgacttcagcgccgaccaaaaggagcgcttcatcgcgcggtccctcgtagagacccgccaggtgatcaagaacgtggccaccctgatcaaggagtactatgacgatagccaggtcgaggccctgccctccgagatcacggccgagatgcggcgctacctcaacgtgcggaagaaccgcgacatcaacgactatcaccacgcgcatgatgccctgctgttcgccaccgccggcgagttcagccggaaggtggggatcatggagaagggccgcgtctccgacggcgccgggaacatttacaaccgctacaccaaggacatcatccagcgggcgcgcgccaaggccggccaggacaagaaggtgcggccgttcaccttcatcgtggggagcatggccaaccccgacacgaagttccagacaaaccagaccaccggcgagatcgtctggacgcccgaggacgtggcctatctccgcaaggtgatcgactacaagaagatgctggtcaccaagatgaccctggaccaaaccgggacgctctacaacgagacccgttacggctccggcgacaagcacgtggcggtggccctgagcaaggacaaggccgccgacctgtacgggggcttcgggtccctaaagcccgcctacgcggccctggtctatagcaagaagaagttccgcctggtgaacgtgctccggctgtggctgccggagatcaagaagaacgcctccgtcctcgagcgcaaggtgcagagcgtgctgggcgacgacaacgccaaggtcatccgggcccacgtgccctgcgggcagctgctcatcaaggacggcgcactggtgaccgtctccagcgcgaccgagctgcacaacttcagacaactctggctgcctaaggccgactaccaagacatctccatcctgctcggcgcccccgacaaggtgacggcggagaaccggctgcaggccgagagccacttcgacgacgtggaccagcgcttcgagagcctgctgaaggacgtcatcgaccaagcccggcagtactatccgctgaagacccaccagacctccctggagaagctcatcgggaagatcggcaagttcgacgagctgaagttcgcccagaagcagcaggtcttcagccgcctgctctccgccctgcatgcgaacgccaccaacagcgacctgaagcagatcggactctccacggcctggggccggctgatctaccccaagggggtaagcctgaccgatgaggacaagctcatcaactccagcttcaccggcctgttcaacgacgtgatgtccataaaggagttccacgacttcagcatcaactga

SEQ ID NO: 7735 - RNA, 4104 nt, synthetic construct; identical to SEQ ID NO: 1935
  misc_feature 1..4104: note = Cas9 variant
  source 1..4104: mol_type = other RNA

SEQ ID NO: 7736 - RNA, 4104 nt, synthetic construct; identical to SEQ ID NO: 1936
  misc_feature 1..4104: note = Cas9 variant
  source 1..4104: mol_type = other RNA

SEQ ID NO: 7737 - RNA, 4104 nt, synthetic construct; identical to SEQ ID NO: 1937
  misc_feature 1..4104: note = Cas9 variant
  source 1..4104: mol_type = other RNA

SEQ ID NO: 7738 - RNA, 4104 nt, synthetic construct; identical to SEQ ID NO: 1938
  misc_feature 1..4104: note = Cas9 variant
  source 1..4104: mol_type = other RNA

SEQ ID NO: 7739 - RNA, 4104 nt, synthetic construct; identical to SEQ ID NO: 1939
  misc_feature 1..4104: note = Cas9 variant
  source 1..4104: mol_type = other RNA

SEQ ID NO: 7740 - RNA, 4104 nt, synthetic construct; identical to SEQ ID NO: 1940
  misc_feature 1..4104: note = Cas9 variant
  source 1..4104: mol_type = other RNA

SEQ ID NO: 7741 - RNA, 4104 nt, synthetic construct
  misc_feature 1..4104: note = Cas9 variant
  source 1..4104: mol_type = other RNA
atggtgaagaagaagtacgccattggcatcgacatcgggaccaacagcgtcggctggtccgtggtgaccgacgactacaaggtccccagcaagaagatgaaggtgttcgggaacacggagaagcgctacatcaagaagaacctgctgggcaccctcctgttcgatgaggggaacaccgccgagaaccggcgcttaaagcggaccgcgcgacggcgctacacgcggcgcagaaaccgcatcctgtacctgcaggagatattcgccgaggagatcaacaagatcgacgactccttcttccagcggttggacgacagcttcctgatcgtggaggacaagcagggctccaaacacccgatcttcggcaccctacaggaggagaaggagtaccacaagcagttccccaccatctaccacctccgcaaacagctggccgacagctcccagaaggccgacatccgcctgatctacctcgccctggcgcacatcatcaagtaccgcgggcactttctgttcgagggcgacctcaagagcgagaacaaggacgtccagcacctgttcaacgacttcgtggagatgttcgacaagaccgtggagggatcctatctgagcgagaacctccccaacgtcgccgacgtgctggtggagaaggtctccaagtcacggcgcctggagaacatcctccactacttccccaacgagaagaaaaacggcctgttcgggaacttcctgacgctcgccctgggcctgcagccgaacttcaagaccaacttcgagctcgccgaggatgcgaagatccagttctccaaggagacatacgaggaggacctggaggagctgctcggcaagatcggcgacgactacgccgacctcttcatcgccaccaagagcctgtacgacggcatcctcctggccgggatcctgtccacgaccgacagcaccaccaaggcgcccctctccagctctatggtgaatcggtacgaggagcaccagaaggatctggccctgctcaagaacttcatccaccagaacctgagcgacagctacaaggaggtgttcaacgataagctgaaggacggctacgccggctacatcgagggcaagacgacccaggagaacttctaccgcttcatcaagaaggccatcgagaagatcgagggctccaactacttcatcgacaagatcgaccgggaggacttcctccgcaagcagcggaccttcgacaacggaagcatcccccaccagatccacctccaggaaatgcacgccatcatccgccgccaggccgagttctaccccttcctggtcgaaaaccaggacaagatcgagaagatcctcaccttcagaatcccgtactacgtgggccccctggcgcgtgggaagtccgagttcgcctggcttaaccgcaagagcgacgagaagatacggccatggaacttcgacgagatggtggacaaggagacgtccgccgagaacttcatcacccggatgaccaattacgaccagtacctccccgaccagaaggtcttaccgaagcacagcctgctgtacgagaagttcgccgtgtacaacgagctcaccaaggtgcgctacgtcacggagcagggcaagagcttcttcttcgacgccaacatgaagcaggagatcttcgacggcgtgttcaaggtgtaccggaaggtcaccaaggaaaagctgatggacttcctggggaaggagttcgacgagttccgcatcgtggacctcctgggcctggacaaggacaacaagagcttcaacgcgtccctcgggacataccacgatctgaaaaagatcgtcagcaaggacctgcttgacaaccccgagaacgaggacatcctggagaacgtggtgctgaccctcacgctgttcgaggaccgggagatgatccgaaagcggctggagaagtacaaggatgtcctcacggaggaacagcgcaagaagctggagcggcgccactacacgggctgggggcggctgtccgccaaactcatcaacggtatccgcgacaaggtgacccggaagacgatcctggactacctgatcgacgacggcaccagcaaccgcaatttcatgcagctcatcaacgacgacaccctgtccttcgtggacgagatccggcttgcccaggggagcggcgaagccgaggactaccgcgccgaggtccagaacctcgcggggtcccccgccatcaagaagggcatcctgcagagcctgaagatcgttgacgagctcatcgaggtgatggggtacgaccctgagcatatcgtcgtggagatggcccgcgagaaccagttcaccaaccaggggcggcgcaactcccagcagcggtacaagaagatcgagaacgccatcaagaacctggacagcaatctcaactccaagattctcaaggagtacccgacgaacaaccaggcgctgcagaacgaccgcctgttcctctactacctgcagaacggcaaggacatgtacaccgacgaggagctggacatcgaccagctcagccagtacgacatcgaccacatcatcccccaggccttcatcaaggacgacagcctggacaacaaggtgctgaccaagtccgccaagaaccgggggaagtccgacgacgtccccagcctcgagatcgtgcacaagaagaagaacttctggaagcaactgctggacagccagctcatctcccagcgcaagttcgacaacctgaccaaggccgagcgtggagggctgaccaacgaggacaaggcccgcttcatccagagacagctcgtggagacgcgccagatcaccaagcacgtcgcgcggatcttggacacccggtttaataccaagctggacgaggccggcaaccggatccgcgaccccaaggtgaacatcatcacgctcaagagcaacctggtgtcccagttccgtaaggactaccagctgtacaaggtccgcgagatcaacaactaccaccacgcccacgacgcctatctcaacgccgtggtggcgaccgccctgctgaagaagtatccgcagctcgcccccgagttcgtctacggcgactaccccaagtacaacagctacaagtcccgcaagagcgccaccgagaaggtgctgttctactccaacatcatgaacttcttccggcgggtgctggtctacagcaagaccggggaggtgcgcatccggcccgttatcgaggtcaacaaggagacgggcgagatcgtgtgggacaagaagtccgacttccgcaccgtgcgcaaggtcctcagctacccccaggtgaacgtggtcaagaaggttgagatgcagaccgggggcttctccaaggagagcatcctgcagcacggggactccgacaaactgatcccccggaagaccgagaagttctacctcgacacgaagaagtacggcggcttcgacagccccaccatcgcctacagcgtgctgcttatcgcggacatcgagaaggggaaggccaagaagctcaagcgggtcaaggagctgatcggcatcaccatcatggagcggatggccttcgagaagaaccccatcgagttcctggagcacaaggggtacaagaacatcttggagaagaacatcatcaagctgccgaagtactccctgttcgaattggagaacggccgccggcgcctgcttgccagcgcgaaggagctccagaaggggaacgagatgatcctgccgccccacttggtgaccctcctgtaccactccagcaacatccacaagatcacggagccgatccacctgaactacgtgaacaagaacaagcacgagttcaaggagctcctgcggcacatctccgatttcagcacccgctacatcctggcccaggaccggctctccaagatcgaggagctgtacgacaaaaacgacggcgacgacatcagcgacctgacctccagcttcgtcaacctcctgaccttcacggccatcggcgcgcccgccgcgttcaaattcctggggtccgtgatcgaccgcaagcggtacacctcgatcgccgagatactcgaggccaccctgatccaccagtccgtgaccggcctgtacgagacacgcatcgacctcagcaagctcgggggcgactga

SEQ ID NO: 7742 - RNA, 4104 nt, synthetic construct
  misc_feature 1..4104: note = Cas9 variant
  source 1..4104: mol_type = other RNA
atggtgaagaagaagtacgccatcggcatcgacatcgggaccaacagcgtcggttggtccgtggtgaccgacgactacaaggtcccaagcaagaagatgaaggtgttcgggaacacggagaagcgctacatcaagaagaacctgctgggcaccctgttgttcgacgaggggaacaccgccgagaaccggcgcctcaagcggaccgcgcgccggagatacacgcggcgccggaaccgcatcctttacctgcaggagatttttgccgaggaaatcaacaagatcgacgactccttcttccagcggctcgacgacagcttcctgatcgtggaggacaagcagggctccaagcacccgatcttcggcaccctgcaggaggagaaggagtaccacaagcagttccccaccatctaccacctccgcaagcagctggccgacagctcccagaaggctgacatccggctgatctacctcgccctggcgcatatcatcaagtaccgcgggcacttcctgttcgagggcgacctcaagagcgagaacaaggacgtccagcacctgttcaacgacttcgtggagatgtttgacaagacagttgaggggtcctacctgagcgagaacctccccaacgtggccgacgtgctggtggagaaagtctccaagagccggcgcctggaaaacatcctccactacttccccaacgagaagaagaacggccttttcggcaacttccttgccctcgccctgggcctgcagccgaacttcaagacgaactttgagctcgcggaggacgccaagatccagttctctaaggagacctacgaggaggacctggaggaactgctcggcaagatcggggacgactacgccgacctgttcattgccaccaagagcctgtacgacggcatcctcctggccggcatcctgtccacaacggacagcactaccaaggcgcccctctccagctccatggtgaaccggtacgaggagcaccagaaggacctggccctgctcaagaacttcatccaccagaacctgagcgacagctacaaggaggtgttcaacgacaagctgaaggacgggtacgccggctacatcgaggggaagaccactcaggagaacttctaccgcttcatcaagaaggccatagagaagatcgagggttccaactacttcatcgacaagatcgaccgggaggacttcctccgcaagcagcggaccttcgacaacgggagcatcccccaccagattcacctccaggagatgcacgccatcatccgccgccaggcggagttctaccccttcctggtcgagaaccaggacaagatcgagaagatcctgaccttccgaatcccgtactacgtgggccccctggcccgcgggaagtccgagttcgcctggctgaaccgcaagtcagatgagaagatccggccctggaacttcgacgagatggtggacaaggagacctccgccgagaacttcatcacgaggatgaccaactacgaccagtacctccccgaccagaaggtccttccgaagcacagcctgctgtacgagaaattcgccgtgtacaacgagctcaccaaggtgcgctacgtcaccgagcagggcaagtccttcttcttcgacgcgaacatgaagcaggagatcttcgacggcgtgttcaaggtgtaccggaaggtcacgaaggagaagctgatggacttcctggggaaggagttcgacgagttccgcatcgtggacctactgggcctggacaaggacaacaagagcttcaacgcctccctcgggacctaccatgacctgaagaagatcgtcagcaaggacctgctcgacaaccccgagaacgaggacatcctggaaaacgtggtgcttaccctcaccctgttcgaggaccgggagatgatccgcaagcgcctggagaagtacaaggacgtcctcacggaggagcagcgcaagaagctggagcggcgccactacaccggctgggggcggctgtccgccaagctcatcaacggcatccgtgacaaggtgacccggaagaccatcctggactacctgatcgatgacggcacgagcaaccgcaacttcatgcagctcataaacgatgacaccctgtctttcgtggacgagatccggctggcccaagggagcggcgaggccgaggattaccgcgcggaggtccagaacctcgccgggtcccccgccatcaagaagggcatcctgcagagcctgaagatagtggacgagctcatcgaggtgatggggtacgatcccgagcacatcgttgtggagatggcccgcgagaaccagttcaccaaccagggccggcgcaacagtcaacaacggtataagaagatcgagaacgcgataaagaacctggacagcaacctgaactccaagatcctcaaggagtacccaaccaataaccaggccctgcagaacgaccgcctgttcctctactacctgcagaacggtaaggacatgtacacggacgaggagctggacatcgaccagctcagccagtacgacatcgaccacatcatcccccaggccttcatcaaggacgacagcctggacaacaaggtgctgaccaagtccgcgaagaaccgggggaagtccgacgacgtccccagcctcgaaatcgtgcacaagaagaagaacttctggaagcagctgctggacagccagctcatctcccagcgcaagttcgacaacctgaccaaggccgagcggggcgggctgaccaacgaggacaaggcgcgcttcatccagcggcagctcgtggagacccgccagatcacgaagcacgtcgcccggatcctggacacccgcttcaacaccaagctggacgaggccggcaaccggatccgcgaccccaaggtgaacatcatcaccctcaagagcaacctggtgtcccagttccggaaagactaccagctgtacaaggtccgcgagatcaacaactaccaccacgcccacgacgcctacctcaacgcggtggtggccacggccctgctgaagaagtacccgcagctcgcccccgagttcgtctatggcgactaccccaagtacaacagctacaagtcccgcaagtctgccaccgagaaggtgctgttctactccaacatcatgaacttcttccggcgggtgcttgtctacagcaagaccggggaggtgcgcatccggcccgtgattgaggtcaacaaggagaccggcgagatcgtgtgggacaagaagtccgacttccgcacggtgcgcaaggttctcagctacccccaggtgaacgtggtcaagaaggtggagatgcagaccgggggcttcagcaaggagagcatcctgcagcacggggactccgacaagctgatcccccggaagaccgagaagttctacctcgacaccaagaagtacggcggcttcgacagccccacgatcgcgtactcggtgctgctgatcgccgacatcgagaaggggaaggccaagaagctcaagcgcgtcaaggagctgatcggcatcaccatcatggagcggatggccttcgagaagaaccccatcgagttcctagagcacaaggggtacaagaacatcctcgagaagaacatcatcaagctgccgaaatactccctgttcgaactcgagaacggccgccggcgcctgctggcgagcgccaaggagctccagaaggggaacgagatgatcctgccgccccacctggtgaccctcctgtaccactccagcaacatccacaagatcaccgagccgatccacctgaactacgtgaacaagaacaagcacgagttcaaggagctcctgcggcacatctccgacttcagcacgcgctacatcctggcccaggaccggctctccaagatcgaggagctgtacgacaagaacgacggcgacgacatctcagacctgacctccagcttcgtcaacctcctgaccttcaccgcaatcggcgcacccgcggcgttcaagttcctggggtccgtgatcgaccgcaagcggtacacgagcatcgccgaaatcctcgaggccaccctgatccaccagtccgtgaccggcctgtacgagacccgcatcgacctcagcaagctcgggggcgactga

SEQ ID NO: 7743 - RNA, 4107 nt, synthetic construct
  misc_feature 1..4107: note = Cas9 variant
  source 1..4107: mol_type = other RNA
atggacaagaagtacagcatcggcctggacatcgggacctccagcatcgggttcgtgggggtcgacgagaacggctggcccctcaacatcaaggggaagcgcgccataggcgcccatctgttccgggagggcgaggcggccgccgagacccgagggttccggacgaccagacggcgctacaacagacgcaagtggcggctgcggctcctgcgggagatcttcgacgagccgatctcccgcgtggaccctaccttcttcgcccggatgaaggagagctcggtgagcccgaaggacccaaactatgacggcctggccaaggagatcctcattccgcgcgacaaggacgggaagatcctgtaccccacaatctaccacctccgtcacgcgctcatgtacgaggaccaccagttcgacatccgcgagatctatttagccatccaccacatcgtcaagtaccgggggcacttcctcctcgacggtgccgccaagaacttcgagtccagcaacctggacctgaagtccgacatccacgagatcaacgcgatcctcgtgggcattttcggtaacgagcaggtccagttcaacgatcagtatgtggagaagctgaaggaggtgctgctcgacagcactcagtcccgctccgaccggcagaaggcggccgccaaggtgctgctgcccaccaacgacctagacaaggacacaaccaagatcttaaagacggtctccaccgagattaccaaggccatcaccggactgaaggcgaagttcttcgtgatcaccggcaacgacatcgccaaggaccagcagaaggactggaccttcagtatcgacaccctagacgagaagatgtccgtgatcgagcccagcttcagcgagaagaacttcagcctgatcaccatcctgcagaaactttactccagcgtcacgctggccgggatcgtgccgaacggcctaagcctctccgaagccatgatccagaagtacgaccgccacgccagcgatctggtgctgctcaagaagtactgggacaccaagcccaaggtactgaagcaccagctgcagaacacctacgcggagtacatcgagatccaccaggtcgtggatgagttttactccgacctcagcaagctgatcaagaacgacgacgacaccctggcccaagagatcaaatccaagatcacgatcggcaacttcctccccaagcagaggaccaccgagaacggggtcatcccctaccagctgcagcagcgcgagctggatacgatcatcaagaaccagcaggaatactatccgtggctcgcggaggaaaaccccgtggcagaccaccaaatcgccttcccctacaagctggacgagctggtgggattccgcatcccctattacgtcgggccgatgatcgcgaaagaggacacgagcaactccaagaacagcaagttcgcttggatgatccggaagcagtccggcgaagtgaccccctggaacttcgatgagaaaatcgaccgcaccgccagcgcgaccgcctttatcgaccggatgacgaccaccgacacctatctcatcggggaggacgtgctgcctaagcagtccctgatctaccaacgcttcgaggtcctcaacgagctgaacaagatctcgatcgacggccagcccatcacgcggaagcagaagcagtccgtgtacacgcacgtctttgagaagaagaagaccgtccaggtgaaggacgtgcaaaaattcctggtgagctccggcgaggtgatgagcctgccgaagatcgggggcctcgcgaacgagaagcagttcaactccagcctgtccaccctgtacgactacaacaagatcatccccgacgccctcgaggaccgcaacaaggtcgacgacatcgagaagatcatactgtggtccacgatcttcgaggataacagcatctttgtggagaagctggactccatcgactggctcaccagctcccagaggaagcgcctggcccagaagcggtaccgcggctggggccggctgagcttgcggctgctgaccaccttcaagaacaaggacgggtactccatcctcgacgagctgtggaacagcaaccacaacttcatggagatccaagcccagtccgactttagcgagcaaatcgcgaccgccaacaacaacaacctgtcccaggtgctccccgccaagtgggagcccggccggaagaatctggccagcctggacgagttcatctccaacctctacacgagcccgcagaacaagaaggccctgcggaaggccatccgggtcgtgcaggacatgatgaccgccgcaggccacatgcccgagaagatcttcattgaggtagcccgtgacacctccaacagccaccagcagaccatcgcccggcagcgccagttgcagcagctctaccagtccgaggcgaaggaggtcatcgacagctccgtccggtccgagctggacgatatcctgaagaaccgcgccaacatcaaggaccagctgttcctgtacttccagcagggcgggcgcgacctgtacacgggcaaggccataaacatcgacaagctctcactataccacatcgatcacatcctgccccagtccctcgtgaaggacgacagcctcgacaaccgtgtcctggtgtcccagaagacgaacgaggacaagggcgtgaccttcgtcagcgacaaatacatgaacaacatgctccccacctggaaacgctggcacgagatggggctgatctctgcacggaagctgaagaacctcaccatgagaccggacgagatcgacaagtacgcccctggtttcattcagcggcagctggtggagacacgccaagtgaccaagctggtcatcgagctcctggatgcgctgctaggcaactcccaaaccgagatcatcacgatcaaggcgtccctgagccaccagttccggcagcagttcgacctggtgaagatccgcgaggtgaacgacaaccaccacgcatttgacgccttcctcgcggcccgcatcgggacctacctgtacaagcgctaccccaagctgcggccgtacttcgtctacggccagtatatgcagaaccacaagaatctcaagtccatcaacctgatcaagaccctggacagcgacaaggccatcgttgacgaggggaccggcgagatcctatgggacaagaagtccgacttagccaagatgatcaagatctataactaccagcgcctgctcatcacgcacgagagccggacctccttcggcgccatgtacaagcaaaagatcctgaaggcgacggacgccaagcagaacgggggagggttcaagctggtgcccaccaagcgcaactggcccgtcgacatctacggcgggtacacgggccagaccgccgcctacctcaccatagtgcgggtgtacagcaagaagacctccgagctgcgcgtcctgcccatctacacgaataaggtgcagcagatcgaaaaggccatgacccagggcgacaaggcgaccatgctcgccttcaagaaggtgatcgccccgcagctcgggaaggagaacaaaaagacccatgagatcaagatccccgagttcgacgtcgtaatccccaaggtgctgctcgaccagctggtcatcgacgacatcgccggcagcccccaccggttccgcctggggacggacacttactaccataactcccagcagctgttcctaccgctgagcatgcagcggcagctcatggaccgcgagtccgacgacaaggtgtatctggacatcttcaacgatgtgctgaaacaagtcgactcgtacttcaacctctatgacgtgaacggcttccgggccgcgctgcaaaagtccaagaaggccttcgagcagctgcccatcaacgacttccccaaggacgtgcccgacaacaagaagaagaaggggaagcgcagcatcctcaaggaaatctttatcggcttgcacgccaacgccaccctgggcaacctcaagcagatggggatcaaaaccgacttcgggaagctgcagaagtccaacgggctgagaatcacggagaactgtaagatcattcaccagtcgcccaccggcctcttcgagcggatcgtccccatcaagtga

SEQ ID NO: 7744 - RNA, 4107 nt, synthetic construct
  misc_feature 1..4107: note = Cas9 variant
  source 1..4107: mol_type = other RNA
atgagccgcccctacaacatcggcctggatatcgggacctccagcatcggctggtccgtcgtcgacgaccagagcaagctcgtgtccgtgcgggggaagtacggctacggggtccgcctatacgacgagggccagaccgccgccgagcggcgcagcttccggacgacccgccggcgcctgaagcggagaaagtggcggctcggcctgctgcgggagatcttcgagccgtacatcacccccgtggacgacaccttcttcctccggcagaagcagtccaacctgagccccaaggaccagcgcaagctgtacccccagacgtccctcttcaacgaccggaccgaccgcgcgttctacgacgactatccgaccatttaccacctcaggtacaagctgatgaccgagaagcgccagttcgacatccgggagatctacctggccatgcatcacatcgtgaagtaccgcgggcacttcctgaacgaggcccccgtcagctccttcaagagctccgagatcaacctggtggcccacttcgaccggctcaacacgatcttcgccgacctgttcagcgagtccggcttccagctggagaccgacaagctcgcggaagtgaaggccctgctgctcgataaccagcagagcgcctccaaccgccagcgccaggccctgagcctgatctacaccccctccaccaacaaggccgtcgagaagcagaacaaggccatcgccacggagctcctgaaggccatcctggggctcaaggccaagttcaacgtgctgaccggcatcgaggcggaggacgtgaaggcctggaccctgaccttcaacgccgagaacttcgacgaggagatggtgaagctcgagagcagcctggacgacaacgcccatcagatcatcgagtccctgcaggagctctacagcggggtgctgctggccggcatcgtgcccgagaaccagtcccttagccaggcgatgatcacgaagtacgacgaccaccagaagcacttgaagatgctgaaggccgtccgggaggccctcgctccggaggaccgccagcggctgaagcaggcctacgaccagtacgtggacggccaggaaaacaccaaggcgtactccaaggaagacttctacggagacatcaccaaggccctgaagaacaaccccgaccaccccatcgtgagcgagatcaagaagttaatcgagctggaccagttcatgcccaagcagcgcaccaaggacaacggcgccatcccgcaccagctgcaccagcaggagctcgaccggatcatcgagaaccagcagcagtactacccctggctggccgagctgaatcccaattccaagcgccagacggtcgccaagtacaagctcgacgagctggtggcgtttcgggtgccctactacgtcgggccgctgatcaccgccgagcagcagcgccagagctccgacgccaagttcgcctggctgatccggaaggcggagggccgcatcaccccttggaacttcgacgacaaggtggaccggcaggcgagcgccaacgagttcatcaagcgcatgaccacgaccgatacctacctcctggccgaagacgtgctgcccaagcagtccctcatctaccagcggttcgaggtcctgaacgaactgaacggcctcaagatcgacgaccagcccatcaccacggagctgaagcaggccatcttcaccgacctgttcatgcagaagatcagcgtgaccgtcaagaacatccaggactacctcgtgtccgagaagcgctacgcgagccggccagccatcaccgggctgtccgacgagaacaagttcaacagccgcctgtccacgtaccacgacctcaagatgatcgtgggcgacgccgtcgacgacgtggacaagcaggccgacctggagaaatgcatcgagtggagcaccatcttcgaggacgggaagatttactccgccaaactgaacgaaatcgactggctcaccgaccagcagcgggtgcagctggctgcaaagcgctaccggggctgggggcgcctgagcgcgaaactcctgacccagatcgtcaacgccaacggccagcgcatcatggacctgctctgggacacgaccgacaacttcatgcggatcgtgcacagcgaggacttcgacaagctgatcaccgaggccaaccagatgatgctggcggagaacgacgtgcaggacgtcatcaacgacctctacaccagcccccagaacaagaaggccttacgccagatcctgctcgtggtgaacgacatccagaaggccatgaagggccaggcccccgagcggatcctgatcgagttcgcgcgcgaggacgaggtcaacccccggctgtccgtgcagcgcaagcgccaggtggagcaggtctaccagaacatctccaacgagctcctgaacaataccgagatccggaacgagctgaaggacctctcgaactccgccctaagcaacacgcggctgttcctctacttcatgcagggcggtcgcgacatgtacactggggactccctgaacatcgaccggctgagcacctacgatatagaccacatcttaccgcagtcgttcgtgaaggacaacagcctggacaaccgcgttctggtctcccagaagatgaacagaagcaaggccgaccaggtgcccaccgacttcacgtccgtggagctcggcaagaagatgcagctgcagtgggagcagatgctgcgcgccgggctcatcaccaagaagaagtacgacaatctgaccctgaaccccgaccacatcagcaagtacgccatgaagggcttcatcaaccggcagctcgtagagacccgccaagtgatcaagctggcgacaaacctgctcatggaacagtacggcgaggacaacatcgagctgatcaccgtgaagtccgggctgacccaccagatgcggaccgagttcgacttccccaagaaccgcaacctcaacaaccaccaccatgccttcgacgcctacctgacggccttcgtcggtctgtacctcctgaagcggtacccgaagctgaagccctacttcgtatacggggagtaccagaaggccagccagcaggacaagtggcgcaacttcaacttcctcaacggtctgaagaaggatgagctggtggacgagaacaccgaggcggtcatctgggacaaggagtccgggctcgcctacctgaacaagatctaccagttcaagaagatcttggtgacccgggaggtgcacgagaacagcggcgccttattcaaccagaccctgtacgccgccaaggacgacaaggcgagcggccagggcggtaagcaactgatccccgccaagcaggaccgcccgacggccttatacgggggctactccggcaagacctccgcctacctgtgcctggtgaagatcaagaacaagtccgagtatatctaccgcatcttcggggtgaacacctcttggtccagcgagctcaagcagatccaggaccccgcggagcggctggtgcgcctggagaagctcctgacgccccagctcaccatcaacaagaagaagaagggtgagcccgtcccggtgaccaaggacttcaagatcatcctcccccggatcctgatcaaccagaagttctactcccgcgggcaggacatcagcatcgcctccgagttctacctgcataacgagcaagagctcgtgctggacaagagcgacatcaagatcctgaacggcgccatcaaggtcaacaactccaacaaacaggtgatcaacctcttcaaccacatcctggagcaggtcaaccagtatttccccgtttacgacatttataagagccgggaggtgctgaactccagcaaggagatctttgaaaacctcacctggaacgaccagtggcgcaaccggaagctgatcaacgtgggccagaagaccatcttgaaccgcatcctcatcggcctgcacgccaacgccgcgcggatcaagatctccgagctgggcttcaagaacgacttcgggctcctgacgcagaccagcggcatcaccttcacccccgacacgcagatcatctaccagtcccctacggggctgttcgagcgccgggtggccctgcgcgacctctga

SEQ ID NO: 7745 - RNA, 4107 nt, synthetic construct
  misc_feature 1..4107: note = Cas9 variant
  source 1..4107: mol_type = other RNA
atgaagcgcagctacaatattgggctggacatcgggacgaactccattggctgggctatagtggacgatcagagcaaactaattagtgtcaaggggaagtacggctatggggtgcggttgtatgacgaaggacagacggcagcggagcgccggagcttccgcaccactcggagacggctgaagcgccgtaagtggcgcctcggtttgctgcgggagatcttcgaaccgtacatcacgccaatcgactccacctttttcctccgccagaaacagagcaacttgtccccgaaggaccagcggaagctgtacccccagacgagcctgttcaatgatcgccctgacgcggacttctaccagcagtacccgacgatctaccacttacggtatcagctgatgaccgagaagcgccagttcgacatccgggagatctatctcgcaatgcaccacatcgtgaagtaccgaggacatttcctgaacgaggcccccgtcgcctcctttaagagcagcgagatcaacttggctgagcacttcgaccagctcaacaccatcttcgccgacctgttccgggagtcaggctttcaactggagacggacgaattagtggccgtgaaggccctgctgatggacaaccagcagtcggctagcaaccggcagcggaaggccctccccaagctgtacaccccctcagctgacaagagcatcgagaagcagcgcaaggcaatcgcgaccgaaatactaaaggccatcctagggctgaaggcgaagttcaacgtcgtgaccggcattgaagcggaggacgtgaaggcctgggccctgacctttaatgcggagaacttcgacgaagaactcgccaagctggagtccagcctagacgacaacgggcacgaggtcatcggcatactccaagagctgtactccggcatcctgttagccggcatcgtgccggaaaatcagagcctgagccaggccatgatcaccaagtacgaggagcaccaggcccacctgaagatgctcaaggcggtaagggacgacctggccaccgccgatcagcagaagttaaagaaggcctacgaccaatatatcgacggccaagagaacaccaaggcctactccaaggaggccttttacgacgacgtcactaaggccctcaaagattacagcgagcagcccctggtgtccgagatccagaaacttatcgagctcgaccaattcatgcccaagcaacggaccaaggacaacggggccatcccccaccagctgcaccagcaggagctggaccgcataatcgagaaccaacaacagtattacccatggctcgccgagctcaaccccaatcctaagcggcaaacggtcgcgaagtacaagctggatgagctcgtcgccttccgcgtaccctactacgttgggccattaatcaccgccgaacagcagcagcagagcagtaatgccaaattcgcctggatgatccggaaaacggagggacgcataaccccctggaacttcgacgacaaggtcgaccggcaggcgagtgccaacgagttcatcaagcgcatgaccaccacggacacttatctgctggccgaggacgtgctcccaaaacagtccctcatctaccagcggttcgaggtcttgaacgaactcaacgggctgaaaatcgacgaccagcccataaccaacgagctgaaacaggccatcttcaacgatttattcatgcagaagactagcgtctcggtgaagaacatccaggactacctggttagtgagaagaggtacgcctcccggccagccatcacaggcctgtccgacgagaagaagttcaactcccgcctgagcacctaccacgacctgaaggtcattgtgggagacgccgtggacgacgtggacaagcaggccgacctcgagaagtgcatcgagtggtccaccatcttcgaggatggcaagatctacagcgctaagctcaacgagattacctggctgacggaacaacaacggggccagctggccaccaagcgctaccggggttggggtcgcctctcggcgaagctgctgacacagatagtgaacgcaaacgggcaacggattatggacctactgtgggacaccacggacaacttcatgcgcatcgtccacttcgaggacttcgacaagttaatcaccgaggccaaccagatggtgttggcggagaatgatgtgcaagacgtcatcaacgatctgtacacgagcccccagaataagaaagcgctccggcagatcctcctggtagtgaatgacatccagaaggccatgaagggacaagccccagaacgcattctgatagagttcgctcgcggggcccagaaggacaaatcactaaccgtccggcgcaagcggaagctggacgagatgtacagccagatctccgacgcagtattggcagacgagtccgtgcgccaggaactcaagtcatccaaccaggacgacctggtcaaggagaaggtgtacctgtacttcatgcagggcgggcgggacctttacaccggcaacgccctgaacatcgaccggctgtcagactaccacgtggaccacatcatcccccaggcctacattaaggacgactccctcgacaataaggcgctggtcagttctcggatgaacgagattaaggctgaccgcgtgccactccaagtggtacagaagcagttcggtaagaacatggcctcggagtgggggtacatgcaccgggccggcctgatatcccgcaagaagtacgacaacctgatgttcaaccccgagaatcttaacaagtaccaaatcaaccggttcatcagccgccagctcgtggagacgcagcaggttatcaaattggtggccaacctgctctccaaccagtatgagggggacaacgtcaagatcatcaccgtaaagtcaaagctgacacagacaatccggtcggagttcgatttccccaagaaccgggaggtgaacaactaccaccacgccttcgacgcgtacctgacagctttcgtgggcatgtacctcctgaaacgataccccaagttgagctcctacttcacctacggggagtacctcaagggcaaccagcaagacaaatggagctccttcaacttcctgaacgacttgaagcgcgcgaagctcgaggacaagaccaacaaggagatcttctggcacaaagagagcggcctggcctacctgaacaagatctatcagttcaagaagatcctcgtgacccgtgaagtccacgagaacagcggggcactgttcaaccagacgctgtacgcagccaaggacgacaaggcgtccggccagggcgggaaacaactcatcccggccaagcaggcgcgccccaccgccctttatggtgggtactccgggaagacggtcgcctacatgtgcatcgtacggatcaagaacaagaaaggggatctatacaaggtttgcggcgtggagacctcctggctcgcccagctgaagcagctgaaggacgaagacagccagaaggcctttctcaagcagaagatcagcccacagttcacgaaggcgaagaagcagaagggaaccatcgttaaagtcgtggaagacttcgaggtgatcgccccgcacatcctgattaaccaacgcttattcgacaacggccaggagctcaccctgggcagcgccacatacaagcataacgagcaggagctgatactcgataagaccgccgttaagctgttgaacggcgagctccccttggcccagtccgaggagctggcggagctagtgtatgacgagatcctggaccaggttatgcactatttcccactgtacgacactaatcaattccgggctaagctcctggccggcaaaaccgccttcatgcagctgccctggaagtccaacccggacgacaataagaccgtccaaatcacgcagcccatcgtgctcaagaagatcctgcaggggctccatgcagacgcaggccgcgtgtccctcaaggagctggggatgaccaccgacttcggcatgctgcaaaaggctaccggcatcacgttcaccccggacacccaaatcatctaccaaagccccaccggactgttcgagcgccgggtcgccctgagagacctctga

SEQ ID NO: 7746 - RNA, 4107 nt, synthetic construct
  misc_feature 1..4107: note = Cas9 variant
  source 1..4107: mol_type = other RNA
atggacaagaagtacagcatcggcctggacatcgggaccaactccgtgggctgggcagtcatcaccgacgactacaaggtccccagcaaaaagttcaaggtgctggggaacacggaccgccactccattaagaagaacctgatcggcgccctgctgttcgacagcggggagaccgcggaggccacccggctgaagcgcaccgctcgtcgccggtacacgcgccggaagaaccgcatttgctacctgcaggagatcttcagtaacgagatggccaaggtcgacgacagcttcttccaccgcctcgaggagtccttcctggtggaggaggacaagaagcacgagcgccacccgatcttcggcaacatcgtggacgaagtcgcctaccacgagaaataccccaccatctaccacctccggaagaagctcgtggacagcaccgacaaggcggacctgcgcctgatatacctcgcccttgcacacatgatcaagttccggggccacttcctgatcgagggggacctcaaccccgacaactccgacgtggacaagctgttcatccagctggtgcagacttacaaccagctttttgaggagaaccccatcaacgccagcggcgtggacgcgaaggccatcctgtccgcccgcctgagcaagtcccggcgcctcgagaacctgatcgcccagctgccgggggagaagaagaacggcctcttcgggaacctgatcgccctgagcctcggcctgacgcccaacttcaagtccaacttcgatctggcggaggacgccaagctccagctgagcaaggacacctacgacgacgacctggacaaccttctggcccagatcggcgaccagtacgccgacctgttcctcgccgcgaagaacctgtccgacgcgatcctgctcagcgacatcctgcgggtaaataccgagatcaccaaggccccgctgtccgccagcatgatcaagcgctacgacgagcaccaccaggacctaacgctgctgaaggccctcgtccggcagcagctgcccgagaaatataaggagatcttcttcgatcagagcaagaacgggtacgcgggctacatcgacgggggcgccagtcaggaggagttctacaagttcatcaagccgatcctggagaagatggacggcaccgaggagctcctggtgaagttaaaccgcgaggacctgctccggaagcagcgcaccttcgacaacgggagcatcccccaccagatccacctgggcgagctgcacgccatcctccgccggcaggaggacttctaccccttcctgaaggacaaccgcgaaaagatcgagaagatcctgaccttccggatcccctactacgtggggccgctcgcccgcggcaactcccggttcgcctggatgacgcgcaagagcgaggagaccatcaccccctggaacttcgaggaggtcgtggacaagggcgcgtccgcccagagcttcatcgagcggatgaccaacttcgataagaacctgcccaacgagaaggtgctgccgaagcactccctcctgtacgagtacttcacggtctacaacgagctgaccaaggtgaagtacgtgaccgaaggcatgcgcaagccggccttcctcagcggggagcagaagaaggccatcgtcgacctgctgttcaagaccaaccggaaggtcacggtgaagcagctcaaggaggactacttcaagaagatcgagtgcttcgacagcgtcgagatcagcggggtggaggaccgcttcaatgcgtccctgggcacctaccacgaccttctcaagatcatcaaggacaaggacttcctggacaacgaggagaacgaggatatcctggaggacatcgtcctcaccctgaccctgttcgaggaccgggagatgatcgaggagcgcctcaagacgtacgcccacctgttcgacgataaggtgatgaagcagctgaaacggcgccggtacaccgggtggggccgcctcagccggaagctgattaacgggatccgcgacaaacagtccggcaagaccatcctggacttcctcaagagcgacggcttcgccaaccgcaacttcatgcagctgatccacgacgactccctgaccttcaaagaggacatccagaaggcccaggtgagcgggcagggcgactccctccacgagcacatcgccaacctggcggggtcacccgccatcaagaagggcatcctgcagacggtcaaggtggtggacgagctcgtcaaggtgatgggccgccacaagcccgagaacatcgtgatcgagatggcacgcgagaaccagaccacccagaagggccaaaagaactcccgggagcgcatgaagcggatcgaggagggcatcaaggagctggggagccagatcctgaaggagcaccccgtcgagaacactcagctccaaaacgagaagctgtatctgtactacctccagaacggccgcgacatgtacgttgaccaggagctggacatcaaccggcttagcgactacgacgtcgaccacatcgtcccgcagtccttcctcaaggacgacagcatcgacaacaaggtgctgacgcgctccgacaagaaccggggcaagagcgacaacgtgccctccgaggaggtcgtgaagaagatgaagaactactggcgccagctgctcaacgccaagctgatcacccagcgtaagttcgacaacctgaccaaggccgagcgcgggggcctctccgagctggacaaggcggggttcatcaagcggcagttggtggagacccgccagatcaccaagcacgtcgcccagatactcgactcccggatgaacacgaagtacgacgagaacgacaagctgatccgcgaggtgaaggttatcaccctcaagtcaaagctcgtctcggacttccggaaggacttccagttctacaaggtgcgcgagatcaacaactaccaccacgcccacgacgcctacctgaacgccgtggtcggcaccgcgctgatcaagaagtaccccaagctcgagagcgagttcgtctacggggactacaaggtgtacgacgtccggaagatgatcgccaagtccgagcaggagataggcaaggccactgccaagtacttcttctatagcaacatcatgaacttcttcaagacggagatcaccctggcaaacggggagatccgcaagcgccccctgatcgagaccaacggcgagaccggcgagatcgtgtgggataaggggcgcgacttcgccacggtgcggaaggtcctctccatgcctcaggtgaacatcgtgaagaagaccgaggtccagaccggcgggttcagcaaggagtccatcctgcccaagcgcaactcagacaagctgatcgcccgcaagaaggactgggaccccaagaagtacggcgggttcgactcccccaccgtggcctactcggttctcgtcgtggccaaggtggagaagggcaagagcaaaaagctgaagtccgtcaaggagctgctcggcatcacgatcatggagcggagctccttcgagaagaatccgatcgacttcctcgaggcgaaggggtacaaggaggtgaagaaggacctgatcatcaagctccccaagtacagcctgttcgagttggagaacggccgcaagcggatgctcgcctccgccggggagttacagaagggcaacgagctggccctccccagcaagtacgtaaacttcctgtacctggcctcccattacgagaagctcaaggggagcccggaggacaacgagcagaagcaactgttcgtcgagcagcacaagcactacctggacgagatcatcgagcagatctccgagttcagcaagcgcgtaatcctcgcggacgcaaacctcgataaagtgctgtccgcctacaacaagcaccgggacaagcccatccgcgagcaggccgaaaacatcatccacctcttcaccctgaccaacctgggcgcccccgcggccttcaagtacttcgacaccactatcgaccgaaagcgctacacaagcaccaaggaggtcctcgacgccaccctgatccaccagtccatcacgggcctgtacgagacccgaatcgacctcagccagctcgggggcgactga

SEQ ID NO: 7747 - RNA, 4107 nt, synthetic construct
  misc_feature 1..4107: note = Cas9 variant
  source 1..4107: mol_type = other RNA
atggacaagaagtacagcatcggcctggacatcgggaccaactccgtgggctgggccgtcatcaccgatgactacaaggtgcccagcaagaaactcaaggggctgggcaatacggaccgccacgggatcaagaagaacctgatcggcgccctcctgttcgactccggcgagaccgcggaggctacccggctgaagcgcaccgcccggcgccggtacacgcgccggaaaaaccgcatctgctacctccaggagatcttcagcaacgagatggccaaggtggacgattccttcttccaccggctggaggagagcttcctggtcgaggaggacaagaagcacgagagacacccgatcttcgggaacatcgtggacgaggtggcctaccacgagaagtaccccaccatctaccacctccggaagaagctggcagactccacggacaaggtcgacctgcgcctcatctacctggccctggcccacatgatcaagttccggggccatttcctcatcgagggggacctgaaccccgacaacagcgacgtggacaagctgttcatccagctcgtgcagacctacaaccagttattcgaggagaaccccatcaacgcctcccgcgtcgacgccaaggccatcctgagcgcccggctctccaagagccgccggctggagaacctgatcgcccagctcccgggcgagaagaagaacgggctgttcggcaacctgatcgccctctccctgggcctgacgcccaacttcaagagcaacttcgacctcgcggaggacgccaagctgcagctgtccaaggacacctacgatgacgacctcgacaacctgctggcccagatcggggaccagtacgccgatctcttcctggccgcgaagaacctgagcgacgccaccctcctgtccgacatcctgcgcgtgaacagcgagatcaccaaggcgcccctctccgcaagcatgattaagcggtacgacgagcaccaccaggacctgacgctgctcaaggccctggtgcgccagcagctgcccgagaagtacaaggagatcttcttcgaccagagcaagaacggctacgccgggtacatcgacggcggcgcctcccaggaggagttctacaagttcatcaagccgatcctcgagaagatggacgggaccgaggagctgctggccaagctgaaccgggaggacctcttacgaaagcagcgcaccttcgacaacggcagcatcccctaccagatccacctgggggagctccacgccatcctgcggcgccaggaggacttctaccccttcctgaaagacaaccgggaaaagatcgagaagatcctcacattccgcatcccctactacgtcggacctctggcccgggggaacagccgcttcgcgtggatgacgcgcaagagcgaggagaccatcaccccctggaacttcgaggaggtcgtggacaagggcgcctccgcccagagcttcatcgagcggatgaccaacttcgacaagaacctgcccaacgagaaggtcctacccaagcactccctgctgtacgagtacttcacggtgtacaacgagcttaccaaggtgaagtacgtaaccgagggcatgcggaagccggccttcctgagcggggagcaaaagaaggcgatcgtggacctcctgttcaagaccaaccgcaaggtgacggtcaagcagctaaaggaagactacttcaagaagatcgagtgcttcgactccgtggagatcagcggcgtggaggaccggttcaacgcctccctggggacctaccacgacctcctgaagatcataaaggacaaggacttcctggacaacgaggagaacgaggacatcctcgaggacatcgtcctgaccctgaccctcttcgaggaccgcgagatgatcgaggagcgactgaagacgtacgcccacctgttcgacgacaaagtgatgaagcagctcaagcgcagaaggtacaccggctgggggcggctgagccgcaagctgatcaacggcatccgggataagcagtccggcaagaccatactcgacttcctcaagagcgacgggttcgccaaccgcaacttcatgcagctgatccacgacgactccctcaccttcaaggaggacatccagaaggcccaggtcagcggccagggggactccctgcacgagcacatcgcgaacctggccggcagccccgccatcaagaaggggatcctccagacggtgaaggtggtcgacgaactggtgaaggtgatgggccgccacaagcccgagaacatcgtcatcgagatggcccgggagaaccagaccacccagaagggccagaagaacagtcgcgagcggatgaagcgcatcgaggaggggatcaaggagctgggcagcgacatcctcaaggagtaccccgtggagaacacccagctgcagaacgagaagctgtacttgtactacctgcagaacgggcgggacatgtacgtcgatcaggagctagacatcaaccgcctcagcgactacgatgtcgaccacatcgtgccgcagtccttcctgaaggacgacagcattgacaacaaggtgctgacgcggtccgacaagaaccgcggcaaaagcgacaacgtcccctccgaagaggtggtgaagaagatgaagaactactggcgccagctcctaaacgccaagctgattacccagcgcaagttcgacaacctcaccaaggcggagcggggcgggctgagcgagctggacaaggtcggctttatcaagcgccagctcgtggagacccggcagatcaccaagcacgtcgcccagatcctggactcccgcatgaacacgaaatacgacgagaacgacaagctgatccgggaggtccgcgtgatcaccctcaagagcaagctggtgtccgacttccggaaggacttccagttctacaaggtccgcgagatcaacaactaccaccacgcccacgacgcctacctgaacgccgtggtggggaccgcgctcatcaaaaagtaccccaagttagagagcgagttcgtctacggcgactacaaggtgtacgacgtgcggaagatgatcgctaagtcagagcaggagatcgggaaggccaccgccaagtacttcttttacagcaacatcatgaacttcttcaagacggaaatcaccctggcgaacggcgagatccgcaagcggccgctcatcgagaccaacggcgagaccggtgagatcgtctgggacaagggccgcgacttcgccacagtgcgcaaggtgctgtccatgccgcaagtcaacatcgtgaagaaaaccgaggtgcagaccgggggcttcagcaaggagtccatcctgcccaagcggaacagcgacaagctcatcgcccgcaagaaggactgggaccccaaaaagtacggtggcttcgactcccccaccgtcgcatacagcgtgctggtggtcgccaaggtggagaagggcaagagcaagaagctgaaatccgtgaaggagctcctggggataacgatcatggagcggagctccttcgagaaggacccgatcgacttcctggaggcgaagggctacaaggaggtccgcaaggacctcattatcaagctgcccaagtacagcctgtttgagctcgagaacgggcggaagcgcatgctggcctccgccggcgagctgcagaaggggaacgagctcgccctgcccagcaagtatgtgaacttcctgtacctcgccagccactacgagaagctgaagggcagcccggaggacaacgagcagaagcagctgttcgtggagcagcacaagcactacctcgacgagatcatcgagcagatctccgagttcagcaagcgggtcatcctggcggatgccaacctggacaaggtgctctccgcctacaacaagcaccgcgacaagcccatccgggagcaggccgagaacatcatccacctcttcaccctgaccaacctcggcgcccccgcggccttcaagtacttcgacactacaatcgaccgcaagcggtacaccagcaccaaggaggtgctggacgccaccctgatccaccagtccatcacagggctctacgagacccgcatcgacctgagccagctgggcggggactga

SEQ ID NO: 7748 - RNA, 4107 nt, synthetic construct
  misc_feature 1..4107: note = Cas9 variant
  source 1..4107: mol_type = other RNA
atggacaagaagtacagcatcggccttgacatcgggaccaactccgtgggctgggccgtcatcaccgacgactacaaggtacccagcaagaagttcaaggtgctagggaacacggaccgccactccatcaagaagaacctgatcggcgccctcctcttcgacagcggggagaccgcggaggcaacccggctgaagcgcaccgcgcggaggcggtacacccgccggaagaaccgcatctgctacctgcaggagatcttctccaacgagatggccaaggtcgacgacagcttcttccaccggctcgaggagtccttcctcgtggaggaggacaaaaagcatgagcgccacccgatcttcggcaacattgtggacgaagtcgcctaccacgagaagtaccccaccatctatcacctccggaagaaactcgccgacagcaccgacaaggcagacctgcgcctgatttatctcgcactggcccacatgatcaagttccggggccacttcctgatcgagggggatctcaaccccgacaactccgacgtggataagctgttcatccagctggtgcagacctacaatcagctattcgaggagaaccccatcaacgcgagccgcgtcgacgcaaaggccatcctctccgcgcggctcagcaagtcccgccggctcgagaacctgatcgcccagctgccgggcgagaagcgcaatgggctgttcggcaaccttatcgcgctgtccctcgggctgacgcccaacttcaagtccaacttcgacctggccgaggacgccaagctacagctgagcaaggacacctacgacgatgacctggacaacctcctggcccagatcggcgaccagtacgcagacctgttcctcgcagccaagaatctgtccgacgccatcctgctcagcgatatcctgcgggtgaactctgagatcacgaaggccccgctgagcgcctccatgatcaagcggtacgacgagcaccaccaggacctcaccctgctgaaggcgctcgtccggcagcagctacccgagaaatacaaggagatctttttcgaccagtccaagaacggctacgccgggtacatcgacggcggggcaagccaagaggagttctacaagttcatcaagccgatcctggagaagatggacggcacggaggagctcctggccaagctgaaccgcgaagacctgctccgaaagcagcggaccttcgacaacggctcgatcccccaccagatccacctgggggagttacacgccatcctccgccggcaggaggacttctacccgtttttaaaggacaaccgcgagaagatcgagaagatcctaaccttccggatcccctactacgtcggcccgctcgcgcgcgggaacagccggttcgcgtggatgacccgcaagtccgaagagacgatcactccctggaacttcgaggaggtggtggacaagggtgccagcgcccagtccttcatcgagcggatgaccaactttgacaagaacctgcccaacgagaaggtcctgcccaaacacagcctcctgtacgagtacttcaccgtgtacaatgagctgacaaaggtgaagtacgtcaccgaggggatgcgcaagcctgagttcctctccggcgagcagaagaaggcgatcgtggacctgctgttcaagacaaaccggaaggtgaccgtaaagcagctcaaggaggactacttcaagaagatcgagtgcttcgactcagtggagatctccggcgtggaggaccgcttcaacgccagcctggggacttaccacgacctgttaaagatcatcaaggacaaggacttcctggacaacgaggagaacgaggacatcctggaggacatcgtcctcaccctgaccttgttcgaggaccgggaaatgatcgaggagcgcctcaaaacgtacgcccacctcttcgacgacaaggttatgaagcagctgaagcggcgccggtacacaggctgggggcgcctctccagaaagctgatcaacgggatcagagacaagcagagcgggaagaccatcctggatttcctcaagtccgacggctttgcgaaccgcaacttcatgcagctgatccacgacgacagcctgaccttcaaggaggacatccagaaggcccaggtctccggacagggggacagtctccacgaacatattgcgaacttggccggctcccccgccatcaaaaaggggatcctgcagaccgtgaaagttgtcgacgaactcgtgaaggtgatgggccggcacaagcccgagaacatcgtcatcgagatggcccgcgagaaccagactacccagaaggggcaaaagaacagccgggagaggatgaagagaattgaggaggggattaaggagctgggcagcgacatcctgaaggagtaccccgtggagaacacccagctccagaacgagaagctgtacctgtactacctccagaacgggcgcgatatgtacgtggaccaggagcttgacatcaaccggctatccgactacgacgtcgaccacatcgtgccgcagagcttcatcaaggacgactccatcgacaacaaggtgctcactagaagcgacaagaaccggggcaagtccgacaatgtccccagcgaggaggtggtgaagaagatgaagaactattggaaacaactgctgaacgccaagctcatcactcagcgcaagttcgacaacctgaccaaggcggagcgcgggggcctgtccgagctcgacaaggccggcttcatcaagcggcagctggtcgagacccggcagatcaccaagcacgtggcccagatcttagacagccgcatgaacaccaagtacgacgagaatgacaaactcatccgggaggtgaaggtcatcacgctgaagtccaagctggtgagcgacttccgaaaggacttccagttctacaaggtgcgggagatcaacaactaccaccatgctcacgacgcctacttaaacgccgtcgtgggaaccgccctgatcaagaagtaccccaagctggagtccgagttcgtctacggcgactacaaggtctacgacgtgcgcaagatgatcgccaagagcgagcaggagatcggcaaggccaccgcgaaatacttcttctactccaacattatgaacttcttcaagaccgagatcacgctcgccaacggcgagatacggaagcgccccctcatcgagaccaacggggagaccggcgagatcgtctgggacaagggacgggacttcgccaccgtccgcaaggtgctgagcatgccccaggtgaacatcgtcaagaagacggaggttcagacgggtgggttctccaaggagtccatcctccccaagcgtaactccgacaagctgatcgcccggaagaaagactgggaccccaagaagtacggagggttcgactcacccaccgtggcctacagcgtcctggtggtggcgaaggttgaaaaggggaagtccaagaagctcaagagcgtgaaggagctgctgggcatcacgatcatggagcgctccagcttcgagaagaacccgattgacttcctcgaggccaagggctacaaggaggttcggaaggacctgatcatcaagctgcccaagtactccctcttcgagttagagaacgggcgcaagcggatgctggccagcgccggggagctccaaaaggggaacgagctggccctgccctctaagtacgtcaactttctctacctggcaagccactacgagaagctgaagggctccccggaggacaacgagcagaaacagctgtttgtcgagcagcacaagcactacctggacgaaatcattgagcagatctcagagttctctaagcgcgtgatcctggccgacgctaacttggacaaggtcctgagcgcctacaacaagcaccgggacaagcccatcagggagcaggccgaaaacatcatccacctattcacgctcaccaacttcggggcgcccgccgccttcatctacttcgacaccacaatcggccggaaccgctacaagtccatcaaggaggtgctggacgccacgctgatacaccagtcgatcaccggcctctacgaaacccggatcgacctgtcccagctcgggggcgactga

SEQ ID NO: 7749 - RNA, 4107 nt, synthetic construct; identical to SEQ ID NO: 1949
  misc_feature 1..4107: note = Cas9 variant
  source 1..4107: mol_type = other RNA

SEQ ID NO: 7750 - RNA, 4107 nt, synthetic construct
  misc_feature 1..4107: note = Cas9 variant
  source 1..4107: mol_type = other RNA
atgtccagaccctacaacataggcctagacataggtacctcctccataggctggagcgtcgtcgacgaccagagcaagctagtatcagtgcgaggcaagtacggctacggcgtccgcctatacgacgaaggccaaactgccgcagaacgccgcagtttcaggactacgcgtcggcgcctcaaacgacgtaagtggcgtctaggtctattgcgcgaaatcttcgagccatacattaccccagtagacgacactttcttcctccgaaagaaacagagtaacctatcaccgaaagaccaacggaagctatacccacagacttccctcttcaacgaccggaccgaccgcgccttttacgacgattacccaactatctaccacctccgctacaaactaatgaccgagaaaagacagttcgacatacgagaaatatatctggccatgcaccacatcgtaaagtaccgcggccacttcctcaacgaagcgccagtctcctcttttaaaagcagtgaaataaacctggtcgcacactttgaccgtcttaacaccatcttcgctgacctcttttccgagtccggcttccaactcgagacagacaaactagcagaagtgaaagccctactcctcgacaatcaccaaagcgcctctaacagacaacgccaagctctcctccttatatacaccccatcaaccaacaaggccgtcgaaaaacaaaacaaagcaatcgccacggaactactcaaagccattttaggactcaaagctaagttcaacgtgcttacaggaatcgaagccgaagacgtaaaaacctggacgctcactttcaacgccgaaaacttcgacgaagaaatggtcaaactcgaatcctcgctcgacgacaacgcacaccaaataatcgagtctctacaagagctctactcaggcgtactgctggcaggcatagtgccggaaaaccaatcactcagccaagccatgatcaccaagtacgatgaccaccaaaaacacctcaagatgctgaaagccgtccgagaagcgctggcccccgaagacagacaacgcctaaaacaggcatacgaccaatatgtcgacggccaagagaacaccaaagcatactccaaagaagacttctacggcgacatcaccaaagcattgaagaataatccggaccatccaatagtctccgagatcaagaaactcatagaactcgatcaattcatgcccaagcaacgaaccaaagacaacggggccattccccatcaactccaccaacaagaactcgatcgcattatcgaaaaccagcaacaatactacccttggctcgccgagctcaaccccaactccaaacgtcaaactgtggcaaaatacaaactcgacgaacttgtggcgttccgagtcccatactatgttggccctttaattaccgcagagcaacaacaacaatcctcggacgcaaaattcgcctggatgattagaaaagcagaaggccaaatcacaccatggaacttcgacgacaaggtagaccggcaagcatccgccaacgagttcataaaacgaatgaccactacagacacctacctactcgcagaagacgtgctacccaaacaatcactcatttaccaacgattcgaagtcctaaacgagctgaacggcctaaagatagacgaccagcctataactaccgaactgaagcaagcgatttttacagacctatttatgcagaaaacaagcgtcacagtcaaaaacatccaagactacctcgtatcggaaaagcgatacgcatcccgacccgcaatcactggtctgagcgacgaaaacaagtttaactcccgcctctctacataccacgacctcaagaccatagtaggagacgcagtcgacgacgtggacaaacaagcagacctcgagaaatgcatagaatggtccaccatcttcgaggacggaaagatctacagcgccaaactaaacgaaatcgattggctcactgaccagcaacgagtccaactggccgccaaacgatacagaggctggggtagactctccgcaaaactactgacccagatcgtaaacgcaaatggccaacgaattatggacctgctgtgggacaccacagacaactttatgcgcatcgtccactccgaagacttcgacaagttgataacggaagcaaaccaaatgatgctcgccgaaaacgacgtccaagacgtcataaacgacctctacacatccccacagaacaaaaaggcccttcgccaaattttacttgtcgtcaacgacatccagaaagcgatgaaaggtcaagccccggaaagaatcctcatagaatttgcgcgcgaagacgaggtaaacccccgactgagtgtgcaacgcaaacgccaggtagaacaagtttaccaaaatatcagcaatgaactcctcaacaacaccgaaatccgtaacgagctcaaagacctctccaactcagcactttcaaatacccgcttattcctatacttcatgcaaggaggccgggacatgtataccggcgactccctcaacatagatcgactttcaacgtacgatatcgaccacatactaccacagagcttcataaaagacaactccctagacaaccgcgtcctcgtatctcaacgaatgaaccgctcgaaagcagaccaagtccccaccgactttacatcagtagaactagggcagaaaatgcagattcagtgggagcagatgctcagagcaggattaatcacgaaaaagaaatacgacaacctcaccctcaaccccgaccacatatcaaaatacgcaatgaaaggcttcatcaacaggcagctagtcgaaacaaggcaagtaatcaaattagcaaccaacctcctaatggaacaatacggtgaagacaacatagaactcataaccgttaaatccggactaacccaccaaatgcgcactgagttcgacttccccaaaaaccgcaatttgaacaaccaccaccacgctttcgacgcctatctaaccgcgttcgttggactatacctactcaaaagatacccaaaacttaaaccatacttcgtctatggagaataccagaaagcctcacaacaagacaaatggcgtaacttcaacttcctgaatgggctgaaaaaggacgagctcgtcgacgaaaacacagaagcagtcatctggaataaagaatccggactagcatatcttaacaaaatctaccaattcaagaaaatacttgtcactagagaggtacacgagaactcaggagccctcttcaaccaaacactctacgccgccaaagacgacaaagcgtccggccaaggaggaaaacagcttatcccagccaaacaagaccggccaaccgcactttatggcggctacagtgggaaaaccgttgcatacatgtgcatagtcagaataaagaacaagaaaggtgacctctacaaagtctgcggagtcgaaacctcctggcttgctcaactaaaacagctgaccgacgaagactcgaagaaagccttcctcaagcagaaaatcagcccacaattcaccaaagtaaagaaacaaaaaggcaccatagttaaagttgtggaagacttcgaagtcatcgcaccgcacatactaatcaaccagcgatttttcgacaacggacaagagctcaccctcggcagcgcaacatacaaacacaacgagcaagaactaatactcgacaaaaccgcagtcaaactgctcaacggtgcactcccgctaacccaaagcgaagaacttgctgaacaagtctacgacgaaatcttagaccaagtcatgcactacttccctctctacgacaccaaccaatttcgcgcaaaactaagtgccggcaaagccgctttcatgaagctgccttggaaatcccagtgggatggcaacaaaatggtccaagtcggccaacaggtgatcctcgaccgggtactcataggcctacacgcaaacgctgccgtttctgatctcggagtcctaaaaataagcacacctttaggaaagatgcagcaaccgagcggcatttccctctcccccgacacccagataatctaccaaagccctactggcttattcgagagacgagtcgcgctccgagacctatga

SEQ ID NO: 7751 - RNA, 4107 nt, synthetic construct
  misc_feature 1..4107: note = Cas9 variant
  source 1..4107: mol_type = other RNA
atgtcgcgcccctacaacatcggcctggacatcgggacctcaagcatcggctggtccgtggtcgacgaccagagcaagctcgtgtcggtcagagggaagtacggctacggggtccggctgtacgacgagggccagaccgccgccgagcggcgcagcttccggacgacccggcggcgcctgaagcggcgcaaatggcgcctcggtctgctcagggagatcttcgagccgtatatcacccccgtggacgacacattcttcctacggcagaagcagtccaacctgagccccaaggatcagagaaaactgtacccccagacgtccctcttcaacgaccggaccgaccgcgcgttctacgacgactacccgaccatctaccatctgcggtacaagctgatgaccgagaagcgccagttcgacatccgggagatttacctggcaatgcaccacatcgtaaagtaccgcgggcacttcctgaacgaggcccccgtcagctctttcaagtcgtccgagatcaacctcgtggcccacttcgatcggctcaacactattttcgccgacctgttctcggagagtggcttccagttggaaaccgacaagctcgcggaggtgaaggccctgctgctcgacaaccaacagagcgcatccaaccgccagcgccaggctctcagcctgatctacaccccctccaccaacaaagcggtcgagaagcagaacaaggccatcgccactgagttgctgaaggccatcctggggctcaaggccaagtttaatgtactgactcggatcgaggcggaggacgtaaaagcctggaccctgaccttcaacgctgagaacttcgacgaggagatggtcaagctcgagagcagcctggacgacaacgcccaccaaatcatagagtcattacaggagctctatagcggcatcctgctggctgggatcgtgcccgagaaccagtccctctctcaagctatgatcatgaagtacgacgaccaccagaagcacctaaagatgctgaaggccgtacgcgaggccttagccccggaggaccggcaacgcttgaagcaagcgtacgaccagtacgtcgacgggcaggagaacacgaaggcgtacagtaaggaggacttctacggcgacataaccaaagccctgaagaacaaccccgaccaccccattgtgagcgagatcaagaagctcatcgagctggaccaattcatgcccaagcagagaaccaaggacaacggggccatcccgcaccagctgcaccagcaggagctcgaccgcattatcgagaaccagcagcagtactacccgtggctggccgagctgaacccgaactccaagcggcagaccgtcgccaagtacaagctcgacgagctggtcgccttccgcgtgccttactacgtgggcccgctgatcacagcagagcagcagcggcagagctcggacgccaaattcgcctggctgatccgcaaggcggaggggaggatcaccccttggaacttcgacgacaaagtcgaccgccaggccagcgccaacgagttcatcaagcggatgacgaccaccgatacctacctcctggccgaggacgtgctgcccaagcagtccctcatctaccagcgcttcgaggtgctgaacgagctgaacggcctcaagatcgacgaccagcccatcaccaccgagctgaagcaggccatcttcacggacttattcatgcagaagaccagcgtatccgtgaagaatatccaggactacctcgtctcagagaagcggtatgcgtcccggccggccatcaccggcctgagcgacgaaaacaagttcaactcccgtctgtccacctaccacgatctcaaggccatcgtgggggacgccgtcgaggacgtcgacaagcaggtcgacctggagaagtgcgtggagtggtccacgatcttcgaggacggcaagatctacagcgccaagctgaacgagatcgactggctcaccgaccagcagcgcgtgcagcttgctgccaagcggtatcgcggctggggacgactgagtgctaaactcctgacccagatcgtgaacgccaacggacagcggatcatggacctgctctgggacaccacggacaacttcatgcgcatcgtgcactccgaggacttcgacaagctgattaccgaggctaaccagatgatgctggcggagaacgacgtccaggacgtgatcaacgacctctacaccagcccccagaacaagaaggctctgcgtcagatcttactcgtggtcaacgacatacagaaggccatgaagggccaggctcccgagcgcatcctgatcgagttcgcgcgtgaggacgaggtgaacccccgcctgtccgtccagcggaagagacaggtcgagcaggtctatcaaaacatcagcaacgagctcctgaacaacacagagatccggaatgagctgaaagacctctccaacagcgccctgtccaacacccgcctgttcctctattttatgcagggtggccgggacatgtacacgggcgacagcttaaacatcgatcgcctgtccacgtacgacatcgaccacatcctcccgcagagcttcatcaaggacaactccttagacaaccgggtgctggtgagccagaagatgaaccgctccaaagcggaccaggtacccaccgacttcacctcggtggagctggggaaaaagatgcagctgcaatgggagcagatgctacgggccggcctcatcacgaaaaagaaatacgacaacctgaccctgaaccccgaccacatctctaagtacgcgatgaaggggttcatcaaccgccagttagtcgagacacgtcaggtgatcaagctggcgaccaacttactcatggagcaatatggagaggataacatcgagctgatcacggtgaagtccggcctgacacaccagatgcggaccgagttcgacttccccaagaaccggaacctcaacaatcatcaccatgccttcgacgcttacctcaccgcctttgtcggcctgtacctcctgaagcgctacccgaagctgaagccctatttcgtgtacggcgagtaccagaaggcctcccagcaggacaagtggcgaaacttcaacttcctcaacgggctgaagaaagacgagctggtggacgagaacacagaagcggtgatttgggacaaggagtctgggctcgcctacctgaacaagatataccagttcaagaagatactggtgacccgcgaggtgcacgagaacagcggggccttattcaaccagaccctgtacgccgccaaggacgacaaggcatccggccaaggagggaagcagttgatccctgcaaagcaggaccgcccgaccgccctctacggcgggtacagcggcaagacggtcgcctacatgtgcatcgtgcggatcaagaacaagaagggcgacctgtataaagtgtgcggggtcgagacctcctggctggcgcagctcaagcagctgaccgacgaagacagccagaaggcgttcttaaagcagaaaataagcccccagttcacaaaggtcaaaaagcagaagggcacgatcgtgaaggttgtggaagacttcaaggtgatcgcgcctcatatcttaatcaaccagcgcttcttcgacaacgggcaggagctgaccctgggcagtgccacctacaagcacaacgaacaagaactcatcctggacaagactgccgtcaagctgctcaacggggccctgcccctgactcaatccgaggaactcgccgaacaggtctacgacgagatcctggaccaggtgatgcactacttcccgttgtacgacaccaaccaattccgggctaagctcagcgccggcaaagccgctttcatgaagctgccctggaagtccatctgggacggaaacaagatgacccagatcgggcagcagatcatcctggaccgcatcctcatcggcctgcacgccaacgcagccgtgagcgacctgggagtcctcaagatctccactcccctgggtaagatgcagcagcccagcggcatcagcctgagccctgacacccagatcatctaccagtctcccaccggcttattcgagcggcgcgtggctctccgggacctgtga

SEQ ID NO: 7752 - RNA, 4107 nt, synthetic construct; identical to SEQ ID NO: 1952
  misc_feature 1..4107: note = Cas9 variant
  source 1..4107: mol_type = other RNA

SEQ ID NO: 7753 - RNA, 4107 nt, synthetic construct
  misc_feature 1..4107: note = Cas9 variant
  source 1..4107: mol_type = other RNA
atggacaagaagtatagcatcggcctggacatcgggaccaactccgtgggctgggccgtcatcaccgatgactacaaggtgcccagcaagaagttcaaggtgctcgggaacacggaccgccactccatcaagaagaacctgatcggcgccctgctgttcgacagcggggagaccgcggaggccacccggctgaagcgaaccgcccggcgcaggtacacgcgccggaagaaccgcatctgctacctgcaggagatcttctccaacgaaatcgccaaggtcgacgacagcttcttccaccggctcgaggagtccttcctggtggaggaggacaagaagcacgagcgccacccgatcttcggcaacatcgtggacgaggtcgcctaccacgagaagtaccccaccatctaccatcttcggaagaagctcgcggacagcaccgacaaggccgacctgcgcctgatctacctcgccctggcgcacatgatcaagttccggggccacttcctgatcgagggggacctaaaccccgacaactccgacgtggacaagctgttcatccagctggtgcagacctacaaccagctgttcgaggagaatcccatcaacgcgagccgcgtcgacgccaaggccatcctgtccgcccggctgagcaagtcccgtcggctcgagaacctgatcgcccagctgccgggcgagaagcgcaacggcctcttcgggaacctgatcgcgctgagcttagggctaacgcccaacttcaagtccaacttcgacctggccgaggacgccaagctgcagctgagcaaggacacctacgacgacgatctggacaacctcctggcccagatcggtgaccagtacgccgacctattcctcgctgccaagaacctgtccgatgccatcctgctcagcgacatcctgagagtgaacaccgagatcaccaaggccccgctgtccgccagcatgatcaagcgctacgacgagcaccaccaggacctcacgctgctgaaggcgctcgtgcggcagcagctgcccgagaagtataaggagatcttcttcgaccagagcaagaacggctacgccgggtacatcgacggcggggcctcccaggaggagttttacaagttcatcaagcctatcttggagaagatggacggcaccgaggagctcctggccaagctgaaccgcgaggacctactgcgcaagcagaggaccttcgacaacggcagcatcccccatcagatccacctgggggagctgcacgccatcctccgccggcaggaggacttctaccccttcctgaaggacaaccgcgagaagatcgagaagatcctgaccttcaggatcccctactacgtcggcccgctcgcgcgcgggaactcccggttcgcctggatgacgcgcaagagcgaggagaccatcaccccctggaacttcgaggaggtggtggacaagggcgcctccgcccagagcttcatcgagcggatgaccaacttcgacaagaacctgcccaacgagaaggtcctgcccaagcactccctcctgtacgagtacttcacggtgtacaacgagctgacaaaggtgaagtacgtcaccgaggggatgcgcaagccggcgttcctcagcggcgagcagaagaaggccatcgtggacctgttattcaagaccaacaggaaggtcacggtcaagcagctcaaggaggactacttcaagaagatcgagtgcttcgactccgtggagatcagcggcgtggaggaccgcttcaacgcctccttagggacctaccacgacctgctcaagatcatcaaggacaaggacttcctcgacaacgaggagaacgaggacatcctggaggacatcgtcctcacacttaccctgttcgaggaccgggagatgatcgaggagcggctcaagacgtacgcccacctgttcgacgacaaggtgatgaaacagctgaagcggcgccggtacaccggctgggggcgcctcagtcggaagctgatcaacggcatccgcgacaagcagtccggcaagaccatcctcgacttcctaaagagcgacggcttcgccaaccgcaacttcatgcagctgattcacgacgactccctgaccttcaaagaggacctccagaaggcgcaggttagcggccagggggattccctccacgagcacatcgccaacctggccggcagccccgccatcaaaaaggggatcctccagacggtgaaggtggtcgacgagctggtgaaggtgatgggccgacacaagcccgagaacatcgtcatcgagatggcccgtgagaaccagacgacccagaaggggcaaaagaactcccgggagcgcatgaagcggatcgaggagggcatcaaggagctgggcagcgacatactcaaggagtatcccgtggagaccacgcagctgcagaacgagaagctgtacctatactatctgcagaacgggcgcgacatgtacgtggaccaggagctggacatcaaccggctcagcgactacgacgtcgatcacatcgtgccgcagtccttcctgaaggacgacagcatcgacaacaaggtgctgacccgctccgacaagaaccgcggcaagtcggacaacgtcccctccgaggaggtggtgaagaagatgaagaactactggaagcagctcctgaacgcgaagctgatcacccagcgcaaattcgacaacctcaccaaggccgagcgcggaggcctgagcgagctggacaaggccggcttcatcaagcggcaactcgttgagacccggcagatcacgaagcacgtggcccagatcctggactcccgcatgaacaccaagtacgacgagaacgacaagttgatccgggaggtgcgcgtcatcaccctcaagagcaagctggtgtccgacttccggaaggacttccagttctacaaggtgcgcgagatcaacaactaccaccacgcccacgacgcgtacctgaacgccgtcgtggggaccgcccttatcaagaagtaccccaagttagagagcgagttcgtgtacggcgactacaaggtctacgacatccggaaaatgatcgccaagtccgagcaggagatcgggaaggcgacggccaagtacttcttctacagcaacatcatgaacttcttcaagaccgagatcaccctggccaacggcgagatccgcaagcggcccctcattgagaccaacggggagacgggcgagatcgtgtgggacaagggccgcgacttcgccaccgtgcgcaaggtcctgtccatgccccaggtgaacatcgtgaagaagaccgaggtccagacagggggcttcagtaaggagtccatcctgcccaagcggaacagcgacaagctcatcgcccgcaagaaggactgggaccccaagaaatacggtggcttcgactcccccaccgtggcgtacagcgtgctggtcgtggccaaggtggaaaagggcaagagcaagaagctgaaatccgtcaaggagctcgtgggcatcaccatcatggagcggagctccttcgagaaggacccggtggactttctggaggccaagggctacaaggaggtccgcaaggacctgatcatcaagctccccaagtatagcctgttcgagctggagaacgggcggaagcgcatgctcgcctccgccggcgagctgcagaaggggaacgaactggcgctccccagcaaatacgtgaacttcctgtacctggcctcccactacgagaagctcaagggcagccccgaggacaacgagcaaaagcagctgtttgtggaacagcacaagcactaccttgacgagatcatcgagcagatatccgagttcagcaagcgggtcatcctcgccgacgcaaacctggacaaggtgctgtccgcatacaacaagcaccgcgacaagcccatccgggagcaggcggagaacatcattcacctattcaccctgaccaacctgggggcccccgccgccttcaagtgcttcgacacgaccatcggccgcaaccggtacaagagcatcaaggaagtgctcgacgcgaccctcatccaccagtccatcaccggcctgtacgagacgcgcatcgacctcagccagttagggggcgactga

SEQ ID NO: 7754 - RNA, 4107 nt, synthetic construct
  misc_feature 1..4107: note = Cas9 variant
  source 1..4107: mol_type = other RNA
atggacaagaagtacagcatcggacttgacatagggacctccagcatcggcttcgtaggggtcgacgagaacggttggcccctcaacatcaaaggtaagcgcgccatcggcgcccacctgttccgggaaggcgaggcggccgccgagacccgcgggtttcggacgacccgccggcgctacaaccgacgcaagtggcggctgcgcctcctgcgggagatcttcgacgagccgatctccagggtggaccccaccttcttcgcccggatgaaggagagttccgtgagccccaaggaccccaattacgacggcctggccaaggagattctcatcccccgcgacaaggacgggaagatactgtaccccacaatctaccatctcaggcacgcgctgatgtacgaggaccaccaattcgacatccgcgagatctacctggccattcaccacatcgttaagtacaggggacactttttactcgacggggccgccaaaaacttcgagtcctccaacctggaccttaagtccgacatccacgagattaacgcgatcctcgtgggcatcttcggcaacgagcaggtccagttcaacgaccagtatgttgagaagttgaaggaggtgctgctggacagcacgcagtccaggagcgaccggcagaaggccgccgccaaacttctgctccccaccaatgacttggacaaagacaccaccaagatcctgaaaactgtgagcaccgagatcaccaaggccatcaccggcctcaaggctaagttcttcgtcattacgggcaacgacatcgccaaggaccagcaaaaggactggaccttcagcattgacaccctggacgagaagatgagcgtgatcgagcccagcttcagcgagaagaattttagcttaataactatactccagaaactttattccagcgtcacgctggctgggattgtcccgaatggcctcagcttgtccgaggccatgatccagaagtacgaccgccacgccagcgaccttgtgctcctgaagaagtactgggataccaagcccaaggtgctaaagcaccagctccagaatacctatgcggaatacatcgaaatccaccaggtcgttgacgagttctactccgacctgtcgaagctgatcaagaacgacgacgacaccctcgcccaggagatcaagtccaagatcacgatcggcaatttcctgcccaagcagcggaccaccgagaacggcgtgataccttaccagctgcagcagcgggagctcgacaccatcatcaagaaccagcaggagtattacccgtggctggccgaagagaatcccgtcgccgaccaccaaattgccttcccttacaagctcgacgagctcgtgggcttcaggatcccctactacgtggggccgatgatagcgaaggaggacactagcaacagcaaaaacagcaaattcgcctggatgattcggaagcaatccggagaggtcaccccctggaacttcgacgagaagatcgaccgcaccgccagcgccactgccttcattgaccgtatgacgaccacagacacttacctgatcggggaggacgtgctgcccaagcagtcccttatctaccagcgctttgaggttttgaacgagctgaacaagatcagcatcgacggacagcctataacgcgaaagcagaagcagtccgtgtacacccatgtgttcgagaagaagaagaccgtccaggtgaaggatgtgcagaagtttctggtcagctccggcgaagtgatgagcctcccgaagatcggcggactggcgaacgaaaagcagttcaactccagcctgtctactctctacgactacaacaagatcatccccgacgccctggaggacagaaacaaggtggacgacatcgagaagatcatcctgtggagcacgatcttcgaagacaatagcatctttgtcgagaaactcgactccatagattggctgacctcgtcccagcggaagcgcctggctcagaagcggtaccgggggtggggtcggctcagcctgcgcctgttgaccaccttcaagaacaaggacggatactccatcctggacgagctgtggaacagtaaccacaatttcatggagatccaggcccagtccgacttcagcgagcaaatcgcgaccgccaacaacaacaacctctcccaggttctgcctgccaagtgggagcccggccgtaagaaccttgcctctctggacgagttcatctccaacctgtacacgagcccgcagaacaagaaggccctgcgcaaggcgatccgggtggtacaggacatgatgacagcggccggccacatgcccgagaagatcttcatcgaggtggcccgcgatacctccaacagccaccagcagaccatcgcccgacagcgccagctccaacagctgtaccagtccgaagataaggaggtgatcgacagcagcgtacggagcgagctggatgacatcctgaagaaccgcgcaaacatcaaggaccagctgttcctgtacttccagcagggcgggcgcgacctctacacggggaaggccatcaacatcgacaagctgagcttgtaccacatcgaccacatcctcccccagagcctggtgaaggacgacagcctcgacaaccgggtgctcgtctcccagaaaaccaacgaagataagggcgttaccttcgttagcgacaagtacatgaacaacatgctgcccacctggaagcgctggcacgagatggggctgatttccgctagaaaactcaagaacctgacgatgcgcccggacgagatcgacaagtacgcacccggattcatccagcggcagctggttgagacccgccaggtgaccaagctcgttatcgagctgctggatgcactcctgggcaacagccagaccgagatcatcacgattaaggcgtccctgagccatcagttcagacagcagttcgacctcgttaagatccgcgaggtgaacgacaaccatcacgccttcgacgccttcctggccgcccgaatcgggacctacctgtacaagcgataccctaagttgcgtccgtacttcgtgtacggccagtacatgcagaaccacaaaaacctgaagtccatcaacctgatcaaaaccctcgacagcgacaaggcaatcgtcgacgaggggaccggcgagatcctctgggacaagaaatccgacctggccaaaatgatcaagatctacaactaccagcgcctcctgatcacgcacgagagccggaccagtttcggcgccatgtacaagcagaagatcctcaaggccaccgacgcgaagcaaaacgggggcgggttcaagctcgtgccgaccaagcgtaaccgtcccgtcgatatatacggcggctacacgggccagaccgccgcctacctgaccatcgtccgcgtgtacagcaagaaaacctccgagctgcgggttttacccatctacaccaacaaggtccagcaaatcgagaaggccatgacccagggcgacaaggccaccatgctggcgttcaagaaggttatcgccccgcagctgggtaaagaaaacaagaaaacccacgagatcaagatccccgagttcgacgtggtaatcccgaaggtattgctggaccagctggtgatcgacgacattgccggctctcctcaccgcttccgcctcgggacggacacctattaccacaactcccagcagctattccttccgctcagcatgcagcggcagctgatggaccgggagtccgacgacaaggtctacctggacatcttcaacgacgtgctcaagcaggtcgactcatacttcaacctgtacgacgtgaacggcttccgggccgccctgcagaagtccaagaaggcgttcgagcagctccccatcaacgacttccccaaggacgtgcccgacaacaagaagaagaaggggaagcgcagcatcctaaaggagattttcatcggcttacacgccaacgccaccctcggcaaccttaagcagatggggatcaagaccgactttggcaagctgcaaaagtccaacggcctccggatcaccgagaactgcaagatcatccaccaaagcccgacaggcctgttcgagcgcatcgtgcccatcaaatga

SEQ ID NO: 7755 - RNA, 4107 nt, synthetic construct
  misc_feature 1..4107: note = Cas9 variant
  source 1..4107: mol_type = other RNA
atggacaagaagtacagcatcggcctggacatcgggaccaactccgtgggctgggccgtcatcaccgacgactacaaggtgccctcgaagaagttcaaggtgctcgggaacacggaccgccactccatcaagaagaacctgatcggcgccctgctgttcgacagcggggagatagcggaggccaccagactgaagcgcaccgcccggcgccggtacacccgccggaagaaccgcatctgttacctgcaggagatcttctccaacgaaatggccaaggtcgacgacagcttcttccaccggctcgaggagtccttcctggtggaggaggacaagaagcacgagcgccacccgatcttcggcaacatcgtggacgaggtcgcctaccacgagaagtaccccacgatctaccaccttcggaagaagctcgtggacagcaccgacaaggcggacctgcgcctgatctacctcgccctggcccacatgatcaagttccggggccacttcctgattgaaggggacctcaaccccgacaactccgacgtggacaagctgttcatccagctggtccagacctacaaccagctgttcgaggagaaccccatcaacgccagcggcgttgacgcgaaggccatcctgtccgcccgcctgagcaagtctcggagattggagaacctgatcgcccagctgccgggggagaagaagaacggcctcttcgggaacctgatcgccctgagcctcggcctgacgcccaacttcaagtccaacttcgacctggcggaggacgccaagctccagctgagcaaggacacgtacgacgacgacctggacaacctcctggcccaaatcggcgaccagtacgccgaccttttcctcgcggcgaagaacctgtccgacgccatcctgctcagcgacatcctccgactgaactccgagatcaccaaggcgcccctcagcgccagcatgatcaagcgctacgacgagcaccaccaggacctgaccctgctcaaggccctggtgcggcagcagctgcccgagaagtacaaggagatcttcttcgaccagtccaagaacgggtacgccggctacatcgacgggggcgccagccaggaggagttctacaagtttatcaagccgatcctcgagaagatggacggcacggaggagctgctggccaagctgaaccgcgaggacctcctgcggaagcagcgcacgttcgacaacgggtccatcccccaccagatccatctgggcgagctccacgccatcctgcgccggcaggaggacttctaccccttcctgaaggacaaccgcgagaagatcgagaagatactcaccttccggatcccctactacgtcgggccgctggcccgcggcaacagccggttcgcgtggatgacccgcaagtccgaggagaccatcacgccctggaatttcgaggaggtggtggacaagggagccagcgcccagtccttcatagagcggatgaccaactttgacaagaacctgcccaacgagaaagtcctccccaagcacagcctgctgtacgagtacttcaccgtgtacaacgagctcacgaaggtgaagtacgtcacggaggggatgcgcaagccggccttcctgtccggcgagcagaagaaagcgatcgtggatctcctcttcaaaaccaaccgcaaggtgaccgtcaagcagctgaaagaggactacttcaagaagatcgagtgtttcgactcggtggagatctccggggtggaagaccgttttaacgccagcttgggcacctaccacgacctcctgaagatcatcaaggacaaggacttcctggacaacgaggagaacgaggacatcctcgaggacatcgtcctgacgctgaccctcttcgaggaccgggagatgatcgaggagcgcctgaagacctacgcccacctgttcgacgacaaggtgatgaagcagctcaagcggcgccggtacaccgtctgggggcgcctgtcccggaagctgatcaacggcatccgcgacaagcagagcgggaagacgatcctcgacttcctgaagtccgacggcttcgccaaccggaacttcatgcagcttatccacgacgactcgctcaccttcaaggaggacatccagaaggcccaggtgtccggccagggggacagcctgcacgagcacatcgcgaaccttgccgggtcccccgccatcaagaaggggatcctccagaccgtgaaggtcgtggacgagctggtgaaggtcatgggccgccacaagcccgaaaacatcgtgatcgagatggcccgcgagaaccagaccacgcagaaggggcagaagaatagcagagagcgcatgaagcggatcgaggagggcatcaaggagctgggcagccagatcctcaaggagcaccccgtggagaacacccagctgcagaacgagaagctgtacctttactacctgcagaacggccgcgacatgtacgtcgaccaggagctggacatcaaccggctctccgactacgacgtggaccacatcgtgccgcagagcttcatcaaggacgactccatcgacaacaaggtcctgacccgtagcgacaagaacagaggaaagtccgacaacgtgcccagcgaggaggtggtaaagaagatgaagaactactggcgccagctgctcaacgccaagctgatcacccagcggaagttcgacaacctgacgaaggcggagcgcgggggcctcagcgagctggacaaggccggcttcatcaagcggcagctggtggagacccgccagatcaccaagcacgtggcacagatcctcgacagccggatgaacaccaagtacgacgagaacgacaagctgataagggaggtcaaagtgatcaccctcaagagcaagctggtgagcgacttccggaaggacttccagttctacaaggtccgcgagatcaacaactaccaccacgcccacgacgcctacctgaacgcggtggtggggacggccctgataaagaaataccccaagctcgagtccgagttcgtctacggcgactacaaggtatacgacgtgcggaagatgctggccaaaagcgaacaggagatcgggaaggccacagcgaagtacttcttctactccaacatcatgaacttcttcaagaccgagatcaccctagccaacggcgagatccgcaagcggcccctcatcgagacgaacggggagaccggcgagatcgtctgggacaagggccgcgacttcgccaccgtgcggaaggtgctgagcatgccgcaggtcaacatcgtgaaaaagaccgaggtgcagaccgggggcttctccaaggagagcatcctgcccaagcgcaactccgacaagctcatcgcccgcaagaaggactgggatcccaaaaagtacgggggcttcgacagccccacggtcgcctacagcgtgctggtggtcgccaaggtggagaaggggaagtccaagaagctcaagagcgtgaaggagctgctgggcatcaccatcatggagcgatccagcttcgagaagaacccgatcgacttcctagaggccaagggctacaaggaggtccgcaaggacctcatcatcaagctgcccaagtactccctgttcgagctcgagaatgggcggaagcgcatgctggccagcgccggcgagctgcagaaggggaatgagctcgccctgccctccaagtacgtgaacttcctgtacctcgcgagccactacgagaagctgaaaggctccccggaggacaacgagcagaagcagctgttcgtggagcagcacaagcactacctcgacgagatcatcgagcaaatcagcgagttctccaagcgggtcatcctggctgacgccaacctggacaaggtgctcagcgcctacaacaagcaccgcgacaagcccatccgggagcaggccgagaacatcatccacctgttcaccctgacgaatctcggggcgcccaccgcattcaagtacttcgacaccaccatcgaccgcaagcggtacacgtccaccaaggaggtgctggacgccacctttatccaccagagcatcaccggcctatacgagacgcgcatcgacctctcccagctgggaggggactga

SEQ ID NO: 7756 - RNA, 4107 nt, synthetic construct
  misc_feature 1..4107: note = Cas9 variant
  source 1..4107: mol_type = other RNA
atggacaagaagtactcaattggcctggacatcgggaccaattccgtgggctgggcagtcatcaccgacgactacaaggtgcccagcaagaagttcaaggtgctcgggaacacggaccgccactccatcaagaagaacctgatcggcgccctgcttttcgacagcggggaaaccgcggaggccacccggctgaagcgcaccgcccggcgccggtacacgcgccggaagaaccgcatctgctacctgcaggagatcttctccaacgagatggccaaggtcgacgacagcttcttccaccggctcgaggagtccttcctggtggaggaggacaagaagcacgagcgccacccgatcttcggcaacatcgtggacgaggtcgcctaccacgagaagtaccccaccatctaccacctccggaagaagctcgtggacagcaccgacaaggcggacctgcgcctgatctacctcgccctggcccacatgatcaagttccgaggccacttcctgatcgagggggacctcaaccccgacaactccgacgtggacaagctgttcatccagctggtccagacctacaaccagctgttcgaggagaaccccatcaacgccagcggcgttgacgcgaaggccatcctgtccgcccgcctgagcaagtcccggcgcctcgagaacctgatcgcccagctgccgggggagaagaagaacggcctcttcgggaacctgatcgcgctgagcttgggcctgacgcccaacttcaagtccaacttcgacctggcggaggacgccaagctccagctgtcaaaggacacttacgacgatgacctggacaacctcctcgcccagatcggcgaccagtacgccgacctgttcctcgccgcgaagaacctgtccgacgcgatcttactcagcgacatcctacggctgaactccgagataaccaaggccccgctcagcgccagcatgatcaagcgctacgacgagcaccaccaggacctgaccctgctcaaagccctggtgcggcagcagctgcccgagaagtacaaggagatcttcttcgaccagtccaagaacgggtacgcgggctacatcgacgggggcgccagccaggaggagttctacaagttcatcaagccgatcctcgaaaagatggacggcacggaggagctgctggccaagctgaaccgcgaggatctcctgcggaagcagcgcaccttcgacaacggctccatcccccaccagatccacctgggcgagctccacgccatcctgcgccggcaggaggacttctaccccttcctgaaggacaaccgcgagaagatcgagaagatcctcaccttccggattccctactatgtcgggccgctggcccgcggcaacagccggttcgcgtggatgacccgcaagtccgaggaaacgatcaccccctggaacttcgaggaggtggtagacaagggggccagcgcccagtccttcatcgagcggatgaccaacttcgacaagaacctgcccaacgagaaggtcctccccaagcacagcctgttatacgagtacttcaccgtgtacaacgagctcacgaaggtgaagtacgtcaccgagggcatgcgcaagccggccttcctgagtggcgagcagaagaaggcgatcgtggacctcctcttcaagaccaatcggaaggtgaccgtcaagcagctgaaggaggactacttcaagaagattgagtgcttcgacagcgttgagatctccggggtggaggaccgcttcaacgcgagcctgggcacgtaccacgatctcctgaagatcatcaaggacaaagacttcctggacaacgaggagaacgaggacatcctcgaggacatagtcctgaccctgaccctcttcgaggaccgggagatgatcgaggagcgcctgaagacctacgcccacctgttcgacgacaaggtgatgaagcagctcaagcggcgccggtacaccgggtggggacgcctgtcccggaagctgattaacgggatccgcgacaaacagagcggcaagaccatcctcgacttcctgaagtccgacggcttcgccaaccgcaacttcatgcagctgatccacgacgactcgctcaccttcaaggaggacatccagaaagcgcaggtctccgggcaaggcgacagcctgcacgagcacatcgcgaacctggccgggtcccccgccatcaagaagggcatcctccagaccgtgaaggtggtcgacgagctggtgaaggtgatggggcgacacaagcccgagaacatcgtcatcgagatggcccgcgagaaccagacgacccagaagggccagaagaacagccgggagcgcatgaagcggatcgaggagggcatcaaggagctggggagccagatcctcaaggagcaccccgtggagaacacccagctgcagaacgagaagctgtacctctactacctgcagaacggccgcgacatgtacgtggaccaggagttggacatcaaccggctctccgactacgacgtcgaccacatcgtgccgcagagcttcatcaaggacgacagcatcgacaacaaggtgctgacccgcagcgacaagaaccgggggaagtccaacaacgtccccagcgaggaggtggtgaagaagatgaagaactactggcgccagctgctcaacgccaagctgatcacgcagcggaagttcgacaacctgacaaaggcggagcgcgggggtctctccgagctcgacaaggccgggttcataaagcggcagctggtcgagacccgccagatcaccaagcacgtggcccagatccttgacagccggatgaacaccaagtacgacgagaacgacaagctgatccgcgaggtgaaggtcatcacgctgaagtccaaactcgtgagcgacttccggaaggactttcagttctacaaggtgcgcgaaatcaacaactaccaccacgcccacgacgcatacctgaacgcggtcgtgggcaccgccctgatcaagaagtaccccaagctcgagtccgagttcgtgtacggggactacaaggtctacgacgtgcggaagatgatcgccaagagcgagcaggagatcggcaaggccaccgcgaagtacttcttctattccaacatcatgaacttcttcaagaccgagatcacgctggccaacggggagatcaggaagcggcccctgatcgagaccaacggcgagaccggcgagatcgtgtgggacaaggggcgcgacttcgccaccgtccggaaggtcctcagcatgccccaggtgaacatcgtcaagaagacggaggtgcagaccggcgggttctccaaggagagcatcctgcccaagcgcaactccgacaagctgatcgcccgcaagaaagactgggaccccaagaagtacggcgggttcgacagccccaccgtggcctacagcgtcctcgtggtggcgaaggtcgaaaagggcaagtccaagaagctcaaaagcgtgaaggagctgctgggcatcaccatcatggagcggtccagctttgagaagaacccgatcgacttcctggaggccaaggggtataaggaggtgcgcaaggacctgatcgtcaagctccccaagtattccctgttcgagctggaaaacggccggaagcgcatgctcgctagcgccggggagctgcagaagggcaacgagctggccctcccctccaagtacgtgaacttcctgtacctggcgagccactacgagaagctcaaggggtccccggaggacaacgagcagaagcagctgttcgttgagcagcacaagcactacctggacgaaatcatcgagcagatcagcgagttctccaagcgggtcatcctcgccgacgccaacctagataaagtgctgagcgcatacaacaagcaccgcgacaagcccatccgggagcaggccgagaacatcatccacctcttcacgctgaccaacctgggcgcgcccgccgccttcaagtacttcgacaccaccatcgaccgcaagcggtacacctccaccaaggaagtgctcgacgccaccttcatccaccagagcatcaccggcctgtacgagacgcgcatcgacctgtcccagctcgggggcgactga

SEQ ID NO: 7757 - RNA, 4107 nt, synthetic construct
  misc_feature 1..4107: note = Cas9 variant
  source 1..4107: mol_type = other RNA
atgtctcgcccctacaacatcggcttagacatcgggacctcaagcattggctggtccgtagtcgacgaccagagtaagctcgtgtccgtgcgggggaagtacggctacggggtccgcctgtacgacgagggccagaccgccgccgagcggcgcagcttccggacgacccgccggcgcctgaagcgtcgcaagtggcgcctcggcctgctgcgcgagatcttcgagccgtacatcacccccatcgacgacacctttttcctccggcagaagcagtccaacctgagcccgaaggaccagcgcaagctgtacacgcagacctccctcttcaacgaccggaccgaccgcgcgttctacgacgactatcccaccatctaccacctccggtaccgcctgatgacggagaagcgtcagttcgacatccgcgagatctacctggccatgcaccacatcgtgaaataccgggggcacttcctgaacgaggccccggtgagctcattcaaaagctccgagatcaacctggtcgcccacttcgaccgcttgaacacgattttcgcggacctgttcagcgagagtgggttccagctggaaacggataaattagcggaggtgaaggccctcctgctcgacaaccagcagagcgcctccaaccgccagcggcaggccctgagcctgatctacaccccctccacgaacaaggcggtcgagaagcagaacaaggccatcgccaccgaactcctgaaggccatcctggggctcaaggccaagttcaacgtcttgactggcatcgaggcggaggatgtgaaggcctggaccctgacgttcaacgccgagaacttcgatgaggagatggtgaagctcgagagcagcctggacgacaacgcccaccagatcatcgagtcgctacaggagctctacagcggggttctgctggccggcatcgtgcccgaaaatcagtccctctcccaggcgatgatcacaaagtacgacgaccaccagaaacacctgaaaatgctcaaggccgtccgcgaggctctcgcccccggcgaccgacagcgcctgaagcaggcctacgaccagtacgtggacgggcaggagaacaccaaggcgtactccaaggaggacttctacggcgacatcaccaaggccctcaagaacaacccggaccaccccatcgtgagcgagattaagaagctcatcgagctggaccaattcatgccgaagcagcgcacgaaggacaacggggcgatcccccatcagctgcaccagcaggagctcgaccgcatcatagagaaccaacagcagtactatccgtggctggccgagctgaaccccaactccaagcggcagaccgtggccaagtacaaacttgacgagttagtcgcgttccgtgtgccctactacgtgggccccctgatcaccgccgagcagcagcggcagagctcggacgccaagttcgcctggctgatccgcaaggcggaggggcggatcaccccgtggaacttcgacgataaggtcgaccgccaggccagcgccaacgagttcatcaaacggatgacaaccaccgacacctacctcctggccgaggacgtgctacccaagcagagcctcatctaccagcgctttgaggtgctgaacgagctgaacgggctcaagatcgacgaccagcccatcacgaccgaactgaagcaggcaattttcaccgacctgttcatgcagaagatcagcgtcaccgtgaagaacatacaggattacctcgtctccgagaagcggtacgcgagccgacccgccatcacgggcctctccgatgagaacaagttcaacagccggctgtccacctaccatgacctcaagatgatcgtgggggacgccgtggacgacgtagacaagcaggccgacctggagaagtgcatcgagtggagcaccatcttcgaggacggcaagatctactccgccaagctgaacgagatcgactggctcaccgaccagcagcgcgtgcagcttgcggcaaagcggtaccgcgggtggggccgcctgtcagccaagctcctgacgcagatcgtgaacgccaacggacaaagaatcatggatctgctgtgggacaccaccgacaacttcatgcgcatcgtacacagcgaggacttcgacaagctgatcaccgaggccaaccagatgatgctagcggagaacgacgtgcaggacgtgatcaacgacctctacaccagcccccagaacaagaaggccctgcggcagatactgcttgtcgtgaatgacatccagaaggccatgaaggggcaggcccccgagcgcatcctgattgagttcgctcgggaggacgaggtgaactcccgcctgtccgtccagcggaaacgccaggtggagcaggtctaccagaatatcagcaacgagctcctgaacaacacggagatccggaacgagctgaaggacctttccaatagcgccctgtccaacacgcgcctgttcctctacttcatgcagggcgggcgggacatgtacaccggggacagcctgaacatcgaccgcctgtccacctacgacatcgaccacatcctcccccagagcttcatcaaagacaactccctggacaaccgggtgctggtgagccagaagatgaaccgctccaaggccgaccaggtgcccacagacttcactagcgtcgagctcgggcaaaagatgcagatccagtgggagcagatgctgcgggccggcctgatcaccaagaagaagtacgacaacctcaccctgaacccggaccacatctccaagtacgccatgaagggcttcatcaaccgccagctggtggagacgcgtcaggtgatcaagctcgcgacaaacctgttgatggagcagtatggggaggacaacatcgagctcatcaccgtcaaaagcggcctgacccaccagatgcggacggagttcgacttccccaagaaccggaacttaaataaccaccaccacgccttcgacgcctacctcaccgccttcgtggggctgtacctgctcaagcgctaccccaagctgaagccatacttcgtgtacggcgaataccaaaaggcctcccagcaggacaagtggaggaacttcaacttcctcaacgggctcaagaaggacgagctggtcgacgagaacaccgaggcggtgatctgggataaggagagcggcctggcctacctcaacaagatctaccagttcaagaagatactggtgacccgcggcgtccacgagaacagcggggccctgttcaaccagacgctttacgccgccaaggacgacaaggcgtccggccaaggcgggaagcagctgatccccgccaagcaggaccgtagcaccgccctgtacggcgggtactccggcaaaaccgtggcctacatgtgcatcgtgcggatcaagaacaagaagggggacctctacaaggtatgcggcgtggaaaccagctggctggcgcagctgaaacagctcacggacgaggactcccagaaggccttcctggagcagaagatcagcccccagttcaccaaggtgaagaagcagaaggggaacattatcgaagccgtcgaggagttcgaagtgatcgctccccacatcctgatcaaccagcgcttcttcgacaacggccaggagttaacactgggctccgccacctacaagcacaacgagcaggagctgatactcgacaagacggccgtgaagctcctgaacggcgccctcccgctgacccagagcgaggagctggccgagcaggtctacgacgagatcctcgaccaggtgatgcattacttccccctgtacgacactaaccagttccgggccaagctgtccaccggcaaggccgcgttcatgaagctcccctggaagtcccagtgggacgggaacaagatggtgcaggtcggccagcaggtaatcctggaccgcatcctgatcgggctccacgccaacgccgccatgagcgacttaaaggtgctgaagatgactacccccttcggcatgattcagcaaagtaccggcatcaccctctccgccgacacgcaaatcatctaccagagcccgaccgggttattcgagcggcgcgtggcgctgcgggacctgtga

SEQ ID NO: 7758 - RNA, 4107 nt, synthetic construct
  misc_feature 1..4107: note = Cas9 variant
  source 1..4107: mol_type = other RNA
atggacaagaagtacagcatcggcctggacatcgggaccaactccgtgggctgggccgtcatcaccgacgactacaaggtgcccagcaaaaagttcaaggtgctcggcaacacggaccgccactccatcaagaaaaacctgatcggcgccttgctattcgatagcggggagaccgcggaggccacccggctgaagcgcaccgcccggcgccggtacacgcgccggaagaaccgcatctgttacctgcaggagatcttctccaacgagatggccaaggtcgacgacagcttctttcaccggctcgaggagtccttcctggtggaggaggacaagaagcacgagcgccacccgatcttcggcaacatcgtggacgaggttgcctaccacgagaagtaccccacaatctaccacctccggaagaaactcgtggacagcaccgacaaggcggacctgcgcctgatctacctcgccctggcccacatgatcaagttccggggccacttcctgatcgagggggacctcaaccccgataactccgacgtggacaaactcttcatccagctggtccagacctacaatcagcttttcgaggagaaccccatcaacgccagcggcgtggacgcgaaggccatcctgtcagcccgcctgagcaagtcccggcgcctcgagaacctgatcgcccagctgccgggggagaagaagaacggcctcttcgggaacctgatcgccctgagcctcggcctgacgcctaacttcaagtccaacttcgacctggcggaggacgccaagctccagctgagcaaggacacctacgacgacgacctggacaacctcctggcccagatcggcgaccagtacgcggacctgttcctcgccgcgaagaacctgtccgacgccatcctgctcagcgatatcctgcggctaaactccgagatcaccaaggccccgcttagcgccagcatgatcaagcgttacgacgagcaccaccaggacctgaccctgctcaaggccctggtgcggcagcagctgcccgagaagtacaaggagatcttcttcgaccagtccaagaacgggtacgcgggctacattgacgggggcgccagccaggaggagttctacaagttcatcaagccgatccttgagaagatggacggcacggaggagctgctggccaagctgaaccgcgaggacctcctgcggaagcagcgcaccttcgacaacggctctatcccgcaccagatccatctgggcgagctccacgccatcctgcgccggcaggaggacttctaccccttcctgaaggacaaccgcgagaagatcgagaagatcctcaccttccggatcccctactacgtcgggccgctggcccgcggcaacagccggttcgcgtggatgacccgcaagtccgaggagacgatcaccccctggaacttcgaggaggtggtggacaagggggccagcgcccagtccttcatcgagcggatgaccaacttcgacaagaacctgcccaacgagaaggtcctccccaagcacagcctgctgtacgagtacttcaccgtatacaacgagctcacgaaggtgaagtacgtcaccgagggcatgcgcaagccggccttcctgtccggcgagcagaagaaggcgatcgtggacctgctgttcaagaccaaccggaaggtgaccgtcaagcagctgaaggaggactacttcaagaagatcgagtgcttcgacagcgtggagatctccggggtggaggatcgcttcaacgccagcctgggcacgtaccacgacctcctgaagatcatcaaggacaaggacttcctggacaacgaggagaacgaggacatcctcgaggacatcgtcctgaccctgaccctcttcgaggaccgggagatgatcgaggagcgcctgaagacctacgcccatctgttcgacgacaaggtgatgaagcagctcaagcggcgccggtacacggggtggggccgcctgtcccggaagctgatcaacgggatccgcgacaagcagagcggtaagaccatcctcgacttcctgaagtccgatggcttcgccaaccggaacttcatgcagctgatccacgacgacagcctcaccttcaaggaggacatccagaaggcccaggtctccgggcagggcgacagcctgcacgagcacatcgcgaacctggccgggtcccccgccatcaagaaggggatcttacagaccgtgaaggtggtcgacgagctggtgaaggtgatgggccgacacaagcccgagaacatcgtcatcgagatggcccgcgagaaccagacgacgcagaagggccagaagaacagccgggagcgcatgaagcggatcgaggagggcatcaaggagttggggtcacagatcctcaaggagcaccccgtggagaacacccagctacagaacgagaagctgtacctctactacctgcagaacggccgcgacatgtacgtggaccaggagctggacattaaccggctctccgactacgacgtcgaccatatagtgccgcagagcttcatcaaggacgactccatcgacaacaaggtgctgacccgcagcgacaagaaccgggggaagtccgacaacgtccccagcgaggaggtggtgaagaagatgaagaactactggcgccagctgctcaacgccaagctcatcacgcagaggaagttcgacaacctgaccaaggcggagcgcggcggcctctccgagctggacaaggccgggttcatcaagcggcagctggtcgaaacccgccagatcaccaagcacgtggcccagatcctcgacagccggatgaacaccaagtacgacgagaacgacaagctgatacgcgaggtgaaggtcatcacgctgaagtccaagctcgtgagcgacttccggaaagacttccagttctacaaggtgcgcgagatcaacaactaccaccacgcccacgacgcctacctgaacgcggtcgtgggcaccgccctgatcaagaagtaccccaagctcgagtctgagttcgtgtacggggactacaaggtctacgacgtgcggaagatgatcgcaaaaagcgagcaggagatcggcaaggccaccgcgaaatacttcttctactccaacatcatgaacttcttcaagaccgagatcacgctggccaacggggagatccgcaagcggcccctgatcgagaccaacggcgagaccggcgagatcgtgtgggacaaggggcgcgacttcgccaccgtccggaaggtgctctccatgccccaggtgaacatagtcaagaagacggaagtgcagaccggcgggttctccaaggagagcatcctgcccaagcgcaactccgacaagctgatcgcccgcaagaaggattgggaccccaagaagtacggcgggttcgacagccccaccgtggcctattcggtcctcgtggtggcgaaggtcgagaagggcaaatccaagaagctcaagagcgtgaaggagctgctcggcctgaccatcatggagcggtccagcttcgagaagaacccgatcgacttcctggaggccaaggggtacaaggaggtgaagaaggacctcatcatcaagctgcccaagtactcacttttcgagctcgagaacggccgcaagcgaatgctggccagcgccggggagctgcagaagggcaacgagctcgccctgccctccaagtacgttaacttcctgtacctcgcgagccactatgagaaacttaaggggtccccggaggataacgagcagaagcagctgttcgtggagcagcacaagcactacctcgacgagatcatcgaacagatctcggagttctccaagcgcgtgatcctggccgacgccaacctagacaaggtcctctcggcctacaacaaacaccgggacaagcccattcgcgagcaggccgagaacatcatacacctgttcacgctgaccaacctcggcgcgcccgcggccttcaagtacttcgacaccaccatcgaccggaagcgctacacgtccaccaaggaggtgctggacgccaccctgatccaccagagcatcaccggcctctacgagacgcggatcgacctgtcccagctcgggggcgactga

SEQ ID NO: 7759 - RNA, 4110 nt, synthetic construct
  misc_feature 1..4110: note = Cas9 variant
  source 1..4110: mol_type = other RNA
atgaaacgaatcctcggactggacctcggtacaaacagcataggctgggccctcgtcaacgaggcggaaaccgtcaatgagaaaagctccatcgtcaaactaggagtccgcgtaaaccccctcacggtcgatgaacagaaaaacttcgaggcaggcaagagcatacccacaaacgcaggccgtaccctaaaacgaggcatgagaagaaacctacagcgatacaagctgaggcgagactacttaatacaatgcctcaaagaatacggctggataacaagcgacacgctactctacgaatgtggtaacaggaccacgttcgaaacctaccgactgcgagcaaaagcagtagacgaggaaattgcattagaagaactcggccgcgttctcctgatgatcaacaagaaacgcggctacaagtcgaaccgcaaagcaaagagcagtgacgaaggccaactgatcgacgggatggccatcgcaatggacatgtatcacaacggaacgacccccggagaatacgtctattcgttactcagcaaaggaaagaaatatatcccagtattctaccgcagtgacttactagacgagttcgacagaatatgggactaccaatgcgcctactacccggacatcctgacatcgcagttcaaagaactaataaggggaaaatccagtcaagtaacatccaaattgttcaaacagcagtacaacctatttacagcggataataaagaaaaagacaagcgcctacaggcatactgcagacgagcagacgcactcaagaaacgcctaccagttgaagaggtagcggccgcattgtgcgatgtaaaccgtgatgtcaacgcgtcatccgggtacctgggcacgatatcggatcggagcaagaaactattcttcaacaaacaaactgtagggcagtacctcatgctagaactggacaaagattcccacttctcggtgaaaaacgaagtattctataggcaagattacctcaacgagttcgaagccatatgggagaaacaagccgaataccacccagagctcacaccagaccgtaaaaagatacttcgcgatgttgtcatcttttaccaaagacccttaaaatcacaaaaagacttagtagcgtgctgcgaactcgaacgtcgcagaatagaggtaatgaaagacggaaaagtgagatcagtcgaaatcggccccaaagtgtgcccaaagagcagcccgctatttcaagatttcaaaatatggcacgtactgaacaaccttaaagtaagagacaaggccacaggcgatgaacgctttctagagctcgatgagaaggagatcctgttctcagagctcgcgatcaagagcaaactatcaaagaccgaggcgttgaaacttctatatcagaagccgaaaggcctcgacctaaactacgattcggtggaagggaacacaacccaagcggcgttattcgaagcctaccagaccgtcatagcaatgaccggacacggcgagtacgtattctcaaaaatgagcgcctccgaagtaatgtccgtagtagagggagtattcgggggactcggattcaacacttccgtactgagattcgactccctgctccaaggaaaagagctagaaaagcaagacagctaccgattatggcacctcctgtacagctacgagggcgacaatagcgtcaccggcaccgatggcctcgtagcaaaagtagcgagcctgctccgatgtgacgaagaatacgcaaaagtcgtcgctggggtcactttccaaccagactacggaagcctgtcagcgaaggccattcgaagaatattaccccacatgagggccggcaatgaatatagcctagcctgcgaatacgcgggatacaaacacagcagaagatccctcacgaaagaagaactcgaacagaaagactacaaggaccatctagaattactccccagaaactcactacgaaacccggttgtagagaaaatactcaaccagatggtgaacgtcgtaaacgctgtagtcgacgcctacggcaaaccagacgaaatacgcatagaaatggccagagaactcaagaagtccgcaaaggaacgcgaagaaatgaccgccgccatcaacaaagcaaccagcgaacacgaaagaataaaggaaatactcaacaaagagttcggcatccaacatgtttcgcacaacgacatagtccgatacaaactctattgcgaacttaaaaacaacggatacaaaacactctacagcgacacatatataccccaagagaagttattcagcaaggaagtcgacatcgagcacatactaccacaggcaagactgttcgacgacagcttcagcaacaaaacactagagtaccgctccgtcaacatagagaaatccaaccagaccgcatgggactacgtcgcagcaaaatggggcgaagaaggaagcctgcgctacaagaaacgagtagacgacttacttgcggcaggagtgataggaaagtcaaaacacgataaactcttaatgaagcaagaagacatccccacagacttcatcaacagggacctccgagacacccagtatatcgctcgtaaggcacgagaaatactcgaagacctcgtacccatggtggtcagcaccactggagcagtaacagacagattgcgcgaagactggcaactcgtcgacgtaatgcaagaactgaactgggacaaatacgccatgaagggcctaacggaagaatggacagacaaagacggccgcaggatcagccgaatcaaagagtggacaaagcgcaacgaccaccgtcaccacgcgatggacgccctcacgatcgcgttcacaaaacactcattcatacaatacctcaacaacctaaacgctcgatctgataaaagcggaagcatctacgccatcgagcaaaaagaactataccgagacaaccacggaaaactgagattcatcatgcccttcgagggcttccgatccgaagcaaaacgtcaactcgaaaacatcctagtcagcatcaaagcgaaaaacaaagtggtcacgcgcaacgtaaacaacgcccgtaggggatcgggccgccaggccaaggtccaactgaccccgcgggggcaactccacaacgaaaccatctatggatcgatccatcgatacgtaacaaagctggaaaaagtgggaggaaacttcgacggggaacagatcgcaaaagtcgccaacctcaggtacagagaggcgctgcaagcgagacacgaagcatttgggggtgatgcaaagaaagccttcacgggcaaaaacgccctcgataaaaacccgctgtacctcaaggacacccgcaccgaagtcccactgaaagtaaagaccgtaagcacagagacactctacacgatccgcaaagcagtcgccccggacctaaacgtggacaaggtaatcgacgcaaaagtccgcaaggtactcgaagagaggctgcaagagtatggaggagacccgaagaaagccttcgtaaacttagacgaaaacccaatatacctaaataaagccaagggaatcacaattaaaagggtagccatcaccggggtcaacaacgcaatcgcactgcacgacaagaaagacgtaggaggacacgtgatgctcgacgcgtccggtcgaaaacagcccgtagacttcgttaatacagggaacaaccaccacgtcgcaatatatcgagacgccgaaggtagcttacaggaagtagttgtcagtttctacgaagccgtggcgcgggtatccctaggactcccggtcatagacagagaataccgaaaagaagacggctggcaattcctattcaccatgaaacaaaacgaatacttcgtgttcccgaacccagaaacagggttcaacccacaagaagtcgacctgaccgacgaaacaaactacgcactgataagcccgaacctctttcgagtccagaagttcacgataaaggactacttcttccggcaccatctggaaacaacagtagaagaccggaaagaactaaaggacatgacatggaagcgctgcgggctagggggcatcataggaatcgtaaaggtaagggttaaccacatcggtcgcatcgtgtcagtcggagaatactga

SEQ ID NO: 7760 - RNA, 4110 nt, synthetic construct
  misc_feature 1..4110: note = Cas9 variant
  source 1..4110: mol_type = other RNA
atggccaagacctacaacatcggcctggatatcggtaccaacagcataggctgggccgtggtggacgaccagaaccacctcatgtccatcaaggggaagtacggctacggggtgcgcctgtacgacgagggcaagacggcggaggagcggcgtagcttccggaccacccgccggcgcctgaagcggcgcaagtggcggctctccctgctgcgggaaatcttcgaaccccagatcaccccgctcgacaacacgttcttcctgcggcaaaagcagagctcactgagctccaaggacaaccgcaagttgtaccccgagatgagtctattcaacgaccggaccgacaccgatttctacacccagtaccccacgatataccacctgtcccgcgacttaatgaccaagaacaagcagttcgatatccgggagatctatctagccatgtatcacatcgtgaagtaccgcggccacttcctgaacgagtctcccgtctccagcttcaagtcctcggagatcaagctcgccgagaacttcgagacgctgaaccagatattcaacgagcggttcaacgagtccatgttccagctggccgtgaacgacttcgacgacctcaaggccctgctgctcaacgaccagcagagcgcgtccaacagacaaaagaaggccctggggatgatctacgtgccgaacgagaacaagagcctggagaagcagaacaaggccatcgccaccgagctcctgaaggcgatcttgggcctcaaggccaagttcaacgtcctgacggggatcgaggtggacgacgccaagccctggaccctgtccttcaacagcgagagcttcgacgaggacatcgacaaggccgccaccaacatcgacgatgactcccgggaaataatcgcgatcctccagggcctgtacagcgggatcctgctcgccggcatcatccccgagaaccagagtctgagcgaggctatggtggagaaatacgaccagcacgccgcccacctgaagcagctcaagtccatctaccctctcctgagcatatccgacaagaaggcgatccagcaagcctacaactactacatagacggccaggacaacgccaaggcctacagccgcgaggacttctatgccgcgaccacaaaggccctcaagtcctaccaggacaacgagaccatcgccgagatcttgaagctgatcgagctcgagcagttcatgccgaagcagcggaccaaggacaacggggccatcccccaccagctgcaccagcaggagcttgagcgcatcatcgagaaccagcagaagtactacccctggctcgccgagctgaaccccaacgaaagccgccggaagatcgcgaagtacaagctggacgagctcgtcgccttccgcgtgccgtactacgtgggcccgctgatcacctccgagcaacagcagcagagctccaacaagaagttcgcctggatgatccggaaggccgaggggaagatcacgccctggaacttcgatgagaaggtcgaccgccaggcgagcgccaatgagttcatcaagagaatgaccaccaccgacacgtacctcttagctgaggacgttctccccaagcagtccctggtgtaccagcgcttcgaggttctgaacgaactcaacggcatcaagatagacgacgtgccgatcaccgtggagcagaagcaacggatcttcaacgacctattcatgatgcaggccagcgtctccgtaaagaacatccaggactacttagtatccaagggctacttcgcctcccgccccgagattacggggctcagcgacgagaacaaggtcatcagccggctgtccacctaccacgacctgaaggcgattctcggcgggatcgtcgacgaggccaataagcaggccgacctggagaagtgcgtggagtggagcacgatcttcgaggacggcaagatcttcgtcgagaaattaaacgagatcgagtggctcaccgacgagcagcgcaagcggctgtcctcgaagcgctaccgcgggtggggccgcctatccaacaagctcctgaaccagatcgtgaacgagaacggccagcggatcatggacctgttgtgggacaccaccgacaacttcatgcgcatcgtccacagcgaggagttcgacaaactgatctcggccgccaaccagacgctgttaagcaagaacgacgtgcaggatgtgatcaacgacctgtacacctccccgcagaacaagaaggcgctgcggcagatcctcctggtcgtgagcgacatccagaaggccatgaaaaaccaggccccctcgaagatcctgatcgaatttgcccgcgaagacgaggccaatccgcggctcagcgtgcagcgcaaacgccaggtcgagcaggtatatcagaacatctccaaggacatcctcagcgactccgacgtgaaggcggagctgaaggatctcacaaacaccgccctggccaacacgcggctgttcctctacttcatgcagggtgggcatgacatgtacaccggggagaccctgaacatcgatcgcttaagcgagtacgacatagaccatatcctcccccaggccttcatcaaggataactccctggacaaccgggtgctggtgagcgcgaaaatgaaccgcagcaagtccgatcaggtgcctctcaacgactacaccgaggagcggttcggctcaaagatgcgggtccagtgggagcagatgctgcgggccgggctcatcaccaagcgcaagtacgacaacctcacgcttaaccccgaccggatctccaagtacgcaatgaaggggttcatcaaccgccagctggtggagacccgccaggtgatcaagctagtcaccaacctgctgatggaccactacgaggatgacgaggtgcaactcattaccgtcaaaagcggcctgatccaccagatgcgggaaatgttcgacttcccgaagaaccggaatttaaacaaccaccaccacgccttcgacgcctacctcacggcgttcgtagggatctacctgctgaagcgctaccccaagctcaccccctttttcgtgtacggctcctaccagaagaacaacaccaacgacaagtggcggaacttcaatttcctgaacgacctgaagaaagaggaggtgatcgacagcgactcccacgaggtcatctggaacaaggcccaggggctcgtggagttagacaagatctaccagttcaagaagatcctggtgacccgcgaagtccacgagaacacgggcgccctctacaaccagaccctgtacagcgccaaggacgataaggcctccggtcagggcggcaagcagctgatccccgcgaagcaggaccggccgaccgccctctacgggggttacagcgggaagaccgtggcctacatgtgcattgtgcgcatcaagtccaagaaggaagacacgtacaaggtctgcggggtgaaaaccagctgggtggccgagctggagcggttgtccgacagtaacgagcagcttgccagcctcaaggcgaaacttatgcccaagttcaccaaaaacaagaaacagaagggcaagaccatccaggtcacggaagactttgagatcattgtaccccgcgtgttaatcaaccagcggttctatgacaacgggcaggagatcaccctgggtagcgccacctacaagcacaacgagcaggagctgatgctcaataagaaggccgtcaagctgttgaacgggcagctctcccttgtggaggccgagaccctggcgccccaggtgtatgacgagatcctcaagcaagtcatgaagtacttccccctgtacgacacgaaccaattccgcaccaagttgaagatgggcaaggagcagttcatcaagctcccctggaagaacaaatgggacgggaacaagctgatacacgtgggccaacagaccgtgctagaccgtatcctcatcggcctgcacgccaacgccgccgtaagcgacctgtccacactcaaggtgacgacgcccttcgggaagctgcagcagccgagcggaatcgccctgagtctcaacaccaagatcatctaccaatcccccaccgggctgttcgagcggcgcgtggcgctgcgggggctctga

SEQ ID NO: 7761 - RNA, 4110 nt, synthetic construct
  misc_feature 1..4110: note = Cas9 variant
  source 1..4110: mol_type = other RNA
atggacaagccctacaacattggcctggacatcgggtcacactccatcggctggaccgtggttgacgacaacagcaagctcgtgcgcatcaaggggaagctgggctacggggtgcggctgttcgacgagggcaagaccgccgaggagcgccggcagttccgcacgacccggcgccggctcaagcgccggaagtggcgcctgcggctgttacgcgagatcttcgagccgcacatcgcgcccctggacgagacattcttcctgcggcagaagcagtccaacctcgtacccacccagaagaagttgccccagttgagcctcttcaacgaccgctccgacgcggagttctaccacaagtacccgacgatctatcacctaagaaacgccctgatgaccgagaagcgccagttcgacctccgggagatctacctggccatccaccacatcgtgaagtaccgcggccacttccttaacgccgcccccgcggccagcttcaagtccgggaagttcgacctcgagaacaaattcgaccagctgaacctgctgttcgccagcgcttactccgacctggacttcacgctacggaccgacaacgtggaccaggtcaaggcgatcttactgaacgaggacctgagcgcctccacgagacagcggcaggccctccccctgatctaccagaccagcgccgaccagaaggccgcgaagaagctgaccaagtccctggccaccgagctgctgaaggccatcctcggcctgaaggccaagttcgacgtgctgacggggatcgagaccgacgacaccaaggcctggcgcctcaccttcaacgcggaggacttcgacgacaagctgaacgagctgaacgttacggacaacgaggccgccacccagatcatcgagatcctccgcgagctgtacagctccatcctgctggccgccatcgtccccgagaactacaccctgagccaggcgatgatggccaagtacaacgcccacaagcagcacctgtccctcctgcgccaggtgaagaccacgctgccggccaagaagcagaaggagctccaggcggcgtacgacgactacatcgaccagcacctccccctggacaagttctacgccaagctgaccaaggtgctccccaaggagaaggacaccgacaacccccagatcatccagatcctgaacctgatcgacctcgaccagttcctgccgaagcagcggaccaaggacaacggcgccatcccccaccagctgcaccagcaggagctcgaccagatcatcgacaaccagaaggcatactacccctggctggcgcagctgaaccccaacgagaagcggcagaagatcgccaaatacaagctcgacgagctggtcgccttccgcgtgccgtactacgtagggcccttgatcgaggccaagacgcagcagaagaccagcggcgccaacttcgcgtggatgatacggaaggagcccggcaccaccacgcccatcaccccgtggaacttcgacgagaaagtcaaccgccaggcctccgcaaacgagttcatcaagcgtatgaccaccacggacacctacctactgggggaggacgtactgcccaagcatagcctcctgtaccagcgcttcgaggtgctgaacgagctcaacggcatcaagatcgaccagaagcgggtcaccgtgcgccagaagcaggccatcttcaacgacctgttcctgaagcagcccaacgtgaccgtcaagaagctccagcagtacctgcaggccaagggggagtacgcgtcggcccccatcatcacgggcctgtccgacccgaagaagttcaacagccagctctccacctaccacgagtacaagaagatattcggcgggctgatcgacgaccccgacaagcaggctgacttcgagaagtgcatcgagtggagcaccatcttcgaggactcccagatcctgaaggacaagctcaaggagatcaactggctgacccccgagcagcgccacaaagtggccaacaagcgttaccagggctgggggcggctgagcaagaagctcctgacccagctggtggactacaacggccagcgcatcatcgacatcctctggaacacgaccgataacttcatgcagatcgtccactccgaggccttcgacaaggcgatcatcaaagagaaccaggccctgctgacccagtacaacccccaggcagtgatcgacgacctctacaccagcccacagaacaagaaggccctccggcaaatcctgctcgtcgtgaacgacatccagaaggcgttaaaggggcaggctccctcccgcatcctgatcgagtttgccagggagggccaggagaacccccgcctcagcacgcaacggaagcagcaggtcgagaacgcctacaaggaggcctccgacgcgctgctgagctccgccgaagtgcgccaggagctcaagggcctggacaacaaggccctggccaacacccgcttgttcctgtacttcatgcagggcgggcgggacatttacaccggcaagagcctgaacatcgacgacctgtcgaagtacgatatcgaccacatcctgccgcaggccttcatcaaggacaacagcctggacaaccgcgtactcgtgtccgcgaaaatgaaccggagcaagtccgaccaggtccccctgaacgacttcgccgagatccgctatgggaagcagatgcggcagcagtgggagaagatgctgcgcgccgggctcatcacccggaagaagtaccacaacctcacgctgaaccccgagagcatcaacaagtacaccgccaagggattcatcaaccgccagctcgtggagacacgccaggtgactaagctagccacgaacctgctagtggaccagtacgcggaggacgacgtgcagctgatcaccgtcaagagcaacctgacccaccagatgcgggaggagttcgacttccccaagaaccggaacgtcaacaaccaccaccacgccttcgatgcctacctcaccgccttcgtgggtctgtatctgctcaagcgctacccgaagctagcgccctacttcgtgtacggggactaccagaagggagcctcccagaactcgaagtggagaaacttcaacttcctggggaacctccaccgcgagaaagtcgtggacaagaacacgggcgagatcatctggcagcgggacgccgggctgggcgagctgaaccgcatctacaacttcaagaagatcctcgtgacccgggccctgcgcgtcaaccggggccccatgttcaagcagactatctacaaggccgaggaggacaagtccagcgggcgcggctccaagcagctgatccccaccaagaagaaccggccgacggagctctacgggggctacaccaacaaggagaccgcgtacctgtgcctggtcaaggagccccacaagaagggcgacatctaccgcatctgcagtgtgctcaacatgtggctgaccgaactcgaccgcatcgccgaccccatcgccaaggcccagaagctcacggagctgctgacgccccagttcaccaccaccaagaagaagcaggggcagaaaatcccggtcgtgaagcccttcaaggtggtcatccccaagatcctcatcaaccagcggttcttctcccgcggccaggagctaaccgtggccagccccatgtacatgcacaacgagcaggagctgtttctcaacaagaagaccatcaagctgctgaacgggcagctcgcgaagaacgaggcccacgagctggccccgaagatctaccagcagatactggaccaggtgaacgactacttccccctgtacgacatgtacaagttccgggacaccctcaacgcctccaaagagatcttcgtcaacctgccctggcaggaccagcgccaggacaagaagatcagccagtccggccaaaagagcatcctgaacaagatcctcatcgggctgcacgccaacgcggcccggatcaagctgacggagctcaacttcaagagcgacttcggcctgctgagccagcgctccggcatcgccttcagccccgacgaccagatcatctaccagtccccgaccgggctgtttgagcggcgcgtgaccctgaaggacctgtga

SEQ ID NO: 7762 - RNA, 4110 nt, synthetic construct
  misc_feature 1..4110: note = Cas9 variant
  source 1..4110: mol_type = other RNA
atgaaggtgaacaactaccacatcggcctggacatcgggaccagctccatcggctgggtcgccatgggcgaggacggcaagcccctccgcgtgaaggggaagaccgccatcggcgcgcggctgttccgcgagggcaacccggccgcggaccggcgcatgttccggacgacccgccggcgcctgaaccggcgcaagtggcggctcaagctgctggacgagatcttcgacccctacatcacccccgtggactcaaccttcttcgcccgcctcaagcagtccaactggagccccaaggactcccggaaggccttcaaagacagcaccctcttcccggacctgacggacaagcagtaccacctcgactaccccaccatctaccacctccggcacgcgctgatgacccaggacaagcagttcgacatccggatggtctacctggccctgcaccacatcgtaaagtaccgcgggaacttcctgaactccacccccgtggacagtttcaaggcctccaaagtcaacttcgacgaccagttcaagaaactcaacgagctctacaccgccatcaaccccgaggagagcttccaaatcaacttcgcgaactccgagaagatcggccagcagttcctggatccgagcatccggaagttcgacaagaagaagcagatctccaagatcgtgcccgtgaccatggacgacaaggccgtcgacaagctcaacgggaagatcgccagcgaaatcgtgaacgcaatcctgggctacaagtccaagctggacgtggccgtccagtgcgaccccgaggacagcaagccctgggcggtgaagttcgacgacgaagacatcgacgccaagctccagaagatcctgccagagatggacgagaaccagcagtccatcatcgggatcatccaggacctgtacagccaggtgaccctcaaccagattgtccccaacggcatgtccctgagcgaaagcatgatcaagaagtacaacgaccaccacgaccacctgaagctctacaagaagctgattggccagatctccgacagcaagaagaagacggccctgaagaaggcatacgaccagtacgtggggaacgacggcaaggtgatcgagcaggacgacttctactccagcgtcaagaagaacctcgacgactccgagctgagcaagcagatcatggacctgatcgacgccgacaagttcatgcccaagcagcgcacctcccagaacggggtgatcccccaccagctccaccagcgggagctggacgagatcatcgagcaccagagcaagtactacccgtggctggcggagtccaaccccaacaagcacgacctccacctggccaagtacaagatcgaggagctggtggcgttccgcatcccctactacgtcggccccatgatcaccccggaggaccagaagaagtccggcgccgccgtgttcagctggatgaagcggaaggagcccgggcaaatcaccccctggaacttcgatcagaaggtggaccgcatggagagcgcgaacaagttcataaagcgcatgacgaccaaagacacttacctcatcggcgaggacgtcctgcccgacgagtccctgctctacgagaagttcaaggtgctgaacgagctgaacatggtccgggtgaacggggacagcctcaaggtggccgacaagcaggccatctaccaggacctgttcgagaactataagcacatctccgtcaagaagatgcagaactacatcaaagataagaccggcctgccgaacaaccccgacatcagcgggctctccgaccccgaccactttaacaacagcctgggcacctacaacgacttcaagaagctgttcggcgacaaggtggacgaccccgacctgcaggacgacttcgagaagatcgtggagtggtccaccgtattcgaggacaagaagatcctccgcgccaagctgaacgagatcagctggctgagcgacaagcaaaaggacgacctcgagagtagccggtaccagcgctgggggcggctgtccaagaagctgctcaccggcatcgtgaacgaccagggggagcgcatcatcgacgagctgtggaacaccaacaagaatttcatgcagatccagagcgacgatgacttcgccaagcggatccacgaggcgaacgccgatcagatgaaagccacggatgtggaggacgtcctggccgacgcgtacacctccccgcagaacaagaaggccatccgccaggtggtgaaggtcgtggacgacatccagcgggctatgggcggtgtggccccgaagttcatcagcatcgagttcacccgttccgaggaccggaacccccgccggaccatcagccgcgagcgccagctcgaggacacgctgaaggacaccgccaagacccttgtcaagtccatgaacccggacatcctcagcgagctggacaatgcgtccaagagcaagaagggcctgaccgaccgcttatacctgtacttcacgcagctgggccgggacatgtacaccgggaagcccatcaacatcgacgagatctccaactacgacatcgaccacatcctcccccaggccttcatcaaggacgacagcctgagtaaccgcgtgcttgtgagcaaggccgtcaacaacggtaagtccgccaacgttcccctcaagctgttcggggtgaagatggcccacttctggaagcagctggcggaggccggcctcatcaacaagaggaagctgaagaacctgcagaccaatccggacaccatcagcaagttcgccatgcacgggttcatccgccgccagctcgtcgagacgagccaggtgatcaagctggtggccaacatcctgggcgacaagtaccggaacgacgacaccaagatcatcgagatcaccgcccgcatgaaccaccagatgcgggacgagttcgcgttcatcaagaaccgcgagatcaacgactatcaccacgccttcgacgcctacctcaccgccttcctgggccggtacctgtaccaccgctacatcaagctccggccctacttcgtctacggggacttcaagaaattccgcgaggacaaggtgaccatgagaaacttcaacttcctgcacgacctgacggacgacacccaggcgcgcatcgccgacaccgagaccggcgaggtgatctgggaccgggagacgtccatcaagcagctccgcgacgtctaccactacaagttcatgctgatcagccaggaggtgtacaccctgcgcggggccatgttcaaccagaccatctaccccgccgacgaggccggccggaagaagctcatccccaccaaggcggacaaggccgtggacgtctacggcgggtactccggcagcaacgacgcctacatggccattgtgcggatccacgacaagaagggggacaagtacaaggtggtcggcgtgcccatgcgcgccctggatcggctgaacgcggccaagaacgtgagcgacgccaagtacgaccaggtcctcaaggacgtgctgacgccacagttcaccaagagcaagaagtcccgcaagaccggggagatcagccagaccgtggaggacttcgaggtcgtgctgggcaaggtgatgtaccggcagctcgtcatcgacggcgacaagaagttcatgctggggtccagcacgtaccagtacaatgccaagcagctggtgctctccgacgagagcgtgaagaccctggcctccaagggcaagctggacgaggcgcaggagagcgccgcctacgacaacgtctacgacgagatcctcgacaaggtggaccgctactttgccctgtacgaccaacggaactaccgcaccaatctgcacgagggggaacagaagttcatcggcctccccctgcacgacaccttcgacgggtccaagaaggtggcgaacggcaaacgcgaaacgatcagcgacatcctgaacggcctccacgccaacgccaccatgaccaacctgaaggtcctggggatctccagccccttcggcatgttccagtcccacgggccgatcaacttaaaccccgagaccatcatcctgtgccagtcacccacgggcctgttcgagcggcgcataatcctccgggatctatga

SEQ ID NO: 7763 - RNA, 4113 nt, synthetic construct; identical to SEQ ID NO: 1963
  misc_feature 1..4113: note = Cas9 variant
  source 1..4113: mol_type = other RNA

SEQ ID NO: 7764 - RNA, 4113 nt, synthetic construct
  misc_feature 1..4113: note = Cas9 variant
  source 1..4113: mol_type = other RNA
atgaacaaaccctatagcatcggcctggacatcgggaccaactccgtgggctggagcatcattaccgacgactataaggtcccggccaagaagatgcgcgtgctcgggaacacggacaaggagtatatcaagaaaaacctgatcggcgccttactgttcgatgggggcaacaccgcggccgaccgtcgcctgaagcggaccgcccgccggcgctacacccggcgccggaatcgcatcctgtacctccaagagatattcgccgaggagatgtccaaggtggacgacagcttcttccaccggctcgaagactccttcctggtcgaggaggacaaacgcggcagcaagtaccccatcttcgccacgatgcaggaggagaagtactaccatgagaagttcccaaccatctaccacctcaggaaggagttagcggacaagaaggagaaggccgacctgcgtctcatctatctggccctggcccacatcatcaagttccgcgggcacttcctcatcgaggacgaccgcttcgacgtgcggaacaccgacatccagaagcagtaccaggcgttcctggagatcttcgatactacgttcgagaacaacgaccttctcagccagaacgtggacgtcgaggccatcctgaccgacaagatatctaagtcggcgaaaaaggaccgcatactggcccggtatcccaaccagaaatccaccggcatcttcgccgagttcctcaaacttatagtgggtaaccaggcagacttcaagaagcacttcaacctggaggacaagaccccgctccagttcgccaaggacagctacgacgaggatctggaaaacctgctcggccagatcggggacgagttcgctgacctgttcagcgccgccaagaagctgtacgactccgtgctcctgagcggcatcctcacggtcaccgacctctccaccaaggcgcccttgagcgcctcaatgatccaacgctacgacgagcaccgcgaggatctgaagcagctcaagcagttcgtgaaggccagcctgcccgagaagtaccaggagatcttcgcggactccagcaaggacgggtacgccgggtacatcgagggtaagaccaaccaggaagcgttttacaagtacctgagcaagctcctgacgaagcaggaggggtccgagtacctgttggagaagatcaagaacgaggacttcctgcgcaagcagcgcaccttcgacaacggcagcatcccccaccaagtgcatctgaccgagctccgggccatcatccgccggcagtccgagtactatccgttcctgaaggagaacctggaccgcatcgagaagatattaacattccggatcccctactacgtcggccccctggcccgcgaaaagtccgacttcgcctggatgacgcggaagaccgacgacagcattcgcccctggaatttcgaggacctggtggacaaggagaagtccgccgaagcgttcatccaccggatgaccaacaatgatctgtacctcccggaggagaaggtcctgcccaagcacagcctgatctacgagaagttcaccgtctacaacgaactcacgaaggtgcgcttcctagccgaggggtttaaggacttccagttcctgaaccggaagcagaaggagaccatctttaacagcctcttcaaggagaagcgcaaggtgaccgagaaggacatcatctccttcctgaacaaggtcgacggatacgaggggatcgccatcaagggcatagagaagcagttcaacgccagcctgtccacctaccacgacctcaagaagatcctggggaaagacttcctggacaacacggacaacgagctcatcctggaagacatagtgcaaacgctgaccctcttcgaggaccgagagatgatcaggaagcggctcgacatctacaaggacttcttcaccgagagccagctgaagaagctctaccgccgccactacacgggctggggccgcctgtccgcgaagctgatcaacgggatccggaacaaggaaaaccagaagaccatcctcgactacctgatcgacgacggcagcgccaaccgcaactttatgcagctgatcaaggacgccggactcagtttcaagccgatcatcgacaaggctcgcaccggcagccactccgacaacctcaaggaagtagtcggggagctggccggaagccccgcgatcaagaagggcatccttcagagcctgaagatcgtggacgagctggtgaaagtcatggggtacgagccggaacagatcgtggtcgagatggcccgggaaaatcagaccactgcaaagggcctcagccgcctgcggcagcgcctgaccaccctccgggagagcctggccaacttaaagtccaacatcctcgaggagaagaagcccaagtacgtcaaggaccaggtggaaaaccaccacctgagcgacgatcgcctgttcctctactacctgcagaacgggaaggacatgtataccgacgacgagctggacatcgacaacctcagtcagtacgatatcgacttgatcatcccccaggctttcatcaaggacgacagcatcgacaacagggtcctggtgtccagcgcgaagaaccgcggtaagtccgacgacgtgcccagtgtcgagattgtgaaggactgcaaggtgttctggaagaagctcctggacgccaagctgatgtcccagcggaagtatgacaacttaaccaaggccgagcgcggcggcctgaccagcgacgacaaggcccggttcatccagcgccagctggtcgagacccggcagatcaccaagcacgtggcccgcatcctcgacgagcggttcaacaacgagctggactccaagggccgccggatccgcaaggtaaagatagtcaccctcaagagcaacctcgtctcaaacttccggaaggagttcggattctacaagatccgcgaagtcaacaactaccatcacgcgcacgacgcctacttgaacgccgtcgtggccaaggcgatcctgacgaagtacccacagctcgagcccgagttcgtgtacggcgactacccgaagtataacagctacaagacccggaagtccgccaccgagaagctgtttttctacagcaacatcatgaacttcttcaagaccaaggtcacgctggccgacgggaccgtggtggtcaaagacgacatcgaggtgaacaacgacaccggcgagatcgtgtgggacaagaagaaacactttgccaccgtacgaaaggtgctctcgtacccacaggtgaacatcgtcaagaagacggaaatccagaccggcgggttcagcaaggagagcatcctggcccacggcaacagtgacaagctgatcccgcgcaagaccaaggacatttacctcgaccccaagaagtacggcgggttcgacagccccattgtggcgtactccgtgctggtagtagccgacatcaagaaggggaaagcccagaagttgaagaccgtgacggagctcctggggatcaccatcatggagcggagccggtttgagaagaacccatccgccttcctggaaagcaagggctacctcaacatccgggacgacaagctgatgatcctgccgaagtactccctcttcgagctggagaacgggcgccggcgcctgctcgccagcgcggacgagctgcaaaaggggaacgagctggccctccccacccagttcatgaaattcctttacctggcctcccggtacaacgagctcaaggggaagcccgaggagatcgaacaaaagcaggagttcgtcgtgcagcacgttagctacttcgatgacatcctgcagatcatcaacgacttctccaaccgcgtcatcctggccgacgccaacttagagaagatcaacaagctgtaccaggacaacaaggagaacatcccggtggacgagctggcgaacaacatcataaacctcttcacctttacgagcctgggcgcccccgccgccttcaagttcttcgacaagatcgtggacaggaagcgctacacctccacgaaggaggtactgaacagcaccctcatccatcagtccatcaccgggctgtacgagacccggatagatctgggcaaactcggcgaggactga

SEQ ID NO: 7765 - RNA, 4113 nt, synthetic construct
  misc_feature 1..4113: note = Cas9 variant
  source 1..4113: mol_type = other RNA
atgaccaagaagaactatagcatcggcctggacatcgggaccaactccgtgggctgggccgtcatcacggacgactataaggtgcccgccaagaaaatgaaggtgctcgggaacaccgacaagaagtacatcaagaagaacttgctgggcgcgctcctgttcgacagcggggagaccgccgaggccacccgcctgaagcggactgcccgccggcgctacacccggcgcaagaaccggctccgctacctgcaggagatcttcgcagaggagatgaccaaggtcgacgagtccttcttctaccggctggacgagagcttcctcaccacggacgagaaggacttcgagcgccacccgatcttcggcaacaaggcagaggaggacgcctaccaccagaagttccccaccatctaccacctccggaactacctggccgactccagcgagaaggccgatctccgcttagtgtacctggcgctcgctcacatgatcaagtaccggggccacttcctgatcgaggggaagctgaacgccgagaacaccgacgtgcagaagttattcaccgacttcgtcggcgtgtacgaccgcactttcgacgactcccacctgagcgagatcaccgtggacgtcgcctccaccctgaccgagaagatcagcaagtcccggcgcctcgaaaacctgattaagtactaccccacggagaaaaagaacaccctgttcgggaacctcatcgccctggcgctgggcctccagcccaacttcaagatgaacttcaagctgagcgaggacgccaagctgcagttctccaaggacacgtacgaagaggacctcgaggagctgctggggaagatcggcgacgactacgccgacttgtttaccagcgccaagaacctgtacgacgccatcctgctctccggcatcctgacggtggacgacaacagcaccaaggcgccgctgtccgccagcatgatcaagcggtacgtggagcaccacgaggacctcgaaaagctgaaggagttcataaaggccaacaagtccgagctgtaccacgacatcttcaaggacaagaacaagaacgggtacgccggctacatcgagaacggggtcaagcaggacgagttctacaagtacctcaagaacaccctgagcaagatcgacggcagcgactacttcctggataagatcgagcgcgaggacttcctccggaagcagcgcaccttcgacaacggctccattccccaccagatccacctccaggagatgcacgccatcctgcggcggcagggggactactatcccttcctcaaggagaagcaggaccgcatcgagaagatcctcacgttccggatcccctactacgtgggtccgctggtcaggaaggacagccggttcgcgtgggccgagtacagatctgacgagaagatcaccccctggaacttcgacaaggtcatcgacaaggagaagtccgcagagaaattcatcacccggatgaccctgaacgacctctacctgcccgaggagaaggtgctgcccaagcacagccacgtgtacgagacgtacgccgtctacaacgagctcaccaagatcaagtacgtgaacgagcaggggaaggagagcttcttcgactcgaacatgaagcaggagatcttcgaccacgtgttcaaggagaaccgaaaggtcaccaaggagaagctgctgaactacctcaacaaggagttcccggagtaccggatcaaggacctcataggcctggacaaggagaacaagagcttcaacgcctccctcggcacataccacgacctgaagaagatcctggacaaggcgttcctcgacgacaaggtgaacgaggaggtcatcgaggacatcatcaagacgctgaccctgttcgaggacaaggacatgatccacgagcgcctccagaagtacagcgacatcttcaccgccaatcagttgaaaaagctggagcggcgccactacaccggctggggccggctctcctacaagctgatcaacgggatccgcaacaaggagaacaacaagacgatcctggactacctcatcgacgacggcagcgccaaccggaacttcatgcagctgatcaacgacgacactctgcccttcaagcagatcatccagaagtcccaggtcgtgggggacgtcgacgacatcgaggcagtggtgcacgacctccccggcagccccgcgatcaagaaggggatcctgcagtccgtcaagatcgtggacgagctggtgaaggtcatgggcgacaacccggacaacatcgtgatcgagatggcccgcgaaaaccagaccaccaaccggggacgcagccagtcccagcagcggctcaagaagctgcaaagctccctgaaggagctcgggagcaacatcctgaacgaggagaagcccagctacatcgaggacaaggtggagaactcccacctccagaacgaccagctgttcctgtactacatccagaacggcaaggacatgtacaccggggacgagctggacatcgaccacctgagcgactatgacatcgaccacatcatcccccaagccttcatcaaggacgactccatcgacaaccgcgtcctgacgagctccgccaagaaccggggcaagagcgacgacgtgccctccctggacatagtccgcgcccggaaggcggagtgggtccggctctacaagagcggtctgatctccaagcgcaagttcgacaacctgaccaaggccgagcggggcggcctcaccgaggccgacaaggccgggttcatcaagcgccagctggtggagacccggcagatcacgaagcacgtggcccagatcctggacgcgcgcttcaacaccgagcacgacgagaacgacaaggtcatccgggacgtgaaggtgatcaccctcaagagcaacctggtctcccagttccgcaaggacttcgagttctacaaggtgcgggaaatcaacgactaccaccacgcccacgacgcctacctgaacgccgtggtcggcaccgccctcctgaagaagtacccgaagctggcgagcgagtttgtgtacggggagtataagaagtacgacatccgcaagttcatcacgaacagcagcgacaaagccaccgcaaagtacttcttctactccaacctcatgaacttcttcaagaccaaggtgaagtacgccgacggcaccgtctttgagcggcccatcatcgagacgaacgcggacggcgagatcgcctggaacaagcagatcgacttcgagaaggtgcgcaaggtgttaagctacccccaggtcaacatcgtgaagaaggtggagacccagaccgggggcttctccaaggagagcatcctgcccaagggggacagcgacaagctcatcccgcggaagaccaagaaggtctactgggacacaaagaagtacggcgggttcgactcccccaccgtggcatatagcgtgttcgtcgtcgccgacgtggagaaggggaaggccaagaagctgaagaccgtcaaggagctggtgggcatctccatcatggagcgctcattcttcgaggagaaccccgttgagttcctcgagaacaaggggtaccacaatatccgggaggacaagctgatcaagctgcccaagtactccctcttcgagttcgagggcgggcgccggcgcctgctggcgagcgcctccgagctccagaagggcaacgagatggtcctgccggggtacctggtggagctcctgtaccacgcccaccgggccgacaacttcaacagcaccgagtacctgaactacgtgtccgagcacaagaaggagttcgagaaggtcctcagctgcgtggaggacttcgccaacctgtacgtggacgtcgagaagaacctgtccaagatccgcgcggtggccgacagcatggacaacttctccatcgaggagatcagcaactccttcatcaacctcctgacgctgaccgccctcggagcgcccgccgacttcaacttcctgggcgaaaagatccccaggaagcgctacaccagcactaaggagtgcctgacggcgacgctcatccaccagtccatcaccgggctttacgagacccgcatcgacctgagcaagctcggcgaggagtga

SEQ ID NO: 7766 - RNA, 4113 nt, synthetic construct; identical to SEQ ID NO: 1966
  misc_feature 1..4113: note = Cas9 variant
  source 1..4113: mol_type = other RNA

SEQ ID NO: 7767 - RNA, 4113 nt, synthetic construct
  misc_feature 1..4113: note = Cas9 variant
  source 1..4113: mol_type = other RNA
atgaacaagccctacagcatcggcctggacatcgggacaaactccgtgggttggagcataatcaccgacgattacaaggtcccggccaagaagatgagggtgctcgggaacacggacaaagagtacatcaagaagaacctgatcggcgccctcctgttcgacgggggcaacactgcggccgaccggaggctgaagcggaccgccagaaggcgctacacccgtcgccggaaccgcatcctgtacctccaggagatcttcgccgaggagatgtccaaggtggacgacagcttcttccaccggcttgaggactccttcctggtcgaggaggacaagcgcggtagcaagtaccccatcttcgccacgatgcaggaggaaaagtactaccacgagaagttccccacgatctaccacctccggaaggagctagcggacaagaaggagaaggccgacctgcgcctaatctacctggccctggcccacatcatcaagttccgggggcacttcctcatcgaggacgaccgctttgatgtgcggaacaccgacatccagaagcagtaccaggctttcctggagatcttcgacaccacgttcgagaacaacgaccttctcagccagaacgtggacgtagaggccatcctgaccgacaagatcagcaagagcgccaagaaggaccgcatcctggcccggtaccccaaccagaagtccaccggaatcttcgccgagttcctcaagctgatcgtggggaaccaggcagacttcaagaagcactttaacctggaggacaagaccccgctccagtttgccaaggacagctacgacgaggacctggagaatctgctcggccagatcggggacgagttcgccgacctgttcagcgccgccaagaaactttacgactccgtgctcctgagtggcatcctgacggtcaccgacctctccaccaaggcgcccctcagcgcctccatgatccagcgttacgacgagcaccgggaggacctgaagcagctcaagcagttcgtgaaggccagcctgcccgaaaagtaccaagagatcttcgccgactccagcaaggacggctacgccgggtacatagagggcaagacaaaccaagaggcgttctacaagtacctgagcaagctccttacgaagcaggagggctccgagtacctgctcgagaagataaagaacgaggacttcctgcgcaagcagcgcaccttcgacaacggcagcatcccacaccaggtccacctgaccgagctccgggccatcatccggcggcagtcggaatattaccccttcctgaaggagaacctggaccgcatcgagaagatcctgacttttcggatcccctactacgtcggccccctggcccgagagaagtccgacttcgcctggatgacgcggaagaccgacgacagcatccgcccctggaacttcgaggacctggtagacaaggagaagtccgccgaggcctttatccaccggatgaccaacaacgatctgtacctcccggaggagaaggtgctccccaagcacagcctaatctacgagaagttcaccgtctacaacgagctcacaaaggtgagattcctggccgaggggttcaaggactttcagttcctgaatcggaaacagaaggagacaatctttaacagcctcttcaaggagaagcgcaaggtgaccgagaaggacatcatctccttcctgaacaaggttgacggctacgagggtattgccataaagggcatcgagaagcagttcaatgccagcctgtccacctaccacgacctcaagaagatactggggaaagacttcctggacaacacggacaacgagctcatcctggaggacatcgtccaaacccttaccctcttcgaagaccgggagatgatccgcaagcggctggatatctacaaggacttcttcaccgagtcacagctgaagaagctctatcgccggcactacaccggctggggccgcctgtccgctaagctgataaacggtatccggaacaaagagaaccagaaaaccattctcgactacctgatcgacgacggttcggccaaccgcaacttcatgcagctgatcaaggacgccgggctctcatttaagcccatcatcgacaaggcccgcaccggctcccactccgacaacctgaaggaggtggttggggagctagcaggcagccccgcgatcaagaagggcatcctccagtccctgaagatcgtggacgagctggtgaaggtcatgggatacgagccggagcagatcgtggtcgagatggcccgggagaaccagaccacggccaaaggcctcagccgcagccggcaaagactgacgacactgcgggagagtctcgccaacctcaagagcaacatcctggaggagaagaaacccaagtatgtgaaggaccaggtggagaaccaccacctttccgacgaccgcctgttcctgtactacctccagaacgggaaggacatgtacaccgacgacgagcttgacatcgacaatctgtcccagtacgatatcgaccacatcattccccaggccttcatcaaggacgactccatcgacaatcgggtcttggtaagctccgcgaagaatcgcggcaagagcgacgacgtgccctccgtcgagatcgtgaaggactgtaaagtgttctggaagaagctgctggacgcaaaattgatgagccagcggaaatacgacaacctgaccaaagccgagcgcgggggcctgacctccgatgacaaagcccggttcatccagcgccagctcgtcgagacccggcagatcaccaagcacgtggcccgcatccttgacgagcggttcaacaacgagctggacagcaagggccgccggatccgcaaggtgaagatcgtcaccctcaagagcaacctggtgagcaacttccggaaggagttcgggttctacaagatccgcgaggtgaacaactaccaccacgcgcacgacgcctacctgaacgccgtggtggccaaggcgatcctcacgaagtacccgcagctggaacccgagttcgtatacggggactaccccaagtacaactcctacaagacccgcaagagcgccaccgagaaactgttcttctactccaatatcatgaactttttcaagaccaaggtcacgctcgccgacggcaccgtggtggtcaaggacgacatcgaggtgaacaacgacaccggcgagatcgtgtgggacaagaagaagcacttcgccaccgtcagaaaagtgctgagctacccccaggtgaacatagtcaagaagacagagatccagaccggcgggttcagcaaggaatccatcctggcccacggcaacagcgacaagctcatcccgcgcaagaccaaggacatttatcttgaccccaagaagtacgggggcttcgactcccccatcgtggcgtacagcgtgctggtcgtggccgacatcaagaaagggaaggcccagaagctcaagacggtgacggagttgctggggatcacaatcatggagcggtcccgcttcgagaagaaccccagcgccttcctcgagtccaagggctacttaaacatccgggacgacaagctgatgatcctcccgaagtacagcctgtttgagctggagaacgggcgccggcgcctcctggcctccgcgggcgagctgcagaaggggaacgagctcgccctgcccacacagttcatgaagttcctgtatctcgccagccggtataacgagctgaagggcaagcccgaggagatcgagcagaagcaggagttcgtcgttcagcacgtgtcctacttcgacgacatcctacagatcatcaacgacttcagcaaccgcgtcatcctcgccgacgccaacctagagaagatcaacaagctgtaccaggacaacaaggagaatatcccggtggatgagcttgcgaacaacataatcaacctgttcaccttcacgtccctgggggcccccgctgccttcaagttcttcgataagatcgttgacaggaagcgctacaccagcaccaaagaggtcctcaactccaccctgatccaccagagcatcacgggcctgtacgagacgcggatcgacctcggcaagctgggggaagattga

SEQ ID NO: 7768 - RNA, 4113 nt, synthetic construct; identical to SEQ ID NO: 1968
  misc_feature 1..4113: note = Cas9 variant
  source 1..4113: mol_type = other RNA

SEQ ID NO: 7769 - RNA, 4113 nt, synthetic construct
  misc_feature 1..4113: note = Cas9 variant
  source 1..4113: mol_type = other RNA
atgaccaagatcaaggacgactacatcgtgggactggatatcgggaccgacagctgcggctgggtcgccatgaactccgacaacgacatcctcaagctgcaggggaagacggccatcggcagccacctgttcgaggcggggaagtccgccgccgaccgccgcctcttccggaccacacaccggcgcatcaagcggcgccggtggcgcctgaaacttctcgaggagttcttcgacccctacatggccaaggtggacccatacttcttcgcccggctgaaggagtcaggcctgagccccctcgacaagcgcaagaacgtgttctccatcgtcttccccaccgcggccgaggacaagaagttctacgacgactaccccacgatctaccacctccggtacaagctgatgaccgaggacgagaagttcgacctccgggaggtgtacctggcgatccaccacatcatcaagtacagaggcaacttcctgtacaacacctccgtgaaggacttcaaggccagcaagatcgacgtcaagtccagcatcgagaagctcaacgagctgtacgagaacctggggctcgacctgaacgtggagttcaacatctccaacaccgcagagatcgagaaggttctcaaggacaagcagatcttcaagcgcgacaaggtcaagaagatcgccgagctgttcgccatcaagacggacaacaaggagcagagcaagcggatcaaggacatctccaagcaggtcgccaacgccgtgctgggctacaagacccgctttgacaccatcgcgcttaaggaggtgagcaaggacgagctctccgactggaacttcaagctgagcgacatcgacgccgactccaagttcgaggccctgatggggaacctagacgagaacgagcaggccatcctgctgaccatcaaggagctgttcaacgccgtgacgctcaacggcatcgtggaggacgggaacaccctgagcgagtccatgatcaacaagtacaacgaccaccgggacgacctcaagttactgaaggaggtcatcgagaatcacatcgaccgcaaaaaggcggtgaagctcgcactggcctacgacctgtacgtgaacaaccgtcacggccagctcatccaggccaagaagaagctgggcaagatcaaaccggggagcaaggaggacttctacaaggtcgtgaacaagaacctggacgactcgcaggcctccaaggagatcaaaaagaagatcgagctcgacagcttcatgcccaagcagcgcaccaacgcgaacggcgtgatcccctaccaactgcatcagctggagctcgacaagatcatcgagaaccaatccaagtactaccccttcctgaaggagatcaacccggtcagctcccacctgaaggaggccccctacaagctcgacgagctgatccggttcagggtgccctactacgtggggcccctgatcagcccgaacgagtccaccaaggacattcaaacgaagaagaaccagaacttcgcctggatgatccgcaaggaggagggccggatcaccccctggaacttcgaccaaaaggtcgaccgcattgagagcgccaacaagttcatcaagcggatgactaccaaggacacgtacctgttcggcgagaacgtgctccccgccaactccctgctgtaccagaagttcaccgtcctcaacgagctgaacaacatccgcatcaacgggaagcggatcagcgtggacctgaagcaagagatctacgagaacctcttcaagaagcacaccaccgtgacggtcaagaagctggagaactacctgaagcagaaccacaacctcgtgaaggtggagataaagggcctggcggacgagaagaagttcaactccgggctgaccacttacaaccgcttcaagaacctcaacatcttcgacaaccagatcgacgacctgaagtaccggaaggacttcgagaagatcatcgagtggagcaccatcttcgaggacaagtccatctacaaggagaagctgcgcagcatcgactggctcaacgagaagcagatcaacgccctatccaacatccggctgcagggctgggggcgcctcagcaagaagctgctggcccagctccacgaccacaacggccagacgatcatcgagcagctgtgggactcccagaacaacttcatgcagatcgtcacccaggccgacttcaaggacgcgatcgccaaggccaaccagaacctgctagtggccaccagcgtagaggatatcctgaacgacgcctacacctcccccgcgaacaagaaggccatcaggcaggtcatcaaggtggtggacgacatcgtcaaggccgccagcggcaaggtaccgaagcagatcgccatcgagttcacgcgcgacgcggacgacaaccccaagcggagccagacccgcgggagtaagctgcagaaggtgtacaaggacttaagcaccgagctggcctccaaggccatcgccgaggagctgaacgaggccatcaaggacaaaaagctcgtccaggacaagtactacctgtacttcatgcagctgggccgggacgcgtacaccggcgagcccatcaacatcgacgagatccagaagtacgacatcgaccacatcctcccccagagcttcatcaaggacgacgccctggacaatcgcgtgctggtgtccaaggccgtcaacaacgataagagcgacaacgtgccggtgaagctgttcggcaacgagatggccgggaacctcggcatcacgattcggaagatgtgggaggagtggaagaacatcggcctgatctccaaaactaagtacaacaacctcctgaccgaccccgaccacatcaacaagtacgagagcgcggggttcatccgccggcagctggtcgaaacctcccagattatcaagctcgtgagcaccatcctgcagtccagataccccaacacggagatcatcactgtgaaggccaagtacaatcactacctgcgcgagaagttcgacctctacaagagccgggaggtcaacgactaccaccacgcgatcgacgcctacctgtccgccatctgcggcaacctgctctaccagaactaccccaacctgcgcccgttcttcgtgtacgggcagtacaagaagttcagctcagaccccgacaaggagaaggagatcttcaacaagacccggaagttcagcttcatctcccagatcctgaagaacaagagcgagaacagcaaggagatcgcggagaagctcaagcgcgcctaccagtttaagtacatgctggtgtcccgggagaccgagacgaaggaccaggagatgttcaagatgaccgtcttcccccgcgagacgcccggcaatctgatcccgaagaagaaggggatggccaccgagatctacggcggctacacgaagaacagcgacgcctacatggtgatcgtgaagatcgacaagaagaaggagaccgagtaccggatcctcgggatacccacccgcgagctggtcaacctgaagaaggccgagaaggaggaccactacgagtcctacctcaaggagatcctcgcgccccggatcctgtacaacaagaacggcaagcgcgacaagaagatcaccagcttcgagatcgtgaagtccaagatcccgtacaagcaggtcatccaggacggggataagaagttcatgctcggcagctccacgtacgtctacaacgccaagcagctgaccctgagcaccgagtccatgaaggccatcaccaacaactttgacaaggacagcgacgagaacgacgctctgatcaaggcctacgacgagatcctggacaaggtggacaagtacctgcccctcttcgacatcaatgcgttccggaagaagctgcactccggccgcgagaagttcgtggagctgagcctcgaggacaagaaggacatcatcctgaaggtcctgatcgggctccacgataaccccgccacgtccgacctgaagaccctggggttcagctccaccgagctagggaaaatgcagaagaacagcggcatcgtgctgtccgggaacgccaagctgatttaccagagccccaccggcctcttcaagaagtccgtgaagatcagcgacctgtga

SEQ ID NO: 7770 - RNA, 4113 nt, synthetic construct
  misc_feature 1..4113: note = Cas9 variant
  source 1..4113: mol_type = other RNA
atgaacaagccctacagcatcggcctggatatcgggaccaactccgtgggctggagcatcatcaccgacgactacaaggtcccggccaagaagatgcgcgtgctcgggaacacggataaggagtacatcaagaagaacctgatcggcgccctgctgttcgacgggggcaatacagcagccgaccgccgcctgaagcggaccgcccgccggcgctacacccggcgccggaaccgcatcctgtacctccaagagatcttcgccgaggagatgtccaaggtggacgacagcttctttcaccggctagaggactccttcctggtcgaggaggacaagcgcggaagcaaataccccatcttcgccacgatgcaggaggagaagtactaccacgagaagtttcccaccatctaccatctccggaaggagcttgccgacaagaaggagaaagccgacctacgcctcatctacctagccctggcccatatcatcaagttccgggggcacttcctcatcgaggacgaccgattcgacgtgcggaacacagacatccagaaacagtaccaggccttcctggagatcttcgacaccacgttcgagaacaatgacctgttgtcccagaacgtggacgtcgaggccatcctgaccgacaagatcagcaagtccgccaagaaagaccgcatcctggcccggtaccccaaccagaagtccaccggcatcttcgccgagttcctcaagctgatcgtggggaaccaggccgacttcaaaaagcactttaacctagaggacaagaccccgctccagttcgccaaggacagctacgacgaggacctggagaacctactcggccagatcggggacgagttcgccgacctgttcagcgccgccaagaagctgtacgactccgtgttactgagcggcatcctgacggtcactgacttgtccaccaaggcgcccctgagcgcttccatgatccaacgctacgatgaacaccgcgaggacctgaagcagctcaagcaatttgtgaaggcaagcctgccggagaagtaccaggagatcttcgcagattcaagcaaggatggctacgccgggtacatcgagggcaagaccaatcaagaggcgttctacaagtacctgagcaagctcctgacgaagcaggaggggtccgagtacctactcgagaagatcaagaacgaggactttctgcgcaaacagcgcaccttcgacaacggcagcattccgcaccaggtgcacctgacagagctccgggccatcatccggcggcagtccgagtattacccgttcctcaaggaaaacctggaccgcatcgagaagatactcaccttccggatcccctactacgtgggccctctggctcgcgagaagtccgacttcgcctggatgacgcggaagaccgacgactctatccgcccctggaacttcgaggacctggtggacaaggagaagtccgccgaggcgttcattcaccggatgaccaataacgacctgtacctcccggaggagaaggttcttcccaagcacagccttatctacgagaagttcacggtctacaacgagctcacgaaggtgcgcttcctggccgaagggttcaaggacttccagttcctgaaccggaagcagaaggagaccatcttcaacagcctcttcaaggagaaacgcaaagtgaccgagaaggacatcatttctttcctgaacaaggtcgacggctacgagggaatcgccatcaagggaatcgagaaacagttcaacgccagcctgtccacctaccacgaccttaagaagatcctggggaaggacttcctggataacacggacaatgagctcatcctggaggacatcgtgcagaccctgaccctcttcgaggaccgtgagatgatccgcaagcgtctggatatctacaaggacttcttcaccgagagccagctgaaaaagctctaccgccggcactacaccggctggggacgtctgtccgcgaagctgatcaacgggatccggaacaaagaaaaccagaagacgatcctcgactacctgatcgacgacggcagcgccaaccgcaacttcatgcagctgatcaaggacgccgggctctccttcaagcccatcatagacaaggcccgcacgggcagccactccgacaatctgaaggaggtggtcggggagctggccggcagccccgcgataaagaagggcatccttcagtccttaaagatcgtggacgagctggtgaaggtcatggggtacgagccggagcagattgtggtcgagatggcccgggaaaaccagaccacggccaaaggcctctctcgcagccggcagcgcctgaccaccctgcgggagtccctcgccaatctcaagagcaacatcctggaggagaagaagcccaagtacgtaaaggaccaggtggagaaccaccacctctccgacgaccgcctcttcctgtactacctccagaacgggaaggacatgtataccgacgacgagctggacatcgacaacctgtcgcaatacgacattgaccacatcatcccgcaggccttcatcaaggacgacagcatcgacaaccgggtcctcgtgagctccgcgaagaaccgcggcaagagcgacgacgtgccctccgtcgagatagtgaaggactgcaaggtgttctggaagaagctgctggacgccaagctcatgagccagcggaaatacgacaacctgaccaaggccgagcgcgggggcctgacgtccgacgacaaggcacggttcatccaacgccagctcgtcgagacccgtcagatcaccaaacacgtggcccgcatcctggacgagcggttcaacaacgagctggacagcaagggccgccggatccgcaaggtgaagatcgtcaccctcaagtccaacctggtgagcaacttccggaaggagttcgggttctataagatccgcgaggtgaacaactaccaccacgcgcacgatgcctacctgaacgccgttgtggccaaggcgatcctcacgaaatacccgcagctggagccagagttcgtgtacggcgactaccctaagtacaattcttacaagacgcgcaagagcgccaccgagaagctgttcttctactccaacatcatgaacttcttcaagacaaaagtcacgctagccgacgggaccgtggtggtcaaagacgacatcgaggtgaacaacgacaccggagaaatcgtgtgggacaagaagaagcacttcgccactgtccggaaggtactgagctacccccaagtgaacatagtcaagaagacggagatccagaccggcgggttcagcaaggagtctatcctggcccacggtaacagcgacaagttaataccgcgcaagaccaaggacatctacctggaccccaagaagtacgggggcttcgactcccccaaggtggcgtacagcgtgctggtcgtggccgatatcaagaaagggaaggcccagaaactgaagaccgtgacggagctgctgggcatcaccatcatggagcgctcccgcttcgagaagaaccccagcgccttcctcgagtccaagggctacctgaacattcgggacgacaagctgatgatcctcccgaagtacagcctgttcgagctagagaacgggcgccggcgtctcctggcctccgcgggagaactgcagaagggcaacgagctcgccctgcccacccaattcatgaagttcctgtacctcgccagccggtacaacgagctgaagggcaagcccgaagagatcgagcagaaacaggagttcgtcgtgcagcacgtgtcctacttcgacgacatcctgcagatcatcaacgacttcagcaaccgcgtcatcctcgccgacgccaacctggagaagatcaacaagctgtaccaggacaacaaagagaacatccctgtggacgagctcgcgaacaacatcatcaacctcttcaccttcacgtccctgggggcccccgccgccttcaagtttttcgacaaaatcgtggaccggaagcgctacaccagcacgaaagaggtcctcaactccaccctgatacataagagcatcaccggcctgtacgagacccggatcgacctcggcaagctgggggaggactga

SEQ ID NO: 7771 - RNA, 4113 nt, synthetic construct
  misc_feature 1..4113: note = Cas9 variant
  source 1..4113: mol_type = other RNA
atgaacaagccctacagcatcggcctggacatcgggaccaactccgtgggctggagtatcatcaccgacgactacaaggttccggccaagaagatgcgcgtgctcgggaacacggacaaggagtacatcaagaagaacctgatcggcgccctgctgttcgacgggggcaacaccgctgccgaccggcgcctgaagcggaccgcccgccggcgctacacccgacgcagaaaccgcatcctgtacctccaggagatcttcgccgaggagatgtccaaggtggacgacagcttcttccaccggctggaggactctttcctggtcgaggaggacaagcgcggcagcaagtaccccatcttcgccactctccaggaggagaaggactaccacgagaagttctccaccatctaccacctccggaaggagctggcggacaaaaaggagaaggccgatctccgcctgatatacatcgcccttgcccacatcatcaagttccgggggcacttcctcatcgaagatgatagcttcgacgtgcgcaacaccgacatctccaagcagtatcaggacttcctggagatcttcaacaccacgttcgagaacaacgacctgctcagccagaacgtggacgtcgaggcgatcctgaccgacaagatctccaagagcgccaagaaggaccggatcctggcccagtaccccaaccagaagtccaccggcatcttcgccgagttcctcaagctgatcgtggggaaccaagccgacttcaagaaatacttcaacctggaggacaagacgcccctccagttcgcgaaggacagctacgacgaggacctggagaacctgctcggccagatcggggacgagttcgccgacctgttctccgccgccaaaaagctgtacgacagcgtgctcctgtccggcatcctgacggtcatcgacctcagcaccaaggccccgctgtccgcgagcatgatccagcgctacgacgagcaccgggaggacctgaagcaactcaagcagttcgtgaaggccagcttgcccgagaagtaccaggagatcttcgccgactccagtaaagacggctacgccgggtacatcgagggcaagactaaccaggaggcattctataagtacctgtccaagctcctgaccaagcaggaggacagcgagaacttcctggagaagatcaagaacgaggacttcctccgcaagcagcggacgttcgacaacgggtccatcccccaccaggtgcacctgaccgagctcaaggcgattatccgccgccagagcgagtactaccccttcctcaaggagaaccaggaccggatcgagaaaatcctgacattccgcattccgtactacatcggccccctggcccgggagaagtccgacttcgcctggatgacccgcaagacggacgacagcatccggccctggaacttcgaagacctcgtcgacaaggagaagtccgccgaggccttcatccaccgcatgaccaacaacgacttctacctgcccgaggaaaaggtgctgccgaagcacagcctgatctacgagaagttcaccgtgtacaacgagctcaccaaggtccggtacaagaacgagcagggcgagacgtactttttcgactccaacatcaagcaggagatcttcgatggggtgttcaaggagcaccgcaaggtgagcaagaagaagctgctggacttcctcgcgaaggagtacgaggagttccgtatcgtcgacgtgatcggcctggacaaggagaacaaagccttcaacgcctccctggggacctaccacgacctcgagaagatcctggataaggacttcctggacaaccccgacaacgagagcatcctcgaggacatcgtgcaaacgctgaccctgttcgaggaccgcgagatgatcaagaaacggctcgagaactacaaggacctgttcacggagtcccagctgaagaagctctaccgccggcactacaccggctgggggcgtctgagcgccaaactgatcaacggcatccgggacaaggagtcccagaagaccatcctcgactacctgatcgacgacgggcgcagcaaccggaacttcatgcagctgatcaatgacgacgggctcagtttcaagagcataatcagcaaggcgcaggccggctcccacagcgacaacctgaaggaggtcgtgggggagctggccggctcccccgccatcaagaaggggatcctccagagcctgaagatcgtggacgagttagtcaaggtgatgggctacgagcccgagcagatcgtcgtggagatggcccgcgagaaccagaccacgaaccagggccggcgcaactcccgccagcggtacaagctccttgacgatggggtgaaaaacctggcgagcgacttaaacggcaacatcctgaaggagtacccgaccgacaaccaggccctgcagaacgagcgcttattcttgtactacctgcagaacgggcgggacatgtacaccggcgaggccctcgacatcgacaacctgtcccagtacgacatcgaccacatcattccccaggccttcatcaaggacgacagcatcgacaaccgcgtcctggtgtccagcgccaagaaccgggggaagtccgacgacgtgcccagcctcgagatcgtcaaggactgcaaggtgttctggaagaagctgctggacgcgaagctcatgtcccagcgcaagtatgacaacctgacaaaggccgagcggggcggcctgacgagcgacgacaaggcccgcttcatccagcggcagctcgtggagacccgccagatcaccaagcacgtcgcccggatcctggacgagcgctttaacaacgagctggactccaaggggcggcgcatccggaaggtgaagatcgtgaccctcaagagcaacctggtttccaacttccgcaaggagttcggcttctacaagatccgcgaggtgaacaactaccaccacgcccacgacgcgtacctgaacgccgtggtcgccaaggccatcctcaccaagtacccccaactggagccggagttcgtgtacggggactaccccaagtacaacagctacaagacgcgcaagtccgcgactgagaagctgttcttctactccaacatcatgaacttcttcaagaccaaggtgacgctcgccgacggcacggtcgtggtgaaggacgacattgaggtaaacaacgacaccggcgagatcgtgtgggacaagaagaagcacttcgccaccgtgcggaaggtcctgagctacccccagaacaacatcgtgaagaagaccgagatccagaccgggggcttctccaaagagagcatcctggctcacgggaactccgacaagctaatcccccgcaagaccaaggacatctacctggacccgaagaagtacggcgggttcgacagccccatcgtggcctactccgtcctggtggtggcggacatcaagaagggcaaggcccagaagctcaagactgtaaccgagctgctgggcatcactatcatggagcggagccgcttcgagaagaacccctccgccttcctcgagagcaaggggtacctgaacatccgcgccgacaagctgatcatcctccccaagtactccctgttcgagctggagaacggccggcgccggctcctggccagcgcgggggagctgcagaagggcaacgagctcgccctgccgacccagttcatgaagttcctgtacctcgcctcccgctacaacgagagcaaggggaagcccgaggagatcgagaagaagcaagagtttgtgaaccagcacgtgtcctacttcgacgacatcctgcagctgatcaacgacttcagcaagcgcgtcatcctcgccgacgccaacctggagaagatcaacaagctgtaccaggacaacaaggagaacatctccgtggacgagctcgcaaacaacatcatcaacctgttcaccttcaccagcctgggcgcccccgccgccttcaagttcttcgacaagatcgtggaccgcaagcggtacacgtccaccaaggaggtcctcaacagcaccctgatccaccaaagcataaccggcctgtatgagacgcgcatcgacctcgggaagctgggcgaggactga

SEQ ID NO: 7772 - RNA, 4113 nt, synthetic construct
  misc_feature 1..4113: note = Cas9 variant
  source 1..4113: mol_type = other RNA
atgaacaagccctacagcatcggcctggacatcgggaccaactccgtgggctggagcatcataaccgatgattacaaggtcccggccaagaagatgcgcgtgcttgggaacaccgacaaggagtacatcaagaagaacctgatcggcgcgctgctgttcgacggcgggaacaccgcggccgacagacgcctgaagcggaccgcccgacggcggtacacccggcgccggaaccgcatcctgtacctccaggagatcttcgccgaagagatgtccaaggtggacgacagcttcttccaccggctggaggactccttcctggtcgaggaggacaagcgcgggagcaagtaccccatcttcgccacgcttcaggaggagaaggactatcacgagaagttcagcaccatctaccacctccggaaggagctggcggacaagaaagaaaaggccgacctccgcctgatctacatcgccctggcccacataataaagttccgggggcacttcctcatcgaggacgacagctttgacgtccgcaataccgacatctccaagcagtaccaggacttcttggagattttcaacaccacgttcgagaacaacgacctgctctcccagaacgtagacgtagaagctatcctgaccgacaaaatttccaagagcgccaagaaggaccggatcctggcccagtacccaaaccaaaagtccaccggcatcttcgccgagttcctcaaactgatcgtggggaaccaggccgacttcaagaagtactttaacctggaggacaagacgccactccagttcgcgaaggactcctacgacgaggatctggagaatctgctcggccagatcggggacgagttcgccgacttgttctccgccgccaagaagctgtacgacagcgtgctcctgagtggcatcctgacggttatcgacctcagcaccaaggccccgttatccgcgagcatgatacagcgctatgacgagcaccgggaggacctcaagcagctcaagcagttcgtgaaggccagcttacccgagaagtaccaggagatctttgccgacagtagcaaggacggctacgccggatacatcgagggcaagactaaccaggaggccttctacaagtatctgtccaagctcctgacaaagcaggaggactcagagaatttcctggagaagatcaagaacgaggactttctccgcaagcagcggacgttcgacaacggatccatcccccaccaggtgcacctaaccgagctgaaggcgataatccgcaggcagagcgagtactaccccttcctcaaggagaaccaggatcggatcgagaagatcttgaccttccgcatcccgtactacatcggccccctggcccgggaaaagtccgacttcgcctggatgactcgcaaaacggacgacagcattcggccctggaacttcgaggacctcgtcgacaaggaaaagtccgccgaggcgtttatccaccgcatgaccaacaacgacttctacctgcccgaggagaaagtgctgccaaagcatagcctgatctacgagaagttcaccgtctacaacgaactcaccaaggtccggtacaagaacgagcagggcgagacgtacttcttcgactccaacatcaagcaggagatcttcgacggggtattcaaggagcatcgcaaggtgagcaagaagaagctgttggacttcctcgcgaaggagtacgaggagttccggatcgtcgacgtgatcggcctggacaaggagaacaaggccttcaacgcgtccctggggacataccacgacctcgaaaagatcctggacaaggacttcctggacaaccctgacaacgagagcatactcgaggacatcgtgcagaccctgaccctgttcgaggacagagaaatgatcaagaagagactcgagaattacaaggacctgttcacggagtctcagctgaagaagctctatcgcagacactacaccggctgggggcgcctaagcgccaaactgatcaacggcatcagggacaaagagtcccagaagaccatcctcgactacctgatcgacgatggccggagcaaccggaacttcatgcagctgatcaacgacgacgggctatccttcaaaagcatcatcagcaaggcgcaggccggctctcatagcgacaacctgaaggaggtcgtcggggagttggccggctccccagccataaagaaggggatcctccaaagcctaaagatcgtggacgaactggtcaaggtgatgggctacgagcccgagcagatcgtcgtggagatggcccgcgagaaccagaccacgaaccaaggccggcgcaactcacgccagagatacaagctcctggacgacggggtgaagaacctggcgagcgacctcaacgggaacatactgaaagagtaccctaccgacaaccaggccctgcagaacgagcgcctcttcctgtactacctgcaaaatgggcgggacatgtacaccggcgaggcgctcgacatcgacaacctgtcccaatacgacatcgaccacatcatccctcaggccttcatcaaggacgacagcatagacaacagagtcctggtgtccagcgccaagaatcggggtaagtccgacgacgtgcccagcctcgagatcgttaaggactgcaaggtgttctggaagaagttactggacgcgaaactcatgtcccagcgaaagtacgacaacctgaccaaggccgagcggggcggcctcactagcgacgataaggcccgcttcatccagcggcagctcgtggagacccgccagatcacgaagcacgtcgcccggatcctggacgagcgcttcaacaacgagctggactccaagggccggcggatccggaaggttaagattgtgaccctcaagagcaatctggtctccaacttccgcaaggagttcggtttttacaaaatccgggaggtgaataactaccaccacgcgcacgacgcgtacctgaatgccgtggtcgccaaggccatcctcacaaagtacccccagctggagcccgagttcgtgtacggggactaccccaagtacaatagctacaagacgcgcaagagcgcgacggaaaagctgttcttctactccaacatcatgaacttcttcaagacaaaggttactctcgccgacggaacggtcgtggttaaggacgacatcgaggtcaacaacgacaccggcgagatcgtttgggacaagaagaagcactttgcaaccgtgaggaaggttctgagctatccccagaacaacatcgttaagaagaccgaaatccagaccgggggattctccaaggagagcatactcgcccacgggaactccgacaagctcataccccgcaagaccaaggacatctacctggacccgaagaagtacggcgggttcgacagccccatcgtggcctacagcgtcctagtggtggctgacatcaaaaagggcaaggcccaaaaactcaagacggtcaccgagttgctgggcatcacgatcatggagcggagccgctttgagaagaatccctccgcattcctcgagagcaaggggtacctgaacatccgggacgacaagctgatgatcctccccaagtactccctgttcgagctggagaacggccggcgccggctcctagccagcgccggggagttacagaagggtaacgagctcgcattaccgacccagttcatgaaattcttatacctcgcctcccgctacaacgagagcaaagggaagcccgaggagatagagaaaaagcaggagttcgtgaaccagcacgtgtcctacttcgacgacatcctgcagctgatcaacgacttcagcaagcgggtcattcttgccgacgccaacttagagaagatcaacaagctgtaccaagacaataaggaaaacatctccgtggacgagctcgccaataacattatcaacttgttcaccttcaccagcctgggggcgcccgccgcctttaagttcttcgacaagatcgtggaccgcaagcgctatacgtccaccaaggaggtcctcaacagcaccctaatccaccagagcatcaccggactgtacgagacgaggatcgacctagggaagctgggtgaggactga

SEQ ID NO: 7773 - RNA, 4113 nt, synthetic construct
  misc_feature 1..4113: note = Cas9 variant
  source 1..4113: mol_type = other RNA
atgaacaagccctatagcatcggcctggacatcgggaccaactccgtgggctggagcatcatcaccgacgactacaaggtcccggccaagaagatgcgcgtgctagggaacacggacaaggagtacatcaagaagaacctgatcggcgccctcctcttcgacgggggcaacaccgcggccgaccggcgcctgaagcggaccgcccgccgtcgctacacccggcgccggaaccgcatcctgtacctccaggagatcttcgccgaggagatgtccaaggtggacgacagcttcttccaccggctagaggactccttcctggtcgaggaggacaagcgcggcagcaaataccccatcttcgccacgatgcaggaagagaagtactaccacgagaagttccccaccatttaccacctccggaaggaactggcggacaagaaggagaaggctgacctgcgcctcatatacctggccctggcccacatcatcaagttccgggggcacttcctcatcgaggacgaccgcttcgacgtgcggaacaccgacattcagaagcagtaccaggcgttcctggagatcttcgacaccacattcgagaacaacgacctgctctcccaaaacgtggacgtcgaggccatcctgaccgacaagatcagcaagtccgccaagaaggaccgcatcctggcccggtacccgaaccagaagtccaccggcatcttcgccgagttcctcaagctgatcgtggggaaccaggcggacttcaagaagcacttcaacctggaggacaagaccccgctccagttcgccaaggacagctacgacgaagacctggagaacctgctcggccagatcggggacgagttcgccgacctgttcagcgccgccaagaagctgtacgactccgtgctcctgagcggcatcctgacggtcaccgacctatccaccaaggcgcccctgagcgcctccatgatccagcgctacgacgagcaccgggaggacctgaagcagctcaagcagttcgtgaaggccagcctgcccgagaagtaccaggagatcttcgccgactccagcaaggacggctacgccgggtacatcgaagggaagaccaaccaggaggcgttctacaagtacctgagcaagctcctgacgaagcaggaggggtccgagtacctgctcgagaagatcaagaacgaggacttcctgcgcaagcagcgcaccttcgacaacggcagcatcccccaccaggtgcacctgaccgagctccgggccatcatacgccggcagtccgagtactacccactgctgaaggagaacctcgaccgcattgagaagatcctgaccttccggatcccctactacgtcggccccctggcccgagagaagtccgacttcgcctggatgacgcgtaagaccgacgacagcatccgcccctggaacttcgaggacctggtggacaaggagaagtccgccgaggcgttcatccaccggatgaccaacaacgacctctacctgccggaggagaaggtgctgcccaagcacagcctcatctacgagaagttcaccgtctacaacgagctcacgaaggtgcgcttcctggccgaggggttcaaggacttccagttcctcaaccggaagcagaaggagaccatcttcaacagccttttcaaggagaagcgcaaggtgaccgaaaaggacatcatctccttcctgaacaaggtcgacggctacgagggaatcgccatcaagggcatcgagaagcaattcaacgccagcctctccacctaccacgacctgaaaaagatcctagggaaggacttcctcgacaacacggacaacgagctgatcctggaggacattgtgcagaccctcaccctgttcgaggaccgggagatgatccgcaagcggctggacatctataaggactttttcaccgagagccagctcaagaagctgtatcgccgccactacacgggttggggccgcctttccgcgaagctcatcaacgggatccggaacaaggagaaccagaaaaccatcctggactatctgatcgacgacggcagcgccaaccgcaacttcatgcagctcatcaaggacgccgggctgtccttcaagcccatcatcgacaaggcccgcaccggcagccattccgacaacctgaaggaggtggtcggggagctcgccggcagccccgcgatcaagaagggcatcctgcagtccctgaagatcgtagacgagctcgtgaaggtcatggggtacgagccggagcaaatcgtggtcgagatggcccgggagaaccagaccacggctaagggcctgagccgcagccgccagcgcctcaccacactccgggagtccctggccaacctcaagagcaatatattagaagagaagaagcccaagtacgtgaaggaccaggtggagaaccaccacctgtccgacgaccgcctgttcctctactacctgcagaacgggaaggacatgtacaccgacgacgagctggacatcgacaacctcagccaatacgacatcgaccacatcatcccccaggccttcatcaaggacgactctatcgacaaccgggtcttagtgagctccgctaagaaccgcggcaagagcgacgacgtgccctccgtcgaaatcgtgaaggactgcaaggtcttctggaagaagctgctcgacgccaagctgatgagccagcggaagtacgacaacctgaccaaggccgagcgcgggggactcacgtccgatgacaaagcccggttcatccagcgccagctggtcgagacccggcagatcaccaagcacgtggcccgcatcctggacgagcggttcaacaacgagctcgacagcaagggtcgccggatccgcaaggtgaagatcgtcaccctgaagtccaacctggtgagcaactttcggaaggagttcgggttctacaagatccgcgaggtgaacaactaccaccacgcgcacgacgcctacctcaacgccgttgtggccaaggcgatcctgacgaagtacccgcaactggagcccgagttcgtatacggcgactaccccaagtacaactcctacaagacccgcaagagcgcaacggagaagctgttcttctactccaacatcatgaacttcttcaagaccaaggtcacgctggccgacgggaccgtggtggtcaaggacgacatcgaggtgaacaacgacaccggcgagattgtgtgggacaagaagaagcacttcgccaccgtccggaaagtgctgagctacccccaggtgaacatagtcaagaagacggagatccagaccggcgggttcagcaaggagtccatactcgcccacggcaacagcgacaagctgatcccgcgcaaaaccaaggacatctacctggaccccaagaagtacgggggcttcgactcccccatcgtggcgtacagcgtgctcgtcgtcgccgacatcaagaaggggaaggcccagaagctgaagaccgtgacggaactgctcggcatcaccatcatggagcggtcccgctttgagaagaaccccagcgccttcctggagtccaagggctacctggacatccgtgatgacaagctcatgatcctgccgaagtacagcctgttcgagctcgagaacgggcgccggcgcctgctggcctccgcgggcgagctccagaaggggaacgagctggccctgcccacccagttcatgaagttcctctacctggccagccggtacaacgagctgaagggcaagcccgaggagatcgagcagaagcaggagttcgtcgtgcagcacgtgtcctacttcgacgacatcctccagatcatcaacgacttcagcaaccgcgtcatcctggccgacgccaacctggagaagatcaacaagctctaccaggacaacaaagagaacattccggtcgacgagctggcgaacaacatcatcaacctgttcaccttcacgtccctcggggcccccgccgccttcaagttcttcgacaagatcgttgaccggaagcgctacacctcaaccaaggaggtcctgaactccaccctgatccaccagagcatcacgggcctctacgagacccggatcgacctgggcaagctgggggaggactga

SEQ ID NO: 7774 - RNA, 4113 nt, synthetic construct
  misc_feature 1..4113: note = Cas9 variant
  source 1..4113: mol_type = other RNA
atgaagaagccctacagcatcggcctggacatcgggaccaactccgtgggctgggccgtcgtgaccgacgactacaaggtgccggccaagaagatgcgcgtcttcggggacactgaccggagccacatcaagaagaacctcctgggcaccctcctcttcgacgacggcaacaccgcggagtcccgccggttgaagcgcaccgcccggcgccggtacacgcgccggcgcaaccgaatcctgtacctccaggagatcttcaccgagagcatgaacgagatcgacgagtccttcttccaccgcctggacgacagcttcctggtgcccgaggacaagcgggggtccaagtaccccatttttgccaccctccaggaagagaaggagtaccacaagcagtttcccaccatctaccacctccgcaagcagctggccgacagcaaggagaagtccgacgtgcggctcatctacctggccctggcgcacatgatcaagtaccgcggccacttcctgtacgaggagacgttcgacatcaaaaacaacgacatccagaagatcttcaacgagttcatcaacatctacgacaacactttcgaggggagctccctgagcggccagaacgcccaggtcgaggccatcttcaccgacaagatctccaagtcagccaagcgggagcgcgtgctgaagctgttcccggacgagaagtccaccgggctgttcagcgagttcctgaagctgattgtgggcaaccaggcggacttcaagaagcactttgatctggaggagaaggcaccgctgcagttctccaaggacacgtacgacgaggagctcgagaacctgctggggcagatcggcgacgacttcgccgacctcttcctgatcgcaaagaagctgtacgatgccatcctcctgagcggcatcctgaccgtcaccgatccctccaccaaggcgcccctcagcgcctctatgatcgagcggtacgagaaccaccagaaggacctggccgccctgaagcagttcatcaagaacaacctcccggagaagtacgtggaggtgttctcagaccagagcaaggacgggtacgccggctacatcgacgggaagacgacccaggaggcgttctacaagtacatcaagaacctgctgtccaagttcgagggcgccgactacttcctcgacaagatcgagcgcgaggacttcctgcggaagcagcgcaccttcgacaacggcagcatcccccaccagatccacctccaggagatgaacgccatcctgcgccggcagggggagcactaccccttcttgaaggagaaccgcgagaagatcgagaagatcctgaccttccggatcccctactacgtcggcccgctcgcccgcgacaacagagacttctcctggctgacgcgcaacagcgacgagcccatccggccctggaacttcgaggaagtggtggacaaggcccgctccgcggaggacttcatccaccggatgaccaactatgacctgtacctccccgaggagaaggtcctgccgaagcatagcctgctgtacgagaccttcgccgtgtacaacgagctcaccaaggtgaaattcatcgcggaggggctgcgcgactaccagttcctggactccggccagaagaagcagatcgtcaaccagctgttcaaggagaagcggaaggtgacggagaaggacatcattcactacctgcacaacgtggacgggtatgacggcatcgagctgaagggcatcgaaaagcagttcaacgccaacctcagcacctaccacgacctgctgaagatcaccaaggacaaggagttcatggacgaccccaagaacgaggagatcctcgagaacatcgtccataccctgacaatattcgaggacagagagatgatcaagcagcggctggcccagtacgacaccctcttcgacgaaaaggtgattaaggcgctgacccgccggcactacaccgggtggggcaagctgtccgccaagctcatcaacgggatccgcgacaagcagagcggcaaaacgatcctggactacctgatcgacgacgacaagatcaaccggaacttcatgcagctcatcaacgacgacgggctgtccttcaaggagatcatccagaaggcccaggtggtcggcaagaccgacgacgtgaagcaggtcgtgcaggagctccccggcagccccgccatcaagaaggggatcctccagtccatcaagatcgtggacgaactggtcaaggtgatgggctacgcgctggagagcatagtgatcgagatggcccgcgagaaccagaccaccgcccgggggaagaagaactcccagcagcgctacaaacgcatcgaggacgccctcaagaacctggccccgggcctggacagcaacatcctcaaggagaatcccacggacaacatccagttaaagaacgaccggctgttcctctactacctgcagaacgggaaggacatgtacaccggcaagcccctggacatcaaccagctctccagctacgacatcgaccacatcatcccccaggcgttcatcaaggacgacagcatcgacaaccgcgtcctgacctccagcaaggacaaccggggcaagtccgacaacgtgccgagcctggaggtagtccagaagcgcaaggccttttggcagcagctgctggattccaagctgatcagcgagcggaagttcaacaacctcaccaaggccgagcgcgggggcctggatgagcgggacaaggtggggttcatccgccggcagctggtggagacccagcagatcacgaagaacgtcgcccagatcctcgacgcccgcttcaacaccgaggtgaaggagaagaaccagaagatccggaccgtgaagatcatcaccctgaagtccaacctggtcagcaacttccgcaaggagttcggcctctacaaggtgcgggagatcaacaactaccaccacgcgcacgacgcctacctgaacgctgtggtcgccaaggccatcctgaagaaataccccaagctcgagcccgagttcgtctacggcgactaccagaagtacgacctgaagaagtacatctcccgcttcaagcccagcaaggagatcgagaaggccacggagaagtacttcttctactccaacctgctcaacttcttcaaggaggaggttctctacgccgacggaaccatccggaagcgcgagaacatcgagtacagcaaggacacgggcgagatcgcctgggacaaggagaaggacttcgccaccatcaagaaggtcctgtcctacccccaggtgaacatcgtgaagaagcgggaggtccagaccgggggcttcagcaaggagtcaatcctccccaaggggaacagcgacaagctgatcccccgcaagacgaaggacatcctgtgggacaccaccaagtacggcggctttgactccccggtgatcgcgtacagcatcctcctgatcgccgacatcgagaaggggaaggccaagaagctgaagacggtgaagaccctcgtcggcatcaccatcatggagaaggccgccttcgaggagaaccccatcaccttcctggagaacaaggggtaccacaacgtgcggaaggagaacatcctgtgcctccccaagtacagcctgttcgagctggagaacggcagacggcgcctcctggcgtccgccaaggagctgcagaaggggaacgagatcgtcctccccgtctgcctgacgaccctgttgtaccacagcaagaacctgcacaagctggacgagcccgagcacctcgagtacatccagaagcaccgcaacgagttcaaggacctgctgaacctcgtgtccgagttcagccagaagtacatcctggccgaggccaacctggagaagatcaaggacctctacgctgacaatgagcaggcggacatcgagatcctggccaactccttcatcaacctcctcacgttcaccgccctgggcgcccccgccgcgttcaagttcttcggcaaggacgtggaccggaagcgctacacgaccgtcagcgaaatcttaaacgccaccctcatccaccagagcatcacggggctgtacgagacgcggatcgacctgagcaagctcggcgaggagtga

SEQ ID NO: 7775 - RNA, 4113 nt, synthetic construct; identical to SEQ ID NO: 1975
  misc_feature 1..4113: note = Cas9 variant
  source 1..4113: mol_type = other RNA

SEQ ID NO: 7776 - RNA, 4113 nt, synthetic construct
  misc_feature 1..4113: note = Cas9 variant
  source 1..4113: mol_type = other RNA
atgaataagccctacagcatcggcctggacattggtacgaactccgtgggctggagcatcataaccgatgattacaaggtaccggccaagaagatgcgtgtgctcgggaacacagataaggagtacatcaagaagaatctgataggggcactcctgttcgatggaggaaacaccgctgctgaccgacgcctgaagcggaccgccagacggaggtacacccggcgccggaaccgcatcctgtacctgcaggagattttcgccgaggagatgagcaaggtggacgacagcttcttccacaggctggaggattccttcttagtcgaggaggacaagcgtggctccaagtatcccatcttcgccacgatgcaagaggagaagtactaccacgagaagtttcccaccatctaccatctccggaaggaactggcggacaagaaggagaaagccgacctgcgcctgatctacctggccctggcccacattatcaagttccgggggcactttctcatagaggacgaccgctttgacgtccggaacaccgacatccagaagcagtatcaggcattcctggagatcttcgacaccactttcgagaacaacgatctcctgtcccagaacgtcgacgtcgaagccatcctgaccgacaagattagcaagtccgccaagaaggaccgcatcttggcccggtacccgaaccagaaatccactggcatcttcgccgagttcctcaagctgatagtggggaatcaagcggacttcaagaagcacttcaacctggaggacaagactccgctgcagttcgccaaggacagctacgacgaagacctggaaaatctactcggccagatcggtgacgagttcgccgacctgttcagcgccgccaagaaactgtacgactccgtgctcttgagcggcatcctgacggtcaccgacttgtccaccaaggcgcccctttctgccagcatgatccagcgctacgatgagcatcgggaagacctgaagcagctcaagcagttcgtgaaggcaagccttcccgaaaagtaccaggagatattcgccgactccagcaaggacggctacgccgggtacatagagggcaagaccaaccaggaggcattctataagtacctgagcaagctcctgacgaagcaggaggggtccgagtacctgctcgaaaagatcaaaaatgaagacttcctgcgcaagcagcgcaccttcgacaacgggagtatcccccaccaggtgcatctaaccgagctccgggccatcattcgccgccagtccgaatactacccgtttctgaaggagaacttagaccgcatcgagaagatcctcactttccggatcccctattacgtcggccccctggcacgcgaaaagtcagacttcgcctggatgacgcggaagaccgacgacagcattcgcccctggaacttcgaagacctggtggacaaggagaagtccgccgaggcgttcatccaccggatgaccaacaacgacttatatctcccagaggagaaggttctccccaaacactctctgatctacgagaagtttaccgtctacaacgagttgactaaggtcaggttcctggccgaggggttcaaagatttccagtttctgaacaggaagcaaaaggagaccatcttcaatagcctgttcaaggagaagcgcaaggtgaccgagaaggacatcatttccttcctgaataaagtcgacggctacgaggggatcgccatcaagggcattgagaaacagttcaacgcctccctgtccacttaccacgacctcaagaagatcctgggcaaggactttctggacaatacggataacgagctcattctggaagacatcgtgcagaccctgacactcttcgaggaccgggagatgatccgcaagcggctggacatctacaaggatttcttcaccgagagccagctgaagaaactctatcgccggcactacacgggctggggccggctatctgcgaagctgatcaacgggatccggaacaaggagaaccagaagacaatcttggactaccttatcgacgacggaagcgccaaccgcaactttatgcagctgatcaaagacgccggcctctccttcaagcccatcatagacaaggcccggaccggcagccactccgacaatctgaaggaggtggtgggtgagctggccggcagccccgcgatcaagaagggcatattacagtccctaaagatcgtggacgagctggtgaaggtaatggggtacgagccggagcagatcgtggtcgaaatggcccgggagaaccaaaccaccgccaagggcctcagccgcttgcggcaacgcttgactaccctcagggagagcctggccaacctgaagtccaacatactcgaggagaagaagcccaagtacgtgaaggaccaagtggagaaccaccacttaagcgacgaccgcctgttcctctattacctgcagaacgggaaggacatgtacaccgacgacgagctggacatcgacaaccttagccagtacgacatcgaccacatcatcccccaagccttcataaaggacgacagcatcgacaatcgggtactggtgtctagtgctaagaatcgcggcaagtccgacgatgttcccagcgtcgagattgttaaggactgcaaggtcttctggaagaagctgctcgacgccaaactgatgtcccagagaaagtatgacaacctgaccaaggccgaacgagggggcctcacgagcgacgacaaggcccggttcatccagcgccagctggtcgagacccggcagatcaccaagcacgtagcccgcatcctggacgagcggtttaacaacgaactcgactcaaaaggccgcagaatccgcaaagttaaaatcgtcaccctcaagtcgaacctggtgtccaacttccggaaggagttcggattctacaagatccgcgaggtgaacaactaccaccacgcgcatgacgcctaccttaacgccgtcgtggccaaggcgatactgacgaagtacccgcagctggagcctgagtttgtttatggcgactaccccaagtacaacagctacaagacaagaaagtccgccacagagaaactgttcttctacagcaacatcatgaacttcttcaagaccaaggtcacgctggccgacgggaccgtcgtggtcaaggacgacatcgaggttaacaacgacaccggcgagatcgtgtgggacaagaagaagcacttcgcaaccgtccgcaaagtgctgtcctacccacaggtgaacatcgtcaagaagacggagatacagaccggcgggtttagcaaagagagcatcctcgcccacggcaattccgacaagctgatcccgcgcaagaccaaggacatctacctcgaccccaagaaatatgggggcttcgacagccccatcgttgcctactccgtgctcgtcgttgccgacatcaaaaagggaaaggcccagaagctgaagaccgtgacggagctcctcggcataactatcatggaacggtcccgcttcgagaaaaacccctccgccttcctggagagcaagggctacctgaacatccgtgatgacaaactcatgatcttaccgaagtactccctgttcgagctcgagaacggccgccgacgactgctcgccagcgcggacgagctccagaagggtaacgaactcgccttaccgacccaattcatgaagtttctctacctggcctcccgttacaacgagctgaaggggaagcccgaggaaatcgagcagaagcaagagttcgtggtgcagcacgtgagctacttcgacgatatactccagataatcaacgatttctccaaccgcgtgatcctggcagacgccaacctggagaagatcaacaagctctaccaggacaacaaggaaaacatcccggtggacgagttggctaacaacatcatcaacctgttcacgttcacgtcactcggcgcccccgccgccttcaagttcttcgacaagatagtggaccggaagcgctacacctccaccaaggaagtacttaacagcaccctgatccatcagtccatcacggggctctacgagactcggatcgacctaggcaagttgggtgaggactga

SEQ ID NO: 7777 - RNA, 4113 nt, synthetic construct
  misc_feature 1..4113: note = Cas9 variant
  source 1..4113: mol_type = other RNA
atggagaagaacaaggaatatgtgatcggcctggacatcggtactggcagcgttggatggtccgccatcagcacggataactaccagctgatacgccagaagggaaagaacctgatcggggtgcggctgttcaactccgccgagacggcggaagaacggcggggctaccgcaccacccggcgccggctcagccgccggcgctggcggatgagtctgctgaacgacatcttccgcccagagctcaacgagatcgatgagaacttcctggcccggctcaagtacagctgggtgtccccgctcgaccagaagaacccccagctgaacgagcagggcaccaacgccagcctctacggggacatcgaggccgatcaagccttccaccgcgcgtacccgacgatctaccacctccggaagaccctgatggaggacaaccagaagcacgacctgcgcgaggtctacctcgccatacaccacatcgtgaagtatcggggccacttcctgacccccgactttgacgccaactcccaaaccatcgacatcaagggtctgttcaagcagctcggcgacgtgagcgggtccatcgagctgcaggccgaccagacgagcaccgtcatcgcggctttccagtccatcctgttggacttcaccaagaccccgacagagagcgggcgcctggccggccaactgttctccgatcagaacaaggacaagcaggccaagaaacaggtcgaggagctgttcaagctcctgcgtggtggcaagggcagcctcgccgacatgttcctgctgaccgacctcgacaaggtggtgaagaaccagctgaagttcgcgttcgacgacgccgtagacgagaacctgaacttgatctccaacctgattaatgaggaacagtacgagctgctcctgaacatccagaaacttcggggcaccatcatcctcaaacagatcctgggtgacgatgagaccgtgagcgacgccaaggtccgatcctacgaggagcacgcccaccagctgaaggagctcaaggcccaagtgctgacgaaggacaacaaagagaagttcgaagaagcctaccagctgatccaaaagggagacgccagcaggatcgacggtctcaaaaagctgaaaaccataataaaccaggaacacgaggcgctgcgcctcgacaagtacgaggcggataagctgctgaagctgatcgagctcgaccagctgctgcccgtgcagcgcagcaagcgcaacggggagatcccccaccagttgcacgagttcgagctgaagaagatcatcgagaagcagggccggtactaccccttcctgcgcgagaccttcgaacgggacgggcaggagttcaacaagatcggccagcttgtcaacttccgcatcccgtactacgtgggccccctggttgacccccggctggccggtatccagtcaggcgaccaaaccaaccactggatgacgcaaaagaaggcagggaagattaccccctggaattacaccgagctcatcgacatcgacaagagcgccgccgagttcatcaagcgcatgaccgggacggacacctacctagtcggggagccgtctcttcacaaggccagcctcatctaccaggactacaacgtgctgcaggagctgaacaatctgcggtacgatgggaagcccttgccagtggacgccaagcaggagatctactccaacctgcaggtcagcctcaaaaacgcgaccaagaataagataaacagtttcctaatcagcgagggctacctgcaggacggggaggagctcaccggcttcgctgggaaggagctgaaaaacaagctgagctcgttccactatttcaagaacatctttggccccgaacgcatgaacacgctcgggacggataacctggagaaaataaccgagctgcagaccgtgttcgaggaccggcacatgctcaagaggcagctgcagaaactaggcttcctggatgacgacgagtgcgagaaactggcaggcaaacacttcacgggttggggcaatctgtccaagaagctcctgaacaccccggccatcatcgaccccgagatcaacgagaacaagatcagcctgatcgacgcgctctataaggggcagcggaacctgtccttctacgtgaacaatatggacgacaagtatcagttccgcgactggatcgagagcgagaaccagtcccaacaggtcgagattagcctagacgagaagatcaagaatctcgcaggctcccccgccatcaagcggggcatcacccagtccatggccgtgatccaggacatcatccgcgccaacaacgggatttcccccaagcggatctacctggagttcgcgcgcgagagccagaacagctaccagccgaactcccgcatcaagcagatcgagaagatctacgaccagaacaagaaggagctgatgaaggtctaccctgacgtgttcaaggacgtgcagggcgtcctgaacaacgtggacgagaacaacagcctgtcagagaaggccttcctttatttcatgcaactcgggaaggacatgtacaccggcgaggctttggatttcgacaaactttacacgtacgacatcgaccacatcataccccaggccatgaccaaggacaacagctgggacaacaaggtgctcgtcaccgccatcaagaaccgcgagaagtccaaccaggtgctagataacgctatccaggccaagatgcacaacttctggctacagctcaagaaggtgaatctgctgtcccagagaaagtacgacaccctcatgaaaaccaatttctccaagggagacgagaagaagttcatagccagatcgctggtcgagacacgccagataatcaagaacgttgccgagctgatcaagtccgagttcgaccacgtggaggcgattccgatccgccaggagctaacgtcggacatgagacagctgatggactacaagaagaaccgcctggtcaacgactaccatcacgcgcatgacgccctcctgatagccacagtgggagagtttatgcagaagcgcggtttcatgcaggggatgaacccgtcccagaacgtataccacggctacacacaatacgtcaagaagtggctttccatggccaagaaagcgagatccgccgagaagccagagcgaatcttccccctccagttcgtggtggggagcatgcgcatggccgtccgcgacggccaggtggacaaagtgacgcaccctgcaaccggggaaatctgctggacagctgacaacgaggcgtacctacgaaaggtcctgggctacaagaacatcctcgtgacgcgcaaggtgaagaacgctggcaagctgtaccagagagtaacagtgaagccgaaggggtccggcgaggccccggtgaaccaccaaaagtccgacataaacatctacgggggcgtgacctccgagcaggccgcggagctggtgctcatccgcatcaaggcgaagaataacgccaagaacatggtgatcaagatccccaccgccatagccaatcaggttgccaacaagaccacgacctacgacgcgtacgtccggagtctgaacatcccgaattacgccggaataatcctggatcagatccctctcggacagctggtgttcgacgagagaaccagcttctacctggcctccgccgagattaagcacaacgcgcggcagctctgggtcaaccagcacatcaataacgtgctgaccaagaagaacatcaacgacgaggagcgtgacaatatcctgaacctcttaacgaatgagaagaacctggagcggttcaagctgctggagcccgacttgaagcgcgtgaaggcggccaagcagcagtgggccagttgcgacgaccaggagcagatgcagatcctccggatcatcatcaacaagatgcacgacgatgccagtccccagatcccgggaaagatcgaccccttcaagaactacctggacaagcaggggaagggctggcgcgacctgcgcaccaagaagggaatgaagctctccgataacgcggagttcgtctaccagtcaccgacaggcctgtaccaccggaagatcagcatcaacgagctgctcaagcagaagcagctggagtga

SEQ ID NO: 7778 - RNA, 4113 nt, synthetic construct
  misc_feature 1..4113: note = Cas9 variant
  source 1..4113: mol_type = other RNA
atgaacaagccctacagcatcggcctggacatcgggaccaactccgtgggctggagcatcatcaccgacgactacaaggtcccggccaagaagatgcgcgtgctcgggaatacggacaaggagtacatcaaaaagaacctgatcggcgccctgctgttcgacgggggcaacaccgcggccgaccggcgcctgaaacggaccgcccgccggcgctacacccggcgccggaaccgcatcctgtacttacaggagatcttcgccgaggagatgtctaaggtggacgacagcttcttccacagactggaggactccttcctggtcgaggaggacaagcgcggcagcaagtaccccatcttcgctacgatgcaggaggagaagtactaccacgagaagttccccaccatttaccacctccggaaggagctcgcggacaagaaagagaaggcggacctgcgcttgatctacctggccctggcccacataatcaagttccgggggcacttcctcatcgaggacgatcgcttcgacgtgcggaacaccgacatccagaagcagtaccaggcattcctggagatcttcgacaccacgttcgagaacaacgacctgctctcgcagaatgtggacgtcgaggccatcctgaccgacaagatctctaagtccgccaagaaagaccgcatcctggcccggtaccccaaccagaagtccaccggcattttcgccgagttcctcaagctcatcgtggggaaccaggcggacttcaaaaagcacttcaacctggaggacaagaccccgctccagttcgccaaggacagctacgacgaggacctggaaaacctgctcggccagatcggggacgagttcgccgacctgttcagcgccgccaagaagctgtacgactccgtcctcctgtctggcatattaacggtcaccgacctctccaccaaggcgcccctgagcgcctccatgatccagcgctacgacgagcaccgggaggacctgaagcagctcaaacagttcgtgaaggccagcctgcccgagaagtaccaggagatcttcgccgactccagcaaggacggctacgccgggtacatcgagggcaagaccaaccaggaggcgttctacaagtacctgagcaagctcctgacgaagcaggaggggtccgagtacctgctcgagaagatcaagaacgaggacttcctgcgcaagcagcgcaccttcgacaacggctccatcccccaccaggtgcacttgaccgagctccgtgccatcatccgccggcagtccgagtactacccgttcctgaaggaaaacctggaccgcatcgagaagatcctcaccttccggatcccctactacgtcggccccctggcccgcgagaagtccgacttcgcctggatgacgcggaagaccgacgacagcatccgcccctggaacttcgaggacctggtggacaaggagaaatccgccgaggcgttcatccaccggatgaccaacaacgacctgtacctcccggaggagaaggtgctgcccaagcacagcctgatatacgagaagttcaccgtctacaacgagctcacgaaggtgcgattcctggccgaggggttcaaggactttcagttcctgaaccggaagcagaaggagaccatcttcaacagcctcttcaaggagaagcgcaaggtgaccgagaaggacattatctccttcttgaataaggtcgacggctacgaggggatcgccatcaagggcatagagaagcagttcaacgccagcttgtccacgtatcacgacctcaagaagatcctggggaaggacttcctggacaacacggacaacgagctcatcctggaggacatcgtgcagaccctgaccctcttcgaggaccgggagatgatccgcaagcggctggacatctacaaggacttcttcaccgagagccagctgaagaagctctaccgccggcactacacgggctggggccgcctgtccgcgaaactgataaacgggatccggaacaaggagaaccagaagaccatcctcgactacctgatcgacgacggcagcgccaaccgcaacttcatgcagctgatcaaggacgccgggctctccttcaagcccatcatcgacaaggcccgcaccggcagccacctggacaacctgaaggaggtggtcggggagctcgcaggctcccccgcgatcaagaagggcatcctgcagagcctgaagatcgtggacgagctcgtgaaggtcatggggtacgagccggagcagatcgtggtcgagatggcccgggagaaccagaccacggccaaaggcctgtcccgctcccggcagcgcctgaccaccctccgggagagcctggccaacttgaagtccaacatcctcgaggagaagaagcccaagtacgtgaaggaccaggtggagaaccaccacctgagcgacgaccgcctgttcctctactacctgcagaacgggaaggacatgtacaccgacgacgagcttgacatcgacaacctctcccagtacgacatcgaccacatcatcccccaggccttcatcaaggacgacagcatcgacaaccgggttctggtgtccagcgcgaagaaccgcggcaagtccgacgacgtgcccagcctggagatcgtcaaggactgcaaggtgttctggaagaagttactggacgccaagctgatgtcccagcggaagtacgacaacctcaccaaggccgagcgcgggggcctgacgagcgacgacaaggcccggttcatccagcgccagctggtggagacccggcagatcaccaagcacgtcgcccgcatcctcgacgagcggttcaacaacgagctggattcgaagggccgcagaatccgcaaggtgaagatcgtgaccctcaagagcaacctcgtctccaacttccggaaggagttcgggttctacaagatacgcgaggtgaacaactaccaccacgcgcacgacgcctacctgaacgccgtggtcgccaaggcgatcctgacgaagtacccgcagctcgagcccgagttcgtgtacggcgactaccccaagtacaacagctacaagacccgcaagtccgccaccgagaagctgttcttctacagcaacatcatgaacttcttcaagaccaaggtgacgctggccgacgggaccgtcgtggtgaaggacgacatcgaggtaaacaacgacaccggcgagatagtgtgggacaaaaagaagcacttcgccaccgtgcgcaaggtcctctcctacccccaggtgaacatcgtgaagaagacggaggtccagaccggcgggttcagtaaggagagcatcctggcccacggcaactccgacaagctcatcccgcgcaagaccaaggacatctacctcgaccccaagaagtacgggggcttcgacagccccatcgtggcgtactccgtgctggtggtggccgacatcaagaaggggaaggcccagaaactgaagaccgtgacggagctcctgggcatcaccatcatggagcggagccggttcgagaagaacccctccgccttcctggagagcaagggctacctaaacatccggaccgacaagctgatcatcctgccgaagtattccctctttgagctggagaacgggcgacgacgcctgctcgccagcgcgggcgagctccagaaggggaacgagctggcccttccaacccagtacatgaagttcctgtacctggcctcccggtacaatgagctcaagggaaagcccgaggagatcgagcagaagcaggagttcgtcgtgcagcacgtgagctacttcgacgacatcctgcagatcatcaacgacttctccaaccgcgtcatcctagccgacgccaacctcgagaagatcaacaagctgtatcaggacaacaaggagaacatcccggtggacgagctggcgaacaacatcatcaacctcttcacgttcaccagcctgggggcccccgccgccttcaagttcttcgacaagatcgtggaccggaagcgctacacctcgaccaaggaggttctgaacagcacgctcatccaccagtccatcactggcctgtacgagacacggatcgacttgggcaagctcggggagggctga

SEQ ID NO: 7779 - RNA, 4113 nt, synthetic construct
  misc_feature 1..4113: note = Cas9 variant
  source 1..4113: mol_type = other RNA
atgaacaagccctacagcatcggcctggacatcgggaccaactccgtgggctggagcatcatcaccgacgactacaaggtaccggccaagaagatgcgcgtgctcgggaacacggacaaggagtacatcaagaagaacctgatcggcgccctgctgttcgacgggggcaacaccgcggccgaccggcgcctgaagcggaccgcccgccggcgctacacccggcgccggaaccgcatcctgtacctccaggagatctttgccgaggagatgtccaaggtggacgacagcttcttccaccggctggaggactccttcctggtcgaggaggacaagcgcggcagcaagtaccccatcttcgccacgctccaggaggagaaggactaccacgagaagttctccaccatctaccacctccggaaggagctggcggacaagaaggagaaggccgacctccgcctgatctacatcgccctggcccacatcatcaagttccgggggcacttcctcatcgaggacgacagctttgacgtacgcaacaccgacatctccaagcagtaccaagacttccttgagatcttcaataccacgttcgagaacaacgatctgctctcgcagaacgtcgacgtagaggcgatcctgaccgacaagatctccaagagcgccaagaaggaccggatcctggcccagtaccccaaccagaagtccaccggcatcttcgccgagttcctcaagctgatagtggggaaccaggccgacttcaagaagtacttcaacctggaggacaagacgcccctacagttcgccaaggatagctacgacgaggacctggagaacctgctcggccagatcggggacgagttcgccgacctgttctccgccgccaagaagctgtacgacagcgtgctcctttccggcatcctgacggtcatcgacctcagcaccaaggccccgctctccgcgagcatgatccagcgttacgacgagcaccgggaggacctgaagcagctcaagcagttcgtgaaggccagcctgcccgagaagtaccaggagatcttcgccgactccagcaaggacggctacgccgggtacatcgagggcaagacaaaccaggaggccttctacaagtacctgtccaagctcctgaccaagcaggaggacagcgagaacttcctggagaagatcaagaatgaggacttcctccgcaagcagcggactttcgacaacgggtccatcccccaccaggtgcacctgaccgaattgaaggcgatcatccgccgccagagcgagtactacccctttctcaaggagaaccaggaccggatcgagaagatcctgaccttccgcatcccgtactacatcggccccctggctcgggagaagtccgacttcgcctggatgacccgcaagactgacgacagcatacggccctggaacttcgaggacctcgtcgacaaggaaaagtccgccgaggccttcatccaccgcatgacgaacaacgatttttatctgcccgaggagaaagtgctgccgaaacacagcctgatctacgagaagttcaccgtgtacaacgagcttaccaaggtccggtataagaacgagcagggcgaaacgtacttcttcgactccaatatcaagcaggagatcttcgacggggtgttcaaggagcaccgcaaggtgagcaagaagaagctgctggacttcctcgcgaaggagtacgaggagttccggatcgtcgacgtgatcggcctggacaaagagaacaaggccttcaacgcatccctggggacctaccacgacctcgagaagatcctggacaaggacttcctggacaaccccgacaacgaaagcatactcgaggacatcgtgcagaccctgaccctgttcgaggaccgcgagatgatcaagaagcggctcgagaactacaaggacctattcacggagtcccagctgaagaagctctaccgccggcactacaccggctgggggcgcctgagcgccaagctgatcaacggaatccgggacaaggagtcccagaagaccatactcgactacctgatcgacgacggccgcagcaaccggaactttatgcagctgatcaacgacgacggtctctccttcaagagcatcatcagcaaggcgcaagccggctcccacagcgacaacctgaaggaggtcgtgggggagctggccggctcccccgccatcaagaaggggattctccaaagcctgaagatcgtggacgagctggttaaagtgatgggctacgagcccgagcagatcgtcgtggagatggcccgcgagaatcagaccacgaatcagggccggcgcaacagtcgccagcggtacaagctcctggacgacggggtgaagaacctggcgagcgacctcaacggcaacatcctgaaggaatacccgaccgacaaccaggccctccagaacgagcgcctctttctgtactacctgcagaacgggcgggacatgtacaccggcgaggccctcgacatcgacgacctgtcccagtacgacatcgaccacatcatcccccaggccttcatcaaggacgacagcatcgacaaccgcgtcctggtgtccagcgccaagaacagaggcaaatccgacgacgtgccctccctcgagatcgtcaaggactgcaaggtgttctggaagaagctgctggacgcgaagctcatgtcccagcgcaaatacgacaacctgaccaaggccgagcggggcggcctgacgagcgacgacaaggcccgcttcatccagcggcagctcgtggagacccgccagatcaccaagcacgtcgcccggatcctggacgagcgcttcaacaacgagctggactccaaggggcggcgcattcggaaggtgaagatcgtgaccctcaagagtaatctggtctccaacttccgcaaggagttcggcttctacaagatcagggaggtgaacaactaccaccacgcccacgacgcgtacctgaacgccgtggtcgccaaggccatcctcaccaagtacccccagctggagccggagttcgtgtacggagactaccccaagtacaacagctacaagacgcgcaagagcgcaaccgagaagctgttcttctactccaacatcatgaacttcttcaagactaaggtgaccctcgccgacggcacggtcgtggtcaaggacgacatcgaggtcaataacgacacgggcgagatcgtgtgggacaagaagaagcacttcgccaccgtccggaaggtcctgtcctacccccagaacaacatcgtgaagaagaccgagatccagaccgggggcttcagcaaggagagcatcctggcccacgggaactccgacaagctcatcccccggaagaccaaagacatctacctggacccgaagaagtacggcgggttcgacagccccatcgtggcctactccgtcttagtggtggcggacatcaagaaaggcaaggcccagaagctcaagaccgtcaccgagctactgggcatcacgatcatggagcggagccgcttcgagaagaacccctccgccttcctcgagagcaaggggtacctgaacatccgcgccgataagctgatcatcctccccaagtactccctgttcgagctggagaacggccgacgccggcttctggcctcggcgggggaacttcagaagggcaacgagctcgccctgccgacccagttcatgaagttcctgtacctagcctcccgctataacgagagcaaggggaagcccgaggagatcgagaagaagcaggagttcgtgaaccagcacgtgtcctacttcgacgacatcctgcagctgatcaacgacttcagcaagagggtcatcctcgccgacgccaacctggagaagatcaacaagctgtaccaggacaacaaggagaacatctccgtggacgagctcgcgaacaacatcatcaacctgttcaccttcaccagtctgggcgcccccgccgccttcaagttcttcgacaagatcgtggaccgcaagcggtacacgtccaccaaggaggtcctcaacagcaccctgatccaccagagcatcaccggcctgtacgagacgcgcatcgatctcgggaagctgggcgaggactga

SEQ ID NO: 7780 - RNA, 4113 nt, synthetic construct
  misc_feature 1..4113: note = Cas9 variant
  source 1..4113: mol_type = other RNA
atgaacaagccctacagcatcggcctggacatcgggaccaactccgtgggctggagcatcatcaccgacgactacaaggtcccggccaagaagatgcgcgtgctcgggaacacggacaaggaatacatcaagaagaacctgatcggggcgctgctgttcgatgggggcaacacggctgccgaccggcgcctgaagcggaccgcccgccggcgctacacccggcgccggaaccgcatcctgtacctccaggagatcttcgccgaagagatgtccaaggtggacgacagcttcttccaccggctggaagacagtttcctggtcgaggaggacaagcgcggcagcaaataccccatcttcgccacgctccaggaggagaaggactaccacgagaagttctccaccatctaccacctccggaaagagctggcggacaagaaggagagggccgacctccggctgatctacatcgccctggcccatatcatcaagttccgcgggcacttcctcatcgaagacgacagcttcgatgtgcggaacaccgacatcagtaagcagtaccaggacttcctggagatcttcaataccacgttcgagaacaatgacctgctttctcagaatgtggatgtcgaagcgatcttgaccgacaagatctccaaaagcgccaagaaagaccgcatcctggcccagtatcccaaccagaagtccaccggcattttcgccgagttcctcaagctgatcgtgggcaaccaggccgacttcaagaaatacttcaacctggaggacaagacgcccctccaattcgctaaggatagctacgacgaggacctggagaacctgctcggccagatcggggacgagttcgccgacctgttcagtgccgccaagaagctgtacgacagcgtactcctgtccggcatcctgacggtcatcgacctcagcaccaaggcacccctatccgccagcatgatccagcggtacgacgagcaccgcgaggacctgaagcagcttaagcagttcgtgaaggccagcttgccggaaaagtaccaggagatcttcgccgactcaagcaaggacggctacgccgggtacatcgagggcaagaccaaccaggaagccttctacaagtacctgtccaagttactaaccaagcaggaggacagcgagaacttcctggagaagatcaagaacgaggacttcctccgtaagcaacgcacgttcgacaacggttccatcccgcaccaggtgcatctgaccgagctgaaggcgatcatccgccggcagagcgagtactaccccttcctgaaggagaaccaggaccgcatcgagaagatcctgaccttccggatcccgtactacatcggccccctggcccgcgagaagtccgacttcgcctggatgacccggaagacggacgacagcatccgcccctggaactttgaggacctcgtcgacaaggagaagtccgccgaagccttcatccaccggatgaccaacaacgacttctacctgcccgaggagaaggtgctgccgaagcacagcctgatctacgagaagttcaccgtgtacaacgaactcaccaaggtccgctacaagaacgagcagggcgagacgtacttcttcgactccaacatcaagcaggagatcttcgacggggtgttcaaagagcaccggaaggtgagcaagaagaagctgctggacttcctcgcgaaggagtacgaggagttccgcatcgttgacgtgatcggcctggacaaggaaaacaaggccttcaacgcctccctggggacctaccacgacctcgagaagatactggacaaggacttcctggacaaccccgacaacgaatctatcctcgaggacattgtgcagaccctgaccctgttcgaggaccgggagatgatcaagaagcgcctcgagaactacaaggacctgttcacggagtcccagcttaagaagctctaccgtcgccactacacgggctgggggcggctgtctgccaagttgatcaatggcatccgcgacaaggagtcccagaagaccatcctcgattacctgatagatgacggcaggtcaaaccgcaacttcatgcagctgatcaacgacgacgggctgagtttcaagagcatcatcagcaaggcgcaggcgggctcccacagcgacaacctgaaggaggtagtgggggagctggccggctctcccgccatcaagaaggggatcctccagtccctgaagatcgtggacgagctggtcaaggtgatgggctacgagcccgagcagatcgtcgtggagatggccagggagaaccagaccacgaaccagggccgccgcaactcccggcagcgctacaaacttctggacgacggggttaaaaacctagcgagcgacctcaacggcaacatcctgaaggaatacccgaccgacaatcaggccctgcagaacgagcgcctcttcctgtactacctgcagaacgggcgggatatgtacaccggcgaggccctcgacatcgacgacctgtcccagtacgacatcgaccacatcatcccccaggcattcatcaaggacgacagcatcgacaaccgggtcctggtgtccagcgccaagaaccgcgggaagtccgacgacgtgcccagcctcgagatagtcaaggactgcaaggtgttctggaagaagctgttggatgcgaagctcatgtctcaaagaaagtacgacaacctgaccaaggccgagcgcgggggactgacgagcgacgacaaggcccggttcatccagcgccaactcgtggagacccggcagatcaccaagcacgtcgcccgaatcttagacgagcggttcaacaacgagctggactccaaggggcgccggatccgcaaggtgaagatcgtgactctcaagtcaaacctggtctccaatttccggaaggagttcggcttctacaagatccgcgaagtaaacaactaccaccatgcacacgacgcgtacctgaacgccgtggtcgccaaggcgatcttaaccaagtacccccagctggagcctgagttcgtgtacggggactaccccaagtacaacagctacaagacgagaaagagcgcgactgagaagttgttcttctattccaatatcatgaacttctttaagaccaaggtgaccctcgcagacggtacggtcgtggtgaaggacgacatcgaggtcaacaacgacaccggcgagatcgtgtgggacaagaagaagcacttcgccacagtccggaaggtcctgagctacccccagaataacatcgtgaagaagaccgagatccagaccgggggcttctccaaggagagcatcctggcccacgggaactccgacaagctcatcccccggaagaccaaggacatctacctggacccgaagaagtacggcgggtttgacagccccatcgtggcctactccgtcctggtggtggcggacatcaagaagggcaaggcacagaaactcaagaccgtcactgaactgctgggcatcacgatcatggagcgcagccgcttcgagaagaacccctccgccttcctcgagagcaaggggtacctgaacatccgggccgacaagctgatcatcctcccaaagtactccctgttcgagctggagaacggccgccggcgcctcttggccagcgccggggagctgcagaagggcaacgagctcgcacttccgacccagttcatgaagttcctgtacctcgcctcccggtacaacgagagcaaggggaagcccgaggagatcgagaagaagcaggagttcgtgaaccagcacgtatcctacttcgacgacatcctgcagctaatcaacgacttcagcaagcgcgtcatactcgctgacgccaacctggagaagatcaacaagctgtaccaggacaacaaggagaacatctccgtggacgagctcgcgaacaacatcatcaacctgttcaccttcaccagcttaggcgcccccgccgccttcaagttcttcgacaaaatcgtggaccggaagcggtacacatccaccaaggaggtcctcaactctaccctgatccaccagagcatcaccgggctgtacgaaacgcggatcgacctcgggaaactgggggaggactga

SEQ ID NO: 7781 - RNA, 4113 nt, synthetic construct; identical to SEQ ID NO: 1981
  misc_feature 1..4113: note = Cas9 variant
  source 1..4113: mol_type = other RNA

SEQ ID NO: 7782 - RNA, 4113 nt, synthetic construct; identical to SEQ ID NO: 1982
  misc_feature 1..4113: note = Cas9 variant
  source 1..4113: mol_type = other RNA

SEQ ID NO: 7783 - RNA, 4116 nt, synthetic construct; identical to SEQ ID NO: 1983
  misc_feature 1..4116: note = Cas9 variant
  source 1..4116: mol_type = other RNA

SEQ ID NO: 7784 - RNA, 4116 nt, synthetic construct; identical to SEQ ID NO: 1984
  misc_feature 1..4116: note = Cas9 variant
  source 1..4116: mol_type = other RNA

SEQ ID NO: 7785 - RNA, 4116 nt, synthetic construct
  misc_feature 1..4116: note = Cas9 variant
  source 1..4116: mol_type = other RNA
atggacaagaagtacagcatcggcctggacatcgggaccaactccgtgggctgggccgtcatcaccgacgactacaaggtgcccagcaagaagttcaaggtgctcgggaatactgaccgccactccatcaaaaagaacctgatcggagccctgctgttcgactcaggggagaccgcggaggccacccggctgaagcgcaccgcccggcgccggtacacgcgccggaagaaccgcatccggtacctgcaggagatcttctccagtgagatgtccaaggtcgacgacagcttcttccaccgcctcgaggagtccttcctagtggaggaggacaagaagcacgagcggcacccgatcttcggcaacatcgtggacgaggtcgcctaccacgagaagtacccgaccatctaccacctccgcaagaagctcgccgacagcacggacaaggcggacctgcggctgatctacctcgccctggcccacatgatcaagttcaggggccacttcctgatcgagggggacctcaaccccgacaactccgacatggacaaacttttcattcagctggtgcagacctacaaccagctgttcgaggagaaccccataaacgccagccgggtggacgcgaaggccatcctgtccgcccgcctgagcaagtcccggcgcctcgagaacctgatcgctcagctgccgggcgagaagcggaacggcctcttcgggaacctgatcgccctgagcctcgggctgacgcccaacttcaagtccaacttcgacctggcggaggacgccaagctccagctgagcaaggacacttacgacgacgaccttgacaacctcctggcccagatcggcgaccagtacgccgacctgttcctcgccgcaaagaacctgtccgatgcaatcctgctcagcgacatcctgcgcgtcaacagcgagatcaccaaggcgcccctgtccgccagcatgatcaaacggtacgacgagcaccatcaggacctcaccctgctgaaagccctcgtccgacagcagctgcccgagaagtacaaggagatcttcttcgaccaatccaagaacgggtacgcggggtacatcgacggcggggccagccaggaggagttctacaagttcatcaagccgattctggagaagatggacgggacggaggagctcctggccaagctgaaccgcgaggacctgctccggaagcagcgcacgttcgacaacggctccatcccccatcagatccacctgggggagctgcatgccatcctcagacgccaggaggacttctaccccttcctgaaggacaaccgggagaagatcgagaagatcctgaccttccgcatcccctactacgtgggcccgctcgcccgggggaacagccgcttcgcgtggatgacccggaagtccgaggagacgataaccccctggaacttcgaggaggtcgtggacaagggcgccagcgcccaatccttcatcgagcgcatgaccaacttcgacaagaacctacccaacgagaaggtgctgcccaagcacagcctactgtacgagtacttcaccgtctacaacgaactgacgaaggtgaagtatgtgaccgagggtatgaggaagccggagttcctctccggcaagcagaaggaggccatcgtcgaccttctgttcaaaaccaaccgcaaggtgaccgtgaagcagctcaaagaggactactttaagaagatcgagtgcttcgacagcgtcgaaatctccggcgtggaggaccggttcaacgcgagcctggggacgtaccacgacctgctcaagatcatcaaggacaaggacttcctggacaatgaagagaacgaggacatcctggaggacatcgtgctcaccctgaccctgttcgaggacaaggagatgatcgaggagcgcctcaagacctacgcccacctgttcgacgacaaggtcatgaagcagctgaagcggcgccactacactggctgggggcggctctcccgcaagttgatcaacggcatccgggacaagcagagcgggaagaccatcctggacttcctcaagtccgacggcttcgccaaccgcaacttcatccagctgatccacgacgacagcctgaccttcaaggaggccatccagaaggcccaggtgtccggccaggggcacagcctccacgagcagatcgcgaatctggccggcagccccgccatcaagaaggggatcctgcagagtgttaaggtggtggacgagctcgtcaaggtgatgggccacaagcccgagaacatcgtgatcgagatggcccgcgagaaccagaccacgcagaaggggcagaagaacagccgggagcgcatgaagcggattgaggagggcatcaaggagttgggatcccagatcctaaaggagcaccccgtcgagaacacccagctccagaacgagaagctgtacctgtattacctccagaacgggcgcgacatgtacgtcgaccaggagctggacatcaaccggctgagcgactacgacgtggaccacatcgtcccgcagtccttcatcaaggacgacagcatcgacaacaaggtgctcacccgctccgacaagaaccggggcaagagcgacgacgtgccctccgaggaggtcgtgaagaagatgaagaactactggcgccagctgctgaacgccaagttgatcacccagcggaagttcgacaacctgacgaaggcggagcgcgggggcctgagcgagctcgacaaggccggcttcatcaagcggcagctggtggagacccgccagatcaccaagcacgtcgcccagatcctggactcccggatgaacaccaagtacgacgaaaacgacaagctcatacgcgaggtgaaggtgatcaccctcaagagcaagctggtctccgacttccggaaggatttccagttctacaaggtgcgcgagatcaacaattaccaccatgcccacgacgcctacctcaacgcggtggtggggacggccctgatcaagaagtaccccaagctggagagcgagttcgtatacggcgactacaaggtgtacgacgtccggaagatgatcgccaagtccgagcaggagatcgggaaggccaccgcgaagcgcttcttctatagcaacatcatgaacttcttcaagacggagatcaccctcgccaacggcgagatccggaagcgccccctgatcgagacgaacgaggagaccggggagatcgtgtggaacaagggccgggacttcgccaccgtgcgcaaggtcctgtccatgccccaagtgaacatcgtgaagaagaccgaggtccagacgggcgccctcacgaacgagagcatctacgcccgcgggagcttcgacaagctgatctcccggaagcaccgcttcgagagctccaagtacggcgggttcggcagcccgaccgtgacctactccgtgctcgtcgtggccaagagcaaggtgcaggacgggaaggtcaaaaagatcaagacgggcaaggagctcatcggcatcaccctgctggacaagctcgtgttcgagaagaaccccctgaagtttatcgaggacaaggggtacggcaacgtgcagatcgacaagtgcatcaagctgcccaagtactccctcttcgagttcgagaacgggacccggcgtatgctggccagcgtcatggccaacaacaactcccggggcgacctgcagaaggccaacgagatgttcctcccggccaagctggtgaccctgctctaccacgcgcacaagatcgagagctccaaggagctggagcacgaggcctacatcctggaccactacaacgacctctaccagctgctgagctatatcgagcgcttcgcctccctctacgtggacgtcgagaagaacatcagcaaggtgaaggagctgttctccaacatcgagagctactccatctcggagatctgctccagcgtgatcaacctgctcacgctgaccgccagcggggcccccgcggacttcaagttcctgggcaccacaatcccccggaaacgttacggctccccgcagagcatcctctcctcaacgctgatccaccagtccatcaccggactgtacgagacccggatcgatctcagccagctgggcggggactga

SEQ ID NO: 7786 - RNA, 4116 nt, synthetic construct
  misc_feature 1..4116: note = Cas9 variant
  source 1..4116: mol_type = other RNA
atgaacaacaacaattacagcatcggcctggacatcgggaccaattccgtgggctgggccgtcatcaccgacgactacaaggtgcccagcaagaagatgcgcgtgctcgggaacacggacaagcggttcatcaagaagaacctaattggagccctgctgttcgacgagggtaccaccgcggaggaccgccggctgaagcgcaccgcccgacgccggtacacgcgccggaagaaccgcctgcggtacctccaggagatcttcgccgaggagatgtccaaggtagacagctccttcttccaccgcctggacgacagcttcctggtgccggaggacaagtccggcagcaagtatcccatattcgccaccctcgccgaggagaaggagtatcacaaaaagttccccaccatctaccatcttcggaagcacctggcagactcaaaggagaaggccgacctccgcctgatttacctggccctcgcccacatcactaagtaccggggccacttcctgtatgaggaggcgttcgacatcaaaaacaatgacatccagaaaatcttcaacgagttcatcaatatttacgacaacactttcgaggggagctccctgagcggccagaacgcccaggtcgaggccatcttcaccgggaagatctccaagagcgtcaagcgcgagcacgtgctgaagctgttccccgacgagaagtccaccggcctgtttagcgagttcctcaagctgatcgtggggaaccaggccgacttcaagaagcacttcgaccttgaagagaaggcttccctccagttcagcaaggatacctacgacgaggacctggagaacctgctcggccagatcggcgacgacttcgctgatctgttcctggtcgccaagaagctctatgacgccatcctgctgtccggtatcctcacggtgaccgacccgagcaccaaggcgcccctgagcgcctccatgatcgagcggtacgagaaccaccaggaagatctggccgccctcaagcagtttatcaagaataatctgcccgagaagtacgccgaggtgttcagcgatcagtccaaggatggctacgccgggtacatcgacggaaagaccacgcaggaggccttctacaagtacatcaagaatctgctcagcaagtttgagggcgcggactacttccttgacaaaatcgagcgcgaggacttcctgcggaagcagcgcaccttcgacaacgggtccatcccccaccagatacacctccaggagatgaacgccatcctgcggcgccagggtgagcactacccgctgctcaaggagaacaaggagaagatcgagaagatcctgaccttccgcatcccctactacgtcgggcctctggcccggggcaaccgagacttcgcctggctcacccggaacagcgaccaggccattcgcccctggaacttcgaggagatcgttgacaaggcgtcgagcgccgagtccttcatcaacaagatgacgaactatgacctgtatctgccggaggagaaggtgctgcccaaacacagcctcctctacgaaaccttcgcagtctacaacgagctgaccaaggtgaagttcatcgccgaggggctccgggattaccagttcttcgactccggccagaagaagcagatcgtcaatcagctgttcaaagagaagcgcaaggtcaccgaaaaggatatcatccactacctgcacaacgtggacggatacgacgggatcgagctcaagggcatcgagaagcagttcaacgcgagcctgagcacgtaccacgatctgctcaagatcatcaaggacaaggagttcatggacaaccacaagaatcaggagatcctggagaacatcgtgcacaccctgaccatcttcgaggaccgggaaatgattaagcagcgcctcgcccagtacgacagcatcttcgacgagaaggtcatcaaggccctgacccggcgccactacacggggtggggtaagctctccgccaagctcatcaacgggatctgcgacaagaagaccggcaagacaatcctggactacctgatcgacgacggctacaacaaccggaacttcatgcagctcatcaacgacgacggcctgagcttcaaggagattatccagaaggcccaggtggtgggcaagaccgacgacctaacgcaggtcgtgcgcgagctctccgggagccccgcgatcaagaaggggatactgcagtccatcaaaatcgtggacgagctggttaagatcatggggtacgcccccgaaagcatcgtaatcgaaatggcccgggaaaaccagaccaccgccaagggcaagaagaatagccagcagcgctacaagcggatcgaggacgcactcaagaacctggcgccgggcctggactccaccatcagcaaggagaaccccacggacaacatccagctccagaacgaccgcctgttcctgtactacctccagaacgggaaggacatgtataccggcgaggccctggacatcaaccagctgtccagctacgatatcgaccacatcatcccacaggcgttcatcaaggacgactccctcgacaaccgggtcctgacctcatccaaggacaaccgcggcaagtcagacaacgtacccagtctggaggtggtaaagaagcggaaggccttctggcagcagctcctggactccaagctgatctccgagcgcaagttcaacaacctcaccaaggccgaacgcgggggcctggacgaacgggacaaggttgggttcatcaagcgccaactcgtggagacccgccagatcacgaagcacgtcgcgcgcatcctcgacgcccggttcaacaccgaggtgagcgagaaaaaccagaaaatccgctccgtgaagatcatcaccctcaagagcaacctggtctccaatttccggaaagagttcaagctgtataaggtgagagagatcaacgattaccaccacgcccatgacgcgtacctgaacgcggtggtagccaaggccatcctgaagaagtacccgaagttagagcccgagttcgtatacggggactaccagaagtacgacctgaagcggtacatctccaagtccaaggaccctaaggaagtggagaaggccaccgagaagtatttcttttacagcaacctgctcaacttcttcaaggaggaggtccactacgccgacgggacgatcgtcaagcgcgagaacatcgagtacagcaaggacaccggcgaaatcgcgtggaacaaggagaaggacttcgtgaccattaaaaaggtcctgtcctacccacaggtgaacatcgtgaagaagcgtgaggtacagaccgggggtttcagcaaggagtccatcctgccgaagggcaacagcgacaagctcataccccgcaagacgaaggacatcctgtgggacaccaccaagtacgggggcttcgactcccccgtgatcgcctacagcatcctgttgatcgctgacatcgagaaggggaaagccaagaagctgaagaccgtgaagacgctggtgggcatcaccatcatggagaaggccgcgttcgagaaaaaccccatcaccttcctcgagaacaaggggtaccacaacgtgcggaaggagaacatcctgtgcctgccgaagtactccctcttcgagctggagaacggccgacggcgcctgctcgcctccgccaaggagctgcagaagggaaacgagatcgtactgcccgtctacctcaccacgctgttataccactccaagaacgtgcacaagttagatgagccggagcacctggagtacatccagaagcaccggtacgagttcaaggacctgctcaatctggtgtccgagttctcccaaaagtacgtcctggccgaggccaacctcgagaagatcaagagcctgtacgtcgacaacgagcaggcggacatcgagattctggccaactcctttatcaacctcctgaccttcaccgccttgggggccccagccgccttcaagttcttcggcaaggacgtcgaccgcaagcgctacaccacggtcagcgagatcctcaacgccaccctgatccaccagtccatcaccgggctgtacgagacacgcatagacctcagcaagctgggcgaggactga

SEQ ID NO: 7787 - RNA, 4116 nt, synthetic construct
  misc_feature 1..4116: note = Cas9 variant
  source 1..4116: mol_type = other RNA
atgaccgagaagaactacagcatcggcctggacatcgggaccaactccgtgggctgggccgtgatcacggacgactacaaggtgcccgccaagaagatgaaggtgctcgggaacaccgacaagaagtacatcaagaagaacctgctgggcgcgctcctgttcgacaacggggagaccgccgaggccacccgcctgaagcggacggcccgccggcgctacacccggcgtaagaaccggctccgctacctgcaggagatcttcgccgaggagatggcgaaggtcgacgagagcttcttctaccggctggacgagtccttcctcaccacagacgacaaggatttcgagcgccacccgatattcggcaacaaggccgacgagatcaagtaccaccaggagttccccacgatctaccacctccggaagcacctggccgacagccacgagaaggccgacctccgcctgatctacctggcgctcgcccacatgatcaagttccggggccacttcctgatcgagggggagctgaacgcagagaacaccgacgtgcagaagctgttcgaggccttcgtggaggtctacgaccgcactttcgacgactccaacctgagcgagatcaccgtggacgcctccagcatactgacggagaagttctccaagagccggcgcctcgagaacctgatcaagcactaccccaccgagaagaagaacaccctgttcggcaacctcgtggcgctggccctggggctccagcccaacttcaagacctccttcaagctgagcgaggacgccaagctgcagttctccaaggacacgtacgaggaagacctcgaggagctgataggcaagatcggggacgagtacgccgacctgttcaccagcgccaagaacctctacgacgcgatcctgctgtccggcatcctcaccgtcgccgacaacacaacgaaggccccactgtctgcctccatgatcaagcggtacaacgaacaccaggtggacctgaagaagctcaaggagttcatcaagaacaacgcctctgacaagtacgacgagatcttcaacgacaaggacaagaacggctacgcggggtatatcgagaacggcgtaaagcaggacgagttttacaaatacctgaagaccaccctgtccaagatagacgggagcgactacttcctcgacaagatcgagcgcgaggacttcctgcggaagcagcgcaccttcgacaacggcagcatcccccaccagatccacctccaagagatgcacgccatcctccggcgccagggcgagcactacgccttcctgaaggagaaccaagccaagatcgagaagatcttaacgttccgcattccctactacgtcgggcccctcgcccggaaaaattcccgcttcgcttgggccgagtaccacagcgacgagaagatcaccccctggaacttcgacgagatcatcgacaaggagaagtccgccgaaaagttcatcacccggatgaccctgaacgacctgtacctgcccgaggagaaggttctccccaagcacagcctggtgtacgagacgtacaccgtctacaacgagctgaccaaggtgaagtacgtgaacgagcaggggaagtccaacttcttcgacgccaacatgaagcaggagatcttcgagcacgtcttcaaggagaatcgcaaggtgaccaaggacaagttcctcaactacctgaacaaagagttccccgagtaccggatccaggacctgatcgggctcgacaaggagaacaagagcttcaacgcgtcactgggcacgtaccacgacctgaagaagatcctcgacaagagcttcctggacgacaagaccaacgagaccatcatcgaggacatcatccagaccctgacgctgttcgaggaccgcgacatgattcggcagcgcctgcagaagtactccgacatcttcaccccgcaacagctgaagaagctcgagagacgccactacaccgggtggggccggctgagctacaagctgataaacggcatcagaaacaaggagaacgggaagtccatcctcgactacctgatcgacgacggctacgccaaccggaacttcatgcagctgatcagcgacgacaccctccccttcaagcagatcatcaaggacgcccagatcatcggggacatagacgacgtgacctccgtcgtgcgcgagctgcccggcagccccgccatcaagaaggggatcctgcagtccgtgaagatcgtcgacgagctcgtgaaagtcatgggccacaacccggacaacatcgtgatcgagatggcccgggagaaccagacgaccaaccgtggtcggaaccaaagccagcagcgcctgaagaagctgcaggactccctcaaggagctggggagcaacattctgaacgaggagaagccctcctacatcgagggcaaggtggagaacaaccacctccaggacgaccggctgttcctgtactacatccagaacgggaaagacatgtacaccggcgacgagctcgacatcgaccatctgagcgactacgacatcgaccacatcatcccccaggcgtttatcaaggacgacagcatcgacaaccgcgtcctgacctccagcgccaagaaccgcgggaagtctgacgacgtgcccagcctcgatatcgtgcacgaccggaaggccgactggatccgcctgtacaagtccggcctgatcagcaagcggaagttcgataacctcacgaaggccgagcgcggcgggttgaccgaaaacgacaaggccggcttcatcaagcggcagctggtcgagactcgccagatcaccaagcatgtggcgcagatcctcgattcccggttcaacacggagcgtgacgagaacgacaaggtgattcggaacgtcaaggtgataaccctcaagagcaacctggtgtcccagttccgcaaggacttcaagttctacaaggtcagggagatcaacgactaccaccacgcccacgacgcatacctgaatgccgtggtggggaccgccctgctgaagaagtacccgaagttagcgcccgagttcgtctacggcgagtacaagaagtatgacatccgcaagttcatcaccagctccggcgacaaggccacggccaagtacttcttctacagcaacctgatgaacttcttcaagcgggtgatccgctactccaacggcaaggtggtcgtgcggcccgtgatcgagtgcagcaaggacaccggcgagatcgcctggaacaagcagaccgacttcgagaaggtccgccgggtgctgtcctacccccaggtgaacatcgtcaagaaggtggagacccagaccgggggcttcagcaaggagagcatcctcccgaaggggaacagcgacaagctgatcccccgcaagacaaagaagttccggtgggacacccccaagtacggcggcttcgatagccccaacatcgcgtactccgtgttcgtcatcgccgacgtggaaaaggggaaggccaagaagctgaagaccgtgaaggagcttgtcggcatcagcatcatggagcgctccagcttcgaggagaacccggtggtgttcctggagaagaagggctaccaaaatgtccaggaggataacctgatcaagctccccaagtactccctgttcgagtttgagggcgggaggcgccgcctactcgccagcgcctccgagctgcagaagggcaacgaggtggtgctgagccggcacctcgtcgagctgctgtaccatgcgcaccgcgtgaactccttcaacaacagcgagcacctcaagtacgtgtccgaacacaagaaggagttcggcgaggtcctgagctgcgttgaaaacttcgccaagtcctacgtggacgtcgagaagaacctggggaagatccgggccgtggccgacaagatcgacacgttcagcatcgaggacatctccatcagcttcgtgaacctcctgaccctgaccgccctcggcgcgcccgccgacttcaacttcctgggggagaagatcccgcgcaagcggtacacctccacgaaggagtgcctgaacgccaccctcatccaccagagcatcaccggcctgtacgagacccgcatcgacctgtccaagctcggggaggagtga

SEQ ID NO: 7788 - RNA, 4116 nt, synthetic construct
  misc_feature 1..4116: note = Cas9 variant
  source 1..4116: mol_type = other RNA
atgaacctcagaaacgtggagtcataccaagtgggactagacatcggcaccgggagcgtcgggtgggcagtcctcgacgacaacggagatttatgcagattcaagggaaaaccgacctggggctccagagtcttcccgacggcagaaacagcggcagaggcacgcgtccaccgcggacagagacgaaggtacgaccgacgccgacaaaggatcgatctcttacaacgcttcttcgccgacgaggtagcaaaagtagacccagagttcttcatcagattaaaccaggctcgcctgcacccagaaaaccgcgaccccgcccacgccgactaccgatggccgttgttcaacggttcgaacttcaccgagaaggattactaccgacagttcccaacaatataccacctacgagcacacctgttgaagtcggacgaacccgcggacatacggctagtgtacctagcactacataacatcgttaagcatcgaggaaacttcctacaccaagacaatccatcgctctcggcccggaacgcaaacgtaggtgacgccgttgaagcactgtgcctcgccttggacgaatggtgcggggctcacgatgtcgaatgcgcctgtgacgaggcggctcttgcagaagcgctaggtgatgcgagcttacgaccgggcgagaaaagggaaagggcagaagccgcgctaggcgtcgaaaaggcccacaaaaagttagctaaagccgtgagttcagcagtggtagggtacgcagcggaatttggacacgttttcttcgccgaatccgaagggtccaaattcgcactatcaaacgacgaaaaagtagaggcttatgtatgccccgatgaaggaagagacctattcgacgccatgcgagcggtacacagctcctatgtacttatgggcatcctatccgaagcacaaggggagctcctcagcgtctgcaaagtgggcgagtatgaaagatacaagagagacctggaaacactaaaaagtctggttagagcgtatggcccggaaagatacgacgagttcttctgtgggccattctacgaaggaacaagggattatgacccgggaaaagcacagggatacaccaaatataacctgggcgcatccaagctcagtcatgaagacttcctaaaagaggtacagaaacttctgaaagatatcggggcacaggcggacgaacgttacgcagacatcgaacgagcaatagaagccggagcattcctcaggcgcctgaaaactagcgacaacggcaccataccttaccaactgcacctcgaagagatggacgccataatcgagagacaagccgcattctaccccttcctcgcgcaagaaaaggacaagctgaagtccctagtcagcttccgaatcccatattacgtaggcccgctaacacagaaaaacgcagcaagggacggcaagggcgaggcacgatttgcctggagctcgcgaaagcccggtatggaggatgcgagggtatacccatggaactgggaggacgtcatagataaggaccaatcggccgaagacttcatacgacggatgacggggacctgcacttacctcaaaggcgagccggtactggcccgctgctctctcgactacgagctgttctgcgtcttgaacgaactcgccggagctcgatggacccaagacggcgacaaaagctaccgattcgacgcagcagaccgacttggcatcgtcgaagacctgttcaagaaaagaaaacgagtcacatacgaggccgcggagaaatggctagcaagaacgcacggacctgaatccggaaagagcgcaggcggcgcataccacgtatcaggcggccaaggcgaagacgccttcgaaagccaactatcaagccactacgacttctgcaaaatactcggggtcgacgaactaagcgacgcggacgaagcaatggcggaagacataatcctctggaacacagtcttcgaagaccgctctatactgaagcggaaaatcaaactagcgtacggagacaggctgggagacgcccaagtaagaaaactatgtcagaaacggtacacaggctggggcagactatcaggggagctcctccgcggattaagatcggcaacagacaatggaccaaaaacgataatggacatactcctagagggcgacccgaatcacgcgcgcagaatgggagccgcaatgaatttaatggaaattctccacgacgacctactggagttccaagctaaaatcgacgaacataaccgagaacgcgccctggcagtcggaggcatgagcgtagacgaagtcacaggatcaccggcgctaagacgaggaataaatcaagctctccgggtagtcgacgaaatcgccgggatagcggggaaaccaccagcgcacatctacgtcgaagttacacgggatgaaggagcgcggaacaagggacggcgcacgacgagccgataccgagcactagaagccgcactctcaagcataaaagcccagtgcgccgacgtatacgccgaactaaaagaaagagaccccagggcattggatgacgaaaggctgacgctctatttcatgcaatgtggcaaatgcatgtacagtggagacgcactggacatcaacaaactacaaacatatcaggtagaccatatactaccgcaatcgtatgtaaaggacgacagctttgaaaacaaagtgctagtgagacctgacacaaaccagcgcaaaggagacacactgctgctagacgaaagactaatcgcccggatgagagggttctggcgaaccctacgagacgcggagctcataggagagaagaaattcaacaacctaacacgcaccagtgtatccgatgagcagatgaagaaattcgtctcaagacagctagtggaaacaggacagatggtgaaacaagtccagcagcttctacaagcccgctaccccgagagcgaggtccaaccagtcaaagcgggggtctcccaccaactcagagttggatgcgcattagcgaaaagccgagagataaacgacttccaccacgcgcacgacgcgtaccttgcgtgccaagtgggacggtttgtgcaatacagacacagtgccgtctactccgaaccagtaaaaatggcggcggtggtcaaacaattcataaagaaacaagccgaagattacaggcgaacccgagaactacccgggtctgacggctttatcgtctccagcttcatgacgcccggcttcgacgtaaaaacaggggaagtcttcagagacgcatgggacgccggagcagagatagacagaatccggagatgctttgactataaagactgcttcataagcagaatgcccgaagaaacacatggcgcattctgggacgcaacgatctacagcccaagagcagcaggaaaaacgttgtccctaccgctaaaacgcggattagacccacgaaaatacggatcgtacagtagggaacaattcgcctacttcttcgtctacgaagcggtcaaacctaaaaagaaacaaagagtccttgagttcgccccagtgccagtccgggtagctagcgcactcgctaatgacccggatgcgttggaagactacgcccgcgaactcgcagaagcagaagggctggtcttcgaaagaattagaaggcgcaaagtttacaagtaccaacaaatcatagtgggtgacagcagactgtacgtaacaggacgagaggaagtacgtaatgctcggcagctcgcattcagccaggacgaaactaagttaatatgcagaatcgagcagggggaagagtgcgaagaaggagaactcctagacctcttcaggagcatgcagcggaaatacctagcctgtgcccctcgtctcgctagacttatgaaagtagccgaaatggaggaaggattcatagccgcaacagctagtggaaaaagggaagtccttctctcactgactagcatagcagccgcacacagaaacagcatcgacctaaaaccaatcggcaggaaaggctcctccggccaaatgaaaataacattcagtaaagagttgagcaccaacgggatactattcgtcgattcctcagtcacaggcatgttcgaacgccgctgcaggctaggactctga

SEQ ID NO: 7789 - RNA, 4116 nt, synthetic construct
  misc_feature 1..4116: note = Cas9 variant
  source 1..4116: mol_type = other RNA
atggagaacaagaactacagcatcggcctggacatcgggaccaactccgttggctggagcgtcatcaccgacgactacaaggtgccctccaagaagatgaaggtgctcgggaacacggacaagcgcttcatcaagaagaacctgatcggcgccctgctgttcgacgagggcaccaccgccgaggcgcggcgcctgaagcggaccgcccgccggcgctacacgaggcgcaaaaatcggctgcgctacctccaggagatcttcgccgaggagatgagcaaggtcgactccagcttcttccacagactggacgactccttcctgatcccggaggacaagcgcggcagcaagtatcccatctttgccaccctcgccgaggagaaggagtaccacaagcagttccccaccatctaccacctccggaagcagctggcggactctaaggagaagaccgacctccgcctgatctatttggccctcgcccacatgatcaagtaccggggccacttcctgtacgaggacacgttcgacatcaagaacaacgacatccagaagatcttcagcgagttcatctccatctacgacaacaccttcgaggggagctccctgagcggccagaacgcccaggtggaggcgatcttcaccgacaagatctccaagagcgccaagcgcgagagggtactcaagctattccccgacgagaagtccaccggactgttcagcgagttcctaaagctgatcgtaggcaaccaggccgacttcaagaagcacttcgacctgggggagaaggccccgctccagttctccaaggacacgtacgacgaggacctggagaacctgctcggccagattggcgacgacttcgccgacctgttcctggtggcgaagaagctctacgacgccattctgctgagcgggatcctcactgtgacggaccccagcaccaaggcgcccctgtccgccagcatgatcgagcgctacgagaaccaccagaaggacctggccgtcctcaagcagttcatcaagaacaacctgcccgagaagtacgacgaggtgttctccgaccagagcaaggacggctacgccggatacatcgacggcaagacgacccaggaggccttctacaagtacatcaagaacctgctctccaagttcgagggcactgactacttcctggaaaagatcgagcgggaagatttcctgcgcaagcaacggaccttcgacaacgggagcatcccgcaccagatccacctccaggagatgaacgccatcctgcgccgccagggcgagcactaccccttcctgaaagacaacaaagagaagatagagaagatcctcacgttcagaatcccctattacgtggggcccctggcccgcggcaaccgggacttcgcctggttgacccgcaactccgacgaggcgatccggccgtggaacttcgaggagatagtcgacaaggccagctccgccgaggacttcatcaacaagatgaccaactatgacctctacctgcccgaggaaaaggtgctgcccaagcacagcctgctctacgagaccttcgccgtgtacaacgagctgacgaaggtcaagttcatcgccgaggggctgcgcgactatcagttcctcgactccggccagaagaagcagatcgtgacccagctgttcaaggagaagcggaaggtgaccgagaaggacatcatccagttcctgcacaacgtcgacggctacgacgggatcgagctcaagggcatcgagaagcagttcaacgcgagcctgtccacctaccacgacctgctcaagatcatcaaggacaaggagttcatggacgacagcaagaacgaagagatcctggagaacatcgtgcacacgctgaccatcttcgaggatcgcgagatgatcaagcagcggctcgcccagtacgactccctgttcgacgagaaggtgatcaaggccctgatccgccggcactacaccgggtggggcaagctcagcgccaagctgatcgacgggatctgcgacaagcagaccggcaacacgatcctggactacctcatcgacgacggcaagaacaaccgcaacttcatgcagctaatcaacgacgacgggctgtccttcaaggagatcacccagaaggcgcaggtcgtgggcaagaccgacgacgtgaagcaggtcgtgcaggagctccccgggagcccggccatcaagaagggcatcctgcagtccatcaagatcgtcgacgagctggtgaaggtaatgggtcacacccccgagagcatcgtcatcgagatggcccgggagaaccagacgaccgcccgcggcaagaagaacagccagcagcggtacaagcgcatcgaggacgccctcaagaacctggcgtccggcctggacagcaacatcttaaaggagcaccccaccaacaacatccagctccagaacgatcggctgttcctctactacttgcagaacgggcgcgacatgtacaccggcaagcccctggacatcaaccagctctccagctacgacatcgaccacatcgtgccgcaggccttcatcaaggacgactccctggacaaccgcgtgctgaccagcctcaaggacaaccgcgggaagtccgacaacgtccccagcatcgaggtggtgcagaaacgcaaggccttctggcagcagctgcttgactccaagctcatcagcgagcggaagttcaataacctgacaaaggccgagcgcggcggcctggacgagcgggacaaggtcgggttcatcaagcgccagctcgtggagacccggcaaatcaccaagcacgtggcccagatcctggacgcgcgcttcaacaaggaggtcaacgagaaggacaagaaaaaccggaccgtgaagataatcacgctgaagtccaacctcgtgagcaacttccgcaaggagttccggctgtacaaggtccgcgagatcaacgactaccaccatgcccacgacgcctatctgaatgccgtggtggccaaggcgatcctcaagaagtaccccaagctggagcccgagttcgtctacggcgactaccagaagtacgacctgaagagatacatctcccgcagccggaacccgaaggaggtggaaaaggccaccgagaagtacttcttctactccaacctcctgaatttcttcaaggaggaggtgcactacgccgacgggaccatcgtcaagcgcgagaacatcgagtacagcaaggataccggcgagatcgcctggaacaaggagaaggacttcgcgacgatcaagaaggtgctgtcctacccccaggtgaacatcgtcaagaagcgagaggtgcagactgggggcttcagcaaggagagcatcctccccaagggcaactccgacaagctgatcccccgcaagaccaaggacatcctgtgggagaccacgaagtacgggggcttcgacagcccggtgatcgcctactccatcctcctgatcgccgacatcgagaaggggaaggccaagaagctgaagaccgtgaagaccctcgtgggcatcaccatcatggagaaggccgcgttcgaggagaaccccatcacgttcctggagaacaaggggtaccacaacgtgagaaaggagaacatcctgtgcctccccaagtacagcctgttcgagctggagaacggccgccggcgcctcctggcttccgcgaaggagctccagaagggcaacgagatcgtcctcccggtatacctgaccaccctgctctaccacagcaagaacgtgcacaagctggacgagcccgagcacctggagtacatccagaagcaccgtaacgagttcaaggacctcctgaacctggtaagcgagttcagccagaagtacgtgctcgccgacgccaacctggagaagatccagaacctgtacgcggacaacgagcaggccgacatcgagatcctcgccaactccttcatcaacctgctgaccttcacggccctcggtgcccccgcggccttcaagttcttcggcaaggacatcgaccgcaagcgctacaccaccgtgagcgagatcctgaacgccacgctgatccaccagtccatcacgggcctctacgagacccggatcgacctgagcaagctgggcgaggactga

SEQ ID NO: 7790 - RNA, 4116 nt, synthetic construct
  misc_feature 1..4116: note = Cas9 variant
  source 1..4116: mol_type = other RNA
atggacaagaagtacagcatcggcctggacatcgggactaactcagtgggctgggccgtcatcaccgatgactacaaggtgcccagcaagaagttcaaagtgctcgggaacacggaccgccactccattaagaaaaacctgatcggcgccctcctcttcgacagcggggagacggcggaggccacccggctgaagaggaccgcccggcgccgttacacgcgacgcaagaacagaatccggtacctgcaggagatcttctcgagcgaaatgtccaaggtcgacgacagcttcttccacaggctcgaggagtccttcctggtggaggaggacaagaagcacgagcggcacccgatcttcggaaacatcgtggacgaggtcgcctaccacgagaagtacccaaccatctaccatctccgcaagaagctcgccgactctaccgataaggcggacctgcggctgatctacctcgccctggcccacatgataaagttccgcggccacttcctcatcgagggggacctcaaccccgacaactccgacatggacaagctgttcatccagctggtgcaaacctacaaccagctgttcgaggagaaccccattaacgctagccgggtggacgcgaaggccatcctgtccgcccgcctgagcaagtcccggcgcctcgagaacctgatcgcccagctgccgggtgagaaacggaacgggctgttcggaaacctgatcgccctgagcctcggactaacgcccaacttcaagagtaacttcgacctggcggaggacgcgaagctccagctgagcaaggacacctacgacgacgacctggataatctcctggcccagatcggcgaccaatacgccgacctgttcctcgccgcgaagaacctgtccgatgctatcctgctcagcgacatccttcgcgtcaattccgagatcaccaaggcgcccctgagcgccagcatgatcaagcggtacgacgagcaccaccaggacctcaccctgctgaaagccctcgtacgccagcaactgcccgagaagtacaaggagatcttcttcgaccagtccaagaacggctacgcggggtacatcgacggcggcgcctctcaggaggagttttacaagttcatcaagccgattctggagaaaatggacggcacggaggagctgctggccaagctgaatcgcgaggacctgctccggaagcagcgcaccttcgacaacggctccatccctcaccagatccacctgggggagttgcacgccatcctccggcgccaggaggacttttatcccttcctgaaggacaaccgggagaagatcgagaagatcctgacctttcgcattccctactacgtgggcccgctcgcccgggggaatagccgcttcgcgtggatgacccggaagtccgaggagacgatcaccccctggaacttcgaggaggtcgtggacaagggcgcgagcgcccagtccttcattgagcgcatgaccaacttcgacaagaacctgcccaacgagaaggtgctgcctaagcacagcttgctgtacgagtatttcaccgtctacaacgagctgacgaaggtgaagtacgtgacagaagggatgcgaaagccggagttcctctccggcaagcaaaaggaggccatcgtcgatctgctgttcaagaccaaccgcaaggtgaccgtgaagcagttaaaggaggactacttcaagaagatcgaatgcttcgacagcgtcgagatctccggcgtggaggaccgtttcaacgcgtcactgggaacgtaccacgaccttctcaagatcatcaaggataaggacttcctggacaacgaggagaacgaggatatcctggaggacatcgtgctcaccctgaccctgtttgaggacaaggagatgatcgaggagcgcctcaagaagtacgccaacctgttcgacgacaaggtcatgaagcagctcaagcggcgccactacaccggctgggggaggctctcccgcaagctgatcaacggcatacgggacaagcaaagcgggaagacgattctggacttcctcaagagtgacggctttgccaatcgcaacttcatgcagctgatcaacgatgacagcctgaccttcaaagaggccatccagaaggcccaggtgtccggccaggggcacagcctccacgagcagatcgcgaacctggccggcagcccggccatcaagaaggggatcctgcagagtgtcaaggtggtggacgagctcgtcaaggtgatgggccacaagcccgagaacatcgtgatcgagatggcccgcgagaaccagaccacccagaaggggcagaagaacagccgggagcgcatgaagcggatcgaggagggcatcaaggagctgggctcccagatcctcaaggagcaccccgtcgagaatacgcagctccagaacgaaaagctgtacctgtactacctccagaacggccgcgacatgtacgtggaccaggagctggatattaaccggctgagcgactacgacgtggaccacatcgtaccgcagtccttcatcaaggacgacagcatcgacaacaagatcttgacccgctccgataagaaccggggtaagagcgacaacgtgccctccgaggaggtggtcaagaagatgaagaactactggcgccagctgctgaacgccaagctcatcacccagcggaagttcgataacctcaccaaggcggagcgcgggggcctaagcgagcttgacaaagccggcttcatcaagcggcagttggtggagacgcgccagatcaccaaacacgtggcccagatcctggattcccggatgaacaccaagtacgacgagaacgacaaactcatccgcgaggtcaaggtgatcaccttaaagtctaagctggtgtccgacttccggaaagacttccagttctacaaggtccgcgagatcaacaactaccaccacgcccacgacgcctacctcaacgcggtggtggggaccgccctgatcaagaagtacacgaagctagaaagcgagttcgtctacggcgactacaaggtgtacgacgtccggaagatgatcgccaagtccgagcaagagatcgggaaggccactgcgaagcgcttcttctacagcaacatcatgaacttcttcaagaccgagatcaccttggccaacggcgaaatacggaagcgcccactgatcgagacgaacgaggagaccggggagatcgtctgggacaagggccgggacttcgctaccgtacgcaaggtgctgtccatgcctcaggtcaacatcgtgaagaaaaccgaggtgcagacgggcgccctcaccaacgagagcatctacgctcgcgggagcttcgacaaactgatatccagaaaacaccgctttgagagctccaagtacggcgggttcggctctccgactgtaacctactccgtgctggtggtcgcaaagagcaaggtgcaagatgggaaggtgaagaaaatcaagacgggcaaggagctcatcggcatgacactgctggacaagctcgtcttcgagaagaaccccctgaagttcatcgaggacaaggggtacggcaacgtgcagatcgacaagtgcatcaagctgcccaagtactccctctttgagtttgaaaacgggacccggcgcatgctagccagcgtgatggccaacaataacagccggggcgacctgcaaaaggccaacgagatgttcctccccgcgaaactggttaccctgctctatcacgcgcacaagatcgagagctccaaggagctggagcacgaggcctacatcttagaccactacaatgacctctaccagctgctgtcatacatcgagcgcttcgcctccctctacgtggacgtggagaagaacatcagcaaggtcaaggaactgttctccaacatcgagagctactccatcagcgagatctgttccagcgtgatcaacctgctcacgctgaccgccagcggagccccggcggacttcaagttcctgggcaccactatcccccgaaagcgctatggcagcccccagtccatcctctccagcacgctgatccaccagtccataaccgggctgtacgagactcggatcgacctcagccagctgggcggggactga

SEQ ID NO: 7791 - RNA, 4116 nt, synthetic construct
  misc_feature 1..4116: note = Cas9 variant
  source 1..4116: mol_type = other RNA
atggacaagaagtacagcatcggactagatatcgggaccaactccgttggctgggccgtgatcaccgacgactacaaggtgcccagcaagaagttcaaggtgctcgggaacacggaccgccactccatcaagaagaacctgatcggcgccctgctgttcgacagcggggagaccgcggaggccacccggctgaagcgcaccgcgcggcgccggtacacgcgccggaagaaccgcatccggtacctgcaggagatcttctccagcgagatgtccaaggtcgacgacagcttcttccaccgcctcgaggaatccttcctggtggaagaagacaaaaagcatgagcggcaccccatcttcggcaacatcgtggacgaggtcgcctaccacgaaaagtaccccaccatctaccacctccgcaagaagctcgccgacagcaccgacaaggcggacctgcggctgatctacctcgccttggcccacatgattaagttccgcggccactttctgatcgagggggacctcaaccccgacaactccgacgtggacaaactcttcatccagctggtgcaaacctacaaccagctgttcgaggagaaccccatcaacgccagccgggtcgacgcgaaggccatcctgtccgcccgcctgagcaagtcccggcgcctcgagaacctgatcgcccagctgccgggcgagaagcggaacggtctcttcgggaacctgatcgccctcagcctcggtctgacgcccaacttcaagtccaacttcgacctggcggaggacgccaagctccagctgagcaaggacacctacgatgacgacctggacaacctcctggcccagatcggcgaccagtacgccgacctgttcctcgccgcgaagaacctgtccgacgccatcctgctcagcgacatcctgcgcgtgaactctgagataaccaaggccccgctgtccgccagcatgatcaagaggtacgacgagcaccaccaggacctcacgctgctgaaggccctcgtgcgccagcagctgcccgagaagtacaaggagatcttcttcgaccagagcaagaacggctacgcgggttatatcgacggcggggccagccaggaggagttctacaagttcatcaagccgatcctggaaaagatggacggcacggaggagctcctggccaagctgaaccgcgaggacctgctccggaagcagcgcaccttcgataacggctccatcccccaccagatccacctgggggagctgcacgccatcctccggcgccaggaggacttctaccccttcctgaaggacaaccgggagaagatcgagaagatcctgaccttccgcataccctactacgtcggaccgctcgcccgggggaacagccgcttcgcgtggatgacccgaaagtccgaggagacgatcaccccctggaacttcgaggaggtggtggacaagggcgccagcgcccagagtttcatcgagcgcatgaccaacttcgacaagaacctgcccaatgagaaggtcctgcccaagcacagcctcctgtacgagtacttcaccgtgtacaatgagctgacgaaggtgaagtacgtcaccgaggggatgcggaagcctgccttcctctccggcgagcagaagaaggcgatcgtggacctgctgttcaagaccaaccgcaaggtgaccgtcaagcagctcaaggaagactacttcaagaagatcgagtgcttcgactctgtggagatctccggcgtggaagaccggttcaacgccagcctggggacgtaccacgacctgctcaagatcatcaaggacaaggacttcctggacaacgaggagaacgaggacatcctggaggacatcgtcctcaccctgaccctgttcgaggacaaggagatgatcgaggagcggctcaagacctacgcccacctgttcgacgacaaggtgatgaaacagctgaagcggcgccactacacgggttgggggcggctctcccgcaagctcataaatggcatccgggacaagcagagcgggaagaccatcctggacttcctcaagtccgacggcttcgccaaccgcaacttcatccagctgatccatgacgacagcctgaccttcaaggaggccatccagaaggcgcaggtctccggccaggggcacagcctccacgagcagatcgccaacctggccggcagccccgccatcaagaaggggatcctgcagtccgtgaaggtggtagacgagctcgtgaaagtgatgggccacaagcccgagaacatcgtcatcgagatggcccgcgagaaccagaccacgcagaaggggcagaagaacagccgggagcgcatgaagcggatcgaggagggcatcaaggagctgggctcccagatcctgaaggagcaccccgtggagaacacccagctccaaaacgagaagctgtatctgtactacctccagaacgggcgcgacatgtacgtggaccaggagctggacatcaaccggctgagcgactacgacgtggaccatatcgtgccgcagtccttcatcaaggacgacagcatcgacaacaaagtgctcacccgttccgacaagaaccggggcaagagcgacaacgtcccctccgaggaggtggtgaagaagatgaagaattattggcgccagttgctgaacgcgaagctcattacccagcggaagttcgacaacctgacgaaggccgagcgcgggggcctgagcgagctcgataaggccggcttcatcaagcggcaattagtcgagacccgccagatcaccaagcacgtggcccagatcctggactcccggatgaacaccaagtacgacgagaacgacaaactcatccgcgaggtgaaggtcatcaccctcaagagcaagctggtgtccgacttccggaaggacttccagttctacaaggtgcgcgagatcaacaactaccaccacgcccacgacgcgtacctcaacgccgtcgttgggacggccctgatcaagaagtaccccaagctggagagcgagttcgtgtacggcgactacaaggtctacgacgtgcggaagatgatcgccaagtccgagcaggagatcgggaaggcaaccgccaagcgcttcttctatagcaacatcatgaacttcttcaagaccgagatcaccctcgccaacggcgagatccggaagcgccccctgatcgagacgaacgaggagaccggggagatcgtgtgggacaagggccgggacttcgccactgtccgcaaggtgctgtccatgccccaggtgaacatcgtcaagaagaccgaggtgcagacgggcgccctcaccaacgagagcatctacgcgcgcgggtccttcgacaagctgatctcccggaagcaccgcttcgagagctccaagtacggcgggttcggcagccccaccgtgacctactccgtcctggtggtggccaagagcaaggtccaggacgggaaggtgaagaagatcaagacgggcaaggagctcatcggcatcaccctgctggacaagctcgtgttcgagaagaaccccctgaagttcatcgaggacaaggggtacggcaacgtgcagatcgacaagtgcatcaagctgcccaagtactccctgttcgagttcgagaacgggacccggcgcatgctggccagcgtgatggccaacaacaactcccgaggcgacctgcagaaggccaacgagatgttcctcccggcgaagctggtgaccctgctctaccacgcccacaagatcgagagctccaaggagctggaacatgaggcctacatcctggaccactacaatgacctctaccagctgctgagctacatcgagcgcttcgcgtccctctacgtcgacgtggagaaaaacatcagcaaggtgaaggagctgttctccaacatcgagagctactccatctcggagatctgttccagcgtcatcaacctgctcacgctgaccgccagcggggcgcccgccgacttcaagttcctgggcaccaccatcccccggaagcgctacggctccccgcaaagcatcctctccagcacgctgatccaccagtccatcaccggactgtacgagacccggattgacctcagccaactgggcggggactga

SEQ ID NO: 7792 - RNA, 4116 nt, synthetic construct
  misc_feature 1..4116: note = Cas9 variant
  source 1..4116: mol_type = other RNA
atggagaacaagaactacagcatcggcctggacatcgggactaactccgtgggctggtccgtaatcaccgacgactacaaggtgccctccaagaagatgaaggtgctcgggaacacggacaagcacttcatcaagaagaacctgatcggcgccctgctgttcgacgaggggaccaccgccgaggcgcgccggctgaagcgcaccgcccggcgccggtacacgcgccggaagaaccgcctgcggtacctccaggagatcttcagcgaggaaatcggcaaagtcgactccagcttcttccaccgcctggacgactccttcctgatccccgaggacaagcggggcagcaagtaccccatcttcgccaccctcgccgaggagaagaagtaccacaaacagttccccaccatctaccacctccgcaagcagcttgccgactccaaggagaagaccgacctccggctgatctacctggcgcttgcccatatgatcaagtaccgcgggcacttcctgtacgaggaggccttcgacatcaagaacaatgacatccagaagatcttcaacgagttcatcagcatctataataacacattcgaaggcaactccctgagcgggcagaatgtccaggtcgaggccatctttaccgacaagatctccaagagcgcgaagcgggagcgcgtgctcaagctgttccccgacgagaagtccaccgggctgttctcagagttcctcaagctgatcgtggggaaccaggccgacttcaagaagcacttcgacctggaggagaaggctccgctccagttctcccgggacacctacgacgaggacctggagaacctgctcggccagatcggagacgacttcgccgacctgttcctggtggccaaaaagctctacgacgcgatcctgctgagcgggatcctcacggtcaccaacccctccaccaaggccccgctgagcgccagcatgattgaacgctacgagaaccaccagaaggacctggctagtctcaagcagttcatcaagaacaacctgcccgagaagtacgacgaggtgttcagcgaccagtcggaggacggctatgccgggtacatcgacggcaaaaccacgcaggagaccttctacaagtacatcaagaacctgctcagcaagttcgagggcgcggactacttcctggacaagatcgagcgggaggacttcctgcgcaagcagcggaccttcgacaacgggtccatcccgcaccagatccacctccaggaaatgaacgccatcctgcgccgccagggcgagcactaccccttcctgaaggagaacaaggaaaagatcgagaagatccttaccttccggataccctactacgtggggcccctggcccgcggtaaccgggacttcgcctggctgacgcgcaacagcgaccaggccatccggccgtggaacttcgaggagatcgtcgacaaggcgtccagcgccgaggattttatcaacaagatgaccaactacgacctctacctgcccgaggagaaggtgctgcccaagcactccctgctctacgagaccttcgccgtgtacaacgagctgacgaaggtcaagttcatcgccgaggggctgcgcgactaccagttcctcgacagcggccagaagaagcagatcgtgacgcagctgttcaaggagaagcggaaggtgaccgagaaggacatcatccagttcctgcacaacgtcgacggctacgacgggatcgagctcaagggcatcgagaagcaattcaacgcctccctgagcacctaccacgacctgctcaagatcatcaaggacaaggcgttcatggatgacgccaagaacgaggccatcctggagaacatcgtgcacaccctgacgatcttcgaggatcgcgagatgattaagcagcggctcgcccagtacgactccctgttcgacgagaaggtgatcaaggcgctgacccgccggcactacaccgggtggggcaagctcagcgccaagctgatcaatgggatctccgacaagcagaccggcaacacgatcctggactacctcatcgacgacggcgagattaaccgcaacttcatgcagctgatcaacgacgacgggctgagcttcaaggagatcatccagaaggcccaggtcgtgggcaagaccaacgacgtgaagcaggtcgtacaggagctccccgggtccccggccatcaagaagggcatcctgcagagcatcaagatcgtcgacgagctggtgaaggtaatggggcacgccccggaatccatcgtcatcgagatggcgcgggagaaccagaccaccgcccgcggcaagaagaacagccagcagcggtacaagcgcatcgaggacagcctcaagatcctggcctccggcctgaacagcaagatcctcaaggagcaccccacggacaacatccagctgcagaacgaccggctgttcctctactacctgcagaacgggaaggacatgtacaccggcgaggccctggacatcaaccagctctccagctgcgacatcgaccacatcatcccgcaggccttcatcaaggacgatagtctagacaatcgcgtgctaaccagctccaaggacaaccggggcaagagcgacaacgtgccgtccctcgaggtcgtagacaagatgaaggtgttctggcagcagctgctggacagcaagctcatctcctaccgcaagttcaacaacctgacgaaggcggagcgcgggggcctgaacgagctcgacaaggtcgggttcatcaagcggcagctggtggagacccgccagatcacgaagcacgtggcccagatcctggacgcccggttcaacaaggaggtaaccgagaaggacaagaagaaccgcaccgtgaagataatcacactcaagagcaacctggtgtccaacttccggaaggagttcgagctgtacaaagtccgcgaaatcaacgactaccaccacgcccacgacgcctacctcaacgcagtggtggccaaggccatcctgaagaagtaccccaagctggagcccgagttcgtatatggcgactaccagaagtacgacctcaagcggtacatctcgcgctccaaggaccccaaagagatcgagaaggccacggagaagtacttcttctacagcaacctgctgaacttcttcaaggaggaggtgcactacgcggacgggaccatcgtgaagcgggagaacatcgagtactccaaggacaccggcgagatcgcctggaacaaggagaaggacttcgccaccatcaagaaggtcctcagcctgccccaggtgaacatcgtgaagaagcgcgaggtacagaccgggggcttcagcaaggagtcaatcctgcccaagggcaacagcgacaagctcatcccccgcaagacgaaggacatcctttgggataccaccaagtacgggggcttcgactcccccgtgatcgcctatagcatcttactcatcgccgacatcgagaaggggaaggcgaagaagctgaagaccgtgaaaaccctggtcggcatcaccatcatggagaaggacgccttcgagaaaaacccgatcgccttcctggagaacaaggggtaccacaacgtgtgcaaggaaaacatcctgtgcctgcccaagtactccctcttcgagctggagaacggccgccggcgcctgctagccagcgccaaggagctgcaaaagtgcaacgagatcgtgctgcccgtctacctcaccacgctgctgtaccactcaaagaacgtgcacaagctcgacgagccgggccacctggagtacattcagaagcaccggaacgagttcaaggacctgctcaacttggtgtccgagttctcccagaagtacgtcctggcggacgccaacctcgagaagatcaagaacctgtacgccgacaacgagcaggccgacatcgagatcctggccaacagcttcatcaacctcctgaccttcaccgcgctgggggcccccgccgccttcaagttcttcggcaaggacgtggatcgcaagcggtacaccacggtgtccgagatcctcaacgcgaccctgatccaccagagcatcaccgggctgtacgagacccgcatcgacctctccaagctgggcgaggactga

SEQ ID NO: 7793 - RNA, 4116 nt, synthetic construct
  misc_feature 1..4116: note = Cas9 variant
  source 1..4116: mol_type = other RNA
atgaaagtaaacaactaccacatcgggctggatattggaaccagctccatcggttgggttgcgatcggggaggacgggaagcccctgcgtatcaaggggaagaccgccatcggcgcgcgcctgttccaggagggcaacccggccgcagaccgccgcatgttccgcacaacccggagacgtctgtcacgacggaagtggcgtctcaagctgcttgaggagatcttcgacccgtatatcacccccgttgactctaccttcttcgcccggctcaagcagagcaacctttcccccaaggacagccgcaaggagttcaagggatccatgctgtttccggacctcaccgacatgcagtaccacaaggactaccccaccatctaccacctccggcacgccctgatgacccaggatgaaaagttcgacatccgcatggtgtacctggcgatccaccacatcgtcaagtaccgcggaaacttcctcaacagcacacccgtagactccttcaaggctagcaaagtgaatttcgtcgatcagttcaagaaactgaatgagctctacacagctatcaatcccgaggagtccttccagatcaacctggccaacagcgaagacatcggacaccagttcctggacccgtccatccgcaagttcgacaaaaagaagcaaatccccaagatcgtgcctgtgagcgtcgacgacaaggcgaccgacaagatcaacggaaaaatcgcctccgagatcatcaacgccatcctcgggtacaagagtaagctggatgtggtggtccaatgcacccccgtggactccaagagctgggccctgaagttcgatgaggaggacatcgatgccaagctccagaagatactgccggagatggacgagaaccagcagtccatcatcgcaatcctgcaaaacctctacagccaggtaacactgaaccagattgttcccaatggcatgagcctgtccgagagcatgatagagaagtacaacgaccaccacgaccacctcaagctgtacaagaagataatcgaccagctggccgaccccaaaaagaaggccgccctcaagaaggcctactcccaatacgtgggcgacgacgggaaggtaatcgagcaggcggacttctggagctccgtcaaaaagaacctggatgacagcgacctgtccaagcagatcatggacttgattgacgccgagaagttcatgccaaaacagcggacgagccagaacggcgtgatcccgcaccagctgcaccagcgcgagctggacgaaatcatcgaacaccagtccaagtactacccctggctcgccgagatcaaccccaacaagcacgacctgcacctggcgaagtacaagatcgaggagctcgtggccttccgggtcccctactacgttgggccgatgattacccccgacgaccaagccaagagcgcggaaaccgtgttctcctggatggagcgcaagggcaaggaggccggccagatcaccccatggaacttcgacgagaaggtcgaccggaacgccagcgccaacagattcatcaagcgcatgacgaccaaagacacctacctgatcggggaggacgtgctgcccgacgagtccctcctgtacgagaagttcaaggttctgaacgagctcaacatggttagggtgaacggcaagctgctgaaggtagcggacaaacaggcaatcttccaggacctcttcgagaactacaagcacatcagcgtgaagaagctgcagaattacatcaagtccaagaccggactgccgagcgaccccgaaatctccggcctgagcgaccccgagtacttcaacaactccctcgggacgtacaacgacttcaagaaactcttcggtaacaaggtggacgaacccgacttacaggacgacttcgagaagatcgtcgagtggagtacggtgttcgaggacaagcgcatcctccgggagaagctgaacgagataacctggctaagcgatcagcagaaagacgtgctcgagtccagccgctaccagggctgggggcggttatccaagaagctgctcaccggaattgtcaacgaccagggggagcgcatcatcgacgagttgtggaacacgaacaagaacttcatgcagatccagagcgacaacgacttcgccaaacggatacacgaggccaacgcggaccagatgaaggctgtggacgtcgaggacgtcctggccgacgcctacaccagcccccagaataagaaggccatccgccaggtggtcaaggtcgtggacgacatccagaaggcgatgggcggggtcgcccccaaatatatctcaatcgagttcacccggtccgaggaccgcaatccccggcgcaccatcagccggcagcgccagctcgaaaacacgttgaaggacaccgcaaagtccctggccaagagcatcaacccggagctcttatccgagctggacaacgcagccaagagcaagaagggcctcatcgaccggctgtatctttatttcacccagctcggcaaggacatctacacgggtaagcccatcaacatcgacgagattagcacatacgacatagaccatattcttccccaagcgttcgtcaaggacgacagcctaaacaaccgcgtgctcgtgtccaaggccatcaacaacgggaaaagcgacaatgtccccgttcagttgttcggggccaagatgggccatttctggaaacagctggccgaggcagggctcatctccaagcgcaagctgaagaacctgcagaccgatccggacaccattagcaagtacgccatgcacggcttcatccgcagacagctcgtggagacaagccaggtcataaaattggtggctaacatcctgggcgacaaataccgaaatgacgacacgaagatcatcgagatcaccgcccgtatgaaccatcaaatgcgggatgagttcgggttcataaagaaccgcgagatcaacgactaccatcacgcatttgacgcctacctcaccgccttcctcggccggtacctgtatcaccgctacatcaagctccggccctactttgtttacggggactttaagaagttcaaagaggacaaagtcaccatgcgcaactttaacttcctgcacgacctgaccgacgacacgcaggagaagatagctgacgccgagacgggcgaggtgatctgggaccgggagaactccatccagcagctcaaggacgtgtaccactacaagttcatgctgatcagccatgaggtctacaccctgaggggcgcgatgtttaaccagacggtgtatcccgcctccgacgccggcaagcggaagctcatacccatcaaggccgaccgcccgatcaacgtgtacggcggatacagcggctccgccgacgcttacatggccatcgtacggatccataacaaaaagggggacaagtaccgcgtcgtgggcgtccctatgcgggcccgcgaccggctggacgccgccaaaaaggtgagcgacgcggactacgaccgcgccctgaaggacgtcctcactccccaactgaccaagaccaagaagtcgcggaagaccggcgagatcacccaggtcgtggaggactttgagattgtgctggggaaggtcatgtaccgacagttaatgatcgacggcgacaagaagttcatgctggggagctccacctaccagtacaacgccaaacagttggtgttgagcgaccagtccgtgaagaccctggccagcaagggccggctggaccccctccaagagtccatggactacaacaacgtctacaccgagatcctggacaaagtgaaccagtacttcagcctgtacgatatgaacaagttccgccataagctgaacttagggttcagcaagttcatatccttcccgaaccacaacgtgttcgacggcaacacgaaagcgtccagcggtaagcgggagatcctagaggaggtcctcaacgggctgcacgccaaccccaccttcggcaacctgaaggacatcgggataactaccccctttggccaactccagcagcccaacggtatcctgctgtccgatgaggcgaaaatcagataccagtccccgacgggcctcttcgagcgcaccgtgagcctgaaggacctgtga

SEQ ID NO: 7794 - RNA, 4116 nt, synthetic construct
  misc_feature 1..4116: note = Cas9 variant
  source 1..4116: mol_type = other RNA
atgaaggtgaacaactaccacatcggcctggacatcgggaccagctccatcggctgggtcgccatcgggaaggacggcaagcccctccgcgtgaagggtaagaccgccataggcgcgcggctgttccaggagggcaacccggccgccgaccgccggatgttccgcacgacccgccgccggcttagccgccggaagtggcgcctcaagttgctggaggaaatcttcgacccctacatcacccccgtggactccaccttcttcgcccggctcaagcagagcaacctgtcccccaaggacagccgcaaggagtttaaggggagcatgctgttcccggacctcacggacatgcagtaccacaagaactaccccaccatctaccacctccggcacgccctgatgacccaggacaagaagttcgacatccgcatggtctacctggccatccaccacatcgtgaagtaccggggcaacttcctgaactcaacccccgtggactccttcaaggccagcaaggtcgacttcgtggaccagttcaagaagctgaacgagctctacgccgccatcaaccccgaggagtccttcaagatcaacctggcgaacagcgaggacatcgggcaccagttcctggacccgtccatccgcaagttcgacaagaagaagcagatccccaagatcgtgcccgtcatgatgaacgacaaagtgacggaccggctaaacggcaagatcgccagcgagatcatccacgccatcctggggtacaaggccaagctggacgtggtcctccagtgcaccccggtggactccaagccgtgggccctgaagttcgacgacgaggacatcgacgcgaagctggagaagatcctccccgagatggacgagaaccagcagagcatcgtggccatcctgcagaacctgtactcccaggtcaccctcaatcagatcgtgcccaacggcatgagcctgtccgagagcatgatcgagaagtacaacgaccaccacgaccacctgaaactttacaagaagctgatcgaccagctggccgaccccaagaagaaggccgtgctcaagaaggcctacagccagtacgtcggcgacgacgggaaggtgatcgagcaggcggagttctggtccagcgtgaagaagaacctggatgactccgagctgagcaagcagatcatggacctcatcgacgccgaaaagttcatgccaaagcagcgcacctcccagaacggcgtcatcccccatcagctgcaccagcgggagctggacgagatcattgagcaccagagcaagtactacccctggttagtggagatcaaccccaacaagcacgacctgcacctggcaaagtacaagatcgaacagctcgtggcctttcgcgtcccgtactacgtggggcccatgatcacgcccaaagaccaggccgagagcgcggagaccgtcttcagctggatggagcggaaggggaccgagaccggccagatcacgccctggaatttcgacgagaaggtggaccgcaaggcctccgccaaccgcttcatcaagcggatgaccaccaaggacacctacctgatcggggaggacgtgctgcctgacgagagcctcctgtacgagaagttcaaggtcctaaacgagctcaacatggtacgcgtgaacggcaagctgctgaaggtcgccgacaagcaggccatcttccaggacctgttcgagaattacaagcacgtgtccgtgaagaagctccagaactacatcaaggcgaagacggggctgcccagcgaccccgagatatccggcctgagcgaccccgagcacttcaacaactccctcgggacctacaacgacttcaagaagctgttcggtagcaaggtcgacgagccggacctgcaggacgacttcgagaagatcgtggagtggtccacggtgttcgaggacaagaagatcctccgggagaagctgaatgaaatcacctggctcagcgaccaacagaaggacgtgctcgagtccagccgctaccagggctgggggcggctgagcaagaagctgctcacgggcatcgtgaacgaccagggggagcgcatcatcgacaagctgtggaacaccaacaagaacttcatgcagatccagtccgacgacgacttcgccaagcggatccacgaggccaatgccgaccagatgcaggcggtcgacgtcgaagacgtgctggccgacgcctacaccagcccccagaacaagaaggccattcgccaggtggtcaaggtggtggacgacatccagaaggcaatgggaggggtcgcgcccaagtacatcagtatcgagtttacccggagcgaggaccgcaacccgcggcgcacgatctcccggcagcgccaactcgagaacaccctgaaggacaccgccaagagcctggccaagtccatcaaccccgagctcctgagcgaactggacaacgccgccaagtccaagaagggcctcaccgaccggctgtacctgtacttcacgcagctcggcaaggacatatacaccggggagcccatcaacatcgacgagctaaacaaatacgacatcgaccacatcctgccccaggcgttcatcaaggacaacagcctcgacaaccgcgtgctggtgctgaccgccgtcaacaacggcaagtccgacaacgtgccgctccggatgttcggggccaagatgggccatttctggaagcagctggccgaggccgggctgatcagcaagcgcaagctcaagaacctgcagaccgaccccgacacgatctccaagtacgcgatgcacggcttcatccggcgccagctggtggagaccagccaggtcataaagttagtggccaacattctgggcgacaagtaccgcaacgacgacaccaagatcatcgagatcaccgcccggatgaaccaccagatgcgcgacgagttcgggttcatcaagaaccgggagatcaacgactaccaccacgccttcgacgcgtaccttaccgccttcctcggccgatacctgtaccaccggtacatcaagctgcgcccctacttcgtgtacggggatttcaagaagttccgggaggacaaggttacgatgcgcaacttcaacttcctccacgacctgactgacgacacacaggagaagatcgccgacgccgagaccggcgaggtgatctgggaccgggagaactccatccagcagctgaaggacgtgtaccactacaagttcatgctcatcagccacgaggtctacacgctgcgcggcgccatgtttaatcagaccgtgtaccccgcgtccgacgccgggaagcggaagctgatcccggtgaaggccgaccgccccgtgaacgtgtacggcgggtacagcggcagcgccgacgcctacatggcgatcgtgcggatccacaacaagaagggcgacaagtaccgcgttgtgggcgtgcccatgcgggccctcgaccgcctggacgccgccaagaacgtctccgacgccgacttcgaccgggcgctgaaggacgtgctcgcgccccagcttaccaagaccaagaagtcccgcaagacgggcgagatcacccaagttatcgaggacttcgagatcgtactcgggaaggtgatgtaccggcagctcatgatcgacggcgacaagaagttcatgctggggagcagcacctaccagtacaacgcgaagcaactggtgctctccgaccagagcgtcaagaccctcgcctccaagggcagactggacccgttacaggagagcatggactacaacaacgtgtacacagaaatcctggacaaggtgaaccagtacttctccctgtacgacatgaacaagttccggcacaagctcaacctggggttcagcaagttcatctccttccccaaccacaacgtgctggacggcaacacaaaggtgagctccggcaagcgcgagatccttcaggagatcctgaacgggctgcacgctaaccccaccttcggcaacctcaaggacgtcgggattaccacgcccttcggccagctgcagcagccgaacgggatcctgctcagcgacgagaccaagatccgctaccagtcccccaccggcctgttcgagcggaccgtgtcactgaaggatctctga

SEQ ID NO: 7795 - RNA, 4116 nt, synthetic construct
  misc_feature 1..4116: note = Cas9 variant
  source 1..4116: mol_type = other RNA
atggacaagaagtacagcatcggcctggacatcgggaccaactccgtgggctgggccgtcatcaccgacgactataaggtgcccagcaagaagttcaaggtgctcggcaacacggaccgccacagtatcaaaaagaacctgatcggcgccctgctgttcgactctggggagaccgcggaggctacccggctgaagcgcacggcccggcgccggtacacacgtcgaaagaaccgcatctgctacctgcaggagatcttctccaacgagatggccaaggtcgacgatagctttttccaccggctcgaggaatccttcttagtggaggaggacaagaagcacgagcgccacccgatcttcggcaacatcgtggacgaggtcgcctaccacgagaagtaccccaccatctaccacctccggaagaagctcgcggacagcaccgacaaggccgacctgcgcctgatctacctcgccctggcgcatatgatcaagttccggggccacttcttgatcgagggagacctcaatcccgacaactccgacgtggacaagctgttcatccagctggtgcagacctacaaccagctgttcgaggagaatcccatcaacgcgagccgagtcgacgccaaagccatcctgtccgcccggcttagcaagtccagacggctcgagaaccttatcgcccagctaccgggcgagaagaagaacggcctcttcgggaacctgatcgcgctgagcttaggtctgacgcccaacttcaagtccaacttcgatctggccgaggacgccaagctccagctgagcaaggacacctacgacgacgacctggacaacctcctggcccagatcggggaccagtacgccgacctgttcctcgcggccaagaacctgtccgatgccaccctgctctccgacatcctccgcgtcaactccgagattacgaaagccccgctgagcgccagcatgatcaagcggtacgacgagcaccaccaggacctcacgctgttaaaggcgctcgtgcgccagcagctgcccgagaaatacaaagagatcttcttcgaccagtctaagaatggctacgcagggtacatcgacggcggggcctcccaggaggagttctacaagttcatcaagccgatcctggaaaagatggacggaaccgaggagctcctggccaagctgaaccgggaggacctgctgcgcaaacagcgcaccttcgacaacggctccatcccacaccagatccacctgggggagcttcacgccatcctccggcgccaagaggacttctaccccttcctgaaggataaccgggagaagatcgagaagatcctgaccttccgcatcccctactacgtcggcccgctcgcgcggggcaacagccgcttcgcctggatgacgcggaagtccgaggagaccatcaccccctggaacttcgaggaggtggtggacaagggtgccagcgcccagtccttcatcgaacgaatgaccaacttcgacaagaacctgcccaacgagaaggtcctgcccaagcacagcctcctgtacgagtacttcacggtgtacaacgaactgaccaaggtgaagtacgtcaccgaagggatgcggaagccggctttcttgtccggcgagcagaagaaggcaatcgtggacttactgttcaaaaccaaccgcaaggttacggtcaagcagctcaaggaggactacttcaagaagattgagtgcttcgacagcgttgagatctccggcgtggaggatcgattcaacgccagcttagggacctaccacgacctgctcaagatcatcaaagacaaggacttcctggacaacgaggagaatgaggacatcctggaggacatcgtcctcaccctgaccctgttcgaggacaaggagatgatcgaggagcgcctcaagacgtacgcccacctgttcgacgacaaggtgatgaagcagctaaagcggcgacattacaccggctgggggcggctctcccgcaagctgatcaacggcatccgggacaagcagagcgggaagaccatcctagactttctcaagtccgacggcttcgccaaccggaacttcatccagctcatccacgacgacagcctgaccttcaaggaggcgatccagaaggctcaggtctccggccagggacactctctccatgagcagatcgccaacctggccgggtcccccgccatcaaaaaggggatcctgcagagcgtgaaagtggtcgacgagttggtgaaggtgatgggccacaagcccgagaacatcgtcatcgagatggcacgggagaaccagacgacccagaaggggcagaaaaacagccgtgagagaatgaagcggatcgaggagggcatcaaggagctgggctcccaaatcctgaaggagcaccccgtggagaacacccagctccagaacgaaaagctgtacctgtactacctccagaacgggcgcgatatgtacgtggaccaggagttagacatcaaccgactgagcgactatgacgtcgaccacatcgtgccgcagtccttcattaaggacgacagcatcgacaacaaggtgctcacccgctcggacaagaatcggggcaaaagcgacgacgtgccctccgaggaggtggtgaagaagatgaagaattactggcgccagctgcttaacgccaagctcatcacgcagcggaaattcgacaacctgacgaaggccgagcgcggtggcctgagcgagttggacaaggccggcttcatcaagcggcagctggtcgagacccgccagatcaccaagcacgtggcccagatcctggattcccgcatgaacaccaagtacgacgagaacgacaagctcatcagggaggtgaaggtcatcacgctcaagagcaagctggtgtccgacttccggaaggacttccagttctacaaggtacgagagatcaacaactaccaccacgcgcatgacgcctacctcaacgccgttgtgggtaccgcgctgatcaagaaataccccaagctggagagcgagttcgtgtacggcgactacaaggtctacgacgtgcggaagatgatcgcgaagagtgagcaggagatcggcaaggccaccgccaagcgcttcttctacagcaacataatgaacttcttcaagaccgaaatcacgctcgccaacggcgagatacggaagcgccccctgattgagaccaacgaggagaccggggagatcgtgtgggacaaaggccgggacttcgccaccgttaggaaggtgctgtccatgccccaggttaacatcgtcaagaagacggaggtgcagaccggcgcgctcaccaacgagagcatctacgcccgcgggtccttcgacaagctgattagccgcaagcaccgctttgagagttccaagtacggcgggttcgggagccctaccgtgacgtacagcgtcctcgtggtggccaagagcaaggtccaggatgggaaggtgaagaagatcaaaaccggcaaggagcttatcggcatcaccttattggataagctcgttttcgagaaaaatcccctgaagtttatcgaagacaaggggtacggtaacgtccagatcgacaagtgcatcaagctgcccaagtattccctcttcgagttcgagaacgggacccggcgcatgctggccagcgttatggccaacaacaactcccggggcgacctgcagaaggcgaacgagatgttcctgcccgccaagctggtgacgttgctctaccatgcccacaagatagagagctccaaggagctggagcacgaggcctacatcctggaccactacaacgacctctaccagctgctgagctacatcgagcgcttcgcctccctctacgtcgacgtggagaagaacatcagtaaggtgaaggagctgttctccaacattgagtcttactccatcagcgagatctgctccagcgtcatcaacctgctaaccctgaccgcttccggtgcccccgcagacttcaagttcctgggcacgacgatcccccggaagcgctacggcagcccgcagagcatcctctcaagcacgctcatccaccagtccatcaccgggctgtacgagacccggattgacctcagccagctgggctccgactga

SEQ ID NO: 7796 - RNA, 4119 nt, synthetic construct
  misc_feature 1..4119: note = Cas9 variant
  source 1..4119: mol_type = other RNA
atgaacaacgagtacttcgtgggcttcgacatcgggaccaacagcgtcggcgccgctgtgaccgacgagaagtaccacgtgctgaagttcaaggggaatgcgatgtggacgtccgccgtcttcgagagcgcccagcagtctgccgatcgccggctcaaccgcaccgcccggcgccggctggaccgcagccagcagcggcgcgacctgcttcaggagctcatcgcgcccgccatcaccccggtcgacccccggttcttcgaccgcatccgggagtccgccctgtgggccgaggacaagaccacgggcagccgctttacctacttctccgacgaggggtataccgacaagcagtaccacaaagagtaccccaccatccaccacctcatctgcagcctgatgaacgaccccgcgccgcacgacccccggctggtgtacatagcctgctcctacatgctcacgcaccgcggccatttcctgaacgaggccgacaaggagaaaatcgacgacgtcctggacatccggcgcgtgttcaacgagctctgcagctggttcacctcctacggcatcgaggtgccctttagctgcttccccgaggagttcgggaacgtcctgaccgccaaccggggcgtgcaggaccgcacccgggccttctacgacctcctcttcgcggggaaaaagccgaaaccctccgaggacgatcaggtggacatcgacgtcctgatcaagctgatcagcggcgggaagatcgagctctccaagctgttcctgaacgaggagtactcggagttggagaacaataagatccagctgtcagacgccggcttcgacgagaaggagccagagctgcgcagcgagctcggcgacgacttcgggctagtagccgccgcgaagaacatctacgactggtccctgctcacgggcgtgctgggggagtgcaagagcatcagcgaggcgaaggtaaagacctacgagaagcactccgaggatctggccgccctcagacgcgtggtgcgcaagtaccacccagacaagtacaaggagatcttcaagaagtacgtcgtgggaaactacaccagctactccggcaacgtcaagagtgccgggaagatctctgagaccaagctgaagcggtgcaaccaggccgagttctgcgactacctcaagagcaaacttaaggacgtgaagccggcgccaggcgacgacgagtgcgagcgcgtgctgaaggagatctccaagcacacattctgcccccgccaggtgaccactgacaaccgggttatcccctaccagctgtactacactgagctcaagaaggtgctggagaacgcaaagcggtacataccgcagctgaacgtcacggacgagtatgggagcgccgccgacaagatcctctccctgatgaccttccgcatcccctactacgtgggccccctggtgaagaagaacgacagctccaacgcctggatcgtccggcgcggggagggccggatcctcccatggaacttcgacgagctggtggacaaggacaagtgcgaggacgagttcatccgccggatgacctgcaagtgcacctacatcgcgggcaagaacgtgctgccgaagaacagcctcctgtactgcaagtttatggtcctgaacgagatcaacaacatcaagatcaacggggagcgcatctcggtgggcgacaagcagaagatctacacggagctgttcgagaagaagcggaaggtgaccgtccgcgatatccggaacctgctgaccagcgaggggcgcctgaaggccggcgacaccttcgggggcatcgacatcacggtgaagtccagcctcaagccccagcacgacctgaagcggctgatggccgccggagtgatcaccgaggcggacgccgaggagatcatcgagcgcatcacgtgcaccaccgacgtctcccggctccgcacctggctggggaagttcggcctgagcgccgccgacgccaagtacgtgtcggggctcaagtacagcgacttcggccgcctgagccgggagttcctgaccgaggtgaacgacgtcgaccccgcgaccggggaggtgatcaaccccaacatcatcacgatgatgtgggagaacaacatcaacctcatggagctgctgtcccagaagtacagctaccgctcccagatcgagagcatgaaccgcgagtactacgccgccaacccgctcaccctggacgagagaatgtccgagatgtacatccccagcgccgtgcggcgacccgtcaagcggaccatcgaaatgatgaaggagtacatgcacatcatgcgcaagcccccgaagcggatcttcatcgagatggcccgcgagctgaccgacctcgacaacaagggcaagcggacctccagccgccggaacacgctgctggagttcttcaagaagtgcccccaggacaccaccgagctccgcgcgcagctggagaagaagagtgacgacgagctgcggagcgagaagctctacctgtacttcgcccagctgggcaagtgcatgtactccggggagagcatcgacatcgagcgcctcggctccaagctgtacgacgtggaccacatcttcccccaggcccgggtgaaggacgacagcatcgagaacaaggtcctggtgctctccgacctgaacggggccaagagcgaccgctacccgatcaacgccgacattcggaacaagatgcactcattctgggacaagctgcacagcatcggcctcatcggcgagaagaagtacgagcgcctgacccggagcacggggttcaccgacgacgagctggcgggcttcatctcccgccagctcgtggagacccgccagagcaccaaggccgtcgccgccctgctggcggaggagttccccgagtccgagatcgtgtacgtgaaggccgggctcgccagccagttccggcacgagttcggcttgctgaagtgccgcgagatcaacgacctccaccacgccaaggacgcatacctgaacatcgtcatggggaacatctaccacgtgaagttcacgaaggaccccatgaacttcgtgaaggagtacaggcgcaaggagcaggtcttcgacctgaagatccagtccatgctcacccacgacgcgatccggaacggcgagaccgcctggatcggcgacgggacctggctggagacggtgaagaagcagatggagaagaataacatccgctacgtgcgctacagcttccgccggaagggcgccctgttcaacctcatgccggagcgcaaaaacccgtccctgctgccaagaaagaacgggaagaacatggtcctccccgccgagaagtacggcgggtacaacaacaccgccgcgagcttcttctccctggtgaagtaccacagcgccaagggcagcggcgttgtcatcatccccgtggagctgatccacgcccaccgctacgagcatgacagctcattcgccgaggagtacgctctccgggtgctggcggacatcgtcagcctgaagaaaggggacgtactccagtccgtggagttcccgctgggcagccgcatcctgaaggtcaacaccctcctggacatcgatgggttccgggccaacatcaccgggaaggactccgggggcaagtacctgggcatcagctccgccagcagcctcatcatctcccaggtggacacgacctacatcaagcgcgtgatcagcatcaacgagcggatctccgcctgcgagaagaacaagcagagctacaccatccgccccgagttcgacgtcatcacctccgagcggaacatcgagatctacaatatgctgtgcgagaagatcagctcccgccccttctgcatcaagttcgcgaacacgagcgacaccttcgtgtccggtcgcgagaagttcatcgccctgagcctcaacgagcaggtcaagaccctgaccaacatgctgtccgtgttcaagacgggccgggccagcgggtgcgatctcaccaacatcggcggctccaagaacaccgccatcgtgaagctgaacgccgtgctgagcaacctcaaggacttcaagtccgtccgcatcatcgaccagagccccaccggcctgtacgaaaaggtgtcgccgaacctgctcagcctgtga

SEQ ID NO: 7797 - RNA, 4119 nt, synthetic construct; identical to SEQ ID NO: 1997
  misc_feature 1..4119: note = Cas9 variant
  source 1..4119: mol_type = other RNA

SEQ ID NO: 7798 - RNA, 4119 nt, synthetic construct; identical to SEQ ID NO: 1998
  misc_feature 1..4119: note = Cas9 variant
  source 1..4119: mol_type = other RNA

SEQ ID NO: 7799 - RNA, 4119 nt, synthetic construct
  misc_feature 1..4119: note = Cas9 variant
  source 1..4119: mol_type = other RNA
atgaacagcgacaagcgcgaggactactacgtgggcctggacatggggaccggctccctcgggggcgccgtcacggacacgcagtatcacctcctgaaggtgaaggggaaggacttctggttcgtgcgagagtacgagaccgccaagagccagctggatcgccggacacaccgcatcgcgaagcggcgcctgcagcggcacaaggcccgaatcggcctaatccggtcctacttcgccgaggacatcctcaagcacgaccccctgttctacatccgccaggacaacagcaagtactaccacgaggacaaggacgtccggctgaccacgaaggactccatcttcgccgacccgggctacggggacaaggagtaccttgacgacaaggagtaccccaccatcttccacctccgccaggccctgctgcgggaccagatcaaggacgaggagcgctacagccgtttcctgtacctggcgattatcaacatgttcgagcaccgcggccacttcctcctgaacaccgagtccagcgatctgaacgccgacatgatcaaggacgtgggggagctcgtgatgaacgccatttgcggcgtctccgagtacgggagcgtgacctacaaggagatcatcgagatcctggaggacaagaacatctcccggacggccaagaaggaccagatcgcaagcaagatcgacatcaaaaagagcgagaaggcccagatggagcgcatcaagtgcctgtgcggcatggaggccgacgcccgggtgatgttcgagatcgaggccgacgagaagatcaagatcgcgttccagcaggccgccttcgaggacgagaaggaggagatcgaggccgtcatcggcgaggaccgctacctcatcatcgagaacatgaagcagctgtacgactacagccaactgcagtccgtgctcaacgggttcgactacctgagtgacgcccgggtgcagatgtacgagaagcacaaggaagacctgcacctcctgaagaaggtctacaggaagaacctggaccgcgagatctacgaccggatgttccgctccggcgaggaggggtcgtactgcgcgtactccaacagcaccaacagcgtggactccctcgccgaggccaagaagtaccggcgcaacatgaagaagcggtcgcagaaggacctgtacgaccgaatcaagaaggacctgaaggaggtccacgacgccgacgccgacgcgatccggaaggagatggagctcgagcgcttcctgcccaagcagatcaccggcgccaacggcatcatccccaaccaggtccatagaaaggagctgaagaagatcctcgagaacgccgaacaccacctggacttcctgaaggagaaagacgagtccgggtacaccgtgtccgagcgcatcctcatgctgttctccagcaacatcccctactacgtgggccccgtcgggtccggcagcaaaacggggtgggccaagatccaggagtccggccaggtgctgccctggaacatggagcagaagatcgacatcgagcagaccagtgagcggttcatcaccaacctcatccgcgagtgcacctacctgtccggcgagaaggtgctgcccaagcagagtctcctgtacgagtcctactgcgtcctgaacgagatcaacaacctccggatccacgggaagcgcatcgtgccagagctgaagcaagacatctacaaggaggtgttccagggcttccggctggggaagaaggtcacgaagaagaacatctgcacctacctgatcaaccgcggcctcatcaccgaggagagcgaggtgtccgggatcgacaaggagatcaacgcctacctgcccagttacggcaagatgtacggcgtcttcggggagcggctgcgcgaggaggcggtgcaggagatcgccgagaagatcatctactacggcaccatctacggagacgccaagtccatgttccggaagaagctcaaccagtacgtgagcgacggctggatgacggagtaccaggccaagcgcatctccgggtacaagttcaaggactgggcgcgcttgtcccggagcatgctgtgcctctccggctgcgacaagagcaccggcgagaagatctccctgatccgcgccatgtgggagtacaacctgaacttcatggagctcatttaccgggaggacttcaccttccagaaggagctggaggagcgccggaaggccctggggaagaccctccaggagttccagttcgaggacctggacgagtactactacagcgcccccgtcaagcgcatgatctggcaggccgtgcaggcgctgaaggagatcacgcagatcatgggccacaaccccaagcggatcttcatcgagatgacccgcaccgaggaggagaagggggagcagggccggaagaactcccgcgagaagcgtctcctgaagatgtacgagagcatccgcgacgagcggaattgggccgccgagatcaagaacgctaatgcctccggcaagctgaacagcaagaagctctacctgtactacctgcagatggggcgcgacgtgtacaccggcgagccgatcgacatcgaagacctcttcgacgactcacggtacgacatcgaccacatctacccacgcagcctgacgaacgacaacaacatcgagaacaacctggtcctcgtgtccaagaccatcaaccagaacgaaaagaagaacgactaccccgtgcccgagaaaattcggcgcaacaagaaggtccggaacctgtggcacaccctgcacaagatggggttcatgaacgacgagaagtacaaccgcctcacctcgacggagcggctgtccgaggaccagctggcgggctttatcgcccgccagctcgtggagaccgcccagggggccaagggcatcgccgagctgatgaaggcgatgctgccgggaaccgacatcgtctacgccaaggcccgcaacgtcagcgacttccggaaggagtacaagatgctgaagtcccgccttgttaacgactaccaccacgcccaggacgcgtacctgaacatcgtagtcgggaacgtgtactttatgaagttcacccggaaccccatgaactttgtgaagacggaggcccgccgggacggccgcaactacgactacaacctctacaagatgtacagcaaggacatcatccggaacggggagaaggcctggattgccacctccgagcagggccccgggaccatccggctggtcaaagagaccatgggccggaacacccccatcatcacgcgccaggccttcgagcagcggggcgagctgttcaacctccagccggtggggaagtacagcgcgaagaaggacaactacgtgcccctgaagatcaacgacgagaagatgcaggacgtcagcaagtatggcgggtacacctctctgaaccccagctacttcatcttcatcgagcacggccccgaaaagaagcgcaagaagtgcttcgaggtcatccactcctactacgccgcccagatcaagaccgagaaggacctcattgacttcctgctgcagaaggggtacaagaacccgcgggtgatcaacgcccgcatcaagaagaacgccctcatcaaatacaacggctacttcctgtacatcatcggcatggatgcgcggaagaacatcgagttcagcaacgccaccgccatgtgcctgaagaacaagtacatacaatacgtctgtaagctcgagaagatgaacaaggccatcctgctgtctgagaagcagaagacgaacctccattgggatgagaaaatcacttgcgagagcaacctggagctgtaccgcgagctcaccgagaagcacttacactccatctaccaacggcacccccgcagcatcgggaagtgcctggccgacggcgagggggcgttcaagctgctggacatcgaggagcaggtcaagatcatctgcgacatcgtgcagtacacctccttccagcggggcgtgttcagtctgaaggtgcttgggggccccaaggaggtggggcgcatccgcatctccgggaacatgaccgaggccaaggagtgcaagctggtcaactacagcatcaccggcatgtacaagaccgagatggacctgctcaagaagtga

SEQ ID NO: 7800 - RNA, 4122 nt, synthetic construct; identical to SEQ ID NO: 2000
  misc_feature 1..4122: note = Cas9 variant
  source 1..4122: mol_type = other RNA

SEQ ID NO: 7801 - RNA, 4122 nt, synthetic construct
  misc_feature 1..4122: note = Cas9 variant
  source 1..4122: mol_type = other RNA
atggagaagacatacagcatcggcctggacatcgggaccaactccgtgggctggagcgtcatcacggacgactacaaggtgcccgccaagaagatgaaagtgctcgggaacaccgacaagaagtacatcaagaagaacctgctgggcgccctcctgttcgactccggggagaccgcggaggtcacccgcctgaaacggacggctcgccggcgctacacgcggcgcaagaaccggctccgctacctgcaggagatcttcgccaaggagatggccaaggtggacgagagcttcttccagcggctggaggagtccttcctcaccgacgacgataagacttttgacagccacccgatcttcggcaacaaggccgaggaggacgcgtaccaccaggagttccccacgatctaccacctccgcaagcacctggccgactccagcgagaaggccgacctccggctggtgtacctggccctagcgcacatgattaagttccgcggccacttcctgatcgagggggagctgaacgccgagaataccgacatccagaaactgttcaacgacttcgtcgagacctacgacaagatcgccgacgagtcccacctgagcgaggtggacgcctccagcatcctgaccaacaagatctccaagagtcggcgcctggagaacctaatcaagcagtaccccacagagaagaagaacaccttattcggcaacctcgtggccctggtccttgggctccagcccaactttaagaccaactttaaactgtccgaggacgctaagctgcagttcagcaaggacacctacgacgaggacctcgaggagctgctgggcaagatcggggacgactacgccgacctattcacggccgccaagaacctgtacgacgccatcctgctctccggcatcctgacggtggatgacaacagcaccaaggcgccgctgtccgccagcatgatcaaacggtacgaggagcaccacgaggacctcgagaagctgaagaagttcatcaaggtgaacaacttcgataagtaccacgagatcttcaaggacaagagcaagaacggctacgccgggtacatcgagaacggcgttaagcaggacatcttctacaagcacttaaaatccatcatcagcgagaagaacgggggccagtacttcctcgacaagatcgagagagaggacttcctgcgtaagcaacgcaccttcgacaacggctccatcccccaccagatccacctccaggagatgcgggccatcctgcgccggcagggggaatactaccctttcctgaaagagaaccagagcaagatcgagaagatcctgacgttccgcatcccctactacgtgggcccgctcgcccgcaagaactcccggttcgcgtgggccaagtaccacagcgacgagcccatcaccccctggaacttcgacgaggtggtcgacaaggagaagtccgccgagaagttcatcacccgcatgaccctgaacgacctgtacctgcccgaggagaaggtgctccctaagcacagccacgtgtacgagacgtacgccgtctacaacgagctgaccaagatcaagtatgtgaacgagcaggggaaggagtccttcttcgacagcaacatgaagcaggagatcttcgaccacgtgttcaaggagaaccggaaggtcaccaaggagaagctgctcaactacctgaacaaggagttccccgagtaccgcatcaaggacctgatcggcctcgacaaggagaacaagtccttcaacgccagcctggggacctaccacgatctgaagaagatcctggacaagtccttcctggacgacaaggtgaacgaggaggtgatcgaggacatcatcaagacgctgaccctcttcgaggacaaggacatgatccacgagcggctgcagaagtacagcgacatcttcaccgcaaaccagctgaagaagctcgagcgccggcactacaccggctggggccgcctgtcctacaagctgatcaacgggatccggaacaaggagaataacaagacaatcctcgactacctgatcgacgacggcagcgccaatcgcaacttcatgcagctgatcaacgacgacaccctccccttcaagcagatcatccagaagtcccaggtcgtgggggacgtagacgacatcgaggccgtggtgcacgacctgcccggcagcccggctatcaagaaggggatactgcagtccgtcaagatcgtggacgagctcgtgaaggtcatgggcggcaaccccgacaacatcgtgatcgagatggcgcgggagaaccagaccacaaaccgcgggcggagccagagccagcagcgcctgaagaagctgcagtccagcctcaaggagctgggctccaacatcataaacgaggagaagcccagctacatcgaggacaaggtggagaactcccacctccagaacgaccagctgttcctgtactacatccagaacgggaaagacatgtatacgggcgacgagctggacatcgaccatttaagcgactacgacatcgaccacatcatcccccaggccttcatcaaggacgacagtatcgacaaccgagtcctgaccagctccgccaagaaccgcggcaagagcgacgacgtgccgtccttagacatcgtgcgggcccgcaaggccgagtgggtccggctctacaagagcggtctgatctccaagcgcaaattcgacaacctgaccaaggcggagcgcggcgggctcaccgaggccgacaaggccggcttcatcaagcggcagctggtggagacccgccagatcacgaagcacgtggcccagatcctagacgcccggtttaacaccgagcacgacgagaacgacaaggttatccgcgacgtgaaggtgatcaccctcaagagcaacctggtctcccagttcaggaaggacttcgagttctacaaggtgcgcgagatcaacgactatcaccacgcgcacgacgcctatctgaacgccgtagtcgggaccgcactcctgaagaagtaccccaagctggcccccgagttcgtgtacggcgagtacaagaagtatgacgtgcggaagctcatcgccaagagctccgacgaccacagcgagatgggcaaggcgacggccaagtacttcttctacagcaacctgatgaacttcttcaagaccaaggtaaagtacgccgacgggtccgtgtacgagcgccccatcatcgagaccaacgcggacggcgaggtggtctggaacaagcagaaggacttcgagatcatccggaaggtgctgagctacccccaggtgaacatcgtcaagaaggtggaggagcagaccgtggggcagaacggcggcctcttcgacaacaacatcctggccaaaccggaaaaggacgacaagaagaagctgttcccaatcaagaagtccctcagcacgacatcctacgggggctacgcccgcgccaccatcgcctactcaatcctgatcgtctccgagttcgggaagaacaaggagctgaaactcctgggcctgcccctcctggacaaggtgaagtacgagaagaacccgatcgcgtacctgaacagcatcgggatcattaacgtcaagtccatcttcaagctccccaagtactgcctgttcgagttccaggagaagaacaccaactaccggcgctacatggtcagcaaccaggagctgaagcgggccaaccagctgttcctgacgtgcaaggagaccgagctggtgtacaagtacatcaagtccgacaacgataacacccacctcgtgggcaatgagaagaccatcctgagcatctggaacaagctggtcatcttcatggagcgcacgaagctcatagacaagaagctgttcgcctccctgaagcagctcaaggacgaggtgaacctgatcaacatcctggacatcgccagcaagtccatcgacttcaccaagatcagcgccgggcagaagaagatcgtgctcaacgactccctgagcctacccatcaagcggtggcagttcaagagtgacgagaagatgctcaagcagctgaacgacgctaccctgatccaccagagcatcaccggcctctacgagacgcgcatcgacctgagcaagctgggcgaggagtga

SEQ ID NO: 7802 - RNA, 4122 nt, synthetic construct
  misc_feature 1..4122: note = Cas9 variant
  source 1..4122: mol_type = other RNA
atgaacttgagacgcgcaagagactacagcataggacttgacctcggcacaggcagcgtaggttgggccgtgacagacgccgagggcaacctctatagcttcaagggtcgacccgccatgggcagccgcacattcccaaacgcagagccggcaagcgtcgctcggatcccgcgaggacaaaggcgccgttacgaaaggcgccgccaaagaataaaacttctccagcagttctttatgtccgacatggagcgagtagaccccgactttttcacccgcctaaaccaatcaacactcctcgcagaagacaaagacgaacggatagcaagctgcgcctggcccatcttcaacagtagcgatttcacagaaaaggactactacaaaaagttccccaccatttaccacctccgcgccttcctctgcgaatccgacgaaaaaggcgacctaaggctagtatacctagcattacacaacatagtaaaacatcgaggcaacttcttataccaagataacccagcactgagcgcaagcgatgcttctgtcgacgaggcggtccgccagctcgtcgacgccctcgccgaatggtgccagaacaaagaaatagagctgagctgtgacgccggtcggataatcgaagtattcggcgacgcctccttacggaggaccgacaagagagatcaactaaagggcctcctagggcttccagcagacctcgccaaaactatggggaaagaactagcctccgccgtactcggctacgcagccaacttctctaaaatattcctaataagcgacgccgaacacaaattctcactgggcaacgacgagaaagtagaagagttcgaaaccatatgtcctaacgaatgcaccagcctcttcagcgcactaagaacagcctactcggcctatctactatccggcatcctccgcgacgcgaatggcaaaacactctccttctgcaaaaagaaagaatatgacagatatcacgatgacctggcgctgctcaaagccctagttcgcgaatacgcccccgagagttaccagagctttttcggtggcgaacgcctcgtggtaaacggtcgtatgacaaagcgatacgacccgaccaaggccaaaggatacaccaagtacgacctagtacactcagccggatcttacgacgaactcgccaaagacgtgaagaagctcctcggcagtctcgccgccgacgacagcaggtaccaaaggatgatgcaagcattcgacgaagaacgattccttcgccgcctcaaaacaagcgacaatggatccattccctaccagctacacctcgaagaattaagagcaataatagcccgccaaggtgagttctacccattcctcaaagaagaatccaagaaaatagaatcacttgtcagcttccggataccctactacgtaggccccctaacgaccaaaaatgccgcagtcgacgttcacgggaacaaacgatttgcctggagcgaacgcaaaccaggaatggagtctgcgaaagtccgaccctggaattgggacgacgtaatcgacaggggaaagtcggcagaaaatttcatcgtcagaatgaccggaacctgcacctacctacaaaacgagaaagttctgcccaaatgctcgctcttgtacgaggagttctgcgtcctgaatgaactgaacggagcgcactggagcgcagacggagaccacgagtgtccattcgatacatctgaccgacgtggtatagtacaagacctcttctgcggcaaacggcgcgtcagctacaagcaagtagaggactggttgagacaacacggctcccgccgcgcgagagtatctggaggccaaggggcgagcggcttcgaatctaagatgtccagttacatattcttctccaaagacgtactgcacgtagaccgcatcgatccagcggatttcccaatgattgaggaaatcatactatggaacacgctgttcgaggaccgggacatcctaaaagaaaggatcgaagaagcctatggagaccgactcaacgccgaacaaattaaaaccatatgcaagaaacgcttcacaggctggggccgcctctcacgacgtctgctgaccggtattaaagcgcagacagaccagggcgacctctctatcatggacatcctccgcgaaggcgacccaaacaatgaccacagaggcaaggcaatggtcttcatgggaatcctacactccgaggatcttgggttccagaagaaaatcgaccaaataaaccaggaaaaagtatcagcgggaaaagtatctctcgaggacctccccggctcccccgcgctccgccgcagcataaaccaagccatgcgcgtagttgacgaaatcgtaagcatcgcaaaatgcccaccctcgcacatttacctcgaggttacacgggacgaagacggagctcggaaagggcgaagaagtacccgaagatacgacgccataaaagccgcgcttgaaaaatttaaagaggagagccccacgtggttcgaccaagacgtcttcggcgaatttaggcgcagcagggcagaggacctagacgaacgactatccctctacttcatgcaaggtgggaagtcactgtactcggccacacccctcaaactggaacttcttcatacgaaccaataccaggtcgaccacataatcccccaatcatacataaaagacgactccttcgaaaataaggccctggtgctagccggtgaaaaccaacgcaaaagcgacgcactcctaatagatagctcgatacgcaccgccatggcaccatattggagagccctccaccaagcgggcctcatgggcgacaagaaattcaactccctcatgtgctcaagcatttcagataaacgagtcaggggattcattgcacgccagcttgtcgaaacaagccagattgtcaaactagccggaatgatgctccaaagcaactatcccgaagcagacgtgcaacccgtaaaagcgagcctaggacacgacctacgcgtacaagccggcttcataaaatgccgagaagtcaacgacttccaccacgcacacgacgccctaattgcatgcgaggtaggccgctacattaaccaatgccaccccggcatctacgacaacccaataggctacgccagagcagtgcgcgaactcgtccgaaaacaaaacgaggaaatgagaaagtacggacggctccccggatccgcaggcttcatcgtaggaggcttcatgcggacacacgtagacgtcgatactggcgaagtcgtatgggacgccgaagaagaactaagccgtattcgggcatacctggactactccaacgtattcgtcacaagaatgagcgaagagacctccggggcgctatggaacgcaaccatatactccccacactacggaaaaactgcgccaacgttacatataaaacaaggcctggatgtgcaacgttacggcggatactcaagcgcaactttcgcgtacttcaccctctacgtagcagagaagggcaaaaagcgaaaggcagaactactgggcatcccaataagcgttgcaaggaaaatcgaaggcgagccatccaaactggacgccttcgtagcgcaagatgcagaagccaagaaactaaaacacccacttataatccgagcccgaatactcaaatatgcacgatttgagatggaagggaatcaattctacttcgcggcgcaggacgccgtgtattcagcccgccaattggtactcaagggagacctgtactcagtcgccgcaaaagcctgcgacaaacatctgaacgacagttgcattagcaacgaagacttaatacgcctatatgacgaactcgtccacaaaggtgatctcttatgtaacaaattcggcaatgtaacagacgtcctaagagccgggcgcgaacgttacgcggggctaagcatatcagaaaaacgacagctagtttgcaatgtcctggcctactatagatcagccaccgctcgcgtagacatcagtctggtaggaggcccaaagcacgcaggcaacctaggaatagcgttcgtgttaaacaacccggaagccatcgtatttgtcgaccaatccgtaaccggaatgtttgaaaaacgcaccagggtagaactatga

SEQ ID NO: 7803 - RNA, 4122 nt, synthetic construct; identical to SEQ ID NO: 2003
  misc_feature 1..4122: note = Cas9 variant
  source 1..4122: mol_type = other RNA

SEQ ID NO: 7804 - RNA, 4122 nt, synthetic construct
  misc_feature 1..4122: note = Cas9 variant
  source 1..4122: mol_type = other RNA
atgaccaagaagaactacagcatcggtctggacattgggaccaactccgtgggctgggccgtcatcacggacgactacaaggtgcccgccaagaagatgaaggtgctcgggaacaccgacaagaagtacatcaagaagaacctgctgggcgcgctcctgttcgacagcggggagaccgcggaggccacccgcctgaagcggacggcccgccggcgctacaccaggcgcaagaaccggctccgctacctgcaggagatcttcgccgaggagatgaccaaggtcgacgagtccttcttccagcggctggacgagagcttcctacgctgggacgacgacaacaagaagctgggcagatacccgatcttcggcaacaaggcggacgtggtgaagtaccaccaggagttccccaccatctaccacctccgcaagcacctcgcggactccagcgagaaggccgacctacggctggtctacctcgccctggcgcacatgatcaagttccgcgggcacttcctgatcgagggcgagctgaacgccgagaacacggacgtgcagaagatcttcgccgactttgtgggggtctacgaccggaccttcgacgactcccacctgagcgagatcaccgttgacgccgcctccatcctgaccgagaagatcagcaagtcccgccggctcgagaacctgatcaagtattaccccacggagaagaagaacaccctgttcggcaacctcatcgcgctggccctcgggctccagcccaacttcaagatgaacttcaagctgagcgaggacgccaagctgcagttctccaaggacagctacgaggaggacctcggcgagctgctgggcaagatcggggacgactacgccgacctcttcacctccgccaagaacctgtacgacgcgatcctgctcagcggcatcctgattgtggacgacaactccaccaaggccccgcttagcgcctccatgatcaagcgctacgtcgagcaccaggaggacctcgagaagctgaaggagttcatcaaggccaacaagagtgaactgtaccacgacatcttcaaggacaaaaacaagaacgggtacgccggctacatcgagaacggcgtgaagcaggacgagttctacaagtacctcaagaacacgctgagcaagatcgcggggtccgactacttcctggataagatcgagcgggaggacttcctccgcaagcagcggaccttcgacaacggcagcatcccccaccagatccacctccaggagatgcacgccatcctgcgccgccagggggattactaccccttcctgaaggagaaccaggaccggattgagaagatcttgaccttccgcatcccctactatgtgggcccgctggcccggaaggactcccgcttcagctgggccgagtaccactccgacgagaagatcaccccctggaatttcgacaaggtcatcgacaaggagaaatccgccgagaagttcatcacgcggatgaccctgaacgacctctacctgcccgaggagaaggtgttacccaagcacagccacgtgtacgagacctacgcggtctacaacgagctcacgaagatcaagtacgtgaacgagcaggggaaggacagcttcttcgactccaacatgaagcaagagatcttcgaccacgtgttcaaagagaaccgcaaggtcacgaaggagaagctgctgaactacctcaacaaggagttcccggagtaccggatcaaggacctgatcggcctggacaaggagaacaagagcttcaacgcctccctcggcacctatcacgatctgaagaagatcctggacaaggccttcctcgacgacaaggtgaacgaggaggtgatcgaggatatcatcaaaaccctgaccctgttcgaggacaaggacatgatccacgagcgcctccagaagtactctgacattttcacggccgaccagctaaagaagctggagcggcgccactacaccgggtggggccggctctcctacaagctgatcaacgggatccgcaacaaggagaacaacaagaccatcctggactacctcatagacgacggcagcgcgaaccggaacttcatgcagctgatcaacgacgacaccctgcccttcaagcagatcatccagaagtcccaggtcgtgggggacgtcgacgacatcgaagccgtggtgcacgacctccccggaagccccgccatcaagaagggcatcctgcagtccgtcaagatcgtggacgagctggtgaaagtcatgggggacaacccggacaacatcgtgatcgagatggcccgcgagaaccagacgaccaaccggggccgcagccagtcccagcaacggctcaagaagctgcagaacagcctgaaggagctcgggagcaacatactgaacgaggagaagccctcctacatcgaggacaaggtggagaacagccacctccagaacgaccagctgttcctgtactacatccagaacggcaaggacatgtacaccggggatgagctggacatcgaccacctgtccgactacgacatcgaccatatcatcccccaggccttcatcaaggacgacagcatcgacaaccgcgtgctgacctccagcgcgaagaaccggggcaagtccgacgacgtgcccagcctagacatcgtgcgcgcccgcaaggccgagtgggtccggctctacaagtccggcctgatcagcaagcgcaagttcgacaacctgacgaaggccgagcgcggtggcctcaccgaggccgacaaagcggggtttatcaagcggcagctggtggagacccggcagatcaccaagcacgttgcccagatcctggacgcccgcttcaacaccgagtccgacgagaacgacaaggtcatccgggacgtgaaggtgatcacgctcaagagcaacctggtctcccagttccgcaaggacttcgagttctacaaggtgcgggagatcaacgactaccaccacgcccacgacgcctacctgaacgctgtggtcggcaccgcgctcttgaagaagtacccgaagctggccagcgagttcgtgtacggcgagtacaagaagtatgacatccgcaagttcatcaccaactccagcgacaaggccaccgcgaagtacttcttctactctaacctcatgaacttcttcaagcgggtgatccgctacagcaacgggaaggtcatcgtgcgtcccgtggtagaatacagcaaggacaccgaggacatcgcctgggacaagaagtccaacttccgcaccatctgcaaggtgctgagctacccccaggtgaacatcgtgaagaaggtggagacccagaccggcgggttctccaaggagagcatcctccccaagggcgactccgacaagctcatcccgcggaagacgaagaaggcctactgggacaccaagaagtacgggggcttcgacagccccaccgtggcctactctgtcttcgtggtggccgacgtcgagaagggcaaagcgaagaagctgaagaccgtgaaggagctggtggggatcagcatcatggagcgctccttcttcgaggagaaccccgtagagttcctcgaaaacaagggctaccacaacatccgggaggacaagctgatcaagctgcccaaatacagcctcttcgagttcgagggcgggaaacgccggctgctggcctccgccagcgagctccagaaggggaacgaaatggtgatcccgggccacctggtgaaacttctctaccacgcccagcgcatcaactccttcaactccacgaagtacctcgactacgtctccgcccacaagaaggagttcgagaaggtgctgagctgcgtggaggacttcgcgaacttatacgtcgacgtggagaagaatttgtccaagatccgggccgtggccgacagcatggacaacttctccatcgaagagatctccaactctttcattaacctgctcaccctgaccgccttaggcgcccccgcggacttcaacttcctcggggaaaagatcccccgcaagcgctacacctccacgaaggagtgcctgaacgccaccctgatacaccaaagcatcaccggcctctacgagacccggatcgacctgtccaagatcggggaggagtga

SEQ ID NO: 7805 - RNA, 4122 nt, synthetic construct
  misc_feature 1..4122: note = Cas9 variant
  source 1..4122: mol_type = other RNA
atggagaacaagaactacagcatcggcctggacatcgggaccaactccgtgggctgggccgtcatcaccgacgactacaaggtgcccagcaagaagatgaaggtgctcgggaacacggacaagcgcttcatcaagaagaatctgatcggcgccctgctgttcgacgaggggaccaccgcggaggcccggcgcctgaagcggaccgcccgccggcgctacacgcggcgcaagaaccggctgcgctacctccaggagatcttcgccgaggagatgagcaaggtagacagctccttcttccaccggctggacgacagcttcctgatcccggaggacaagaagggctccaagtaccccatcttcgccaccctcatcgaggagaaggagtaccacaagcagttccccacaatctaccacctccgcaagcagctggcggacagcaaggaaaagaccgacctccggctgatctatctggccctcgcccacatgataaagtaccgcggccacttcctgtacgaggacacgttcgacatcaagaacaacgacattcagaagatcttcaacgagttcatctcgatctacaacaacaccttcgaggggaacagcctgtccggccagaacgtccaggtggaggccatcttcaccgacaagatcagcaagtccgcgaagcgggagcgcgttctcaagctgttcccagacgagaagtccacagggctgttcagcgagttcctcaagctgatcgtgggcaaccaggccgacttcaagaagcacttcgacttagaggagaaggccccgctccagttcagccgggacacgtacgacgaggacctggagaacctgctcggtcaaatcggcgacgacttcgcagacctgtttgtggccgcgaagaagctgtacgatgccatcctcctctccggcatcttaaccgtcaccgaccccagcactaaggcgcccctctccgccagcatgatcgagcgctacgagaaccaccaaaaggacctggctacgctaaagcagttcatcaagaccaacctccccgagaagtacgacgaggtgttcagcgaccagtccaaggacgggtacgcgggttacatcgacgggaaaacaacccaggagagcttctacaagtacatcaagaacctgctgtccaagttcgagggcgccgactacttcctcgagaagatcgagcgggaggacttcctgcgcaagcagcggacgttcgacaacggcagcatcccgcaccagatccacctccaggagatgaacgccatcctgcgccgccagggggagcactacccattcctgaaggagaacaaggagaagatcgagaagatcctgaccttccggatcccctactacgtgggacccctcgcgcgcggtaaccgggacttcgcctggctgacccgcaactccgaccaggcgatccggccgtggaacttcgaggagatcgtcgacaaggccagctccgccgagagcttcatcaacaagatgaccaactacgacctgtacctccccgaggagaaggttctgcccaagcactccctgctgtacgagacgttcgccgtgtacaacgagctcaccaaggtcaagttcatcgccgagggcctgcgcgactatcagttcctggacagccggcagaagaaggacatcttctacaccctattcaaggcggaggacaagcgcaaggtgaccgagaaggacatcatccagtacctgcacacggtggacgggtacgacggcatcgagctgaagggcatcgagaagcagttcaacgcctccctcagcacctaccacgacctgctgaagatcattaaggacaaggagttcatggacgaccccaacaacgaggagatccttgagaacatcgtacacaccctgaccatcttcgaggatcgggagatgatcaagcagcgcctggcccagtacgactccctcttcgacgagaaggtgatcaaggccctgacgcggcgccactacaccgggtggggcaaactgagctccaagctcatcaacgggatccgggacaagcagaccggcaagaccatcctggactacctgatggacgacgggtacaacaaccgcaacttcatgcagctcatcaacgacgacgagctgagcttcaaggagatcatcaagaaggcccaggtggtcggcaagacggacgacgtgaagcaggtcgtgcaggagttacctggttcccccgccatcaagaaggggatcctccagagcatcaagctggtggacgagctggtcaaggtgatgggccacgagcccgagtccatcgtcatcgagatggcccgggagaaccagaccaccgcccgcgggaagaagaacagccagcagcggtacaagcgcatcgaggacagcctcaagatcttggcctccggcctgaacgcgaagatcctcaaggagcatcccaccgacaacatccagctgcaaaacgaccggctgttcctctactacctgcagaacgggcgcgacatgtacaccggcaagccgctggacataaaccagctctcgtcctacgacatcgaccacatcgtcccccaggccttcatcaaggacgacagcctggacaatcgcgtgctgacgtccctcaaggacaaccggggcaagagcgacaacgtgccctccctggaggtcgtggagaagatgaagaccttctggcagcagctgcttgacagcaagctgatctcctaccgcaagttcaacaacctgaccaaggccgagcgcggcgggctcgacgagcgggacaaggtggggttcatcaagcggcagctggtcgagacccgccagataacgaagcacgtggcccagatcctggacgcgagatacaacaccgaggtgaacgaaaaggacaagaagaaccgcaccgtcaagatcatcaccctcaagagcaacctggtgtccaacttccggaaggagttccgcctgtacaaaatccgggagatcaacgactaccaccacgcgcatgacgcctacctcaacgccgtagtcgccaaggccatcctgaagaagtaccctaagctggaaccggagttcgtgtacggggactaccagaagtacgacctcaagcgctacatcagccggtccaaggaccccaaggagatcgagaaggcgacggagaagtacttcttctacagcaacctgctgaacttcttcaaggaggaggtgcactacgccgacggcaccatcgtcaagcgcgagaacatcgagtactccaaggacaccggggagatcgcctggaacaaggagaaggacttcgccacaatcaagaaggtgctcagcttaccccaggtgaacatcgtcaagaagcgggaagtgcagacgggcgggttctctaaggagagcatcctgcccaagggaaacagcgacaagctcatcccgagaaagaccaaggatatactgtgggacactaccaagtacgggggcttcgactcccccgtgatcgcgtacagcatcctgctcatagccgacatcgagaagggcaaggccaagcggctgaagacggtcaagaccctggtggggatcaccatcatggagaaggccaccttcgagaagtccccaatcgccttcctcgagaacaagggctaccacaacgtgcgcaaggagaacatcctgtgcctgccgaagtacagcctcttcgagctgaagaacgggcggcgccggatgctggcgtccgccaaggaactccagaagggcaacgagatcgtcctgcccgtgcacctgacgaccttgttataccacgccaagaacatccaccgcctggacgagcccgagcacctcgagtacatacagaagcaccgcaacgagttcaaggggctgctgaacctcgtgagcgagttctcccagaagtacgtcctggccgacgccaacctggagaagatcaagaacctctacgcggacaacgagcaggccgacatcgagatcctggccaacagcttcatcaacctgctcaccttcactgccctgggcgcccccgcagcctttaagttcttcggcaaggacgtggaccggaaacgctacacaaccgtgtccgagatcctgaacgccaccttaattcaccagagcatcaccgggctgtacgagacgcggatcgacctgtccaagctcggcgaggactga

SEQ ID NO: 7806 - RNA, 4125 nt, synthetic construct
  misc_feature 1..4125: note = Cas9 variant
  source 1..4125: mol_type = other RNA
atggagaccaagttcacctactacttgggcctcgatatggggacggacagcctgggctgggccgtgaccgactccagctatcacatcctgcgcgccaaggggaaggacctctggggcgtccggctgttcccctccgcggagaccagcgtggagcgccgaacctaccgcgtgaaccggcgccggcgccagcgggaggtcgcccgcatcggggccctcaaggagctgtttgccgacgagattgagaaggtggatccgggcttcttcgtgcgcctggacgagtccaagttccacatggaagaccgatccgagaacaacaagcagaagtacggcctgtttgccgacaagctgttctccgacgccgggtactacaagaagtatcccacgatcttccacctccggaaggaactcctcgaaagcgaggaaccccacgacgtccgcctggtgtacctggccctcctgaacatgttcaagcaccggggccacttcctgaactccagcctccagatcgagggggagaactccaacatcgccgagtcctatcagatgttcgtggacaccctgaccgacgaggacctggacttcccagagcaggtctccggagaacgcctccaggagattttccggagctcggacagccgcaagaagaaggtggaaaacctactggccgaaatgaacctctccaagaagcagaagcgggagatccagttcgtgaacctgatctgtgggctgaagggcaagctcagcgagctgttcccggacaaggagtacgacgaggagcagaagaagatcgcgttctcctttcaggacagcgactatgaggacaaggagaacacaatccaggagcttctcgacgagagcgagatgaatatgatctacgccgtcaaggcagtgcacgactccggcgtgctgagcgggatcatgaacggcgagcgatacctgtccgttgctcgtgtggccagctacgaaaaacacaagaaggacctccaaatcctgaaggatatcctgaagaagtatgacacgaaggagtacttcgagatgttccgcaacgagtccgccaagtcagagtcctacagcgcgtacgtgggttccgtcaagtaccacggcaccttccgccggggcctctctgggggcaagcaggaggacctgtacaagcatatcaaaaaggtccttgggaagttcccgcaggacgacgagggcgtaacctatatcttggaggagatcgagaccgagtccttcctgcccaaacagctgacggccagcaacggggtcatacccaaccaggtgcacgcccgcgagatgctggccatcctgaaacacgctgagctgtatctcccattcctgcaagagaaggacgacaccggactgtccgtgagcgagaagatcctcaagctgttcatgttccagatcccctactacgtcgggcccctcgggcaggagtacaaggacaagaagggctataacgtgtgggccgagcggaaagcctccgggaagatctacccctggaacttcgaggacaagatcgatgtcaagaagtccgccgagaagttcatcggccgcatggtgcggcgctgcacctacctgagcggggagcaggccttaccgaagcagagcctgctgtacgagaagttccaggtgctcaacgagctgaacaacctgcggatccgcggcgagaagatcccggtctcccttaagcaggagatctaccacgatttgttcggcgacggcaagaaggtgagcatgacccgccttacaaactacttactgcagaacggcgtgataagcggggaggagaaagactcctgcatcagcggcatcgacgggggcttccacaactccctgagcagcgtcggcaagttcaagggggtgttcggcgacaccgtgcacaccgacgagcaccgcaagatgatcgaggacatcatcttctgggggaccgtcttcggcgacggcaagaagctcctgaaggagaaggtggaggaggtgtacgggaaccagctgacggaggcgcagaagaagcggatcttcggcttcaagttctcatcctgggggcgcctcagcaaggccttcctgaccatggagggcgcgtccaaggacgacggggagatcaagggcctgattcaagccatgtgggacaccaactgcaacctcatggagctgctgagcgaccggttcacctacaaggacaagctcaatgagatggtcacgaccgccgagaaacccctgtgcgagtggaagatcgaggacctggacgagatgtacttatccgcccccgtgaagcgcatggtgtggcagaccatccgggtcgtggatgaagtgcagcagatcatcggctgcccgcccaagcggatcttcgtcgagatgacacggagcgacggggagaagggcaaacgcacggtgtcccggcagaaaaagctggtggacctgtacaaagccctcgggaaggagggcaagacctggagcgaggagctgtccgacacccccgagagccagtttcggatcaagaagctgtatctatactatctgcagatggggaagtgcatgtacaccggcgaggccatcgagctggagcagctcatgaacgacaacctgtacgacatcgaccacatctacccccgccacttcataaaggacgacaacatctccaacaacctggtcctcgtgaagaaggagaagaacgcccacaagagcgacagctttccgatcgagcccgaaatccggaacaagatgatgcccttctggaagtccctgcgcaagaagggctttctgactgaggagaagtacaaccggttgacccgcatgtcagcgtttaccgacgaagagaaagccgcgttcatcgggcggcagctggtggagacctcccagggcacgaaggccatcacccagatcttcgagcaggccttcgcgaacagcgagatcgtcttctccaaagccagcgttgtgtccgccttccgtcagaagtttgattgctacaaggtccggtgcgttaacaactaccaccacgcccatgacgcctacctgaacattgtggcggggaacacctaccgcgtcaaattcaccagcaaccccctcaacttcatcaaggaggctaagaagaacccgaactcccgggagaacagatacaatatggacaagatctttgagtgggacgttactcggaacggcgagactgcgtgggtggcccagacaaaggagcaccccgggaccatccagctggtcaagaagtacctgaacaagaacagccccctcatcaccaagatggtgtacgagaagcacggcggcatcacgcagaaagccaccatctggtccgcaaagaaggcggagagtgggaacaccgacgcctacatccccgtgaaaatgaacgacccgcgcctggccgacgtcaccaagtacggcggggtaacgactatagcggtggccggctacaccctgctcgagtacaaggctggagggaagaccgtacggtccttagaggccctgcccatctacctcggcgggagcaagaagctgacggaggagcagatggtggaatacttctccaacgtgcttcagcaggaaaacaaggagaaggtcgtgagcgacgtgatcatccgcaagaagatgatcccttctggcagcctcatcaagtacaacgggttctactactacctggccggcaagacaggcgaccggatcatcctgatctcggcggttcagctctgcctgccgatggataccatgctgtacatcaagaagatcgagaaagcctgcagcaccgggaacttcgaggagaaggacaagaacggcaagcaggtcctcagtaagcagcagaacgagttcgtgtacgagctgattatacagaagtaccagcagtccattttcaaaaagaaggtgggtgccatcggcgacacgatcatcgagaagcgcgagaagtttgccgagataagcctggaggagcagtgcaaggtgctcatgcagatcttcctgaacttccaatccgggatcggtgtggagctgaagatcatcgagggaggcaaaaagtccggagtcacctaccttaacaagaaggtgatgaacgtccaggagctgaagctgatagatcagagcgtgaccggggtgttcagccgggagatcgacctcctgaccatctga

SEQ ID NO: 7807 - RNA, 4125 nt, synthetic construct; identical to SEQ ID NO: 2007
  misc_feature 1..4125: note = Cas9 variant
  source 1..4125: mol_type = other RNA

SEQ ID NO: 7808 - RNA, 4125 nt, synthetic construct; identical to SEQ ID NO: 2008
  misc_feature 1..4125: note = Cas9 variant
  source 1..4125: mol_type = other RNA

SEQ ID NO: 7809 - RNA, 4128 nt, synthetic construct; identical to SEQ ID NO: 2009
  misc_feature 1..4128: note = Cas9 variant
  source 1..4128: mol_type = other RNA

SEQ ID NO: 7810 - RNA, 4128 nt, synthetic construct
  misc_feature 1..4128: note = Cas9 variant
  source 1..4128: mol_type = other RNA
atgaaggaataccacatcggcctcgacatcgggaccagttcaatcggctgggccgtgacagactctcagttcaagctcatgcgcatcaaggggaagacagccatcggcgtgcgactgttcgaggaagggaaaaccgcggccgaacgccggaccttccgcaccacgcggcgcagattaaagcgcaggaagtggcgcctccactacctagacgagatcttcgccccgcatctgcaggaggtggacgaaaacttcctccggcgcctgaaacagtccaatatccacccggaggaccccgccaagaaccaggcattcatcggcaagctcctcttccccgacctgctgaagaagaacgagcggggataccccaccctcatcaagatgcgcgacgagctaccggtggagcagcgggcccactaccccgtcaccaacatctacaagctgcgcgaggcgatgattaacgaggatcggcagtttgacctccgcgaggtgtacctggccgtgcaccacatcgtcaagtaccgtggccacttcctgaacaacgcctcggtggataagttcaaggtcggtcgcattgatttcgacaagagtttcaatgtcctcaacgaggcgtacgaagaactgcagaatggggagggcagcttcaccatagagccgtccaaggtggagaagatcgggcagctgctattagacacgaagatgaggaagctggaccgccagaaggccgtggccaagctcctggaggtcaaggtggccgacaaagaggagaccaagcgcaacaagcagatcgcaactgctatgtctaagctggtgctcggctataaggccgacttcgccaccgtcgctatggtgaacggcaacgagtggaagatcgatctgtccagcgaaacgtccgaggacgagatcgagaagtttcgcgaggagctgagcgacgcccagaacgacattctcaccgaaatcacatccctgttcagccagatcatgctgaacgagatcgtgcccaacgggatgagtatcagcgagtccatgatggaccgctactggacccacgagcggcagctagcggaggtcaaggagtacctagccacgcagccggccagcgcccgcaaagagttcgaccaagtgtacaataagtacatcggccaggcccccaaggagaaggggttcgacctagagaagggcctcaagaagattctgtccaagaaagagaactggaaagagatcgacgagctgctcaaggcgggcgacttcctgcccaagcaacgcatcagcgccaatggggtgataccacaccagatgcaccagcaggaactggacagaatcattgagaagcaggcaaagtattacccgtggctcgccaccgagaatcccgcgaccggcgagcgggatcgccatcaggcgaagtacgagctggaccagctggtgagcttccggatcccctactacgtgggccccctcgtgacccctgaggtccagaaagccacgtccggcgccaaattcgcctgggcgaagcgcaaggaggacggggaaatcaccccctggaacctgtgggataagatcgaccgggccgagagcgccgaggccttcattaagcgcatgaccgtcaaggacacctacctgttaaatgaggacgtgctgcccgcaaactccctgctgtatcagaagtacaacgtgctcaacgagctgaataacgtgcgggtcaacggccgccggctctccgtcggcatcaaacaggacatctatacggaactcttcaaaaagaagaagaccgtgaaggcgtcggacgtcgctagcctggtgatggcgaagacccgcggtgtgaacaagccgtccgttgagggcctgagcgatccgaagaagttcaattccaacctcgctacctacctggacctgaagagtatcgtaggggacaaagtggacgataaccggtaccagatggacctggagaacatcatcgagtggcgctccgtcttcgaagacggagaaatcttcgccgacaagctgacggaggtggagtggctgaccgacgaacagcggagcgcgttagtgaagaagaggtacaaggggtggggccgcctctccaagaagttgctcaccggcatcgtcgacgagaacgggcagcggatcatagaccttatgtggaataccgatcagaatttcatgcagatcgtgaaccagccagtgttcaaggagcagatcgaccagctgaaccagaaggccattacgaacgacggcatgaccctgcgcgagcgggtagagagcgtgctagacgatgcctacaccagcccccagaacaagaaggcaatctggcaagtggtccgtgtggtggaagacatcgtcaaagccgtggggaacgcgcctaagtccatttccattgagtttgcacggaacgaggggaacaaaggcgaaatcacccgctcgcggcgcacgcagttgcaaaagctgttcgaggaccaggcccacgaattagtgaaggacacctctctgaccgaggagctagagaaggtgccggacctgagcgaccggtactacttttacttcacccagggtggcaaggacatgtacaccggggaccccatcaacttcgatgagatcagcacgaagtacgacatcgaccatattctgccccagtccttcgttaaagatgacagcctcgacaacagggtgctgacctcacgaaaggagaacaacaaaaagagcgaccaggtccccgccaagctctacgcggccaagatgaagccgtactggaatcagcttctgaagcagggcttaatcacgcagcgcaagttcgagaacctcaccatggacgtggaccagacgatcaagtaccggtcccttggcttcgtgaagcgccaactggtcgagacccgccaagtgattaagctcaccgccaatatcctgggcagcatgtaccaggaagccggcaccgacataatcgagacgcgcgccggcctgaccaagcagttgcgggaagagttcgacctgcccaaggtgcgcgaggtcaatgactaccaccatgcggtagacgcctatctgaccaccttcgccggccagtacctcaatcggcgctacccgaagctgcggtccttcttcgtgtacggggaatacatgaagttcaagcacggcagcgatctgaagctccggaatttcaacttcttccacgagctgatggagggggacaagtcccagggcaaggtcgtggaccagcagaccggcgagctgatcaccacccgcgacgaggtggccgactacttcgattgggtccaggacctcaagctaatgctggtgaccaaggaacttaagagaagcaacgggaagctgttcgacgccacgatccagaacgcgaactacaccaagctgaacgagcgcaaaaaggttttcgtccctctgaagaaggagctggataagaccctgtacggctcctattcaggtatccagtccagctacatgaccatcgtgaagaaatttgacaagaagggctccacgtacgccgtgcagagaatccccgtcatgtacagcaagctactggagcttgagaaggagcagtcgaagctcaaccgcctagtgcaaagcatagtgaccagcgaccctcaggcacccaacaacttcgaggtcctgatgccgtgcgttctctccgggcagctagtcatcgacaacggccgtaaatttaccctgacaagctaccggtaccagtgttccaccgcgcaactcttcctgccaaagaaggatctgaagtacatccagaacaacttcaaggagctcaagaaaacccccgacaaacaggacaagatattcgagacgatctacgatgacatactaaaacaggtggacaagtacttctctctgtacgacatcaacaagttccggtccaagctccacgacggcaaggacaagttcctggccttagagaatttcggggagaaagagtctaaggacaaggtgatcactaagatcctccgcggtctgcatgcgaacgccgagcggacatccttaaaggagatcggcctcagcacacccctgggccagttccagtcgggggagggcggcatcaccctgagcgacaacaccaagatcatataccagagtccgaccggtctgtttgagaggcatgtctacctgaaagacctgtga

SEQ ID NO: 7811 - RNA, 4128 nt, synthetic construct; identical to SEQ ID NO: 2011
  misc_feature 1..4128: note = Cas9 variant
  source 1..4128: mol_type = other RNA

SEQ ID NO: 7812 - RNA, 4128 nt, synthetic construct
  misc_feature 1..4128: note = Cas9 variant
  source 1..4128: mol_type = other RNA
atggaaaacaagaagtacagcatcggcctggacatcgggaccagcagcatcggcttcgccgtggtcgacgagaacaaccgcgtgatgcgggtgaaggggaagaacgccatcggcgtccgcctcttttccgagggacagcccgcggccgaccggcgcagcttccggaccacgcgccggcgcctgtcccggaggcggtggcgcctgcggctactgcgcgagatcttcgagccgtacatcaaccccgtggacgaggctttcttcatgcggctgaaggagagcaacctctctcccaaggatgccaacaagcactacagcggcgacatcctgtttaacaaccagaccgaccaggacttctacgagaagtaccccaccatctaccacctcaggcacgctctgatgaccgagcaccggaagttcgacgtgcgcgagatatacctggcgatccaccacatcgtaaagttccggggccacttcctgaacgccgcctcggccagcaacttcacggtagggaagctcaacctggagggcaaattcgacgcgctgaacgagatctaccagcgcgtgctcaccgacgacccgttcgccctgaggaccgacaacctggaccacatcaaggagatcctcatcgacaacaagcgctcccaggccgaccgccagcggaccctgacgggggacgtctatcagagctccgaggagaaggagatcgagaagcgcaacaaggccatcgccacagagatcctgaaggcggccgtgggtaacaaggccaagctcaacgtgatcaccaacgtggaggtggacaaagaggccgccaaggactggagcttaaccttcgactctgagacgatagacgacgagctggccaaggtggacgggcagatgactgacgacggccgggagatcatcgagatcctccgctcgctgtactccggcatcaccctggccgcaattgtccccgagaaccacacgctcagccagtccatggtggagaaatacaacagccacaaggcccacctgaaactgctcaaggacctgatcaacaacatgacggacactaagaaggccaagaaccttcgggcggcctacgacgggtacatcgacggcgtgaagggcaaggtcctcacccgggacgatttctacaagcaaatccagggcaacctggacgacagcgcagaagcccagaagattcaggacgtgatggaccaggacgagttcatgcccaagcagcggaccaaggccaacggctccatcccgcaccagctgcagcagcaggagctcgaccagatcgtggagaaccagaaggagtactacccgtggctggcggaagaaaaccccaacgagactcgtaggggcgtcgccaagtacaagctggacgagctcgtgacctttcgggtgccctactacgtcgggcctatgatcaccgccgaggaccaggagaagcagagcggggcctccttcgcatggatgaagcggaaggagccgggcaacatcaccccctggaattttgaccagaaggtagatcgaatggcctctgccaaccagttcatcaagcggatgacgaccaccgacacctaccttctgggggaggacgtcctccccgcccagtccctgctctaccaacgcttcgaggtgttgaacgagctgaacaagatccggatcgatcgcaagcccatcagcatcgagctgaagcagcagatcttcaacgacctcttcaagaagttcaagaacgtgacgatcaaacaccttcaggagtacctggtcgccaccggcggctacgacaaacggccgcgcatcgacgggttagcggacgaaaagcggttcaacagcggcctgagcgcctaccacgacctgcacgggatcctgggcgccgaggtggtggacgccaacgacaagcaggacgacctcgagaagatcatcgagtggtccaccatcttcgaggacaagaagatctaccgcgccaagctggacgagctgacctggctcacggacagccaaaaggagaaactggcgaccaagcgctaccaggggtggggccggctgtccaagaagctactgagcggcctgcgcaacagcgaccaccggtcgatcctcgacatcctgtggatcaccaacgagaactttatgcagatccaggccgaccctgactttgccgagctggtcaagaacgccaaccaggggatgctcggcaagaacaactctcaggacgtgatcaacgacctgtataccagcccccagaacaagaaggccatccgccagatcctgcttgtagtccacgacatccagaacgcgatgcacgggcaggcccccgccaagatacacgtggagttcgcccggggcgaagaacgaaacccgcggcgctccatccagcgccagcatcagatcgaggcggcctacgacaaggtgaccagcgacctgctggtcgacgccggggtgcgccaagagctcaaggacgccatcaacgacaaacgggacttcaaggaccgcctgttcctgtatttcatgcagggcggccgggacatctacaacggcgagcccatcaacatcgaccgcctctccagctacgacatcgaccacatcctgccacaggccttcgtgaaggacgacagcctgaacaaccgggtcctcacagacgcggagggcaaccgccggaagtcagacgccgtgcccagcgagctgttcggggccaagatgagatccacctgggagctgatgcgggagcagggcctcataagcaaggccaagtaccgcaaccttaccatgaaccccgagaacatcaacgcccacaccgagaacggcttcatcaaccggcagctggtggagacgcgccaggtcatcaagctcgcggtgaacatcctggccgacgagtacaccgaggacacccagatcgtgtccgtcaaggccgacctgagccaccagatgcgcgaagacttcgagctcctgaagaaccgggacgtgaacgactaccaccacgccttcgacgcgtacctggcggccttcatcgggaactacctcctggagcgctaccccaagctgcagtcctacttcgtgtacggcgactttaagaagttcagccagaaggacaccaagatgcggcgcttcaacttcatctatgacctcaagcactccgaccagatcgccgataagaacgggaagaagatctggcacaagacgaacgacctggactacattcggcacctgttcgcctacaagaagatccttatcagccacgaggtctccgagcgcagaggagcgctgtacaaccagaccgtgtacaaggccagcgacgacaaggcctccgggcagggctcaaagaagttaatccccatcaaggccaacaagcccaccgaaatctacggcgggtacaccggtaagacgttagcctacatggcgatcgtgaaggtcatcaaggggaagaagatcgcctataaggtggtgggcgtcccgacctccgccctggtgcagctggccgggatcgagcacggcagccaggaggagttaaaccgcctgtacgacgtgctgaagccccagttcacacagctcaagaagaacaacaagaccggcgagatctccgagacggtcagcaagttcgagatcgtgatcccccgggttaaataccaacagctggtcgaggacgacgacaagctgttcatgatcgggagcgacacctatccgtataacgcccagcagctcgtgctgtccgagggcgcgctgaaggtgatcaacaacgtctacaggaagggggagaacagcgacaagcaggagtcctacaagctcgacgacgtgtacgacgagatcatcatcgccatgaagaagtacttccccctgtacgataaccggggcttccgcgagaaggtcgccgagggcaagagcacctttgagaacctgcccatctccaacgagttcaagaacggcaaactcaccaagattggcaagaaggaggtcatcaaccggatgctgcaggggctgcatgccaacgccacgatgaccgacctcaagatcctgggcatcaagagcccctttgggttcatgcagcagccgaccggcatcgcgttatccgagaacgcccagctcatctaccagagccccaccgacctgttcgagcgccgggtgcagctgaataagatcaagtga

SEQ ID NO: 7813 - RNA, 4128 nt, synthetic construct
  misc_feature 1..4128: note = Cas9 variant
  source 1..4128: mol_type = other RNA
atgaagaagatcttaggcctcgacctggggaccaccagcatcggctgggccttagtgtacgagtccgaaaacacggacgagaagtccagcatcgtccgcctcggggtgcgggtgaaccccctgagcgtcgacgagaagggcaacttcgagaaggggaaggccatcaccaccaacgctgaccgccagcaaacccacggcgcccggatcaacctgcagcgctacaaactccgtcgcgagaacctgaaggactgtctgcagaagcagggctggatcgggacggaggccctctgcgaggagggcaagacctccaccttcgagacctacatgctgcgggccaaggccgcggaggaggaaattagcctgcacgagttatgcagggtgctgtttatgatgaacaagaagcgggggtacaagtccaacaggaaggccaacaataaggaggacggcaaactgttcgacgggatgacagtggccaagaagctctacgaggagcacctgaccccggccgagtacagcttccagctcctctccagcggcaagaaattcaagcaggagtactaccggtccgaccttaaggaggaatttgaccgcatctggaacgagcagcagaagtactaccccgagatcttgaccgacgacttcaagcagcagctccagggcaagtccaaagggaacacctccaagatcttcctgggcaagtacgggatctacagcgcggacctgaagggcctcgaccggaagctgcaacccctgaagtggcgcgtcgaggccctcaagcagcaggtcgacaaggaggtcctggccttcgtgatctccgacctgaacggccagatcgccagcacgtccgggctgctgggcgccatcagcgaccggagtaaggagctgtactttaacaagcagactgtggggcagtacctctggactagcctgaaggagaccccgcacgtatctatcaaaaacaagccgttttaccgccaggactacctggacgagttcgagaagatctgggagacgcaagcgacctaccacaaggagcttacccccgagctgaagcaagagatccgggacatcatcatcttctatcagcgccccctgaagtccaagaagggcctcatctctgtctgcgagttagagcagcggaaggtgaaggttaccatcgacgggaaggagaaggagatctccatcggccccaaggtggcccccaagagctcccccatgttccaggagttccgcatttggcagaacctgaacaacatcctcctgatcgacaagggcaacaacagcatccaccctctgtacgaggaggaaaagaacctcctgtacgaggaactgtccgtgaaggagaagttaagcaaggctgaggccctgaaggtcctgaacaagaatagcaaacagtgggacctgaactacaaggaaatcgagggtaaccggacccaggccgtcctctacgactgctacaaccgcattatagtgatgaccggccacgaggaatacaacttcaagaagctgaaggccagcgagatccgctcctacgtgaagaccaccttcacggggctgggcttcaacaccgacatcctcgagttcgacagctccctgaccgggcacgagctggaaaagcagcccatgtaccagctctggcacctcctgtacagttacgagtccgacaacagccgcaccggcaacgacgccctgctgcgcaagctggagacggccttcggcttcccgaaggagtatgccgccgtgctctccgacgtggtgttcgaggactcatacggaaacctgtccgtcaaggcgatgcggaagattctgccccatctccaagccggcctgaactacagccaggcctgcgaggaagccgggtacaagcacagccgccggtctctgaccaagaacgagctcgaccagaaggagtacaaggagaaacttgagctgctccccaagaacagcctgcacaaccccgtggtggagaagatcctgaaccagatgatcaacgtgatcaacgccgtgatcgacgagtacggaaagccggatgagatccgcatcgagctcgcgcgggagttgaagatcggggccgccgagcgcgagaacatgacccggtccatcaaccagggcaatgccgagaacaagcgcatacgggagatcctggagaaggagttcgctctcagctacatctcccgcaacgacatcatcaagtacaagctgtacgaggagcttaagagcaacgggttcaagaccctctactccgacacgtacataagcaaggacaagctgttctccaaggacttcgacatcgagcacataatccccaaggcccggctgttcgacgacagcctctccaacaagaccatcgaggcccgcgatgtcaacatcgccaagtctaacaagaccgcctttgactttatctccgagaagtacgaccaacaagggatcgaggcttacaagaaaaagctggacatactgctccaggacggcagcatctccaaggccaagtacaaccggctgctgatgaaggaggccgacatcccgagcggattcatcgaccgcgacctccgggacacccagtacatagccaagaaggcctacgagatcctgtccgacctggtgcgcaacgtgacgcccaccaccggcgcggtcaccagccggctccgcgaggactggcagttggtggacgtgatgaaagagctaaacttcgagaagtaccagaagctcggcctggtggaagtgatcgaggaccgcgacgggaggaagatcaagcgcatcaaggactggaccaagcggaacgaccaccgccaccacgccatggacgcactgacgatcgccttcaccaagccgagctacatacagtatctcaacaacctgaacgctcggtccgacaagaacagctccatctacggcatcgagaacaaggagctgcaccgcgaggacaacaagctccggttcaacgcgcccctgcccatcaacgagttccgggccgaggcccgtcgccatctcaagagcatcctggtgagtgtcaaggccaagaacaaggtgatgacccagaacgtgaacgtcatcaagaccaagcacggagtgatcaagaaggtgcaactgacgccccggggagagctgcacaacgccaccttctacgggaccaagaagagaccgataatcaagatggtcaaggtgggcgccgccctcgacgaggtgaccatcaagaaggtcagctccagcttcatccgtgaggccctgctggaccgcctccacgagtataacggcgacgctaagaaagcgttcaccgggagaaactccatcgacaaaaaccccatctacatcgatgaggagcacaagaagaccgtgcccgctctggtgaagaccatcgaatgggagatgtaccaccccacacgcaagctgatcagcccggacctcaagatcgacaaggtcattgacaagggcatccgggagatcctgaagacgcgcctggccaagttcaacggggacgcccaaaaggcattctccaacctcgacgagaaccccatctacaaggacgaggcgaagaagattactctgaagcgggtgagcctggagggcgtgtccagcgtcatacctctccacaccctgaaggaccgcgaggggaagctggtagtgggcaaggacggcaagccggtcctaggggactacgtgcagacctccaacaaccaccacatcgccttctatatggacgaaaatggcaacttgcaggacaatgtggtcagcttcttcgaggccgccgagcggaagtctcagggggttcccgtcatcgacaagaactataaccacgataagggctggaacttcctgttcacgatgaagcagaacgagtacttcgtcttccccaacgaagtgaccgggttcaaccccagcgaggtggacctaatggacgaggcgaactattccatcatcagcccgaacctgtaccgcgtccagaagatgagcaaggcgtccggacgcgactactggttccggcaccacctggaggccatgctcaacgacgaccccaagctgcgcaactctatgttcaagcggatcacctccctgaaggccctcgagggcatcgtgaaggtgcgtatcaactgcatcgggaagatagtcgccgtgggcgagtacgactga

SEQ ID NO: 7814 - RNA, 4128 nt, synthetic construct
  misc_feature 1..4128: note = Cas9 variant
  source 1..4128: mol_type = other RNA
atgagcaacaagagctacagtatcggcctggacatcgggaccaactccgtgggctgggccgtcatcaccgacgactacaaggtgccctcgaagaagatgaaggtgctcgggaacacggacaagcacttcatcaagaagaacctgatcggcgccctgctgttcgatgaggggaccaccgcggaggaccgccggctgaagcgcaccgcccggcgccggtacacgcgccggaagaaccgcctgcggtacctccaagagatcttctcccaggagatcagcaaggtcgactccagcttcttccaccgcctggacgacttcttcctggtgccggaggacaagcggggctccaagtaccccatcttcgccaccctcgtggaggagaaggagtaccacaagaagttccccacaatctaccacctccgcaaacacctggccgacagcaaggagaagaccgacctccggctgatctacctggccctcgcgcacatgatcaagtaccgcggccacttcctgtacgaggagtccttcgacatcaagaacaatgacatccagaagatcttcagcgagttcatctccatctacgacaacaccttcgagggcaagagcctgtccggacagaacgcccaggtcgaggccatcttcaccgacaagataagcaagtccaccaagcgggagcgcgtgctcaagctgttccccgacgagaagtccaccgggctgttcagcgagttcctcaagctgatcgtgggcaaccaggccgacttcaagaagcacttcgacctggaggagaaggcgccgctgcagttcagcaaggacacgtatgacgaggacctggagaacctgctcgggcagatcggcgatgacttcgccgacctgtttctggtcgccaagaagctatacgatgccatcctgctgagcggcatcctcaccgtgaaggacctgtccaccaaggcgcccctgagcgcctccatgatcgagcggtacgagaaccaccagaaggacctcgccgccctgaaacagttcatccagaacaacctgcaggagaagtacgacgaggtgttcagcgaccagtccaaggacgggtacgccggttacatcgacgggaagaccacgcaggaggccttctacaagtacatcaagaaccttctgagcaagttcgagggcgcggactacttcctggacaagatcgagcgcgaggacttcttaaagaagcagcggaccttcgacaacggctccatccctcaccagatccacctccaggaaatgaacgccatcatccgccggcagggggagcactatcccttcctgcaggagaacaaagagaagatcgagaagatcctaaccttccgcatcccgtactacgtcggccctctggcccgcgggaacggcgacttcgcctggctgacccggaacagcgaccaggccatccgcccctggaacttcgaggagatcgtggaccaggcgtccagcgccgaggacttcatcaacaagatgacgaactacgacctctacctgcccgaggagaaggtgctgccgaagcactccctgctctacgagaccttcgcggtctacaacgagctgaccaaggttaagttcatcgccgaagggctgacccggtaccagttcctcgacaagaagcagaagaaggacatcttcgacacgttcttcaaggccgagaacaagcgcaaggtgaccgagaaagacatcatccactatctgcacaacgtcgacggctatgacggcatcgagctgaaggggatcgagaagcagttcaacgcgagcctctccacctaccacgacctgctgaagatcatcaaggacaaggccttcatggacgacagcaagaacgaggagatcctcgagaacatcatccacaccctgacgatcttcgaggaccgggagatgatcaagcagcgcctggcccagtacgactccctcttcgacgaaaaggtgatcaaggctcttacccggcgccactacaccggctgggggaagctgagcgcgaagctcatcaacggcattcgggacaagaagtccgggaagaccatcctggactacctgatcgacgacggcgagatcaaccgcaactttatgcagctcatccacgacgacggcctgagcttcaaggagatcatccagaaggcccaggtgttcgggaagacgaacgatgtcaagcaggtcgtgcaggagctgcccggctcccccgccatcaagaaggggatcctccagagcatcaaaatagtcgacgagctggtgaaggtcatgggccacgcccccgagagcatcgtgatcgagatggccagagaaaaccagaccactgcccgcgggaagaagaactcccagcagcggtacaagcgcatcgaggacagcctgaagaacctcgcctccggcctggacagcaacatcctgaaggagaacccgaccgacaacatacagctccagaacgaccggctgttcctgtactacctccagaacggccgcgacatgtacacggggaagcccctggagatcaatcagctgtccaactacgacatcgaccacatcatcccccaggccttcatcaaggacgacagcctcgacaaccgggtgctgacctccagcaaggacaaccgcggcaagtccgacaacgtccccagcctggaggtggtggagaagatgaaggccttctggcagcagctcctggactccaaactgatctcggagcggaagttcaacaacctcaccaaggccgagcgcgagcgcgggggcctgaacgagctggacaaggtcggcttcatcaagcggcagctcgtggagacccgccagatcaccaagcacgtggcgcagttcctggacgcccggttcaacaaggaggtcacggagaaggacaagaagaaccgcaacgtgaagatcatcaccctgaaatccaacctcgtgagcaacttccggaaggagttcgggctgtacaaggtacgcgagatcaacgactaccaccacgcccacgacgcctacctgaacgccgtgctcgcgaaggccatcctgaagaagtacccgaagctggagcccgagttcgtgtacggcgactaccaaaagtacgacctccagcggtacatttccaagagtcgcgagcccaaggaagtcgagaaggccacccagaagtacttcttttactccaacctgctgaacttcttcaaggaggaggtgcactacgccgacgggaccatcgtgaagcgagagaacatcgagtacagcaaggacacgggcgagatcgcatggaacaaggagaaggatttcgccaccgtcaagaaggtgctcagcctgccccaggtgaacatcgtcaagaagaccgaggtgcagaccgggggcttctccaaggagagcatcctgccgaagggcaattccgacaagctcatcccccgtaagacgaaggagattctgtgggacaccaccaagtacggcggcttcgacagccccgtaatcgcctactccatcctgctcatcgccgatattgagaagggtaaggccaagaagctgaagaccgtcaagacgttagtgggcatcaccatcatggagaaggcgaccttcgaaaagaaccccatcaccttcctcgagaacaaggggtaccacaacgtgcggaaggagaacatcctgtgcctgccgaaatacagcctcttcgagctggagtccggccgccggcgcatgctggccagcgccaaggagctccagaagggcaacgagatcgtcctgcccgtgtacctgacgaccctcctgtaccactccaagaacgtgcacaagctggacgagcccgagcacctcgaatacatccagaagcaccggtacgagttcaaggacctgctgaacctcgtcagcgagttcagtcagaagtacgtgttagccgacgccaacctggagaagatcaagaacctctacgcggacaacgaacaggcagacatcgagatcctggccaacagcttcatcaacctgctcaccttcaccgccctgggggccccggcggcctttaagttcctgggcaaggacgtcgaccgcaagcggtacacgaccgtctccgagatcctcaacgccaccctaatccaccagagcatcaccgggttgtacgagacgcgcatcgatctctccaagctgggcgaggactga

SEQ ID NO: 7815 - RNA, 4128 nt, synthetic construct
  misc_feature 1..4128: note = Cas9 variant
  source 1..4128: mol_type = other RNA
atggagaagaagtactcaattggcctggacatcggaaccaactcagtgggctgggcggtcatcaccgacgactacaaggttcccagcaagaagttcaaggtgctcgggaatacgaacaggaagagtatcaagaaaaacctgatgggcgccctgctgttcgacagcggggagaccgcggaggctacccggctgaaacgcaccgcccggcgccggtacacgcgccggaagaaccgcatccggtacctgcaagagatattcgccaacgagatggcaaagctcgacgattccttctttcagcgcctggaggagagctttcttgtcgaggaagataagaagaacgagcggcaccccatcttcggaaacttggccgatgaggtggcctaccaccgcaactaccccaccatctatcatctccggaagaagctggccgactcccccgagaaggcggacttaagactgatctacctggcgctcgcgcacataatcaagttccggggccacttcctgatcgaggggaagctgaacgccgagaacagcgacgtcgcaaagctgttctaccagctgatccaaacctataaccagctgttcgaggagagccccctcgacgagatcgaggtcgacgccaagggcatcttatccgcgcgcctgtccaagtcgaagagactcgagaagctgatcgccgtgttcccgaacgagaagaagaacgggctgttcggcaacatcatagccctcgcactggggctgacccccaacttcaagtctaatttcgacctcacggaggacgccaaactgcaactgagcaaggacacctacgacgacgacctcgacgagttgctgggccagatcggcgaccagtacgcggacctcttctccgcagccaagaatctgagcgacgccatcctgctctccgacatcctgcgcagcaactccgaagtgaccaaggcgcccctgtctgctagcatggtcaagcggtacgacgagcaccaccaggacctcgccctactgaagaccctcgtgcgccaacaattcccagagaagtatgccgagatcttcaaggacgacacgaaaaacggttacgccggatatgtcggaatcggcatcaagcaccggaagcgcaccaccaagctggccactcaggaggagttctacaagttcatcaagccgatcctggagaagatggacggcgcggaggagttactggccaaattaaaccgcgacgacctgctccggaagcagagaacgttcgacaacgggtctatcccccaccagatccacctgaaggagctgcacgccatccttcggcgccaggaggagttctaccccttcctgaaggagaaccgggagaagatcgagaagatcctgaccttccgcatcccttactacgtcggcccgctcgcccgggggaacagccgcttcgcgtggctgactcggaagtccgaggaggccatcacaccctggaactttgaggaagtggtggacaagggcgccagcgcccagagcttcattgagcgcatgactaacttcgacgagcagctgcccaacaaaaaggtcctccccaagcacagcctgctgtacgagtacttcaccgtgtacaacgaactcaccaaggtgaagtacgtcacagagcggatgcgcaagccggagttcctatccggggagcagaagaaggccatcgtggacctcctcttcaagacgaaccggaaagtaaccgtcaagcagctgaaggaggactacttcaagaagatcgagtgtttcgacagcgtggagatcatcggcgtggaggaccgctttaacgcctccctgggtacctaccatgacctcctgaagattatcaaggataaggacttcctggacaacgaggagaacgaggacatcctcgaggacatcgtcctgaccctcacgctgttcgaggaccgggagatgatcgaggaacgcctgaagacctacgcccacctgttcgacgacaaggtgatgaagcagctcaagcggcgccactacacagggtggggccggctgagccgcaagatgattaacgggatccgcgacaagcagtccggcaagaccatcttggacttcctcaagagcgacgggttcagtaacagaaacttcatgcagctgatccacgacgacagtctgacgttcaaggaggagatcgaaaaggcgcaggtctccggccagggcgactccctccacgagcagatcgccgacctggcggggtcccccgctatcaagaagggcatcctgcagaccgtgaagatcgtggacgagctggtcaaggtgatggggcacaagcccgagaacatcgtgattgaaatggcccgcgagaaccagaccaccacgaagggcctgcagcagagccgggagcgcaagaagcggatcgaggaagggatcaaggagctggagtcccagatcctcaaggagaaccccgtcgagaacacccagctgcagaacgagaagctgtacctctactacctgcagaacggccgcgacatgtacgtggaccaggagctggacatcaaccggttaagcgactacgacgtggaccacattgtcccgcagagcttcatcaaggacgactccatcgacaacaaggtgctgacccgcagcgtggagaaccgtggcaagtcggacaacgtccccagcgaggaggtggtgaagaagatgaagaactactggcgtcagcttctcaacgccaagctcatcacccagcggaagttcgacaacctgaccaaggccgagcgcgggggcctctcggaggccgacaaagcggggttcatcaagcggcagctggtcgaaacgcgccagatcaccaagcatgtggcccggatcctggacagccgcatgaacaccaagcgggacaagaacgacaagcctatccgcgaggtaaaggtcatcacactcaagtctaagttagtgagcgacttccggaaggacttccagctgtacaaggtgcgcgacatcaacaactaccaccacgcccacgatgcgtacctcaacgcggttgtgggcacggccctgatcaagaagtaccccaagctggagtccgagttcgtgtacggcgactacaaggtctacgacgtgcggaagatgatcgccaagagcgagcaggagatcgggaaggccacggccaagcgcttcttctactccaacatcatgaacttcttcaagaccgaggtgaagctcgcaaacggcgagatccgcaagcggccgctgatcgagactaacggggagacaggtgaggtcgtgtggaacaaggagaaggacttcgccacagtgcgcaaggtcctggccatgcctcaggtgaacatcgtgaagaagaccgaggtccagaccggaggcttctcgaaggagtccatcctcagcaagcgggagtccgccaagctgatcccacgcaagaagggctgggacacccggaagtatgggggcttcgggagccccaccgtggcctactccatcctggtggtcgcgaaggtggagaagggcaaagccaagaagctcaaaagtgtgaaggttctggtggggatcaccatcatggaaaagggtagctacgagaaggacccgatcggcttcctggaagccaaggggtacaaggacatcaagaaggagctaatcttcaagctgcccaagtactccctgttcgagctcgagaatggccgccggcgcatgctggccagcgccaccgagctgcagaaggcgaacgagctcgtgctcccccagcatctggtccggctcctgtattacacccagaacatctccgccaccaccggcagcaacaacctgggctacatcgagcagcaccgcgaggagttcaaggaaatattcgagaagattatcgacttctccgagaagtatatcctcaagaacaaagtgaatagcaacctgaagtccagcttcgacgagcaattcgccgtgtccgacagcatcctgctctccaacagcttcgtctccctgctgaagtatacctcgttcggggcctctgggggcttcacgttcctcgacttagacgtgaagcaagggcggctgcgctaccagaccgtgaccgaggtcctcgacgcgaccctgatctaccaaagcatcacgggcctgtacgagacccggaccgacctctcccagctagggggcgactga

SEQ ID NO: 7816 - RNA, 4128 nt, synthetic construct
  misc_feature 1..4128: note = Cas9 variant
  source 1..4128: mol_type = other RNA
atgaagaagatcctgggcctcgacctggggacgaccagcatcggctgggccctggtgaacgagtccgagaacaaggacgagcagagctccatcgtccgcctcggggtgagagtcatacccctgacagtcgacgagaagggcaacttcgagaaggggaaggccatcaccaccaacgcggaccggcagcaggtccacgccgcgcggatcaacttacagcgctacaagctccggcgcgagaacctgcgcgactgcctacagaagcagggctggatcggtagcgagccgatgtgcgaggacggcaagagtagcaccttcgagacgtacaagctccgcgccaaggcagctgtggaggaggtgtccctgcacgagttcgcgcgggtgctgttcatgctaaacaagaagcgcggctacaagagcaaccggaaagccaacgacaaggaggaagggaagctgttcgatggaatgaccatcgccaagaagctgtacgaggagcacttaacccccgcggagtactccctgcagctgctcaacaccgggcgcaagttcacgcccgagtactaccggagcgacctgatcgaggagttcgagaagatctggaacgaacagcagaagtactaccccgagatcctgacggacgagttcaagcagcaactcgagggcaaggccaagtccaacaccagcaagctgttcctgggcaagtacgggatctactccgccgacaccaagggactcgaccgccgcttgcagcccctgaagtggcgcgtggaggccatgaagcagcaggtcgacaaggacgtgctcgcctttgtgatcagcgacctgaaggggcagatcgcgaacacgagcggcctgctcggcgccatcagcgatcggtccaaggagttgtacttctctaagcagaccatagggcagtacctgtgggcctcgctccaagagaacccccacatcagcatcaagaaccagcccttctaccgccaggactacctggacgagttcgagaagatctgggagacccaggccacataccataaggaactgacgagcgagctcaagcaggagatccgggacatcatcatcttctaccagcgccccctgaagtcaaagaagaacctgatcgccgtctgcgagctcgagcagcggaaggtgaaggtgaccgtcgacggcaaagagaaggagatcaccatcgggccgaagatcgcgcccaaaagctcccccatgttccaggagttccgcatctggcagaacttaaacaacatactgctgctggaccacgagaccaacagcaaacgccccctgtacgaagaggagcggaacctcctgtacgaggagctttccgtgaaggagaagctctcaaagacggaggccctgaaggttttaggcaagaaatccaaacagtgggacctgaattacaaggagctcgaggggaaccgcacccaggccgtcctgtacgactgctacaaccggataatcgtgatgagcggccacgaggagtgcaacttcaagaagctcaaggcctccgacatccgccattacgtgaagatgatcttcaagaacctcgccttcaacaccgacatcctgtgcttcgactcctccctgaagggccacgaactcgagcggcagccgatgtgccagctgtggcacctcctgtacagctacgagggggacaactcccgcaccggcaacgacgcgctgctacggaagctcgagactagcttcgggttccccaaggagtacgccgccgtcctggccgacgtgatcttcgaggactcctacggcaacctgagcgtgaaggccatgcgcaacatcctcccccacctccaggcagggaaggactactcgcaggcctgtgaggaggccggctataaacacagccggcgctccctgaccaaggaggagctgaaccagaaggtctacaaggagaagctggagctgctccccaagaacagcctgcataacccggtggtcgagaagatattgaaccagatggtgaacgtgatcaacgccgtcatcgaggagtacggcaaacccgacgagatccggatcgagttggcgcgcgacctgaagatcggggccgctgagcgtgagaacatgacccgctcgatcaatcagggcaacgccgagaacaagcggatccgcgagatcttagagaaggagttcgccctctcgtacctaagccggaacgacattatcaagtacaagctctacgaggagctcaagtccaacggtttcaagaccctttacagcgacacgtacatatccaaggataagctgttcagcaaagacttcgacatcgaacacatcatccccaaggcgaggctgttcgacgactccctcagcaacaagacgatcgaggcccgggacgtgaacatcgccaagtccaacaagaccgccttcgacttcattcttgagcgctatggcgaacagggggtgaagacctacaagacgaagctcctgcgcctgctcgaggacggcgccatcagcaacaagaagtacaacaacctgctgaagaccgaggcggacataccctccggcttcatcgaccgggacctccgcaacacccagtacatcgccaagaaggcctacgagatcctcagcgagctggtcaagatcgtgaccccgacgaccgggtccgtgactaaccggctccgcgaggactggcagctggtcgacgtgatgaaggagttaaatttcgagaagtaccagaagctcggcctagccgacgtgatcgaggaccgggacgggcgcaaggtcaagcggatcaaggactggaccaagcgcaacgaccaccggcaccacgcaatggacgcgctgaccatcgccttcacgaagcccagctacatacagtacctcaacaacctgaacgcccgatccgacaagagctccagcatctacggcattgaggtgaaggagctgcacagggaggagggcaagttccgcttcaacgctcccctccccatcaacgagttccgggccgaggccaagcgtcacctcaaaagcgtgctggtctcaataaaggccaagaagaaggtgatgacccagaacgtgaacaagatcaagaccaagcatgggatcatcaagaaggtccagctgaccccgaggggcgagctgcacaacgctacgtattacgggaccaagaagcgccccctggtgcggatggtgaaggtcggcgccgcgctggacgaggccacgatcaagcgcgtgtgcagccccgcaatccgggccgccctgctgaagcgcctcaacgcgtataacggggacgccaaggaggccttcaccggccggaactccatcgacaagaatcccatctacctggacatcgaacagacgaagctggtgccagtcctcgtgaagaccatcgagtggggcatgtaccaccccatcaggaagcgcatcacccccgacctcaaaatagacaaggtgatcgataaggggatccgggagaagctgaaagcccgcctcgccgagtttaacggcgacgcgcagaaggccttctcaaacctggacgagaacccgatttacatggacgaggccaagcggatcacactgaagcgcgtcagtatcgagggggtgctcagcgccatccccctgcacacgctgaaggacaaggcgggcaagcccgtgatcgggtccgacggcaagcccgtctttggcgactacgtccagaccagcaataaccatcacatcgccttctacatcgacgacaaggggaacctccaggacaacccggtgtccttcttcgaggcggccgagcgcaagagccagggcgtccccgtgatcgaccggcggtacaattgcgacaaggggtggcacttcgtgttcaccatgaagcagaatgaatacttcgtctttcccaacgaggccaccggcttcattccctcagaggtggacctgctggacgaggcgaactactgcatcatcagcccgaacctctacagagtgcagaagctgtccaaggccagcgggcgggactactggttccgccaccacctggagacgatgctcaacgacgacctgcggctgaagaactccacctttaagcgcatccagagcctcaagggcctggaggacatcgtcaaggtgcggatcaactccatcggcaaaatcgtggcggttgggaagtacgactga

SEQ ID NO: 7817 - RNA, 4128 nt, synthetic construct
  misc_feature 1..4128: note = Cas9 variant
  source 1..4128: mol_type = other RNA
atggagaccaagttcacgtactacctgggcctcgacatggggacggacagcctgggctgggccgtgaccgactccagctaccacatcctgagagccaaggggaaggatctctggggcgtccggctgttccccgcggccgagacctccgtggaccgcagaacctaccgtgtgaaccggcgcagacgccagcgggaagttgcacgcattggggccctgaaggagctgtttgccgatgagatcgagaaggtggacccgggcttcttcgtgcggctagacgagagcaagttccacatggaggaccgctccgagaacaacaagcagaagtacggcctgttcgcggataagctgttcagcgatgccgagtattacaagaagtaccccacgatctttcacctccggaaggagctcctcgagtcggaggaaccacatgacgtacggctggtgtacctggccctcctgaacatgttcaagcaccgggggcacttcctgaacagctccctccagatcgaaggcgagaacagtaacatcgccgagtcgtaccagatgttcgtggacaccctgaaggacgaggagctggacttccctgaacaggtcagcggggagcgactccaggagatttttcggagcagtgactcccgcaagaagaaggtggagaacctgctggcagagatgaacctcagcaagaagcagaagcgggagatccagttcgtgaacctgatctgcggcctgaaggggaagctctccgagctgttcccggacaaggaatacgacgaggaacagaagaaaatcgcattcagcttccaggactccgactacgaggacaaggagaacaccatccaggagctactcgacgagagcgaaatgaacatgatctacgccgtcaaggccgtgcacgacagcggcgtgctatccggaatcatgaacggggagcgctacctgagcgttgcccgggtggcgtcctacgaaaagcacaagaaagacctccagatcctgaaggacatcctgaagaaatacgacaccaaggagtacttcgagatgttccgcaacgagagcgagaagtccgagaactacagcgcctacgtgggctccgtcaagtaccacgggacgttccgcaggggcctcagcggcgggaagcaggaggacctgtacaaacacatcaagaaggtgctgggcaagttcccccaggacgacgagggggtgacctacgtcctcgaggagatcgagaccgaatcattcctgccgaagcagctgaccgccagcaacggcgtgatccccaaccaggtgcacgccagggagatgctcgcgatcctgaagcacgcggagctgtacctcccgttcctgcaggagaaggatgacacggggctgtccgtcagcgagaagatcctcaagctgttcatgttccagatcccctattacgtgggacccctgggacaggagtacaaggacaagaagggatacaacgtctgggccgagcggaaggaacccggcaagatctacccctggaacttcgaggaaaagatagacgtgaagaagagtgctgagaagttcatcggacgcatggtgcggcgctgcacttacctgagcggcgagcaggccctccccaagcagagcctgctgtacgagaagtttcaggtcctcaacgagctcaacaacctgcggatccgcggcgagaaaatccccgtgagcttgaagcaggagatctaccatgacctgttcggcgacggcaagaaggtgtccatgacacggctgaccaactacctcctgcaaaacggggtcatcagctccgaagagaaggacagctgcatcagcggcattgacgggggcttccacaactccctgagctccgtggggaagttcaagggtgtgttcggcgacacggtccacaccgacgagcaccgcaagatgatcgaggacatcatattctgggggaccgtgttcggggacggcaagaagctcctgaaggagaaggtggaggaggtttacggcaaccagctgaccgaggcccagaagaaacgaatcttcggcttcaagttcagcggttggggccgcttgtccaaggcgttcctgacgatggagggtgcgtcaaaggacaacggcgaaatcaaggggctgatccaggccatgtgggacaccaactgcaacctcatggagctgctgagtgagcggttcacctacaaggacaagctcaacgaaatggtgaccacggccgagaagcccctgtgcgaatggaagatcgaggacctggacgagatgtacctcagcgccccggtgaagcgtatggtctggcagacgatcagagtggtggacgaggtgcagcaaatcatgggctgcccgcccaagcgcattttcgtggagatgacccggtccgacggcgaaaaggggaagcgcaccgtgagccggcagaagaaacttgtcgacctgtacaaggcgctcggcaaggaagggaagatctggtcagaggagctgaacaacacgcccgagggtcagttccgcatcaagaagctctacctctactacctgcagatggggaagtgtatgtacaccggcgagagcatcgagctggagcccctcatgaacgacaaccacctctatgacatcgaccacatctacccccgccacttcatcaaggacgacaacatctccaacaacttggtgctagtgaagaaggaacgaaacgcccacaagagcgactcgttccccatcgagcccgagatccgcaacaagatgatgccgttctggaagtccctgcggaagaagggcttcctgaccgaggagaagtacaatcgcttaacacggatgagcgccttcactgatgaggagaaggccgcgttcatctctcgccagcttgtcgagactagccaggggaccaaggccatcacccagatcttcaagcaggccttcgccgactccgagattgtgttcagcaaggcctccgtggtcagcgcgttccggcagaagttcgactgttacaaggttcgctgcgtgaacgactaccaccacgcccacgacgcgtacctgaacatcgtcgccggaaacacgtatcgggtgaagttcacctccaaccccctcaacttcatcaaggaggccaagaagaacccgaactctcgcgagaaccgatacaacatggacaagaccttcgagtgggacgtgacccgcaacggggagactgcgtgggtcgcacagtctaacgagaaccccggcacgattcagctggtgaaaaagtacctgaacaagaactcaccgctcatcaccaagatggtgtacgaaaagcacggaggcatcacccagaaggccaccatctggtccgccaagaaggccgagagcggcaacacggacgcgtacatccccgtaaagatgaacgacccccggctggccgacgtgacaaagtacgggggcgtgaccaccattgccgtcgcggggtatacgctgcttgagtacaaggcgggcgggaagaccgtgcgctccctggaggccctgccgatctacctcggcggcagcaagaatctgaccgaggagcagatggtggagtacttctccaacatcctgcagcaggagaacaaggagaaagtcgtgagcgacgtgatcatccggaagaagatgataccctccgggagcttaatcaagtataacggcttctactactacctggccgggaaaaccggcaaccgcatagttctgatctccgccgtgcaactctgtctgcccatggatacgatgctgtacatcaagaagatcgagaaggcctgcagcaccggcaacttcgaggagaaggacaagaacgggaagcaggtcctctccaaacagcagaacgagtttgtttacgagctgatcatcgagaagtaccagcagagcatcttcaagaagaaggtgggcgcgatcggggacaccatcatcgagaagcgggagaagttcgccgagatcagcctcgaggagcagtgtaaagtgctcatgcagattttcctgaacttccagtccggtataggggtcgacctgaccagcgtggacggctccaacaagagcggcgtcacgtacctcaacaagaagatcatgaacgcccaggagctgaagctgatcgaccagtccgtgactggggtgttcagccgcgagatcgacctcctgaccatctga

SEQ ID NO: 7818 - RNA, 4128 nt, synthetic construct
  misc_feature 1..4128: note = Cas9 variant
  source 1..4128: mol_type = other RNA
atgtctaacaagtcctactccatcggccttgacatcgggaccaactctgtgggctgggccgtcataaccgacgactacaaggtgcccagcaagaaaatgaaggtgttaggtaacacggacaagcacttcatcaagaagaaccttataggcgccctcctgttcgacgaagggaccaccgcggaggaccgccggctgaagagaaccgcccggcgccggtacacgcgccgtaagaaccgcctgcggtacctccaggaaatcttctccgaggagatgagcaaagtcgactccagcttcttccaccgcctggacgactccttcctggtgccggaggataagcggggcagcaagtaccccatcttcgccaccctcgccgaggagaaggagtaccacaagaagtttcccaccatctaccacctccggaagcacctggcggactccaaggaaaagaccgacctccggctgatttacctagcgctcgcccacatgatcaagtaccgcggccacttcctatacgaggagagcttcgatatcaaaaacaacgacatccagaagatcttctccgagttcatcagcatctatgataacacgttcgaggagtcctcgctgatcgggcagaacgcccaggtcgaggcaatcttcaccgacaagatttcaaagagcgcgaagcgggagcgcgtcctcaagctattccccgaccagaagtccaccggtctgttcagcgaatttctcaaactcatcctggggaaccaggccgacttcaagaagcactttgacctcgaggagaaagcgccgctgcaatttagcaaggacacctatgacgaggacctggagaacctcctgggccagattcgggacgacttcgccgacttattcctcgtcgccaagaagctgtacgacgcgatactgctgtccgggatcctgacggtgaaggaccttagcacgaaggcgcccctctccgcctccatgatcgagcactacgagaatcaccagaaggacctggccgccctaaagcagttcatccagaacaacctccaggaaaaatacgacgaggtcttctccgaccaaagcaaagacggctacgccggctacatcaacgggaagaccacacaggaggccttctacaagtacatcaagaacttgctgtccaagttcgagggcgccgactacttcctcgacaaaatcgagcgcgaggacttccttcggaagcagcgcacattcgacaacgggagcatcccccaccagattcacctccaggagatgaacgccatcttgcaccggcaaggcgaacactacccgttccttaaggaaaacaaggagaagatcgagaagatccttatcttccgcatcccgtactacgtgggccccctggcacgcggaaaccgggactttgcgtggctgacccgcaattccgacgaggccatccggccttggaacttcgaggagattgtggacaaggccagttccgccgaggacttcatcaacaagatgaccaactacgacctgtacctgcccgaggagaaggttctcccgaagcacagcctgctgtacgagaccttcgctgtgtacaacgagctcacgaaggtgaagttcatcgcggaaggcctgacccgctaccagtttctggacaaaaagcagaagaaagacatcttctacactttcttcaaggccgaggacaaacggaaggtcaccgagaaggacattatccactacctccacacggtggacgggtacgatggcatcgagctggaggggatcgagaaacagttcaacgcctccctgagcacctaccacgacctcctgaagatcatcaaggacaaggagttcatggacgacgacaagaacgaggcgatactggagaacatcgtgcacacactcaccatattcgaggaccgcgagatgatcaagcagcggttggcgcaatataactccctgttcgacgagaaggtcatcaaggccctcacgcgccggcattacactggctggggcaagctgagcgccaagctgataaacgggatccgtgataaaaagtccggcaagacgatcctcgactacctgattgacgacggggagatcaaccggaactttatgcagctgatccatgacgacggactcagcttcaaggagatcatccagaaggcccaggtgttcgggaagaccaacgacgtgaagcaggttgtgcacgaactgcccggcagtcccgcgatcaagaagggcatcctgcagagcatcaagatcgtggacgagctcgtcaaggtgatggggcacgcacccgagagcatcgtcatcgagatggcccgcgagaaccaaacgaccgcccggggcaagaagaactcccaacagcgctacaagagaatcgaggacagcctgaagaacctggcctccgggctcgactccaacatcctgaaggagaacccgaccgacaacgtgcagctgcagaacgaccgcctcttcctgtactacctgcagaatggtcgggacatgtacactgggaagcccctcgagatcaatcagctgtccaactacgacattgaccacatcatcccccaggccttcatcaaagacgacagcttagacaaccgagtgttaacgtccagtaaggacaaccgcggcaagtccgacaacgtccccagcctggaagtcgtggagaagatgaaggcgttctggcagcagttactcgactccaaacttatcagcgagaggaagttcaacaacctgacgaaggccgagcgcgagcggggcgggctaaacgagctggataaggtcggcttcataaagcgccagctggtggagacacggcagataaccaagcacgtggcacagatcctcgacacccgcttcaacaaggaagtcacggagaaggacaagaagaaccgtaatgtgaagatcatcaccctgaagtccaacctggtgagcaacttccgaaaggagttcgggctctacaaggtcagggagatcaacgactaccaccacgcccacgacgcctacctgaacgcggtggtggccaaggctatcctgaagaagtacccgaagctcgaacctgagtttgtatacggcgagtaccaaaagtacgacctcaagcgctacatctcccgtagcaaggacccaaaggatatcgagaaggccaccgaaaagtacttcttctactctaacctactcaacttcttcaaggaggaagtacagtacgccgatggcaccatcgctaagcgcgagaacatcgagtacagcaaggacacaggggagatcgcctggaacaaggagaaggacttcgccacagtgaagaaggtcctgagcctgccccaagtgaacatcgtgaagaagagagaggtccagaccggcgggttctccaaggagagcatcctcccgaagggcaactccgacaagctaatcccccgcaaaaccaaggatatcctgtgggagacgacgaagtacggcgggttcgacagccccgtgatcgcctactccatcctcctgatcgcggacatcgagaaaggcaagagcaaggagctgaagaccgtaaagactctagtcgggatcactatcatggagaaggccaccttcgaggagaaccccatcaccttcctggaaaacaagggttaccataacgtgcggaaggagaacatcctttgcctcccgaagtattctctgttcgagctggagaacgggcgacggcgcctcctggccagcgccaaggaattacagaagggcaacgagatcgtcctccccgtctacctgaccacgctgctctaccactccaagaaccttcacaagctggacgaacccggtcacctcgagtacatccagaagcaccggaacgagttcaaggacctgctgaacctcgtcagcgagttttcccagaagtacatcctggccgacgcgaacctggagaagatccagaacctctacgccgacaacgaacaggcggacatcgagatcctggccaacagctttatcaatctgctcacattcactaccctgggggccccggcggccttcaaattcttcggtaaggacatcgaccgcaagcggtatacgaccgtgtccgagatcctgaacgctaccttgatccaccagagcatcaccgggctgtacgagacccgcatcgacctgtccaagctcggcgaggactga

SEQ ID NO: 7819 - RNA, 4128 nt, synthetic construct
  misc_feature 1..4128: note = Cas9 variant
  source 1..4128: mol_type = other RNA
atggagaagtcctacagcatcggcctcgacatcgggaccaatagcgtgggctgggccgtcatcaccgacgactacaaggtgcccgccaagaagatgaaggtgctcgggaacacggacaagaagtacatcaagaagaacctgctgggcgcgctcctattcgactccggggagaccgccgaggtcacacgcctgaagcggaccgctcgccggcgctatacgcggcgcaagaaccggctcaggtacctgcaagagatcttcgccaaggagatgaccaaggtggacgagagcttcttccagcggctggaggagtctttcctcaccgacgacgacaagaccttcgacagccacccgatcttcggcaacaaggccgaggaggacgcgtaccaccagaagttccccacgatataccacctccgcaagtacctggccgactcccaggaaaaggccgacctcagactggtgtacctggccctcgcgcacatgatcaagtaccggggccacttcctgatcgagggggagctgaacgcggagaacaccgacgtccagaagctgttcaacgtgttcgtggagacctacgacaagatcgtcgacgagagccacctgtccgagatcgaggtggacgccagctccatcctgaccgagaaggtgagcaagtcccggcgcctcgagaacctgatcaagcagtaccccacggagaagaagaacaccctgttcggaaacctcatcgccctggctctggggctccagccaaacttcaaaaccaactttaagctgagcgaggacgcgaagctgcagttctccaaggacacctacgaggaggacctcgaggagctgctgggcaaggtcggggacgactacgccgacctcttcatcagcgccaagaacctgtacgacgcgatcctgctctccggcatcctgacggtggacgacaacagcactaaggccccgctgtccgcgagcatgatcaagcggtacgtggagcatcacgaggacctcgagaagttaaaggagttcatcaagatcaacaagctgaagctctaccacgacatcttcaaggacaagaccaagaacggctacgccgggtacatcgacaacggcgttaagcaggacgagttctacaagtacctgaagaccatcctgacgaagatcgacgacagcgactacttcctcgacaagatcgagcgcgacgacttcctgcggaagcagcgcaccttcgacaacgggtccatcccccaccagatccacctccaggagatgcatagcatcctgcggcgccagggtgattactaccccttcctgaaggagaaccaggccaagatcgagaagatcctgaccttccggatcccctactacgtgggcccgctggcccgcaaggactcccgcttcgcctgggcgaattaccacagcgacgagcctatcaccccctggaacttcgacgaggtggtggacaaagagaagtccgccgagaagttcatcacgcggatgaccctcaacgacctgtacctgcccgaggaaaaagtgctcccgaagcacagccacgtgtacgagaccttcaccgtctacaacgagctgacgaaaatcaagtacgtgaacgagcagggggagtccttcttcttcgacgccaacatgaagcaggagatcttcgaccatgtgtttaaggagaatcgcaaggtcaccaaggccaagctgctcagctacctgaacaatgagttcgaggagttccggatcaacgacctgattggcctcgacaaggactccaagagcttcaacgcctccctggggacctaccacgacctaaagaagatcctcgacaagagcttcctggacgacaagaccaacggccagatcatcgaggacatcgtgctgacgctcaccctgttcgaagaccgcgacatgatccacgagcggctgcagaagtactccgacttcttcaccagccagcagctcaagaagctggagcgccgccactacaccgggtggggccgcctgtcctacaagctcatcaacggcatccggaacaaggagaacaacaagacgattctggacttcctgatcgacgacgggcacgcgaaccgcaacttcatgcagctcatcaacgacgagagcctgtcgttcaaaaccatcatccaggaggcccaggtcgtgggcgacgtggacgacatcgaagccgtcgttcacgacctgcccgggagccccgccatcaagaagggcatcctccagagcgtgaagatcgtcgacgagctggtgaaggtgatgggcgacaaccccgacaacatcgtcatcgagatggcacgggagaaccagaccaccggctacggccgcaacaagagcaaccagcggctgaagcgccttcaggacagcctgaaggagttcgggagtgacatcctgagcaagaagaaaccgtcctacgtggacagcaaggtggagaactcccacctccagaacgaccgtctgttcctgtactacatccagaacggcaaagacatgtacaccggggaggagctcgacatcgaccgcctgagcgactacgacatcgaccacatcatcccccaggccttcatcaaggacaactccatcgacaacaaggtcctgacgagctccgccaaaaaccggggcaagagtgacgacgtgccctccatcgagatcgtgcgcaaccggcgcagctactggtacaagctctacaagtccgggctgatcagcaagcgcaagttcgacaacctgaccaaggccgagcggggcggtctcaccgaggccgacaaggcggggttcatcaagcgccagctggtcgagacccggcagatcacgaagcacgtggcccagatcttagacgcccgcttcaacaccaaacgggacgagaacgacaaggtgatccgcgacgtcaaggtgatcaccctcaagtccaacctggtgagccagttccggaaggagttcaagttctacaaggtccgcgagatcaacgactaccaccacgcccacgacgcctacctgaacgcggtcgtgggcaccgccctcctgaagaagtaccccaagctgacgccggagttcgtctacggggagtacaagaagtacgacgtgcggaagctcatcgccaagtccagcgacgactatagcgagatgggcaaggccaccgccaagtacttcttctactccaacctgatgaacttcttcaagaccgaagtgaagtacgcggacggccgcgtcttcgagcggcccgacatcgagacaaacgccgacggggaggtggtgtggaacaagcagaaggacttcgacatcgtccgcaaggtgctgagctacccccaggtgaacatcgtcaagaaggtggaggcccagacgggcgggttctccaaggagagcatcctctccaagggcgacagcgacaagctgatcccccggaagaccaagaaggtgtactggaacaccaagaagtacgggggattcgactccccgacagtcgcctacagcgtgctggtggtcgcggacatcgagaagggcaaggccaagaagctcaagacggtgaaggagctggtggggatctccatcatggagcgcagctttttcgaggagaaccccgtctccttcctggagaaaaagggctaccacaacgtacaggaggacaagctcatcaagctgcccaagtacagcctgttcgagttcgagggcggccggcgccggctcctggcctccgccaccgagctgcagaaggggaacgaggtgatgctccccgcccacctggtcgagctgctctaccacgcgcaccgcatcgacagcttcaactccaccgagcacctgaagtacgtgagcgagcacaagaaggagtttgagaaggtgctgtcctgcgtcgagaacttcagcaacctctacgtggacgtcgagaagaacctgtccaaggtccgggccgccgccgagagcatgaccaacttcagcctggaggagatctccgccagcttcatcaacctcctgacgctgaccgcgctcggcgccccggccgacttcaacttcctgggggagaagatcccgcgcaagcggtacacctccaccaaggagtgcctgagcgccacgctcatccatcagtccgtgaccgggctgtacgagacccgcatcgacctgagcaagctcggcgaagagtga

SEQ ID NO: 7820 - RNA, 4128 nt, synthetic construct; identical to SEQ ID NO: 2020
  misc_feature 1..4128: note = Cas9 variant
  source 1..4128: mol_type = other RNA

SEQ ID NO: 7821 - RNA, 4131 nt, synthetic construct
  misc_feature 1..4131: note = Cas9 variant
  source 1..4131: mol_type = other RNA
atgagcaactttgacaaccacaaggactccatttgtaagcacaagggcctgaagaaggggaactactacatcgggcttgatatcgggaccaacagcgtgggttgggccgccacaaacgagcagtacgagctgcttaagttcaagtcccacaagatgtggggaagccgcctcttcgcggaggcccagaccgccgtcgacacccgaatgaagcgctccgcccggcgccgtctgcagcgccggaagttccgcctgatcctcctggagagcctgttctccaaggagatcaacgctgtagacgagaccttcttcatgcggctccacgagagcaactaccacgtggaggacaagaccaacctggttaagtacacgctgttcatcgacaagaactacaccgacgtcgactactacaaagagttccccaccatctaccacctccgccaccacctgatgaccgaggggacgaaagacatccggctgcttttcctggcgatacaccatatcctgaagtaccgcggcaacttcctctacgggaagaaggagttctccgtggacggcgaaatgtacagcgtcctgcgctccaccctggaggagctcgggtttggttcttacgtggaagacgagaacgttctgcaatccatcgccaacctggtcctcgaccgagggatcgccagaagcgagaaggtgaagcagatcgagccgctaatcgcccagggcaagaagctgtccagcgtggagaagaaccgcctcaaggcgtgggcctacctgatcatggggctgaaggccaacctcgtcaacctgttcaccgacgaggacgtggaggtcgtcctgcccgaggagaaggagtttaagtccatcaacctccacgaggggatctacgaggacgtgcgggacgcctacgaggacgcctggggcgaccgcttcgcgatcgtggaccaatgcaaggtcctgcacgacatcatcgtgatcagctccatcatcaagcccgggcagagcctaagcgaggccaagatcgagtcctacaaccagcacaaggaggacctcgtgctgctcaagtcggtcctcaaggaggataagaagctgtacgacgacatgttcgtggtggacatcgacaaggggaccaactacgtcaagtacatcaagcagggcgtgaacgggaacacgtccaccacacaggaggcgttctacaaatacgtccggaaagtggtgtccgtcctgcccgagaccgagaacacgcgctgtatcgtgcagaagctcgaggagggtaccttcctgccgctgcagcggatctccaagaatggggtggtcccctaccagctccacaaggaggagctggtacgcatcctggagaaagccaagctcaacttccccttcctgaacgaggtggaggacgggctgaccgtcgccgacaagatcatctctatcctggagttcaagatcccatactacgtggggcctctcaaccccacccactccatcgagaacggcggcttcgcgtgggtggtccgaaaggaagccggccaggttctcccctggaacttcgagcaaaaggtggatgtccaggcctctgcagtgaagttcatcgagaacctgacgaacaagtgcacctacctcattgaccaggatgtgctgcctaagtactcccttctctacgccgagtttagcctgctgaacgagctcaataacatccgggtcaacgacaagccgctgcctgcggacgtgaagcaggctttcattcgcgaccacttcatctccctgcaggacagcaagaccgccaccaagaaggtggtcgccaagtacctcgtggacaacaactacgtgtcccagccgccaatcatcacggggatggaccagcagatcgctaccaagctgaccagccaccgggacatgaccagaatcctgggggagcacttcgactacgcgatggccgaggacatcatccggtacataacgatcttcggggagtccaaggacatgctccgccaggtcctgaagaactactacggagaccggctcaccacggagcagatcaagaagctcggcaagctgacctacacgggatgggggcgcctgtccaagaagttcctctccgacatctggggcatgaaaaagaacgacgacgacgccgaggccgggaccatcattgagcacatgcgggagggccaggagaacttaatgcagctgctcagttccagctacagcttcatcgacgtggtgcaggagtacgttaccaacgtgctgggcgcgaaagagaagaccgccttcgagatgctagaggatctctcactgagccctatggtgaagcgttccgtctggcagaccctgcggatcctcgacgaaatcgtgagcatccgcaaggagctgcccaagaagatcttcgtggaggtcgcccggaccaacaaggccgacaagaagcgcacccagtcccggaaggccctgctcgaggaactgtacgagcaaatcaaggacgaggacgtccacgtgcttcagcaggagctcgagagcaaggaggactccgcgctgaacagcaaaaagctgtacctctacttcactcagatgggccgctgcatgtacagtggccggcgcatcgacatccacgagctgttcaccgacacgtacgacatcgaccacatctacccacggagcctgaccaaggacgactcctggcacaacatcgtcctcgtggagaagcagctgaacgcggagaagaccgaccgcttccccatcctgagcgcaattcagtccaagcagaaggggttctggaagctgctatgggaccgcggcttcatcagcgagaagaagtacgaccggctggtgcgcaccacggacctcaccgacgaagaactgaaccagttcatcaaccggcagatcgtctccactaatcagagcgtgaaagccgtgacaacactgctccaccagctgtacccggagaccgaggtcgtgttctccaaggccgaaaacatcagcgacttccgccgggattacgggttcgtgaaggtccgcagcatcaaccaccaccaccacgcgaaggacgcctaccttaacatcgtggtgggcaatgtctaccacgagaaattcaccaagaacttcctctccttcgctaagcagaagggcacccaccggacgtacaacctgaccaagatgttcgagtacgagattaagctgaccgaggagagcaagaaggtgatctgggaccccaacatccatatggacatcgtgaaaaagatgatgaagtccaacgacgtccgcgttacccagcgggccgtcccccagaagggcgggctcagtgacgagacgatatacaagaaggggatcgccaagcgcggagtctacttacccctgaagtccagcgacgagcgggtgcgcgatgtggagaagtacgggggccggacatccatcactatcagcgagtacatcatcctcaacatccgcgacacctccgaccaggaccggatcgagatcttcagcctgccgttgtacatcgcggggaagaaggacatacacaaggccatcgaggaggcctacctctccacgtgcaagaagcctgccagcgtggtggacatccagatcctataccgcgggctgtacataggctccaaggtcaacatcaacgggttcacatactacatgggcgggaagaccggcagcaacgtgtccgtggacagcgcggtcgacgtggttatggatatcacctccagcgtctacatcaagctactggagaaagtggccatcaagaagatcgagaactccaagacgttccggatcgaaaacatcaagaccagctacaaccacaaggaggtgaccgtcagcaaggagcagaacatcgccctgtaccaggaactcctgaaaaagctggacacgcccctcttctctaagatgaagggcaacaaactggaggagttccgcaccgtggggttcgacaccttcatagccctgagcctcgaggaccaagcctccgtgctgctggaggtcctcaatgtgctgaccaatttcaagaccaagcgggacatcacgaagatcggcatgaccagctcccgaagcaccctggggatcaacatctccaacaccgagcaattcagtgtgatcacgacttccatcaccggcctctacgagcaggagatcaagatcaagtga

SEQ ID NO: 7822 - RNA, 4131 nt, synthetic construct
  misc_feature 1..4131: note = Cas9 variant
  source 1..4131: mol_type = other RNA
atgaccaccaagaaccgcgagaagaacaacaagttccacaaggccagccccctgtacacgctcggcctggacatcgggaccacctccgtgggcttcaccgccatcgacgaggcgcagcggccgatgcgcgccaaggggaaaacggtcatcggcgtgcggctgttccaagaggggcagagcgccgtgggccgcaagaacttccggaccacccgccggcgcctcaagcggcgtcggcgccggctgaacctgctcaagcagttcttctccgcgcccctgcgcaagatcgaccccaccttcttcaagcggctgaaggccagctccctcagccccgccgataagcgccggtacctggccccgggcctgttccccaacgggggcgacatcaagttctaccagaagtaccccacgatctaccacctccgcctggcccttatgaccgagaagcggcccttcgacctccgcgaggtctatctggccatacaccacatcgtgaagtaccgcgggaacttcctgaacccgctccccgtgtccgcgttccgcggcagaaaccagcggttcgaggaccagttcagcgagctgaaccagctgtacaagtccctcgagggcgagagccccttccagttcgacgagaagattttctccgagctggacaagcagctgctcgtcaacgacggccgcaagatcgaccggcagaagcagctggccaagcgcgtgttcatcaagaccaacgagaagcgcatcgatagccaccaccagaagatcgcctccgccttcagcaaggccgttttcggctacaagttccgccccgacgtcctactcaactccgacccgaacgagtcaattgacgagttcatcaagttcggggacgaggacttcgacgacaagttagtgattctgcgggagtccctcaacgcgacccagaaggagatcctggccgtgacgcagcgcatctacagccaaatcatcctgaacgagatcgtcccctcccgggagaccctcagcgaggccatggtgagccgctaccagaagcatcactccgacctgcagctgctcaccgaggcctgcaagaagatgaccaaggccaaggcggcccggatccaggccgcctacacggactacatcggcaagggggacggccacaagctggtgcacgaccagttcgtcgccctgatcaagaagaacctcgacccctcagaggagggccgcgacctggcggagcggctggcccaggacgacttcatgcccctccagcgcaccccgctgaaccgggtgatcccccaccagctgcagcaggaggagctcgaccgcatcatcgagaaccagggggagtactatcccttcctgaagacactgaaccccaaccggtcccgcgccggcgtggccaactaccagctcgacgagctggtcagcttccggatcccctactacgtggggcccctgatcaccgccacggatcagctgcacacctccggcgcgaagttcgcctggatgacccgccgcgccgccggggagatcaccccctggaacttcgaccagaaggtggaccggctcgcgagcgccaaccagttcatccgccagaacatgcccaaggacaaccacctcctggaggccgacgtcctgccggccaactccctgacgtaccagcggtacctggtgctcgacgagctgaacgccgtgaaggtcaaccacaagagcctgaccgtgtcccagaagcagcgcatcttcaacgacctcttcaagcggcagcgcaccgtcaccgtgcttaacttgcagaactacctcaagagcatcgagaagctgcccacgctgcccgtgatcaccggcgtcagcgacagcgagcggttcaagaccaccctctccacgtacctggacttcaagaacatcttcggcgggaaggtggacgacagctcccagaaggagaagttcgagaagataatcctgtacgcgaccatcttcgaggaccacgccgtctacaaggccaagctcgaccagatcgactggctgggccagcagcagaagaccgacctgctcagcaagaactaccaagggtggggccagctgtccgagaagctgctcctggggctgaagaaccaggccggccaatcgatcctcgacgagctgtggcagactaacaaacgcttccgggagatcatgaacgaggcccacttcgcgaaacagatcatggcctccaacgccgccctgctccgcaagaagggtctggacgacgtcctgagcacggccttcctcagcccccagaacaagaaggcgatccggcagaccgtggaggtggtcgacgacatcgtgaaggccatcggttgcccgccccagaagatctccctacacttcagtaaggcccccgccgacgcgatccgccacgagcgggacaacgccaacatcatcctgcgcacctaccggaacctcccggccaagatggtggacgaccagctgaaggccgagctgcaggccaccgcggagaagcaccaggtcctctccgacaagctgtatctgtacttcacccagctcggccgcgacctgtacaccggagagatgctgaagatgagcgagctcgagaacgacatgatcgaccacatcatgccgcagaccttcgcctacgacgactccgtaaacaaccgggtgctcgtcagccagaaccactccagccagttaggcaagacctccggtgagaagtccgatgccaaaatgatccgcttctggcaggtcctccgcgacaacaagctgatcagcgagcaaaagtaccagaacctgaccctcgacagcgaccacctgtccaagagcacccgcgagcagctgctcaaccggtacctggtggagaagaaccccatcacccagtgggtggcctccgtgctgaccgagaagtacggcgacaacggcacccgcgtgctcacgatcaacccccgcatggtctaccagatgcggcggcagttcaacctggtgaacctgccggaggtgaacgactacgaccacgggctcgacgcctacctggcggccttcatcggcaactacgtcgaccgccgctacccccggctgagaagctacttcgtgtacggggacttctccagctcaaaggagatcgtgttccggctcaaccgattcaacttcctgttcgacctgggccaggccgagcccaacgagctcaccgactgggagaccggcgagatgatctgggacaaggccgccgcgaactccgtcctgcgggacgtgtaccagtataagttcatgctgatcagccaggccgtgtactcccgccagggggccatgttcaaccagaccatctaccccgcctctcaggcggccggccggcagctcataccggtcaagaagaaccgcgccactaagctgtacgggggctactccgggaacgtggacgcctatctggccatcgtgcggctcggcggccccaagagcgaccagtaccgcgtcgtggggatccccacccggatggtgggccgcttacaatccgcgatgaagcagggggccgacacctacgccaacaccctgcacaagatcctccagccccagttcacgaagcggaagaagaaccgccagaccggctactacgaggagaccaccgagccatttgccgtcatcctggacaaagtgtactaccggcagctgatcatcgacgggcagcagaagttcatgctcggaagctccacgtaccagttcaacgccaagcagttggtgctgagctcccgcgcgcgccagattctcagcggcgaggagcgcctgaccgacgagaacgggtcccaggacctgatcgacgtctacgacgagatcctcaccaagatcgaccgctacttcgaactgtacgaccagcggcacttccgccagtcactgcacgacggccggaagcagttcatttccctacccatccacaatgtgtaccgcgccaaccggctaatcgagcacgggaagtacgagaccctgagccagatcctcaacggcctgcacgccaacacgatgatgaccaacctgagataccttgggatctccagcccattcggcaagttccagtctcccaacggcatcaagctgagcaaagacgccgtgctggtctaccagagcccctccgggctgttcgagcggcgcgtgcggctccgcgacctgtga

SEQ ID NO: 7823 - RNA, 4131 nt, synthetic construct
  misc_feature 1..4131: note = Cas9 variant
  source 1..4131: mol_type = other RNA
atgaacaacaagccctacagcatcggcctcgacatcgggacgaactccgtgggctgggccgtcatcaccgacgactacaaagtgccgagcaagaagatgaaggtgctcggcaacacggacaagcacttcatcaagaagaacctgctgggcgccctcctgttcgacgaggggaccacagcggaggaccgccggctgaagcgcaccgcccggaggcggtacacgcgccggaagaaccgcctccggtacctgcaggagatcttcacagaggagatgtccaaggtcgacatcagcttcttccaccgcctcgacgactcgttcctcgtgcccgaggacaagcggggcagcaagtaccccatcttcgccaccctggaggaggagaaggagtaccacaagaacttccccaccatctaccacctccgcaagcacctagctgattccaaggagaaggccgacttccggctgatctacctggcgctcgcccacatcataaagtaccgcggccacttcttatacgaggagagcttcgacataaagaacaacgacatccagaagatcttcaacgagttcatctcaatctacgacaacacgttcgaggggagctcactgaacggccagaacgcccaggtggaggccatcttcaccgacaagatcagcaaatccgcgaagcgggagcgggtcctcaagctgttcccggacgagaagtccacggggctgttcagcgagttcctcaagctgatcgtgggcaaccaggccgacttcaagaagcatttcgacctggaggagaaggcgcccctccagttcagcaaggacacctacgatgaggacctggagaacctgctcgtgcagatcggtgacgacttcgccgacctgttcctggtcgccaagaagctctacgacgccatactgctgtccggcatcctcacggtgaccgatcccagcaccaaggcgcccctgtccgccagcatgatcgaccggtacgagaaccaccagaaggatctggctgccctcaagcagttcatcaagaccaacctgccggagaagtacgacgaggtgttcagcgaccagtccaaggatgggtacgccgggtacattgacggcaagacgacccaggaggccttttacaagtacatcaagaaccttctcagcaagctggagggggccgactacttcctggacaagatcgagcgcgaggacttcctccggaagcagcgcaccttcgacaacggctccatcccccaccagatccacctccaggagatgaacgccatcatccggcgccagggcgagcactaccccttcctgcaggagaacaaggagaagatcgagaaaatcctgacctttcgcatcccctactacgtcgggccgctggcccggggcaaccgcgacttcgcgtggctgacgcggaacagcgaccaggccatccgcccttggaacttcgaggagatcgtggacaaggcccggtccgcagaggacttcatcaacaaaatgaccaactacgacctctacctgcccgaggagaaggtgctgcccaagcacagcctgctctacgagaccttcgccgtctacaatgaactgaccaaggtgaagttcatcgcggaggggctgcgcgactaccaattcctcgactccggccagaaacagcagatcgtgacgcagctgttcaaggagaagcggaaggtcaccgagaaggacatcatccagtacctgcacaacgtggacagctacgacgggatcgaactcaagggcatagagaagcagttcaacgcctccctgagcacctaccacgacctgctcaagatcatcaaggacaaagagttcatggacgacagtaagaacgaggccatcctggagaacatcgtgcacaccctgacgatcttcgaggaccgcgagatgatcaagcagcggctcgcccactacgcgagcatattcgacgagaaggtcatcaaggcactgaccaggcggcactacaccgggtgggggaaactctccgccaagctcatcaacggcatttacgacaagcagagcaagaagaccatcctggactacctgatcgacgacggggagatcaaccgcaacttcatgcagctcatcaacgacgacggcctgtccttcaaggagatcatccaaaaggcccaggtggtgggcaagacgaacgacgtcaagcaggtcgtgcaggagctgccgggctcacccgccatcaagaagggcatcctccagtccatcaagctggtggacgagctggtgaaggtcatggggcacgcgcccgagagcatcgtgatcgagatggccagggagaatcagaccaccgcccgcggcaagaagaactcccagcagcggtacaagcgcatcgaggatgctttaaagaacctggcccacgggctggacagcaacatcctcaaggagcaccccaccgacaacatccagctgcagaacgaccggctgttcctctactacctgcagaacggaaaggacatgtacacgggaaagtccctggacatcaaccagctcagcagctgcgacatcgaccacattatcccgcaggcgttcatcaaggacgactccctggataaccgcgtgctgacaagctccaaggacaaccggggcaagagcgacaacgtcccctccctcgagatcgtgcaaaagcgcaaggcattctggcagcagctgctggacagcaagctcatctccgagcgcaagttcaacaacctgaccaaggccgagcggggcgggctggacgagcgcgacaaggtgggcttcatcaagcggcagctcgtcgagacccgccagatcaccaagcacgtggcccagatcctagatgcccggttcaacacggaggtgaccgagaaggacaagaaggaccgaagcgtcaagatcatcaccctgaagtccaacctcgtgagcaacttccgcaaggagttccgcttgtacaaggtgcgggagatcaacgactaccaccacgcgcacgacccctacctgaacgccgtcgttgctaaggccatcctcaagaagtaccccaaactggagccagagttcgtgtacggggactaccagaagtacgacctgaagcgctatatctcccggaccaaggatcccaaggaggtcgagaaggcgacggagaagtacttcttctacagcaacctcctgaacttcttcaaggaggaggtgcactacgccgacggcaccatcgtgaagcgcgagaacatcgagtactccaaggacaccggcgagattgcgtggaacaaggagaaggacttcgccaccataaagaaggtcctgagcctcccccaggtaaacatcgtgaagaagacggaggagcagaccgtcgggcagaacggcgggctgtttgacaacaacatcgtgtccaagaagaaggtggtcgacgccagcaagctgacccccatcaaaagcggcctctccccggagaagtacgggggctacgcgcggcccaccatcgcatactctgtgctggtcatcgccgacatcgagaagggcaaggccaagaagctgaagcgcatcaaggagatggtcgggatcacggtgcaggacaagaagaaattcgaggccaaccccatcgcgtacctcgaggagtgcggctacaagaacatcaaccccaacctgatcatcaagctgcccaagtactccctcttcgagttcaataacgggcagcggcgcctgctggccagctccatcgagctccagaagggcaacgagctgattgtgccctaccacttcacagccctgctctaccacgcccagcggatcaacaagatcagcgagcccatccacaagcagtacgtggagacccaccagtccgagttcaaggagctgctgaccgccatcatcagcctctccaagaagtacatccagaagccgaacgtggagagcctgctgcagcaggcgttcgaccagtccgacaaggacatctaccagctcagcgagtccttcatcagccttctgaagctcatctccttcggggcccccggcacgttcaagttcctgggcgtggagatcagccagtccaacgttcggtaccagagcgtgtccagctgctttaacgccaccctgatccaccagagcatcaccgggctctacgagacccggatcgacttatccaagctgggcgaggactga

SEQ ID NO: 7824 - RNA, 4131 nt, synthetic construct
  misc_feature 1..4131: note = Cas9 variant
  source 1..4131: mol_type = other RNA
atggacaagaaatatggaataggtctggacatagggacgtcatccatcggctggactgtcgtagataaatatgggcacatcatccgcgtcaaaggtcaaacaggcatcggcgtccggctattccgagaaggacaaacggccgcggagcgccgcaccttcagaaccacccgtagacgcttatcaaggcgcagatggcgacttcgcctccttcgtgaaatctttgacgagcccatttcagctatagacgaaaacttcttcgccaggcaaaaagcatcaagcctagcaccgggcgacgctcgttaccaacaggcgttccagcttttcaacgacaggaccgaccaggcattctattgcaaatacccaacaatctatcacctccgccaagccctcatgactgaatcacgccaattcgatatccgagaaatatacctcgccctacaccaaataatcaaatatcgtgggcatttccttctgggcggcgcagccaaagacttccaatctgacaaattagacctcgaggcctacttcacaaccatcaacgcccagcttgcgggcatctacagcgacggaagtgtgcaactgccgaccctagactggaaccaagcctgccaagagctcacagatacgagccgcacgcaatccgaccggaaaaattggcttgtcaaggaattaaaaagctacggcgactcccaactcaaaccaatctacactcagatagccaacgctatactcggctttaagacagatctcgcgaaaatcatgggtatcaacgacccagaaaaagcactatcctttaatctcgacgccctagacgaccaccgcgacgatgtagcagaactcctaacggacgaacaaatacccctcgttaacctgctagccaagctacacaccgcccttgagctagcagccatcctcccagacggccaaacactatccggaaaaatggtcgaaatttacgaaactcaccgcaaacagttaaaaacatacaaagccttcatacgtcaactaccagaccggcaacaacgactggcacttaaacaggcctacgatcactacatcgaccaaggactcaatcgagaggctttctactcagaagttaaagccatcctcgaaaagcaaaaacccctcaccgccaccggacaagcgatgaagaaagcgatggatcaaaacgctttcctcctaaaacaacgtactaaaacgaacatcgccatcccataccaagtacaacaacaagaaatggaccagataatcgccaatcaaagcaaatactacccatggctggcaacgcccaacccagtcaaaagcaggcgcgtcatagctccatacaaactcgacgagctagtatgctttcgcgtcaactactacgtaggccctctcgtacaatccaagcccggtgaagcgactaaagaagccaagttcgcgtggatgacccgcaaggacccacaaagcacggtcgccataacaccatggaacttcgaccaacaggtagacagacaggcttccgccaatgcctttatccaaagaatgaagaccacagacacctacctcctaggcgaagacgtgatacccaaaaactccttgctgtatcaaaaatatgaggtcctaaatgaactcaacaacgtccgcgtcaacggcgactggcttgacccccaacggaagcaatacctcttcaagaaactctttatggaccagccccaaagcgtagtcacagttaaagcactccagaaaaccctggtcgtaataggcgcctgtcccacgctaccaaccgtggaaggattagccaatcccaaacgctttttaagccaactaaccacataccacgacttctgtaaactcctccccgatgacattcaacgcgccgaccgccaagcggacatcgaaaagattatcaactggagcacgatcttcgaagacacagccatcttcaaagaaaaacttcgggacatcaagtggctatcagcggatcaaatcagaagactaagtagccgcccccgctatagaggatggggacggttctccgcgaaactcctctgcggactacacgaccggcaaggaaataccgtcatggacgaactctggcaaacgtcacgaaatttcatgcaaatcataagacaaagtgatttccaaacagcgatagctgctgtcaaccaacaagacctcggcaggcaagacctccaacgcgtaatcgacgacctctacacaagcccgcagaataagaaagccatccgacaagtactagccgtcgttacagacatccaaaaagcaatgcacggcaaagcacctagctggctctttgtcgaagtagcgaaaggagcccaaaagaacccccagaggacacaaagccgacaatcaaaattagccgaggcctaccgcgaatcagcccgcgagttagtggacgaggccgtcaaagaacagttactcaccctgccagatgaccgccaaacattttcggaccgcctcgtactgtacttccagcaaaacgggcgcgacatctacacgggggagccactcgacttcgaacgtctgtccaactatcacatcgaccacataatcccacaagccgtagtgaaagacgattccctggacaaccgcgtactcacgtcgaaccaagcaaacctcgagaaaggagcacacgtcccaaccatcttccgcgacaagcaagaaccagtttggcaagaactctaccgagtcggattgataagtcacagaaagctgcggaacctactcaccacacccgacgacctagatgacagaggccgcgccaccggtttcatcgcccgtcaactcgtcgaaactaggcaggttataaagctagttatggaggtcctctcacaatactatgacaccaccgaaaccgaactcataagcatcaaagccggactctcccaccaattccgccaggaactcaacctcccgaaactgcgcgccctaaatgattaccaccacgcccaagacgcatacctggccgcacgaataggcacatacctcttacagcgttaccctaacctcaaacgattcttcgtgtacggcgacttcaagaaaacacacttcgaccttcagcgacgtttcaacttcataggcgggatgatctcccgagaaaaacaaccgtacaaccttatcaaaaaccccgtaacgcaccaagtaatatgggacgaggaaatggaaattggcgattgtcaaaagaaaaatccagaacaaccaaaacacgacgccacggtcaaaatgatgaacctcactaaaataatgaacctaaaacacatcctggtaactcacgaagtttatgagaaccatggcgcgctgttcaaccaaacaatatacccagcatcccaagcacacaagaagaaactcataccccagaaaaccgaaaaaccaatagaactatacggagggcatagcagtgagcaagctggctacatggcaattatccgactcctcggtaaacgccccggctacaaagtcatgcgggtacccgtgcgctacgtctcacaactacaacaccaagacgtagccgaacaaaagaaactcctctacaagatcttcgtttcggagctaacgagccgcaacaaagtcaagccgttcgaggtagtcgtccctcacgtctgcctaaaccaacccgttgaagacatgatcaaagggcaatggcacagattcgccctacgcacgaacggatactaccaaaaccaacaacaactcatcttatccctagtcgcccaaagaacactagcaggatacaaacccaaggacgacgaactgatggccgtataccacgaaatctgcaagcaagtgaaatactactttccattatacaaaatgaacaaatttcaatcccgcctatttgcagccgaagaactcctacaaaagagaagcaccgtcaacagttttagcatcaccatcggcaaaaacggaaaagaaaacaagacgctcaatctgggaaagcgagagcttctcctacgactactaggcggcctacatgccaacgccacacgagtggacctgaaagacataggctgtaccggccaattcggtcagctccaagtgaaaaatgggatcaaactcacagaacaagccgtgctaatccacgagtcaccaaccggtctcttccatcgtcgagtacgactcaatgacctctga

SEQ ID NO: 7825 - RNA, 4134 nt, synthetic construct
  misc_feature 1..4134: note = Cas9 variant
  source 1..4134: mol_type = other RNA
atgaccaagaagaactacagcatcggcctggacatcgggaccaactccgttggctgggccgtcatcacggacgactacaaggtgcccgccaagaagatgaaggtgctcgggaacaccgacaagaagtacatcaagaagaacctcttaggcgcgctcctgttcgactcaggggagaccgcggaggccacccgcctgaagcggactgccaggcggcgctacacgcggcgcaagaaccggctccgttatctgcaggagatattcgccgaggagatgaccaaggtcgatgaatccttcttctaccgactggatgagagcttcctaaccacggacgagaaagactttgagcgccacccgatcttcggcaacaaggcggacgagatcaagtaccaccaggagttccccaccatataccacctccggaagcacttagccgactccagcgagaaggccgacctgcgcctggtgtacctggccctcgcgcacatgatcaaattccggggccacttcctgatcgagggggagctgaacgccgagaataccgacgtacagaagatcttcgccgacttcgtcggtgtgtacgaccgcactttcgacgactcccacctcagcgagatcacggttgacgccgcctccatcctgaccgagaagatcagcaagtcccggcgcctggagaacctcatcaagtactaccccaccgagaaaaagaacacgctgttcgggaacctgatcgcgctcgcactgggccttcagcctaacttcaagatgaacttcaagctcagcgaagacgccaagttacagttttccaaggacagctacaacgaagacctggaagaactcctggggaaaatcggcgacgactacgccgaccttttcacgtcagccaagaacctctacgacgcgatactgctgagcggcatcctcaccgtcgacgataactccaccaaggccccgctgagcgcctccatgatcaagcggtacgcggagcaccacgaggacctggagaagctcaaggagttcatcaaggccaacaagagcgagctgtaccacgatatcttcaaggacgagaccaaaaacgggtacgcgggctacatcgagaacggcgtgaagcaggacgagttctacaagtatctgaagaacacgctctcgaagatcgccggctccgactacttcctggacaagatcgagcgcgaagacttcctgcgaaagcagcgcaccttcgacaacggcagcatcccccaccagatccatctgcaggagatgcacgccatcctgcggcgccagggggactactacccattcctgaaggagaaccaggaccgcatcgagaagatcctcaccttccggatcccttactacgtgggcccgctcgcccgcaaggactcccggttcagctgggccgagtaccactccgacgagaagatcaccccctggaacttcgacaaggtcatcgacaaagagaagtccgcggagaagttcatcacgagaatgaccctgaacgacctgtacctccccgaagagaaagtgttacccaagcacagccacgtgtacgagacctacgcagtctacaacgagctgacaaagatcaaatacgtgaacgagcaagggaaggacagcttcttcgactccaacatgaagcaggagatcttcgaccacgtgttcaaggagaaccggaaggtgacgaaggagaagctcctgaactacctgaacaaggagttcccggagtaccgcatcaaggacctcatcggcctggacaaggagaacaagagcttcaacgcctcccttgggacctaccacgatctcaagaagatattggataaggccttcctggatgacaaggtgaacgaggaggtgattgaggacatcatcaagaccctcacactgttcgaggacaaggacatgatccacgagcggctccagaagtacagcgacatcttcacggccgaccagctcaagaagctggagcgccggcactacaccggctggggccgcctgagttacaagctcatcaacgggatcagaaacaaggagaataacaagaccatcctggactacctgatcgacgacggcagcgcaaaccgcaacttcatgcagctcatcaacgacgacactctgccattcaagcagatcatccagaagtcccaggtcgtgggggacgttgacgacatcgaggcggtcgtgcacgacctgcccggctctccagccatcaagaaggggatccttcagtccgtcaaaatcgtggacgagctggtgaaggtgatgggcgacaacccggacaacatcgtgatcgagatggctcgggagaatcagacgaccaaccgcggcagaagccagtcccagcagcgcttaaagaagctccagaacagcctgaaggagctggggagcaacatcctcaatgaggagaagccctcctacatcgaggacaaggtggagaacagccacctccagaacgaccaactgttcctgtactacatccagaacggcaaggacatgtacaccggggacgagctggacatcgaccacctgtccgactacgacattgaccacatcatcccccaggcgttcatcaaggacgacagcattgacaaccgtgtcctcacctccagcgccaagaaccgcggcaagtccgacgacgtgcccagcctggacatcgtgcgggctcgcaaggccgagtgggtccgcctgtacaagtccgggctcatcagcaaacggaagttcgacaacctgaccaaggccgagcgcggcggcttgacggaagcagataaagccgggtttatcaagcggcagctcgtggagacccgccagattaccaagcacgtggctcagatcctggacgcccggttcaacaccgagtccgacgagaacgacaaggtcatccgggacgtgaaggtcatcacgctcaagagcaacctggtatcgcagttccggaaggacttcgagttctacaaagtgcgcgaaatcaacgactaccatcacgcgcacgacgcgtacctgaacgccgtggtcggcaccgccctgctcaagaagtacccgaagctggccagcgagttcgtgtacggggagtacaaaaagtacgacgtgcacaaactaatcgcgaagtccagcgacgaccactccgagatgggcaaggccaccgccaagtacttcttctacagcaacctcatgaacttcttcaagcgggtcattcgctacagcaacggcaaggttattgtgcggcccgtcgtggagtacagcaaagacaccgaagacatcgcctgggacaagaagtccaacttccgcacgatctgcaaggtgctgagctacccccaggtcaatatcgtgaagaaagttgagacccagaccgggggcttcagcaaagagtccatcctgcccaagggggacagcgacaagctcatcccgcggaagaccaagaaggcctactgggacacgaaaaagtacggcgggttcgactcccccaccgtcgcgtacagcgtgttcgtggtcgccgacgtggagaagggcaaggcgaagaagctgaagacggtcaaggaactggtcggcatctccatcatggagcgcagcttcttcgaggagaaccccgtggagttcctcgagaacaaggggtaccacaacatccgggaggacaagctgatcaagctgcccaagtacagtctgttcgagttcgagggcgggaagcgccggctgctggccagcgcctccgagctccagaagggcaacgagatggtcatcccggggcacctggtcaagctgctctaccacgcgcagcgcatcaacagcttcaactccaccaagtacctggactacgtgagcgcgcacaagaaggagttcgagaaggtgctgtcctgcgtcgaagatttcgccaacctctacgtggacgtggagaagaacctgagcaagatccgggccgtcgccgactccatggacaacttcagcatcgaggagatcagcaactccttcatcaacctgctcacgctgaccgcgctgggcgctcccgccgacttcaactttcttggcgaaaagatcccccgcaagcggtacaccagcaccaaggagtgcctgaacgctacgcttatccaccagtccatcaccgggctatacgagactcgcatcgacctgagtaagatcggcgaggagtga

SEQ ID NO: 7826 - RNA, 4134 nt, synthetic construct
  misc_feature 1..4134: note = Cas9 variant
  source 1..4134: mol_type = other RNA
atgaagaagccctacagcatcggcctggacattgggaccaactccgtgggctgggccgtcatcaccgacgactacaaagtgccgagcaagaagatgaaggtgctcgggaacacggacaagcacttcatcaagaagaacctgatcggcgcactgctgttcgacgaggggaccaccgcggaggaccgccggctgaagcgaacgtcccggcgccggtacacgcgccggaagaaccgccttcggtacctccaggagatcttcagcgaggagatcagcaagctggacagctccttcttccatagactggacgacagcttcctcgtccccgaggataagcggggctccaagtaccccatcttcgccaccctggaggaagagaaggaataccataagaaattccccacgatataccacctccgcaagcacctcgccgacagcaaggagaagaccgacctccggctgatctacctcgccctggcccacatgatcaagtaccgcggccacttcctgtacgaggagtcctttgacatcaagaacaacgacatacagaagatcttcaatgagttcatcagcatctacgacaacactttcgaggggtcctcgctctccggccagaacgcccaggttgaggcaatctttaccgataaaatctcaaagtccaccaagcgggagcgcgtgctgaagctgttcagcgacgagaagtccaccgggctgttcagcgagttccttaagctgatcgttggcaaccaggcggacttcaagaagcactttgacctcgaggagaaggccccgctgcagttctccaaggacacgtacgacgaggacctggagaacctcctggggcaaatcggcgacggcttcgcggacctgttcctcgtggccaagaagttatacgacgccatcctgctaagcgggatcctgaccgtgaccgaccccagcaccaaggcgcccctttccgccagcatgatcgagcggtacgagaaccaccaggaagacctcgcggcactgaagcagttcatcaagaacaacctgtccgagaagtatgccgaagtcttcagcgaccagagtaaggacggctacgccgggttcatcgacggcaagacgacccaggaggccttctacaagtacatcaaaaacctcctgagcaaactggagggcgcggactactttctcaacaagatcgagcgcgaagatttcctgcggaagcagcgcaccttcgacaacgggtccatcccccaccagatccacctacaggaaatgaacgccatcctccggcgccagggcgagcactacctgtttctgaaagagaaccgcgagaagatcgagaagatcctcgccttccggatcccctactacgtggggcccttggcccgcggcaaccgggacttcgcctggttaacccgcaattcggaccaggcgatccggccctggaacttcgaggaggtggttgacaaggcctccagcgccgaggacttcatcaacaagatgacgaactacgacctgtaccttcccgaagagaaggtactgccgaagcactccctgctctacgagaccttcgccgtgtacaacgagctgacgaaggtcaaattcatcgccgagggactgcgcgactaccagttcctcgacagcggccaaaagaagcagatcgtgaaccagctgttcaaggacaagcggaaggtgaccgagaaagacatcatccactacctgcacaacgtcgacggctacgacgggatcgagctcaagggcatcgagaagcagttcaacgcgtccctgagcacgtaccacgacttactcaagatcatcaaagacaaggagttcatggacaaccccaagaacggggagatcctggagaacatcatccacaccctgacaatcttcgaggaccgcgagatgattaagcaacggctcgcccagtacgacaccctgttcgacgagaaggtgatcaaagccctgacgcgccggcactacaccgggtgggggaagctctccgccaagctgattaatggcatccgcgacaagcagaccggcaaaaccatcctggagtacctcatcgacgacggggactgcaaccggaacttcatgcaactgatcaacgacgatggcctgagcttcaaggagatcatccagaaggcccaggtggtcgggaagacggacgacgtgaagcaagtcgtgcaggagatccccggctcccccgcgatcaagaaggggatcttacagagcatcaagatcgtggacgagctggtcaaggtgatgggccacaacccggagagcatcgtgatcgagatggcgcgcgagaatcagaccaccgccaaggggaaaaagaactcccagcagcggtacaagagaatcgaggatgccctgaagaacctagcgcccggactggacagcaacatcctgaaggagaaccccaccgacaacatccagctccagaacgaccggctgtttctgtattacctgcagaacggcaaggacatgtacacgggaaaggccatcgacatcaatcagctgtccaactacgacattgaccacatcatcccccaggccttcatcaaggacgacagcttagacaaccgcgtcctcacctcaagcaaggacaaccgaggaaagtccgacaacgtgccgagcatcgaagtggtccagaagcgcaaggccttctggcagcagctgctagactccaagctcatcagcgagcgcaagttcaacaacctcaccaaggccaagcggggcgggctggacgagcgagacaaggtgggcttcatcaagcggcagctagtggagacccgccaaatcaccaagcacgtcgcgcaactgctagacacgcggttcaacaccgaggtgaacgaggagaaccagaaaatccgcaccgtgaagatcatcaccctcaagtccaacctggtctcaaatttcagaaaggagttcggcctgtacaaggtgcgcgagatcaacgactaccaccacgcccacgacgcctacctcaacgccgtcgtcgccaaggcgatcctgaagaagtaccccaagctggagcccgagttcgtttacggcgattaccagaaatacgacctcaagcggtacatcttgaagtcaaaggccagcaacacgatcgacaaggcgaccgaaaagtacttcttctattccaacctgctcaacttcttcaaagagaaggtgcgctacgccgatgggaccatcaagaagcgggagaacattgagtacagcaacgataccggcgagatcgcgtggaacaaggagaaggatttcgcaacgataaagaaggtcctgtccctgccccaggtgaatatcgtgaagaagacagaggaacagaccgtcggccagaatgggggcttattcgacaacaacatcgtgtcgaagaagaaggtcgtcgatgccagcaagctgatcccgatcaagtccagcttatcccccgagaagtacgggggctacgctcgccccacgatcgcctacagcgtgctcgtgatcgcggacatcgagaaggggaagggcaaggccaaaaagttaaagaggatcaaggagatcgtcggcataacgatccaggacaaaaagaagttcgagtccaaccccgtgacctacctggaggagtgcgggtacaagaacattaactccaacctcatcattaagttgccgaagtactccctgttcgagttcaacgacggccagcgccggctcctggcgagctccatcgagctgcagaaggggaacgagctcatcctgccctaccacctgaccgctctcctgtaccatgcccagcgcatcaacaagatcagcgagcccatccacaagcagtacgtggaggcgcaccagaacgaatttaaggagctgctcaccacgatcatctccttgagcaagaagtacatccagaagccgaacgttgagctgctcctgcagcaggcgttcgaccaggctgataaggacatataccagctgtccgagagcttcatctccctcttaaagctgaccagcttcggcgcccccggggccttcaagtttctcggcgtggagatctcccagagctccgtgcggtacaaacccaacagccagttcctggacaccacactgatccaccagagcatcacgggcctctacgagactcgtatcgacctgtccaagctgggggaggactga

SEQ ID NO: 7827 - RNA, 4134 nt, synthetic construct
  misc_feature 1..4134: note = Cas9 variant
  source 1..4134: mol_type = other RNA
atgaacaacaagccctacagcatcggcctggacatcgggaccaactccgtgggctggagcgtcatcaccgatgactacaaggtgccgtccaagaaaatgaaggtgctcgggaacacggacaaacgcttcatcaaaaagaacctgatcggcgccctgctgttcgacgaggggaccaccgccgaggcgcggcgcctgaagcggaccgcccgccggcgctacacgcggcgcaagaaccggctgcgctacctccaggagatcttcgccgaggagatgagcaaggtcgactccagcttcttccaccggctggacgactcattcctgatccccgaggacaagcgcggcagcaagtaccccatcttcgccaccctcgtggaggagaaggagtaccacaagcagttccctacgatataccacctccggaagcagttggccgactccaaggagaaggcggacctccgcctgatctacctggtgctcgcccacatgatcaagtaccggggccacttcctgtacgaggaggccttcgacatcaagaacaacgacatccagaaaatcttcaacgagttcatcagcatctatgacaacaccttcgaggggtccagcctgtccggccagaacgcccaggtcgagacgatcttcaccgacaagatcagcaagtccgcgaagcgcgagcgggtgctcaaactgttccccgacgagaagtctaccggtctgttcagcgagttcctcaagctgatcgtgggcaaccaagccgacttcaagaagcacttcgacctggaggagaaggcgccgctccagttcagcaaggacacctatgacgaagacctggagaacctgctcgagcagatcggggacgacttcgccgacctgttcgtcgccgcgaagaaactgtacgacgccatcctcctgtccggcatcctgacggtgaccgaccccagcaccaaggcgcccctcagcgcctcgatgatcgagcgctacgagaatcaccagaaggatctggccgtgctgaagcagttcatcaagaccaacctcccggagaagtacgtcgaggtgttcagcgaccaatccaaggacggctacgccgggtacatcgacggcaagactacccaggaggccttctacaagtacatcaagaacctgctgagcaagttcgacggggccgactacttcctcgacaagatcgagcgggaggtgttcctgcgcaagcagcggaccttcgacaacggctccatcccccaccagatccacctccaggagatgaacaccatcctgcgccgccagggcgagcactaccccttcttgaaggagaacaaggagaagatcgagaagatcctgacgttccggatcccctaccacgtcgggccgctcgcccgcggcaacagggacttcgcctggctgacccgcaacagcgaccaggcgatccgcccctggaacttcgaggagatcgtggacaaggcctccagcgccgaggacttcatcaacaagatgaccaactacgacctgtacctccccgaggagaaggtgctgcccaagcattccctcctgtacgagaccttcgcagtctataacgagctcacgaaggtgaagttcatcgccgaggggatgcgcgactaccagttcctggacagcggccagaagaagaagatcatcaaccagctgttcaagaagaaaaggaaggtgactgaggacgacatcatcgactgcctccagaaaatcgacaactacgacgggatcgagctgaagggcatcgagaaacagttcaacgcgtccctgagcacctaccacgacatcctcaagatcatccgcgacaaggagttcatggacgacccgaagaacggcgacatcctggaaaacgtcatccacaccctgacgatcttcgaggaccgggagatgatcaagcagcgcctggctcagtacaactccatcttcgacgagaaggtgatcaaggccctgagccggaagcactacaccgggtggggcaagctgtcagccaagctcatcgacgggatcagagacaagcagaccggaaagaccatcctggactatctgatggacgacggcaagagcaatcggaacttcatgcagctcatcaaggacgacgagctgtccttcacggagatcatccagaaggcccaggtggtcggggacaccgacaacctgcgccaggtggtccagaacctcccgggcagcccagccatcaagaaggggatcctgcagtccatcaagatcgtggatgagctggtgaaggtcatgggccacgcccctgagagcatcgtgatcgagatggcccgggagaaccagaccaccgcccgcgggaagaagaacagccagcagcggtacaagcgcatcgaggactccctcaagaacctagcgtccggcctggactccaacatcctcaaagagaacccgacggataacatccagctgcagaacgaccggctgttcctctactacctgcagaacgggaaggacatgtacaccggcgaggccctgaacatcaaccagctcagctcctacgacatcgaccacatcatcccccaggctttcatcaaggacgactccctggacaaccgcgtgctgacctccagcaaggacaaccgaggcaagagtgacaacgtccccagcctcgaggtggtggagaagatgaaagccttctggcagcagctgctggactccaagctcatcagcgagcggaagtacaacaacctaaccaaggccgagcgcgagcgcgggggcctgaacgagctggacaaggtcgggttcatcaagcggcagctggtggagacccggcagatcacgaagcacgtggcgcagatcctggacgcccgcttcaacaaggaggtcaccgagaagaacaagaagaaccggaacgtgaagatcatcactctcaagtccaacatggtgagcaacttccgcaaggagttcggcctgtacaaggtgcgggagatcaacgactaccaccacgcccacgacgcctacctgaacgcagtggtcgcgaaggccatcctcaagaaataccccaagctagagccggagttcgtctacggcgactaccagaagtacgacctgaagcgctacatctcacggagcaaggaccccaaggaggtggagaaggccaccgagaagtacttcttctactccaacctcctgaacttcttcaaggaggaggtgcactacgccgacgggacgatcgtaaagcgcgagaacatcgagtacagcaaggacaccggcgagatcgcgtggaataaggagaaggacttcgccaccatcaagaaggtgctgagcctcccccaggtgaacatcgtcaagaagacagaggagcaaacggtggggcagaacggcgggctgttcgacaacaacatcgtgtccaagaagaaggtcgtggacgccagcaagctgatccccatcaagtccggcctcagcccggagaagtacggcgggtacgcccggcccaccatcgcctactccgtgctggtcacctacaagcagaataacaaaatcaagaacaccatggtggggatccccgtgcttactaagctcgagttcgagcgcgacccgaacctgtacctgcggaacttggggatcaacaacgtcagccacgtgatcaagttagtgaagtacaccgtcttggagttcaagcacaaatacggtacctaccgccggttcatcgtatccaaccaggagctgaagcgcgcgaaccagatcttcgtgaccacgaagcagatgaagctgatcagccagtacaccaccctggacaagaacgagcacgactccctcctgaagaacaaccagcagctgatccagagcatctggaaccagttcctcgagttcatgctggccaccgacctggtcaacaagaagcagtacgacgagctcatcctgacaaacaaccagaccatcgaggagtgccggaacatcatgaaccgcgtgatcaccaccctgtccttcacgaacatcaacgccgggcagaagaagatcatcttcgacgacaccctcagcctgcccatcaagcggtggcagttcaccgactccgacaagatggtgaagaagatcatcgagagcaccctgatacaccagtccatcacgggcctctacgagacccgcatcgacctgagcaagctgggcgaggactga

SEQ ID NO: 7828 - RNA, 4134 nt, synthetic construct; identical to SEQ ID NO: 2028
  misc_feature 1..4134: note = Cas9 variant
  source 1..4134: mol_type = other RNA

SEQ ID NO: 7829 - RNA, 4134 nt, synthetic construct
  misc_feature 1..4134: note = Cas9 variant
  source 1..4134: mol_type = other RNA
atgaacaagccctacagtatcggcctggacatcgggaccaactccgtgggctggagcatcatcaccgacgactacaaggtcccggccaagaagatgcgcgtgctcgggaacacggacaaggagtacatcaagaagaacttgatcggcgcgctgctgttcgacgggggcaacaccgcggccgaccggcgcctgaagcggaccgcccgccggcgctacactcggcgccggaaccgcatcctgtacctccaggagatcttcgccgaggagatgtccaaggtggacgacagcttcttccaccggctggaggactccttcctggtcgaggaggacaagcgcggcagcaagtaccccatcttcgcaacgatgcaggaggagaagtactaccacgagaagttccccaccatctaccacctccggaaggagctggcagacaagaaggagaaggccgacctgcgcctcgtgtacctggccctggcccacatcatcaagttccgggggcacttcctcatcgaggacgaccgcttcgacgtgcggaacaccgacatccagaagcagtaccaggcgttcctggagatcttcgacacgacgttcgagaacaaccacctcctctcccagaacgtcgacgtggaggccatcctgaccgacaagatcagcaagtccgccaagaaggaccgcatcctggcccagtaccccaaccagaaatccaccggcatcttcgcagagttcctcaagctgatcgtggggaaccaggcggacttcaagaagcacttcaacttggaggacaagaccccgctccagttcgccaaggacagctacgacgaggacctggagaacctgctcggtcagatcggggacgagttcgccgatctgttcagcgtcgccaagaagctgtacgactccgtgctcctgagcggcatcttaacggtgaccgacctctcgaccaaggcgcccctgagcgcctccatgatccagcggtacgacgagcaccacgaggacctgaagcacctcaagcagttcgtcaaggccagcctgcccgagaattaccgcgaggtgttcgccgactccagcaaggacggctacgctgggtacatcgaaggcaagaccaaccaggaggctttctacaagtacctgctgaagctgttaacgaagcaggaggggagcgagtacttcctcgagaagataaagaacgaagactttctgcggaagcagagaaccttcgacaacggcagtatcccccaccaggtgcacctgaccgagctccgcgcgatcatccggcgccagagcgagtactacccgttcctgaaggagaaccaggaccggatcgagaagatcctgaccttccgcatcccctactacgtcggccccctcgcccgggagaagtctgacttcgcctggatgacgcgcaagaccgacgacagcatccggccctggaacttcgaggacctggtggacaaggaaaagtccgccgaggccttcatccaccgcatgaccaacaacgacttgtacctgccggaggagaaggtgctccccaagcacagcctgatctacgagaagttcactgtctacaacgagctgacgaaggtgcggttcctcgcggaggggttcaaggacttccagttcctgaaccgcaagcagaaggagaccatcttcaactccctgttcaaggagaagcggaaggtgaccgagaaggacatcatcagcttcctcaacaaggtcgacggctacgaggggatcgcaatcaagggcatcgagaagcagttcaacgcctccctgagcacctaccacgacctgaagaagatcctcgggaaggacttcctggacaacacggacaacgagctgatcctcgaggacatcgtgcagaccctgaccctgttcgaggaccgcgagatgatcaagaagtgcctcgacatctacaaggacttcttcaccgaatcccagctgaagaagctgtaccggcgccactacacgggctggggccggctcagcgccaagctgatcaacgggatccgcaacaaggagaaccagaagaccatcctggactacctcatagacgacggctccgcgaaccggaacttcatgcagctgatcaacgacgacgacctgagcttcaagcccatcatcgacaaggcccgcaccgggtcccacagcgacaacctcaaggaggtggtcggcgaactggccgggtcccccgccatcaagaagggcatcctgcagagcctcaagatcgtggacgagctggtcaaggtgatgggctacgagccggagcagatcgtggtcgagatggcacgggagaaccagaccacggcgaaggggctgtcccgcagccgccagcggctcaccaccctgagagagagcctggccaacctcaagtccaacatcctggaggagaagaagcccaagtacgtgaaggaccaggtcgagaaccaccacctgagcgacgaccgcctcttcctgtactacctgcagaacggccgggacatgtacaccaagaaggccctcgacattgacaacctgtcccagtacgacatcgaccacatcatcccccaggccttcatcaaggacgacagcatcgacaaccgggtcctggtgtccagcgccaagaaccgcggaaagtccgacgacgtgcccagcatcgaaatcgtcaaggcgagaaagatgttctggaagaacctcctggacgccaagctgatgtcccagcgcaagtacgacaacctcaccaaggcggagcggggcgggctgacgtccgacgacaaggcccgcttcatccagcggcagctggtagagacccgccagatcaccaagcatgtggcccggatcctcgacgagcgattcaacaacgaggtcgataacggcaagaagatctgcaaggtgaagatcgtgaccctgaagtccaacctggtctccaacttccggaaggagttcggcttctacaagatacgcgaggtgaacgactaccaccacgcgcacgacgcgtacctcaacgccgtggtcgccaaggcgatcctgaccaagtacccgcagctggagcccgagttcgtgtacgggatgtaccgccagaagaagctctccaagatcgtgcacgaggacaaggaggagaagtacagcgaggccacccgcaagatgttcttctactccaacctgatgaacatgttcaagcgggtcgtgcgcttagccgacggaagcatcgtggtccggcccgtgatcgagaccgggcgctacatgcgcaagaccgcctgggacaagaagaaacacttcgccacggtgcggaaggtcctctcctacccccagaacaacatcgtgaagaagaccgagatccagaccggcggcttcagcaaggagagcatcctggcgcacgggaactccgacaagctgatcccgcgaaagaccaaggacatctacctcgaccccaagaagtacggcgggttcgacagccccatcgtggcctactccgtccttgtcgtggccgacatcaagaagggcaaggcccagaagctgaagacggtcaccgagctcctgggcatcaccatcatggagcggtctcgcttcgagaagaatcccagcgccttcctggagagcaagggctacctcaacattcgggacgacaagctgatgatcctgccgaagtactccctcttcgagctggagaacgggcgccggcgcctgctcgcgagcgccggggagctgcagaagggcaatgagctggccctccccacccagtttatgaagttcctgtacctggcctcccggtacaacgagagcaaggggaagcccgaggagatcgagaagaagcaggagttcgtgaaccagcacgtgtcctacttcgacgacatcctccagctgataaacgacttcagcaagcgcgtcatcctggccgacgcgaacctcgagaagatcaacaagctgtaccaggacaacaaggaaaacatcccggtggacgagctggccaacaacatcatcaacttgttcacgttcacctccctgggcgcccccgccgcttttaagttcttcgacaagatcgtggaccggaagcgctacacctccaccaaggaagtcctgaactccacgctcatccaccagagcatcaccgggctgtacgagacccggatcgacctgggcaagctcggcgaggactga

SEQ ID NO: 7830 - RNA, 4134 nt, synthetic construct; identical to SEQ ID NO: 2030
  misc_feature 1..4134: note = Cas9 variant
  source 1..4134: mol_type = other RNA

SEQ ID NO: 7831 - RNA, 4137 nt, synthetic construct
  misc_feature 1..4137: note = Cas9 variant
  source 1..4137: mol_type = other RNA
atgaagaccttcgccgaggagtacgtgatggacaaaagcaagccctatggcatcgggctggacatcggcaccaactccgtcgggttcgtggccacggacgcggagggccacctcatccgcctgaaggggaagaccgtgatcggcgcctatctattcaacgccggcatcagcgccgccgagcggcgcgggttccggaccacccgccggcgcctctcccgggtcaagtggcgcctgggcctgctccgggagatcttcgagacgcacttccaggagagcatgggggagaacgaggacaacgacttcttcctccgcttcaagtactccaacatcagccccaaagacccccagttctccaccgcgaagggcctgttcaatgaccggaccgacaaggagttctacgaccagtaccccactatctaccaccttcgccgggccctgatgacggaggaccaccagtttgacatccgcgagatctacatcgccatgcaccacatcgtgaagtaccgggggcacttcctgaaggaaggccgcgccaaagacttcaaggtgggcgacctccggctgttagacaacttcaagatgatgaacgagcagatcgaggagatcaaccccctctggcaactgaagctgccgaccgacgacgcgagcatcaagtccatcaccgccatcctcctggacaacacccagagccagaacgatcgccagaaggccgtcacgaaggtcatcctggccaccctcgtgaaggccagtgacaaggacatcaacgcggcccgtaagcgcttcgtcggggagctgagcaaggccatggtgggcctgaagaccaagctctgggtgctggccgacgtctcccagaacggggactgggagatcaagtacgagaattacgccgacttcgcggagaccatcggcagcggggagtccgatacgatccagagcctcttcaacgagatcaacgacctctacggggtgatcaccctggccggcatcatccccaaggaggccgagtccttcagcgacgggatggtgcggaagtacgagcaccaccgcaaaaacctggagctcctgaaggtctactgcgccgagcagtccgacggcaagcgcgggcggcagatccgccagacctacgacaagtacatagacggcgtggacagcaagcagttcacccaggaggacttttacaaggccctcagcaagttcacggcgaaggacgaggccacctccgagaacgccaagctcatcgcccaggagatcgccgtgggcaccttcatgcccaagctgcggaccaaggcgaatggaacgatcccccaccagctgcaccaaaaggagttggacgccatcatcgagaaccagaagaagtactacccgtggctgggcgaggtcaaccccgtggagagccaccgccgggccctgccctacaaacttgacgagctggtgtccttccgcatcccctactacgtcgggccaatggtgacccccaccaagggcgaccccgagaagtccaagttcgcctggatggtgcggaaggagcccgggaccatcacgccgtggaacttcgaccagaaggtcgaccgctcagcgagcggcgaggccttcatccagcggatgaagaccaccgacaccttcctgatcggcgaggacgtgctcccccagcagtccctgctgtaccagaagttcgaggtcctcaacgagctgaacaagatcatgatcaacgggaagcccatctgccgcgagcaaaagcaacggctgttcaagcagctgttcatgcagtacaagacggtgaccgtgaagaaggtccagcagaacctcatcgccaacggcgaggagagcgagaacgtgcccatcaccgggctgtccgacccgctgcgcttcaacagctccttctcgacctacatcgactataaggacatcctcggcacagccgccgtgaacgataacgcgaagcagtccgacatcgagcagatcatcgcctggagcaccatcttcgaggacgccgccatcttccgggagaagctgaacgacatcacctggctgaacgacgaccagcgcaacaagctctctcacaagcggtaccgcgggtggggccggcacagccgcaagctgctggccgggctcagagacggggagggccagaccatcattgagcgcctgtggaacaccaacgacaactttatgcagatccagaacgactccgagatcgcgcgccagatcacggaggccaactcctccaagatggccaccgccgaggggacggacgagatcatcgacggcttctacaccagccccgaaaacaagaaggccctgcgggaggtaatgaaggtggtgaaggatatccagcgcgcgcaccacggccaggccccggcctgggtctacatcgagagccccagagagaccccgcgccccgggcagcggaccgtgtcccgcgagcagcagctcaccgacctgtacgagggcgccgcgaaggagatcgtggacgacgccgtcctgaacgagctcaaagacaaggtcaaaagcaaggagaactttaccgacaagctggtgctgtacttcctccagaacgggcacgacatctacgccaacgacagtatcaacatcgacaacctgaacgcctacgacatcgaccacgtgctgccccagtccctcatcaaggacgactccctggacaaccgggtgctgacgacccacgaacgcaacctcaagaagtctaaccggttcgccaccgagctgttcgcggaccagcgcaagaagtgggagaagtggcaccggctgggcctcatcagcagccgcaagctgaagcacctgacaatgcagcccaactccgtggagaaattcgcccacgggttcatcgcccggcagctcacggagacccgccagatcatccacctgaccgccaatgtcctgagcaacctctaccaggaaaacgacaccaagatcgtgatgatcaaggccggcctgaactccgagttccggcgcacgtttgacttcccgaagaaccggagcgtgaacgactaccaccacgcgttcgacgccttcctgaccgccaagatcggccgctacctcctggcccggtaccccaagctggagccattcttcgtctacgggaacttcgtgaagaacccgaaggccatgaagcgcctcagtagcttcgacttcatcgcgcagttggccgccaagaccgacgacacctcccacatcgaccagcggagcctgaagcaggtccccgtggtgaacgaggagacgggcgagatcgtgtgggacaaggatatcgagctcgccgagctggacaaaacctacaactacaagaccatgctggtgaagcgcgcgcagaccgagaataatgcccagatgttcaagcagacggtgttcaaggcccgcgacaaccagaataagaccctcatccccgtgaagaacgggctgtccaccgacgtctacggcgggcactcccagcaggccatcagctacctgtgcatcgtgtgggttggccagaagaagaagtaccgagtcctcggcatctccaccgcccacgcggggatcctgaacaacttcgagaagaactacggccgcttcgaggccaaaaagaagctgcaggagatcgtgagcaacacgctcgacaacgccgaccggaacgacttcaagatcgtggcccccaaggtcttgttcgagcaggtcgtggaggacgataacatgaagttcgggctgggctccgccagcgactaccgcaacgtgcagcagctgttcctctcccggaagaaccaactcctcctggcgaacatgatgaccgaccagatccacgaccaggacctggtgcacctcttcgacgagatcgtggggcagatgaacgcccacttcccgatcttcgaccgtggcggctatcggagctccttaacccagagccgcgacaagttcctgaagctccccttcaagaagaacgaggacctgatcaccaagcaggaggtcatccggcgcatcctggacgggctccatgccaacgccaaccggaaggacctgaaaatcatcggctccaagggggacttcggccgcctggggacgaagaagatctacctcagcaaggacgccaagttaatatacacctccccgacctgcctgttcacccggacggtgcccttgagctccctctga

SEQ ID NO: 7832 - RNA, 4137 nt, synthetic construct
  misc_feature 1..4137: note = Cas9 variant
  source 1..4137: mol_type = other RNA
atgacaaacgagaagtacagcatcggcctggacatcgggacatccagcatcggcttcgccgtggtcaacgacaacaatcgcgtcatccgagtgaaggggaagaacgccatcggcgtccgcctcttcgacgaggggaaggcagccgccgatcgccgctcctttcggacgacccgccggcgcctgagtcggcgccggtggcgcctgaagctcctgcgggagatcttcgacgcatacatcacccccgtggacgaggccttctttatcaggctgaaggagtccaacttaagcccgaaggacagcaagaagcagtactctggcgacatcctgttcaacgaccggagtgacaaggacttctacgagaagtaccccaccatctaccacctccgcaacgcgctgatgacggagcaccgcaagttcgacgtccgcgagatctacttggccatccaccacatcatgaagttccggggccactttctgaacgccacccccgccaacaacttcaaggtcgggcgcctcaacctggaggagaagtttgaggagctgaatgacatctaccagcgagtgttccccgatgaatcaatcgagttccgcaccgacaacctcgagcagatcaaggaggtgctgctggacaacaagcgtagccgggcggaccgccaacggactctcgtcagcgacatataccagtccagcgaggacaaggacatcgagaagcgcaacaaggccgtggccacggaaatcctgaaggcctccctgggcaacaaggccaagctcaacgtgatcaccaacgtcgaggtggacaaggaggcagccaaggagtggtcaatcaccttcgactccgagagcatcgacgacgacctggccaagatcgaggggcagatgaccgacgacggccacgagatcatcgaggtgctgcggtccctctacagcgggatcacgttgagcgccatcgtcccggagaaccacaccctgtcccagagcatggtagccaaatacgacctccacaaagaccacctgaaacttttcaagaagctcattaacggcatgaccgacaccaagaaggcgaagaacctgcgcgccgcctacgacggctacatcgacggggtgaaggggaaagtcctgccccaggaggacttctacaagcaggtccaagtaaacttggacgactccgccgaggccaatgagatccaaacgtatatcgaccaggacatcttcatgcccaagcagcggaccaaggcgaacgggagcatcccccaccaactgcagcagcaagagctggaccagatcatcgagaaccagaaggcctactacccgtggctcgccgagctgaaccccaaccccgacaagaagcgccagcagctggccaagtacaaactcgacgagctggtgaccttccgggtgccctactacgtgggcccgatgatcaccgccaaggaccagaagaaccaatccggcgccgagttcgcctggatgatccgcaaagagccaggaaacatcactccgtggaacttcgaccagaaggtggaccggatggccaccgccaaccagttcatcaagcgtatgaccaccactgacacctacctgctcggcgaggacgtgctgcccgcccagtcgctgctctaccagaaattcgaggtcctgaacgagctgaacaaaatccggatcgaccacaagccgatttccatcgagcagaagcagcagatcttcaacgacctcttcaagcagttcaagaacgtaaccatcaagcacctccaggactacctggtaagccaggggcagtactccaagcgccccctgatcgaaggattagccgacgagaagcggttcaacagctccctgagtacatactccgacctatgcgggatcttcggcgccaagttagtcgaggagaacgataggcaagaggacctagagaagatcatcgagtggagcacgatcttcgaagacaagaagatctaccgggccaagctgaacgacctcacctggctgaccgacgaccagaaggagaagctggccaccaaacgctatcagggctgggggcggctctcccgtaagctgttggtgggactcaagaacagcgagcaccgcaacatcatggatatcctgtggatcacgaacgagaactttatgcagatccaggcggagcccgacttcgcaaagctggtgaccgacgccaacaaggggatgctcgagaagaccgactcccaggacgtcatcaacgacctgtacaccagcccccagaacaaaaaggccatccggcagatcctgctggtggtgcacgacatccagaacgccatgcacggccaggcgccggccaagatccacgtcgagttcgcccgcggggaggaacggaatccacgccggagcgtgcagcgccagcgccaagtggaggccgcctacgagaaggtcagcaacgagctggtgagcgcgaaggtgcggcaagagttcaaggaggccatcaacaacaagcgggactttaaggaccgcctgctcctgtacttcatgcaaggcggcatcgacatatataccgggaagcagctgaacatcgaccagctctccagttatcagatcgaccacatcctgccccaagccttcgtcaaggacgactccctgaccaaccgagtgctcaccaacgagaaccaggtgaaggccgacagcgtgcccatcgacatcttcggcaagaagatgctgagcgtatgggggcgcatgaaggaccagggcctgatcagcaaggggaagtaccggaacctcaccatgaacccggagaacatatccgcgcacactgagaacggcttcatcaaccgccagctggtggagacgagacaggtcatcaagctagccgtgaacatcctcgccgatgagtatggcgacagcacccagatcatctccgtgaaggccgacctgagccaccagatgcgcgaggactttgagctgctcaagaaccgggacgtcaacgactaccaccacgccttcgacgcgtacctggccgccttcatcgggaactacctgctcaagcgctaccccaagctggagtcctacttcgtgtacggcgacttcaagaagttcacccagaaggagaccaagatgcggcgcttcaacttcatctacgacctgaagcactgcgatcaggtggtcaacaaggagacgggggagatcctctggacaaaagacgaggacatcaagtacatccgacacctattcgcctacaagaagatcctggtgagccacgaggtgcgcgagaagaggggcgccttgtacaaccagaccatctacaaggcgaaggacgacaagggctccgggcagggcagcaagaagctgatccgtatcaaggacgacaaggagaccaagatctacgggggctactccggcaagagcttggcctacatgacgatcgtccagatcaccaagaagaacaaggtgtcctaccgcgtgatcgggatccccaccctagcgctggcccggctgaataagctcgagaacgatagcaccgagaacaacggcgagctgtacaaaatcatcaagccccagttcacgcactacaaggtcgacaagaagaacggggagatcatcgaaacgaccgacgactttaagatcgtggtgagcaaggttagatttcagcagctgatcgacgacgccggccagttcttcatgctcgcgtccgacacctacaagaacaacgcccagcagctggtgattagcaacaacgccctgaaggccatcaacaacacgaacatcaccgactgcccccgggacgacctcgagcgcctggacaacctgcggctcgactccgcgttcgacgagatcgtgaagaaaatggacaagtacttcagcgcatacgacgccaacaacttccgcgagaagatccgaaattccaaccttatcttctaccagctgcccgtcgaggaccagtgggagaacaacaagatcaccgagctcgggaagcgcaccgtgctcacgcggattctgcagggcctccacgccaacgccaccaccaccgacatgagcatcttcaagatcaagacgcccttcggtcagctgcgccagcggtccggcatcagcctgtccgagaatgcgcagctaatctaccagagcccgaccggcctgttcgagcgccgggtgcagctgaacaagatcaagtga

SEQ ID NO: 7833 - RNA, 4137 nt, synthetic construct
  misc_feature 1..4137: note = Cas9 variant
  source 1..4137: mol_type = other RNA
atgaagaacaaggactacagcatcgggctggacatcgggacttccagcatcggcttcgccgtggtcgacgagaataaccacgtgatgcgcgtgaaggggaagaacgccatcggcgtccggctgttcgacgaggggaagcccgcggccgatagacgggcgttccgcacaacgcggcgccggctgtcacgccggcgctggcggctgaagctcctgcgcgagatcttcgactcatacataaccccggtggacgaggccttcttcatccggcttaaggagtccaacctcagccccaaggactcaaagaagcagtacagcggcgacatcctattcaacgatcgctccgacaaagacttctacaccaagtaccccaccatataccaccttcgtaatgccctcatgacggagcaccagcgcttcgacatcagagagatctacctggcgatccaccacatcgtgaaattccgcggccatttcttaaacgccacccccgccaacaactttcaggtagggaagctcgatctggaccagaagttcgaggacttgaacgacatctaccagcgggtgttcccggacgacagcatcgagttccgcatcgacaacctcgagcagatcaaagccgtgctgctggactccaagcggagcagatccgacagacagcggagcctcgtcgacgacgtgtaccagacctccgaggacaaggaggtggagaagcagaacaaggcggtcgccaccgaggtgttgaaggccatactgggaaacaaggccaagttgaatatcatcgcaaacgtggaggtcgacaaggaggcggccaaggagtggacgatcaccttcgacagcgagtccatcgacgacgacctggccaagatcgacgggcagatgaccgacgacggccgcgccatagtggagatcctgcggagcctctattccgggattaccctgagcgctattgtgccagagaaccatacgctgagccaggcgatggtcgccaagtacgacctccacaagaagcacctgaccctgctcaagaagctgatcaacagcatgaccgatacgaaaaaggccaagaacctgcgcgccgcctacgacggctacgtggacggcgtgaaggggaaggtcctcacgcaggacgagttctataagcagatccaaagcaacctcgacgagtccgtggaggcgagcgagattcagacctacatcgaccaggacatcttcatgcccaagcagcggaccaaggccaatggctccatcccccaccagctgcagcagcaggaactcgaccagatcatcgagaaccagaaggagtactacccgtggctggccgagctgaaccctaaccccgacaagaagcgccaacagctcgccaagtacaagctggacgagctggtgaccttccgggtcccctattacgtgggcccgatgatcaccgccgaggcgcagaagaagcagtctggcgccgagttcgcctggatgatccggaaggagtccggcaacatcaccccctggaacttcgaccagaaggttgatcggatggccaccgcgaaccagttcatcaagcgcatgaccacgaccgatacgtaccttctgggggaggacgtcctgcccagccagtccctcctgtaccagcggttcgaggtgctgaacgagctcaacaaaatccgcatcgaccggaagcccatctcggtagagctgaagcagcagatcttcaacgacctgttcaagaagttcaagaacgttaccatcaagcacctccaggactacctcgtggcccagggccagtactccaagcgcccgctgatcgaggggctggccgacgagaagcggttcaacagcggcctctccacatacaacgacttctgtggaatcttcggcgcaaagctggtcgacgaaaacgaccgccaggccgacctggagaagatcatcgagtggagcactatctttgaagacaagaagatataccgggcgaagctcaacgacctggcctggctgaccgacgagcagaaggacaagctcgccaccaagcgctatcaaggctgggggcggctgtccagcaagctgctcatcggcttacagaactccgagcacagaaacatcatggatctactatggatcgggaacgagaacttcatgcaaatccaggccgactccgacttcgccaagctgatcaaggacgcgaaccagaacgccctgcagaacaatgactcccaggacgtgatcaacgacctctacaccagcccccagaacaagaaggccatccgccagatactgctggtggtccatgacatccagaacgctatgcacggccaggcccccaccaaaatccacgtggagttcgcgaagggggaggagcggaacccccgccggagcgtgcagcgccagcggcaggtcgaggccgcctacgagaaggcctccaacgagctcgtcggcgccaacgtgcgcgaggagctgaaggacgccatcaccaacaagcgggacttcaaagaccgcctgttcctctacttcatgcaaggcggggtcgacatgtacagcggggagccgattaacattgacaacctgtcccggtacgacatcgaccacatcctgcctcaggccttcgtaaaggacgacagcctcaacaaccgcgtgctgaccgacgccgagaagaatcggcgcaaatctgacgccgttcccaacgagctgttcggggcgaagatgcgggtgacgtgggagcgcatgaaggagcagggtctcatcagcaaggggaaatatcgaaacctgaccatgaaccccgagaacatcaacaagtacaccgagaacgggttcatcaaccggcagctggtggagaccagacaggtcatcaagctcgccgtgaacatcctggctgatgagtacaaggagaacactcagatcatctccgtgaaggccgacctgagccaccagatgcgcgaggacttcgagctcctgaagaaccgggacgtcaacgactaccaccacgccttcgacgcttacctggccgccttcatgggcaactacctcctgaagcgctacccgaagctgcggtcctacttcgtgtacggggatttcaagaagttcacgcagaaagagatcaagctccgacgctttaacttcatctacgacctgaaacacgaggaccaggtgatcgataaggagaccggcgagatcttatggaacaagaacgaggacatcgcctacatccggcacctcttcgcctacaagaagatcctgatcagccacgaggtctccgagcgccgcggagcgctgtacaaccagaccgtgtacaaggcctccgacgacaaggcctccggccaaggcagcaagaaactcatccccatcaaatccgacaaacccaccgagatctacgggggctacacgggacggaccctggcctacatgaccatcgtgaaggtcaccaagggcaagaagatcagctacaaggtggtgggggtccccacggcagtcctggccaagatggcgggcgtgcggcagggctcccaggaggagcaggacaagctctacggggtcctgaagccgcagttcacccaccagaaggagaacaagaagaccggcgagatcaccgagacggtggacaagtttgacatcatcgtgcccaaggtcaagtaccagcaactggtgaacgacaacggtcagctgttcatgatcggcagtgacaccctgccctacaacgccgagcagctggtgctcagcaaggagtccgtccagaccattaacaatcctgggatcaaagacgagggcagcgacgaggagtccgagaacaagaagctggacaacgtgtatgacgagatcgtgctgtgtatgaacaagtattttcccctctacgacaaccgcggtttccgcaacagcatcaccaacgggaagaacaagttcctgaagctgcctatcaagaacatctataagaacggcaagctcatcaacgtcgggaagcgtgaggtgatcaaccgcatccttcagggcctgcacgccaacgcgtccgtgacggacctcagcaacctagggatcaagtcccccttcggcttcctgcagaagggcgcggggctcagcctttctggggaggcccagctcatccaccaaagcgccaccggcctcttcgagcaccgagtccagttaaacaagatcaagtga

SEQ ID NO: 7834 - RNA, 4137 nt, synthetic construct
  misc_feature 1..4137: note = Cas9 variant
  source 1..4137: mol_type = other RNA
atgagcaacaagccctactccatcggcctagatatcgggaccaacagcgtcggctgggccgtcatcaccgacgattacaaggtgccgtccaagaaaatgaaagtgctcgggaacactgacaagcacttcatcaagaagaacctgatcggcgccctgctgttcgacgaggggaccaccgcggagggccgccggctgaagcgcaccgcgcggagacggtacacgcgccggaagaaccgcctgcggtacctccaggagatcttcagcgaggagatctccaaggtcgacagctccttcttccaccgcctggacgactcgttcctggtgcccgaggacaagcggggctccaagtaccccatcttcgcgaccctcgccgaggagaaggagtaccacaagaacttccccaccatctaccacctccgcaagcagctggccgacagcaaggagaaagcggacttacggctgatctacctggccctcgcgcacatgatgaagtacagagggcacttcctgtacgaggagtccttcgacatcaagaacaacgacatccagaagatcttcaacgagttcatcagcatctacgacaacaccttcgagggctccagcctgtccgagcagaacgtgcaggtcgaggccatcttcacggacaagatcagcaagtccgcgaagcgggagcgcgtgctcaagctgttcccggacgagaagtccaccgggctgttcagcgagttcctcaagctgatcgtgggcaaccaggccgagttcaagaagcacttcgacctcgaggagaaggcgcccctccagttcagcaaggacacctacgacgaggacctggagaacctgctcgggcagatcggcgacggcttcgcggacctgtttctggtcgccaagaagctctacgacgccatcctgctgagcgggatcctcaccgtgacggacccctccaccaaggcgcccctgagcgcgtccatgatcgagcggtacgagaaccaccagaaggacctggccagcctcaagcagttcatcaagaataacctgccggccgagaagtgcgtggaggtcttctctgaccagagcaaggacggctacgccgggtatatcgacggcaagaccacccaggaggccttctacaaatacatcaagaacctactctccaagctggagggcgcctactacttcctggacaagatcgagcgcgaggacttcctccggaagcagcgcaccttcgacaacgggagcatcccccaccagatccacctccaagagatgaacgccatcttacggcgccagggcgagcactaccccttcctgaaggagaaccgcgagaagatcgagaagatcctaaccttccggatcccctaccacgtggggccactggcccgcggcaaccgggacttcgcgtggttaacccgcaactccgacgaggccatccggccctggaacttcgaggaaatcgtggaccaggccagctccgccgaggacttcatcaacaagatgaccaactacgacctgtacctgcccgaggagaaggtcctgcccaagcacagcctcctgtacgagacgttcgccgtgtacaacgagctgaccaaggtgaagttcatcgcagaggggctcaccaggtaccagttcctggacaagaagcaaaagaaggacatcttctacaccttctttaaggccgaggacaagcggaaggtcacggagaaggacattatccactacctgcacaacgtggatggatacgacggcatcgagctcaaggggatcgaaaagcagttcaacgcctccctgagcacataccacgacctgctcaagataatcaaggacaaggagttcatggacgacccgaagaacgaggagatcctggagaacattgtgcacaccctgaccatattcgaggaccgcgagatgatcaagcagcggctcgcccagtacgactccctgttcgatgagaaggtcatcaaggcgctgacgcgtcggcactacacgggctgggggaagctcagcgctaagctgatcaacggcatctgcgacaagcagaccgggaagaccatcctggactacctcatcgacgacggcaagatcaaccgcaacttcatgcagttgatcaacgacgacggcctgtccttcaaagaaatcatccagaaggcccaggtggtcgggaagacgtacgacgtcaagcaggtcgtgcaggagctccccggcagccccgccatcaagaaggggatcctgcagtccgtgaagctggtggacgagctcgtcaaggtgatgggccacgcccccgagagcatcgtgatcgagatggcacgggagaaccagaccacggccaagggtaagaagaacagccagcagcgctacaagcggatcgaggacgccataaagaacctggccccgggcctggactccaccatcctcaaggagcaccccacggacaacatccagctgcagaacgaccgcctgttcctctactacctgcaaaacggccgggacatgtacaccgggaagcccctggagatcaaccagctcagcaactacgacatcgaccacatcatcccccaggccttcatcaaggacgactccctggacaaccgcgtcctgaccagctccaaggagaaccggggcaagagcgacaacgtgccgtccctcgaggtggtcgagaagatgaaggcgttctggcagcagctgctggacagcaagctcatctccgagcgcaagttcaacaacctcaccaaggccgagcgcgggggcctggacgaactcgacaaggtgggcttcatcaagcggcagctggtggagacccgccagattacgaagcacgtcgcccagatcctggacgcccggttcaacaaggaggtgaccgagaagaacaagaagaaccgcaacgtgaagatcatcaccctcaagtcgaacatggtctccaacttccggaaggagttcgggctgtacaaggtgcgcgagatcaacgactaccaccacgcccacgacgcgtacctgaacgccgtggtcgccaaggccatcctcaagaagtaccccaagctggagcccgagttcgtgtacggcgactaccagaagtacgacctgaagcggtacattagcaagtccaaggaccccaaggaggtggagaaggcgaccgagaagtacttcttctacagcaacctcctgaacttcttcaaggaggaggtccactacgcagacggtacgatcgtgaagcgcgagaacatcgagtactccaaggacaccggcgagatcgcctggaataaggagaaggacttcgccaccatcaagaaggtgctcagcttcccgcaggtcaacatcgtgaagaaaaccgaggagcaaacggtggggcagaacggcggcctcttcgacaacaacatcgtctccaaggagaaggtggtggacgccagcaagctgatccccatcaagagcgggctgtcccccgagaagtacggcgggtacgcgcggccgaccatcgcctacagcgtcctcgtgacctacaagcagaacaacaagatcaagaacaccatggtgggcatacccgtcctgacgaagctggagttcgaacgcgaccccaacctctacctgcggaacctggggatcaacaacgtgtcccacgtgatcaagctcgtcaagcacaccgtgttggagttcaaacacaaatacggcacctaccgccggttcatcgtgagcaaccaggagctgaagcgcgccaaccagatcttcgtcaccacgaagcagatgaagctcatctcccagtacaccaccctggacaagaacgagcacgacagcctgctcaagaacaaccagcagctgatccagtccatctggaaccagttcctggagttcatgctcgccaccgacctggtgaacaagaagcagtacgacgagctgatcctcacgaacaaccagacgatcgaggagtgccggaacatcatgaaccgcgtgatcaccaccctgagcttcacgaacatcaacgccggccagaagaagatcatcttcgacgataccctgtccctccccatcaagcggtggcagttcaccgatagcgacaagatggtcaagaagatcatcgagtccaccctgatccaccagagcatcacggggctgtacgagacccgcatcgacctcaacaagctgggcgaggactga

SEQ ID NO: 7835 - RNA, 4137 nt, synthetic construct
  misc_feature 1..4137: note = Cas9 variant
  source 1..4137: mol_type = other RNA
atgaacaagccctacagcattggcctcgacatcggcaccaactccgtgggctggagcatcatcaccgacgactacaaggtaccggccaagaagatgcgcgtgctcgggaacacggacaaagagtacatcaagaagaacctgatcggcgccctgctgttcgacgggggcaacaccgcggccgacagacgcctgaagcggaccgcccgccggcgctacacccggcgccgcaaccgcatcctgtacctccaggagatcttcgccgaggagatgagtaaggtggacgacagcttcttccaccggctggaggacagtttcctggtcgaggaggacaagagaggcagcaagtaccccatcttcgccacgatgcaggaggagaagtactaccacgagaagttccccaccatctaccacctccggaaggagctggcggacaagaaagagaaggccgacctgcgcctcatctacctggccctggcccacatcatcaagttccgggggcacttcctcatcgaggacgaccgattcgacgtgcgaaacaccgacattcagaagcagtaccaggcgttcctggagatcttcgacaccacgttcgagaacaacgacctgctctcccagaacgtggacgtcgaggccatcctgaccgacaagatcagcaagagcgccaagaaggaccgcatcctggcccggtaccccaaccagaagtccaccggcatcttcgccgagttcctcaagctgatcgtggggaaccaggcggacttcaagaagcacttcaacctggaggataagaccccgctccagttcgccaaggacagctacgacgaagacctggagaatctgctcggccagatcggggacgagttcgccgacctgttcagcgccgccaagaagctgtacgactccgttctcctgagcggcatcctgacggtcatcgacctctccaccaaggcgcccctgagcgcctccatgatccagcgctacgacgagcaccacgaggacctgaaacacctcaagcagttcgttaaggccagcctgcccgagaactaccgggaggtgttcgccgactccagcaaggacggctacgccgggtacatcgagggcaagaccagccaggaggcgttctacaagtacctgctcaagctgctgaccaagcaggaggggtccgagtacctcctggagaagatcaaaaacgaagacttcctgcgcaagcaacgcacgttcgacaacggcagcatcccccaccaggtccacctcaccgagctgcgggccataatccgccggcagtccgagtactacccgtttctgaaggagaacctcgaccgcatcgagaagatcctgaccttccggatcccctactacgtgggcccgctcgcccgcgagaagtccgacttcgcttggatgacccggaagacggacgacagcattcgcccctggaacttcgaggacctggtggacaaggagaagtccgccgaggcgttcatccaccgaatgaccaacaacgacctctacctgccggaggagaaagtcctgcccaagcacagcctcatctacgagaaattcaccgtgtacaatgagctgaccaaggtgcgcttcctggccgaggggttcaaggacttccagttcctcaacaggaagcagaaggagacgatcttcaacagcctgttcaaggagaagagaaaggtcaccgagaaggacatcatctcattcctgaacaaggtggacggctacgaggggatcgctatcaagggcatcgagaagcagttcaacgccagcctctccacataccacgacctgaaaaagatcttggggaaggacttcctcgacaacaccgacaatgagctgatcctggaggacatcattcagacgctcaccctgttcgaggaccgggagatgatcaagaagcgcctggacatctacaaggacttcttcaccgagagccagctcaagaagctgtaccggcgccactacaccggctggggccggctgtccgctaagctcatcaacgggatccgcaacaaggagaaccagaagacgatcctggactacctgatcgacgacggcagcgccaatcggaacttcatgcagctcatcaaggacgccgggctgtccttcaagcccatcatcgacaaggcccgcaccggcagccactccgacaacctaaaggaggtggtcggggagctcgccggcagccccgcgatcaagaagggcatcttgcagtccctgaagatcgtggacgagctcgtgaaggtgatggggtacgagccggagcagatcgtggtcgagatggcccgcgagaaccagaccaccgccaagggtctgagccggagccgccagcggctgactaccctccgcgagtccctgggtaacctcaagtcgaacatcctcgaggagaagaagcccaagtacgtgaaggaccaggtagagaaccaccacctgtccgacgaccggctgttcctctactacctgcagaacggcaaggacatgtacaccgatgacgagctggacatcgacaacctcagccagtacgacatcgaccacatcatcccacaggccttcatcaaggacgactccatcgacaaccgcgtccttgtgagctccgccaagaaccggggcaagagcgacgacgtgccctccatcgagatcgtcaaggcgcggaaaatgttctggaagaacctgctcgacgccaagctgatgagccagcgcaagtacgacaacctgaccaaggccgagcgcgggggcctcacctccgacgacaaggcgcggttcatccagcgccagctggtggagacgcggcagatcaccaagcacgtggcccgcatcctggacgagcggttcaacaacgagttagacagcaaggggcgccggatccgcaaggtcaagatcgtgaccctgaagtccaacttagtgagcaacttccggaaggagttcggcttctataaaatccgcgaggtcaacaactaccaccacgcgcacgacgcctacctcaacgccgtggtggccaaggcgatcctgaccaaatacccgcagctggagcccgagttcgtctacgggctctaccggcgcaagaagctgtccaagatcgtgcgcgaggacaaggaggagaagtacagcgaggccacgcggaagatgttcttctactccaacctgatgaacatgttcaagcgcgtggtccggctcgccgatggcagcatcgtggttcgccccgtcatcgagaccggccggtacatggggaagacagcctgggacaagaagaagcacttcgccaccgtgcgcaaggtgctgagctacccccagaacaacatcgtcaagaagacggagatccagaccggcgggttctccaaggagagcatcctggcgcacggcaactccgacaagctcatcccgcggaaaaccaaggacatctacctggaccccaagaagtacgggggcttcgacagcccgatcgtggcctactccgtgctggtcgtggccgacatcaagaagggtaaggcccaaaagctcaagacagtgacagagctgctggggatcaccatcatggagcgcagccggttcgaaaagaacacctccgccttcctcgagagcaagggctacctgaacatccgcgacgacaagctgatgatcctccccaagtactccctgttcgagctggagaacgggcggcgccggctcctggcgagcgccggcgagcttcagaaggggaacgagctcgccctgccgacccagttcatgaagttcctgtacttagcgtcccgctacaacgagagcaagggcaagcccgaggagatcgagaaaaagcaggagttcgtaaaccagcacgtgtcctacttcgacgacatcctgcagctgatcaacgacttcagcaaccgcgtaatactcgccgacgcgaacctggagaagatcaacaagctgtaccaggacaacaaggagaacatccccgtcgacgagctcgccaacaacatcatcaatctgttcacgttcacctccctgggcgccccggccgcgttcaagttcttcgacaagatcgtggatcgcaagcgatacaccagcaccaaggaagtgctcaactccacgttaatccaccagagcatcaccgggctgtacgagacccgcatcgacctcggcaagctgggggaaggctga

SEQ ID NO: 7836 - RNA, 4137 nt, synthetic construct
  misc_feature 1..4137: note = Cas9 variant
  source 1..4137: mol_type = other RNA
atgaccaacgagaagtacagcatcggcctggacatcgggacctccagcatcggcttcgccgtggtcaacgacaacaaccgcgtgattcgggtgaaggggaagaacgccataggcgtccgcctcttcgacgaggggaaggcggccgccgaccggcgctccttcaggacgacccgccggcgcctgagccggcgccggtggcgcctgaagctcctgcgtgagatcttcgacgcgtacatcaccccggtggacgaggccttcttcatccgcctgaaggagtccaacctcagcccgaaggactccaagaagcagtacagcggcgacatcctgttcaatgaccggtccgacaaggacttctacgagaagtaccccaccatctaccacctccgcaacgcgctgatgacggaacaccggaagttcgacgtgcgcgagatctacttagccattcaccacatcatgaagttccggggccatttcctcaacgccacccccgccaacaacttcaaggtcgggcgcctcaacctggaggagaagttcgaggagctgaacgatatctaccagcgggtgttcccggacgagagcatcgagttccgcaccgacaacctcgaacagatcaaggaggtgctgctggacaacaagcgctcccgggcggaccgccagcggaccctcgtcagcgacatctaccagtccagcgaggacaaggacatcgagaagcgcaacaaggccgtggccacggagatcctgaaggcgtccctggggaacaaggccaagctcaacgtgatcaccaacgtcgaggtggacaaggaggcggccaaggagtggagcatcaccttcgactccgagagcatcgacgacgacctggccaagatcgaggggcagatgaccgacgacggccacgagatcatcgaggtcctgcggtccctctacagcgggatcacgctgagcgccatcgtcccggagaaccacaccctgtcccagagcatggtggccaagtacgacctccacaaggaccacctgaagctgttcaagaagctcatcaacggcatgaccgacaccaagaaggcgaagaacctgcgcgccgcctacgacggctacatcgacggggtgaagggcaaggtcctgccccaggaggacttttacaagcaggtccaggtgaacctcgacgactccgccgaggccaacgagatccagacgtacatcgaccaggacatcttcatgcccaagcagcggaccaaggctaacggaagcatcccccaccagctgcagcagcaggagctggaccagatcatcgagaaccagaaggcctactacccgtggctcgccgagctgaaccccaaccccgacaagaagcgccagcagctggccaagtacaagctcgacgaactggtgaccttccgggtcccctactacgtgggcccgatgatcaccgccaaagaccagaaaaaccagtccggcgcggagttcgcctggatgatccgcaaggagcccgggaacatcacgccctggaatttcgaccagaaggtggaccggatggccaccgccaaccagttcatcaagcgcatgactaccacggacacctacctgctcggcgaggacgtactgcccgcgcagtccctgctctaccagaagttcgaggtcctgaatgaactgaacaagatccggatcgaccacaagccgatctccatcgagcagaagcagcagatcttcaacgatttattcaagcagttcaaaaacgtgaccatcaagcacctccaggactacctggtgagccaggggcagtactccaagcgccccctgatcgagggcctggccgacgagaagcggttcaacagctccctgtcaacctactccgacctgtgcgggatcttcggcgcgaagctcgtcgaggagaacgaccgccaggaggacctggagaagatcatcgagtggtcaacgatcttcgaggacaagaagatctaccgggccaagctgaacgacctcacctggctgaccgatgaccagaaggagaagctggcaaccaagcgctaccagggctgggggcggctcagtcgcaagctgctggtgggcctcaagaacagcgagcaccgcaacatcatggacatcctgtggatcacgaacgagaacttcatgcagatccaggcggaacccgacttcgccaagctggtgaccgacgccaacaaggggatgctcgagaagaccgactcccaagacgtaatcaacgacctgtacaccagcccccagaacaagaaggctatccggcagatcctactcgtggtgcacgacattcagaacgccatgcacggccaggcgccggccaagatccacgtcgaatttgcccgcggggaggagcggaacccccgccggtccgtgcagcgccagcgccaagtggaggccgcctacgagaaggtcagcaacgagctggtgagcgcgaaggtgcggcaggagttcaaggaggccatcaacaacaagcgggacttcaaggaccgcctgttcctctacttcatgcagggcggcatcgacatctacacggggaagcagctgaacattgaccagctgtccagctaccagatcgaccacatcctcccccaggccttcgttaaggacgacagtctgaccaaccgggtgctgaccaacgagaaccaggtgaaggccgacagcgtccccatcgacatcttcggcaagaagatgttatccgtgtgggggcgcatgaaggaccagggcctgatcagcaaggggaagtaccggaatctgaccatgaacccggaaaacatctccgcgcacaccgagaacggcttcatcaaccgccagctcgtcgagacgcggcaggtcatcaagctggccgtgaacatcctggccgacgagtacggcgacagcacccagatcatctccgtgaaggccgacctcagccaccagatgcgcgaagacttcgagctgctgaagaaccgggatgtcaacgactaccaccacgccttcgacgcgtacctcgccgccttcatagggaactacctgctgaagcgctaccccaagctcgagtcctacttcgtgtacggcgacttcaagaaattcacccagaaggagaccaagatgcggcgcttcaacttcatatacgacctaaagcactgcgaccaggtggtcaacaaggagacgggggagatcctgtggacgaaggacgaggacatcaagtacatccggcacagcttcgcctacaagaagatcctcgtgtcccacgaggttcgcgagaagcgcggcgccctgtacaaccagaccatctacaaggcgaaggacgacaagggaagcgggcaggggtccaaaaagctgatccggatcaaggacgacaaggagaccaagatctacgggggctacagcgggaagtccctcgcctacatgacgatagtccagatcaccaaaaagaacaaggtgagctaccgcgtaatcggcatccccaccctggccctcgcccggctcaacaagctggagaatgacagcaccgagaataacggggagctgtacaagatcatcaagccccagttcacccactacaaggtcgacaagaagaacggggagatcatcgagactaccgacgatttcaagatcgtggtgtccaaggtccgcttccagcagctcatcgacgacgctggccagttcttcatgctggcgagcgacacctacaagaacaacgcccagcagctggtgatctccaacaacgccctcaaggccatcaacaacacgaacatcacggactgcccgcgggacgacctggagcgccttgacaacctccggctggacagcgcgttcgacgagatcgtgaaaaagatggacaagtacttctccgcctacgacgctaacaacttccgcgaaaagatccggaatagcaacctgatcttctaccagctccccgtcgaggaccagtgggagaataacaagatcaccgagctggggaagcgcaccgtactgacccggatactccagggcctgcacgccaacgcgaccacaaccgacatgtccatcttcaagatcaagacgcccttcgggcagctgcgccagcggagcggcatctccctaagcgagaacgcgcagctgatctaccagagcccgaccggcctgttcgagcgccgggtgcagctcaacaagatcaagtga

SEQ ID NO: 7837 - RNA, 4137 nt, synthetic construct
  misc_feature 1..4137: note = Cas9 variant
  source 1..4137: mol_type = other RNA
atgaccaacgaaaagtacagcatcggcctggacatcgggaccagtagcatcggcttcgccgtcgtcaacgacaacaaccgcgtgatccgggtgaaggggaagaacgcaatcggcgtccgcctcttcgacgaggggaaggcggccgccgatcggcgcagtttccggacgacccgccggcgcctgagccggcgccggtggcggctgaagctcctgcgggagatcttcgacgcctacatcacccccgtggacgaggccttcttcatacgcctgaaggagtccaacctcagcccgaaggactccaagaagcagtacagcggcgacatcctcttcaacgaccggtccgacaaggacttctacgagaagtatcccaccatataccacctccgcaacgcgctcatgactgagcaccggaaattcgatgtgcgcgagatctacctggctatacatcacattatgaagttccggggccactttctgaacgccacccctgccaacaatttcaaggtcgggcgcctcaacctggaggagaagttcgaggagctgaacgatatctaccagcgggtgttccccgacgagagcattgagttccgcaccgacaacctcgagcagattaaggaggtgctgctggacaacaaacgctcccgggcggaccgccagcggactttagtcagcgacatctaccagtccagcgaggacaaggacatcgagaagcgcaacaaggccgtggccacagagatcctgaaggcctccctggggaacaaggccaaactcaatgtgatcaccaacgtcgaggtcgacaaggaggcggccaaggagtggagcatcaccttcgactccgagagcatcgacgacgacctggccaagatcgagggtcagatgaccgacgacggccacgagataatcgaggtgctgcggtccctctacagcgggatcacgctgagcgccatcgtcccggagaaccacaccttatcccagagcatggtggccaagtacgacctccacaaggaccacctgaagctgttcaagaagctcatcaatggcatgaccgacaccaaaaaggcaaagaacctgcgcgccgcctacgacggttatatcgacggggtgaagggcaaggtcctgccccaggaggacttttacaagcaagtccaggtgaacctcgacgactccgccgaggcgaacgagatccaaacttacatcgaccaggacatctttatgcctaagcagcggaccaaggcgaacgggagcatcccccaccagctgcaacagcaggagctggaccagattatcgagaatcagaaggcctactacccgtggctcgccgaactgaaccccaaccccgacaagaagcgccagcagctggccaagtacaagctcgacgagctggtgaccttcagagtgccctactacgtcggcccgatgatcaccgccaaggaccagaagaaccagtctggtgctgagttcgcctggatgatccgcaaggagcccgggaacatcacgccctggaacttcgaccagaaggtcgaccggatggccaccgccaaccagttcatcaaacgcatgaccaccacggacacctatctgcttggcgaggacgtgctgccagcgcagagcctgctctaccagaagttcgaggttctcaacgagctgaacaaaatccggatcgatcacaagccgatctccatagagcagaagcagcagatcttcaacgacctctttaagcagttcaagaacgtgactatcaaacatctgcaagactacctggtgagccaggggcagtactccaagcgccccctgatcgagggcctggccgacgagaagcgattcaactcttccctgagcacctactccgacctgtgtgggatcttcggcgcgaagctcgtcgaggaaaacgaccgccaggaggatcttgagaagattatcgagtggagcacgatcttcgaagacaagaagatctaccgggccaaactgaacgacctcacctggctgaccgacgaccagaaggagaagctggccaccaagcgctaccagggctgggggcggctctcccgcaagctgctggtgggattaaagaacagcgagcaccgcaacatcatggacatactgtggatcacaaacgagaacttcatgcagatccaggcggagcccgacttcgcgaagctggtgaccgacgccaacaaggggatgctcgagaagaccgactcccaggacgtcatcaacgacctgtacaccagcccccagaacaagaaggccatcagacagatactgctcgtggtgcatgacatccagaacgccatgcacggccaggcgcctgccaagatccacgtagagttcgcgcgcggggaggagcggaacccccgccggtccgtgcagcgccagcgccaggtggaggccgcctacgagaaggtcagcaacgagctggtgagcgcgaaggtgagacaggagttcaaggaagccatcaacaataaacgggacttcaaggaccgcctgttcctctacttcatgcagggcggcatcgacatctacacggggaagcagctgaacatcgaccagctgtccagctaccagatcgaccacatcctcccccaggccttcgtcaaggacgactccctgaccaaccgggtgctgaccaacgagaaccaggtgaaggccgacagcgtccccatcgacatcttcggcaaaaagatgctatccgtgtgggggcgcatgaaggaccagggcctgatcagcaaggggaagtaccgaaacctgaccatgaatccggagaacatctccgcgcacaccgagaacggattcatcaaccgccagctcgtggagacgcggcaggtcatcaagttagccgtgaacatcctggccgacgagtacggcgacagcacccagatcatctccgtgaaagccgacctcagccaccagatgcgcgaggacttcgagctgcttaagaaccgagacgtcaatgactaccatcatgccttcgacgcgtacctcgccgccttcatcgggaactacctgctgaagcgctaccccaagctcgagtcctacttcgtgtacggggactttaagaagttcacccagaaggagaccaagatgcggcgcttcaatttcatctacgatctgaagcactgcgaccaggtggtcaacaaggagacgggggaaatcctgtggaccaaggacgaggacatcaagtacatccggcacctcttcgcctacaagaagatcctggtgagccacgaggtgcgcgagaagcgcggcgccctgtacaaccagaccatctacaaggcgaaggatgacaagggttccgggcagggaagcaagaagctcatccggataaaagacgacaaggagaccaagatctacgggggctactccggcaagagcctggcctacatgacgatcgtccagatcaccaagaagaacaaggtgtcctaccgcgtgatcgggatccccactctagccctagcccggctgaacaagctggagaacgacagcaccgagaacaacggcgagctctacaaaatcatcaagccccagttcacgcactacaaggtggacaagaagaacggggagatcattgagaccaccgacgacttcaagatcgtggttagtaaggttcgcttccagcagctgatcgacgacgccggccagttcttcatgctcgcgtccgacacctacaagaacaacgcccagcagctcgtaatcagcaacaacgccctgaaagccatcaacaacacgaacatcaccgactgcccgcgggacgacctggagcgcctggacaacctgcggctagactccgcgttcgacgagattgtgaagaagatggacaagtacttcagcgcctacgacgcaaacaacttccgcgagaagatccggaactccaacctcatcttctaccagctgcctgtcgaggaccagtgggaaaacaacaagatcaccgagctcgggaaacggaccgtgctcacgcggatcctgcagggactgcacgccaacgccaccaccaccgacatgagcatcttcaagattaagacgccattcgggcaactccgccagcggtccggcatcagcctgtccgagaacgcgcagctgatttaccagagcccgaccggcctcttcgagcgaagagtgcagctgaacaagatcaagtga

SEQ ID NO: 7838 - RNA, 4140 nt, synthetic construct
  misc_feature 1..4140: note = Cas9 variant
  source 1..4140: mol_type = other RNA
atgaagcagatactgggcctcgacctggggacgacctcaatcggctgggccctggtgcgcgaggccgagaacaaggacgagcagtccagcatcgtccggatcggggtgcgcgtgaatcccctcacatccgacgagcagaagaacttcgagcagggcaagagcataaccaccaacgcggaccggacactcaagcgctccatgcggcgcaacctgcagcggtacaagctccgccgggaccacctgaaggactgccttcagaagaacgggatcatcacggacaaggccgtcctcagcgagaacggcaactacaccacgttccagacctactacctgcgcgccaaggccgtgaacgagaagatctccctggaggagttcgcacgggtgctcctgatgctgaacaagaagcgcggctacaagagctcccggaagatgaagtccgcggacgaggggcaactcatcgacggcatgagcgtcgccaagcgcctgtacaacgacaacattacgccggggcagtacgtgctgagccttctggaggagggccggaagtacatccccgatttctaccgctccgacctgctcgacgagctggacaaaatctggaccttccagcagtgcttctaccccgagatcctgacccccgagtgccggaagctcatcgccgggaagggcaagcaggccaccgcgaagatcttcctgggcaagtacaagatttacacggccgacaacaagagcaaggacaagcgactgcaggcctaccagtggcgggtggaggcgctctccgggcagctgccgatcgaggtcgtggccttcgtggtctgcgagatcaacggcgcgatccaggccagctccgggtacctgggcgccatcagcgaccgctccaaggagctctacttcgagggcctgaccgtggggcagtacctggtgaagcagctcgagaagaaccccgacaccagcctgaaaaacaaggtcttctaccggcaggactacctgaacgagttcgaaaagatctgggagaagcaggccgagtaccacaccgagctcacaccccagctgaagaaggaggtgcgcgacatcatcatcttctaccagcgcaccctcaagagccagaagggcctggtggggttttgcgagttcgagtcccggcagatcgaggtcatgatcgacggcaagctgaaaaagaagaccgtggggtgccgcgtgtgccccaagagtagcccgctgttccaggagtacaagatctggcacaacctaaacaacctgaagatcgtcgagaaggagctgggcaagagccgcttcctcaaccaggacgagaaggagtccctgttccaggagctgaacatcaaggaaaagctcagcaaaaccgacatcctgaaactgctgtgcctcaaggccaaggagttcgacctgaacttcgagaaggtggagggtaaccgcacgcaggcggagctgttccgggcttaccaggccatcatcgagatgtccgggaacggcgactacgatttcagcaagatgacctccagcgagatccaggacaccgtcaccggggtcttccgcggcctcgggtacaacacggacatcctgtccttcgacgccgagaaggaggagaagaccttcgacaagcagcccatgtacctgctctggcacctcctgtacagctacgagggcgactccagcgacaccggcaacaaggccctgatcaccaagatcaagaagctgtgcgggttcgagtccgaggagtacgcgcggatcctgacggacgtgaccttccagagcgagtacggcaacctctccactaaggccatccgccggatcctgcccttcatgaagaaggggagcgagtactccgaggcctgccgccacgccggctaccggcacagcgaacgcagcctgaccaaggaggagctcgacaagaaggtctacaaggaccacctggagctgctcccccggaactcccttcgcaacccggtggtggagaagatcctgaaccagatgatccatgtcgtgaacacggtggtcgacacctacgggaagcccgacgagatccggatcgagctcgcccgtgagctgaagaagtccgcgaaggagcgagacgagatgaccgccagcattaacaagaccgccgccgagcacaagaagtactgcgaagtgctgcagaaggagttcggcttcacgcacgtgagccgcaacgacatcatccggtataagctctacctggagctggagaacaacggctacaagaccctctactccgacacctacatcccccgcgagaagctgttcagcaaggagttcgacatcgagcacatcatcccccagtccaagctgttcgacgacagcttctccaacaagaccctcgagtgccgcagcgtcaacatcgagaagtccaacgacaccgcgtacgactacgtgctgaacaagtacggcgagcaaggaatcctggactacaagaaccggatcgagaacctctacaaggacagcaagatctcccgcacgaagtaccagaagctgatgatgaaaaacagcgacatctccggaaacttcatcgagcgggagctgcgcgacagccagtacatcgccaagaaggcccgggagatcctcgaggagctggtgaagttcgtcgtgccgaccaccggctccgtgaccgcccgcctgcgtgaggactggcagctcgtcgacgtgatgcaggagctgaactggaagaagtacgacaagctgggcctcacggacgtgcgctacgacaaggacgggcgggagatccgctatatcaaggactggagcaagcggaacgaccaccgccaccacgccatggacgcgctgaccatcgccttcaccaagcggagcatcatccagtacctaaacaacctcaacgccaagtccgacaagagcggctccatctacgccatcgagcagaaggagctgttccgcgacaagcgggggaagctgaagttcatcccgcccatgccctgcaacatcttcagggccgaggcgaagcggcacctcgagaacgtcctggtgagcgtgaaggccaagaacaaggtcgtgacccccaacatcaaccgctccaagggcaagaacgggatcaacaagaagatccagctgacgccccggggccagctccacaacgagaccatctacggcagcatgaagcgctacgagaccaagtgggagaagatcgggtccggcttcgacgagcggcagatcgccaaggttgccaacaagaagtttcgcgaggccctgctgagccgcctcgctgagttcgggaacgacccccagaaggccttcaccggcaagaactccctggagaagaaccccctgtacgtggacgagctccacacccagaaggtgccggaaaaggtgaagatcgtcaccctggagaacctgtacaccatccggaaggagatcacccccgacctcaaaatcgacaaggtagtggacgccggggtccgccgggtgctgcaggagcgcctggacgagttcgacgacgacagcaagaaggccttctccaacctcgacgagaaccccatctggctgaacggcaaaaagatgaagcgggtgacgatcatgggcgtcagcaacgcggtgcccctgcacgacaagaaagactacaaggggaacctcgtgttcgactccaagggccgcaagcagccggtcgacttcgtgaacaccgggagcaaccaccacgtggccatctaccgggatgagtccggcgagctgcaggacatcgtcgtgagcttctacgaggccaccacccgcagcacgctggggatcccggtcatcgacaaggagtacaagaaggccgagggctggaacttcctattcagtatgaagcagaacgagtacttcgtcttccccaacgaggagaccggcttcaaccccaaggagatcgacctgatgaaccccgacaactacaccaccatctcccccaacctgtaccgggtgcagaagttcagcaagtgcatgtacgggaacagctccgtgcgcgagtacgtcttccggcaccacctcgagacgtcagtgaacgactccaagggcctgaagaacatcgcctacaagaacgtcaagagcctggtgtacctcgaggggatcgtgaaggtacgcatcaaccacatcggacagatcgtctccgtgggggagtactga

SEQ ID NO: 7839 - RNA, 4140 nt, synthetic construct
  misc_feature 1..4140: note = Cas9 variant
  source 1..4140: mol_type = other RNA
atgcgcatcgacaacggccttgaggagctcaaggtgaacaaccggatctacaacatcgggctggacatcggcaccagctccgtcgggtttgccgtgaccgatgcccaggacaagctggtacgcgtcaagggcaagacggcgatcggcgtgcggctgttcgaggagggccacaccgccgccgagcgccggggcttcaggaccacccggcgccggctgagccgccggaagtggagaatcaacctgctcaaccagatcttcgagccctacatctccgagatcgacccgacgttcttcgcccggctgaagaacagctccctggccgggaaggacaagaagttcgagggctctctcctgttccccgaccgcaccgactaccaattctacaaagacaaccccaccatgtaccacctcaggaaacacctcatggagaaggaccgccagttcgacctgcgagagatctacctggccatgcaccacatcatcaagtaccgcgggaacttcctcaacaccacgcccatgaaccacttcaagaacgaggaaatcgatttctccgccctgttctcgcggctgaacgagctctaccaggagatcgacgacgagaacatcttcgagctgaacatcgagaacgtggacgagatcaagaagatcctgctcaaccacgacctgttcaagatggagaagcagaagcaggtcgcgaaattactcaatgtggacaccgacgacaagcagctgaagaaggagaacaccgccctggcgtcaaacttcagcaaagccatcttgggctacaagttcaatctggccctggtgaccaagatcccggaccaggacaagaaggagtggacgatctccctcggggacgaggacttcgacgaccgcctggacaacgtccccgtggccctgaccgaaagccagctcgaggtggttgaggtcctgcactccatcttcaacagcatctctttaaacgagatcgtggagaacggcgagaccctcagctccgccatggtccggaagtacaacgaccacaagcacgacctgaagctgctcaagaacgtgatgaccacgctggaggatcgcaagaaggcgaagaagatccaaggcatctacaacgtgttcgtcgggaaggacactgacctgatctcagacaaggacaagaacaagtacaaggacaaggacgagttctacaaggaaatccagaagaacctcgacaactccagcgacgccgaggagatcatcaagcgcatcaagcaggaccagttcctgcccaagcagcggaccagcaagaacggcgtgatcccccaccagctgcaccagcgcgagctcgacctgatcatcgagaaccaggccaagtactacccgttcctgaaggaggccaaccccaacaagaagcggctcaagcaggccaagtacaagctggacgagctgattgcgtttaagatcccctactacatcgggcccacctccggcgccgagaacagcgacttctcctggctcaagcgcaagaaggacggccagatcacgccgtggaacttcgacgagaaggtggaccggatcgagagcgccaaccgcttcatccggcgcatgaccaccaaggacacctacctcctggccgaggacgtcctgcccctcgagtccctgatctacgagaagtacagcgtgctgaatgagctcaacaacgtgcggatcaaccgccagaagctgtccgtcaacgacaagcaggacatctacaatgagctgttcaagaacagcaagacggtgactctcaagcagctgcagaagtacttcgaggtcaccaagaagctgaagaccgtggtggtcgaggggctcgccgacccgaagaagttcctgtccaacctgggcacgtaccacgacttcaagctcattttcggggacatcgtggacgaccccgagtaccagaccgacctggagaacatcatcgagtggagcaccattttcgaggaccggggcatcttcaactccaagctgaacgaaatcacctggctgacggacgagcagcgcaagaaggtcctgagcaagcggtaccaggggtggggccgcttctccaagaaactgctcgtcggcctgaagaatagccaagggaactccatcctggacgagctctggaacaccaacctgaacttcatgcagctgcagagccaggacgatttcgcggagctcatccacgccgagaacgccaagcagttcaaggccaacgacccggacaacccctggaacggcatcgacgccatcctgaacgacgcgtacaccagccctcagaacaagaaagccatccgccaggtggtgaaggtcgtgcaagacatcgagaaggccatggggaacaagccccaaaagatcgccatcgagttcacccggagcgcggacaagaacccgcggcgcacggactccaggatcaagcgcctgagcgacatctacaaggaagccgccgagaaggtggtcggcgagagcctcaagctggagctgaacgagtacctcacctcgaagaagaagatgactgacaagatgtacctgtacttcacccagctggggaccgacatctacaccggcaagaagatcgacatcgaccagctcaacaactacgacatcgaccatgtgctgccccagtctttcctgaaggacgactccctcgacaaccgcgtgctgaccaaccggagcgacaactccgaaaagtccgacaccgtccccctgcacaagttcggcgccaagatggggaacttctggaggcagctcgccgacgagggcctgatcactaagcggaagtacaagaacctgacgaccgaccccgcgaccatcgacaagtacaccatccaggggttcatccgccggcagctcgtggagacgtcccaggtgatcaagctcaccgcgaacatcctgggcgggctctacccggaggagaccgagatcctggagatccccgccaagctgaaccaccagttccgcgacatgttcgacctcgtcaaggtgcgggaggtgaacgactaccaccacgccttcgacgcctacatcaccgtcttcgtgggtaacttcctctatcgccggtaccccaagctgcgcagctacttcgtgtacggcgacttcaagaagctcaacaagacggacgacgacatacggaagttcaactttctgaacctgttcaacaaggacaaggtcgaggacaacgagaccgacgagatcctctggtcaaaggcggagagcatccgcgacatcaagaacatctacaactacaaattcatgctggtgtcccgagaggtctacacccgccacggggccatgttcaaccagaccatctaccccgccagcaagaacgactccaagaagctgatcccgatcaagaagggcaaggacacggccatctacgggggctacagcggcaacaccgacgcctacatggcgatcgtcgccgtggaggacaagaagggggagaaattcaaggtggtcggcgtgcccacccgggccgtgtcccgcctcgagcagctggccgcggacgaccatgaccagtacttgaccgccctccacgacgtcctgaagcccaacttcactaaaatcaagaccaaccggaagaccaaggccaaggaggaggtgaccacgccgttccgcatcctggtggggaaggtcggctaccggcagcttatccaggacggccaggtgaagatgatgctggggagctccgcctacaagtacaacgctaagcagctggtgctcagcgagaagtccctgaaagtcatcaagaacaacaagaagtacaaccctgacgatgagaaccaggacctgatcgacgtgtacgacgagatcctcggcgtggtcaatcgcgcgttcaacctgtacgacaccaacgggttccggaagaagctgaacgacaaccgcgtgaagttcgtggagctccccatcaacaacatcttcgacggcaccaagctggtccagatggggaagcgcgccgtgctgacacagatcctcaacggcctgcacgccaacgccgccctgggcgacttaaaggcgctgggcatcagcacgcccttcggcaagatgcaaagcaagtccgggattccgctgagcatggacgcctccctcgtgtaccagagccccaccggcctgttcgagcggaagctgaacctctccgacctgtga

SEQ ID NO: 7840 - RNA, 4140 nt, synthetic construct
  misc_feature 1..4140: note = Cas9 variant
  source 1..4140: mol_type = other RNA
atgaccaagaagaactacagcattggcctggacatcgggaccaactccgtgggctgggccgtcatcacggacgactacaaggtgcccgccaagaagatgaaggtgctcggcaacaccgacaagaagtacatcaagaagaacctgctgggcgcgctcctgttcgacagcggtgagaccgccgaagccacccgcctcaagcggacggcccgccggcgctacacccggcgcaagaaccggctccgctacctgcaggaaatcttcgccgacgaaatggcgaaggtcgacgagtcctttttccagcggctggacgagagcttcctccgctgggacgacgacaacaagaaacttggccggtacccgatcttcggcaacaaggcagacgtggtgaagtaccaccaggagttccccaccatctatcacctccgcaagcacctcgccgactccagcgagaaggccgatctgcggctggtctacctcgcactggcccacatgatcaagttccgcggacacttcctgatcgagggggagctcaacgccgagaacaccgacgtgcagaagatcttctccgatttcgtgcgggtgtacgaccgcacgttcgacgacagccacctgtccgagatcaccgtggacgccgcgagcatcctgaccgagaagatctccaagagccggcgcctcgagaatctgatcaagtactaccctaccgagaagaagaacacgctgttcgggaacctcatcgcgctggccctgggcctccagcccaacttcaagatgaacttcaagctgtccgaggacgccaagttacagttcagcaaggactcctacaacgaggacctcgaggaactgctggggaagatcggcgacgactacgccgacctcttcacctccgccaagaacctgtacgacgcgatcctgctctctggcatcctgaccgtggacgacaacagcaccaaggccccgctgtccgccagcatgatcaagcggtacgccgaacaccacgaggacctcgagaagctgaaggagttcatcaaggccaacaagagcgagctgtaccacgacatcttcaaggacgagacgaagaacgggtacgcgggctacatagagaacggggtcaagcaggatgagttctacaagtacctcaagaacaccctgtccaagatcgccggcagcgactacttcctggacaagatcgagcgcgaggatttccttcggaagcagcgcaccttcgacaacggctccataccccaccagatccacctccaggagatgcacgccatcctgcgccggcagggggactactaccccttcctgaaggagaaccaggaccgcatcgagaagatcctgaccttccggatcccctactacgttggcccgctggcccgcaaggacagccggttcagttgggccgaataccacagcgacgagaagatcacgccctggaacttcgacaaggtgatcgacaaggagaagtccgcggagaagttcatcacacgcatgaccttaaacgacctctacctgcccgaggagaaggtcctgcccaagcacagccacgtgtacgagacctacgccgtgtacaacgagctcacgaagatcaagtatgtcaacgagcaggggaaggactccttcttcgacagcaacatgaagcaagagatcttcgaccacgtgttcaaggagaaccggaaggtgaccaaggagaagctgctgaactacctcaacaaggagttcccggagtaccgcatcaaggacctgatcggcctggataaggagaacaagtccttcaacgccagcctagggacctaccacgacctgaagaagatcctggacaaggccttcctcgacgacaaggtcaacgaggaggtgatcgaggacatcatcaagaccctgactctgttcgaggacaaggatatgatccacgagcggctccaaaagtactccgacatattcaccgcggaccagctgaagaagctggagcgccggcactacacgggctggggccgcctcagctacaagctgataaacgggatccggaacaaggagaataacaagaccatcctggactacctcatcgacgacggctccgccaaccgcaacttcatgcagctgatcaacgacgacacgctgcccttcaagcagatcatccagaagtcccaggtggtcggggacgtggacgacatagaggccgtcgtgcacgacctccccggctctcccgccatcaagaaggggatcttacagagcgtgaagatcgtcgacgagctggtgaaggtaatgggcgacaacccggacaacatcgtcatcgagatggcccgggagaaccagaccaccaaccgcggccggtcccagagccagcagcgcttaaagaagctgcagaacagcctgaaggagctcgggtccaacatcctgaacgaggagaagcccagctacatcgaggacaaggtggagaactcccacctccagaacgaccagctgttcctgtactacattcagaacggcaaggacatgtacaccggggacgagctggacatcgaccacctgagcgactatgacatcgaccatattatcccccaggcgttcatcaaggacgactccatcgacaaccgggtgctgacgagctccgccaagaaccgcggcaagagcgacgacgtcccctccctggatatcgtgcgcgcccggaaggccgagtgggtgcgcctctacaagagcggactgatctccaagcggaaattcgacaacctgaccaaggccgagcgcggcggactcaccgaggcggacaaggccgggttcatcaagcggcagctggtcgagacccgccagatcaccaagcacgtggcccagattctggatgcccggttcaacacggagagtgacgagaacgacaaggtgatccgcgacgtgaaggtgatcaccctcaagtccaacctggtgagccagttccggaaggacttcgagttctacaaggtccgcgagatcaacgactaccaccacgcccacgacgcgtatctgaacgccgtggtgggcaccgccctcctgaagaagtacccgaagctggcctccgagttcgtctacggggagtacaagaagtacgacgtgcacaagctcatcgccaagagctccgacgaccacagcgagatgggcaaggcgaccgccaagtacttcttctacagcaacctgatgaacttcttcaagcgggttatccgctactccaacggcaaggtcatcgtgcggcctgtggtcgagtacagcaaggacacggaggacatcgcctgggacaagaagtccaacttccgcaccatctgcaaggtgctgagctacccccaggtgaacatcgtcaagaaggtggagacccagaccggtggcttctccaaggagagcatcctccccaagggggactccgacaagctgatcccgaggaagacgaagaaggcctactgggacaccaagaagtacggcgggttcgatagccccaccgtggcgtactccgtcttcgtggtggccgacgtcgagaagggcaaagccaagaagctgaagaccgtgaaggagctcgtgggcatcagcatcatggagcgctccttcttcgaggagaaccccgtcgagttcctggagaacaaggggtaccacaacatccgggaggacaaacttatcaagctccccaagtacagcctgttcgagttcgagggcgggaagcgccggctgctcgcctccgccagcgagctgcagaagggcaacgagatggtgataccggggcacctggtgaagctcctataccacgcgcagcgcatcaactcgttcaacagcacgaagtacctggactacgtctccgcccacaagaaggagttcgaaaaggtgctcagctgcgtggaggacttcgccaacctgtacgtcgacgtggagaagaacctgagcaagatccgggccgtggccgacagcatggacaacttcagcatcgaagagatctccaacagcttcatcaacctcctgaccctgaccgcgctcggcgcccccgcagacttcaacttcctgggagagaagataccccgcaagcgctacacctccacgaaggagtgcctgaacgccacactcatccaccagagcatcaccgggctgtacgagacccggatcgacctgtccaagatcggtgaggagtga

SEQ ID NO: 7841 - RNA, 4143 nt, synthetic construct; identical to SEQ ID NO: 2041
  misc_feature 1..4143: note = Cas9 variant
  source 1..4143: mol_type = other RNA

SEQ ID NO: 7842 - RNA, 4143 nt, synthetic construct
  misc_feature 1..4143: note = Cas9 variant
  source 1..4143: mol_type = other RNA
atgaagcgcatactgggcctcgacctggggaccaccagcataggctgggccttagtaaacgaggccgagaacaacaacgaagcgtccagcatcgtgaggctcggagtgcgcgtgaaccccctgaccgtcgatgagaaatccaacttcgaaaagggcaaggccatcaccaccaacgctgaccgacagctgcgccacggggcccggattaacctccagaggtacaagctgaggcgccagaaccttcacgactgtctccagaagcagggctggctagggaccgaggcgatgtacgaggaagggaaagcgagcacgttcgagacttacaagctgcgggccaaagcggccgaggaggaaatatcgctccacgagttcgcgcgcgtgctattcatgctgaacaagaagagaggctacaagagcaaccgcaaagccaacaacaaggaggacgggcagctgttcgacggtatgaccatcgcgaagaaactatacgaagaacacctcaccccggccgaatacagcctccagctcctgaataaggggaaaaagtttacccagggctactaccggagcgacctcaacgccgagctggagcgcatctgggatgagcagaagaagtactaccccgagattctgaccgacgagttcaagcagcagttggagggcaaaactaagaccaacacgtccaagattttcctggcgaaatacgggatctacagcgctgatcttaagggcctcgaccgtaagttccagcccctgaagtggcgcgttgaggccctgcagcagcaggtcgacaaggaagtgctcgccttcgtgatctccgacctaaaggggcagatcgccaacacctcgggcctgctcggagcgatttccgaccgcagcaaggagctgtacttcaacaagcaaaccgtcgggcagtacctgtgggcttccctagaggagaatccccacatcagcatcaaaaacaagcctttttaccgccaggactacctggacgagttcgagaagatctgggaaactcaggccgccttccacaagcagctgacccccgagctcaagcaggagatccgggacatcatcattttctaccagcgcccactgaagtccaagaaatccttaatcagtgtatgcgagctcgagcagcggaaggtgaaggccaccatcgacggcaaggagaaggagatcaccatcggacccaaggttgcgcccaagagcagcccggtcttccaagagtttcgcatctggcagaacctgaacaatgtgctgcttatcgacaatgacacaaatgagaagcgccccctggacgaggtcgagcggaacctgctatacaaagagctgtccatcaaggccaagctgagcaagacggaggccctgaaaatcctcaacaagaagggcaaacaatgggacctcaactaccgcgagctggaggggaaccggacccaggccatcctcttcgattgctacaatcgcataatcaccctgaccggccacgaggagtgcgacttcaaaaagattaaggcctccgaaatccggcactacgtgagtacgatttttaagaaccttggcttctccaccgagatccttgacttcgaccccagcctaaagaaacacgagctggagaagcagccgatgtatcagctgtggcatctcctgtactcctacgagagcgacaattccaggacagggaacgaaagcctcctgcggaagctggagaccacgttcggcttccccgaggagtatgcgacagtgctctgcgacgtcgtgttcgaggaggactacgggaacctgtccgtgaaggccatgcgcgagatcctgccctacctccaggcgggcaacgactacagccaggcctgcgcgtacgccggctacaaccactcccggcacagcctcaccaaagaggagctggaccagaaggtctacaaggagcgcctcgagctgctgccaaagaactctctacggaacccggttgtggagaagatcctgaatcagatgatcaacgtaatcaatgccatcatcgacgagtacggcaagcccgacgagatccgcatcgagatggcacgggagctcaagtcgtccgccgctgaccgcaagaaaaccacgcacgccattagccagggcaacgccgagaatcagcggatccgcgagatcctggagaaagagttcagcctgagctatatcagccggaatgacatcatcaagtataagttgtatgaggagctcgagcccaactactacaaaaccctgtactccgacacctacatcaccaaggacaagctgttctccaaggatttcgacatagagcatatcatccccaaggcccgcctcttcgacgactccttcagcaacaagacgctggaggcccgcaacatcaacctggaaaagagcaacaagaccgcgttcgacttcatcaaggagaaatatggggaggacggcgccgaggcctacaagaagaaactcgacatgctgttggagaacgacgccatcagccgcccgaagtacaataacctcctgcgcgccgaagcggacatcccctccgacttcatcaacagagacctgaggaacacccagtatatcgccaagaaggcatgcgagatcctgggggagctggttaagaccgtcacccccacgaccgggaagatcactaaccggctgcgtgaggactggcagctcgtggacgtgatgaaggagctgaacttcgagaagtacgagaagctggggctcaccgagattgtggaggaccgggacggccgcaagatcaagcggattaaggactggacgaaacgcaatgatcaccggcatcacgccatggacgcgctcgccatcgcttttaccaagcccagcttcattcagtacctgaacaacttaaacgcccgatccaacaaaggcgactctatctacgcaatcgagaacaaggagttgcactacgaggaggggaagctgcggttcaatgcacctatcccagttaacgagttccgcgccgaggccaagcggcacctctccgctatcctggtgagcatcaaggctaagaacaaggttatgacccagaacgttaacaaaatcaagactaaacacggcataattaaaaagatccagcttacgccccgcgggcctctccacaacgagacgatctacggcaccaaaatgcgcccgattataaagatggtgaaggttggcgcggccttagacgaggccaccatcaacaaggtgtcctctcccgccatacgcgaagccctgctcaagcggctgaacgagtactccgggaacgcgaagaaagccttcacgggcaagaacactctggaaaagaaccccatctacctcaacgcagggcgcaccaagaccgtgccgagcctggtcaagacagtggagtgggagtccttccatcccaccaggaaactgatagacaaagaccttaacgtcgacaaggtcgtggacaaggggatccgtgagatcctcaaggcacggctggaggagtttaacggagacgcgaagaaggccttcagcaacctcgaggagaaccccatctacctggatgaggccaagaagatagccctgaagcgcgtcagcattgaaggcgtgctctccgccatccccctgcataccctaaagaaccaggcgggcaagccgatcacggggaaagacggcaagcccgtgctcggaaattatgtgcaaacgagcaacaatcaccacatcgcattctactacgacgaggacggcaacctgcaggataacgcggtctctttcttcgaggctgctgagcgcaaaagccaggggattcccgtgatagataaggactacaaccgggacaagggatggcgcttcttatttaccatgaagcaaaacgagtacttcgtattccccaacgaggcgaccggcttcatcccgtccgaggtcgacctgacagacgaagccaactacgggattatctcgccgaacctgtaccgggtgcagaaggtatcccgcatcgacaagggcacgagcgcctcccgggactactggttccgccaccacctggagaccatcttaaacgacgacgccaagttaaagaacctagccttcaagcggattcgcgggctattggagctgaaggacatcatcaaggtccggatcaacagcaccggcaaaatcgttgcggtgggggaatacgactga

SEQ ID NO: 7843 - RNA, 4143 nt, synthetic construct
  misc_feature 1..4143: note = Cas9 variant
  source 1..4143: mol_type = other RNA
atgaagaaaatcctgggcttagacctaggaactaccagcatcggctgggccctggtgaacgaggccgagacggagtccgaaaagagctcaattatccggctcggggtccgggtgaatccgctcaccatcgacgagaagggcaacttcgagaaggggaaagcaatcaccaccaacagtgatcgccagcagcggcacagcgcccgcatcaatctgcagcggtacaagctccgccggcagaacctctgcgactgcctgcagatcggcggcctcctggggtctgagtcaatgtacgaggaaggcaaagagagcacattcgagacctacaagttacgcgcgaaagctgccaccgagaaggtggcgctccacgagttcgcccggatcctgttcatgctgaacaagaagcggggctataagtccaacagaaaggccaatagcaaggaggacggccaggcctttgacgggatgaccatcgcgaagaaactctacgaggagaacctgaccccggcggagtactccctgcaactcctgaacaaaggcaagaaattcagcccctcctactaccgcagcgacctggagtccgagctcaaccggatctgggaagaacagaaaaagtactaccccgagatcttaaccgacgacttctaccagcagctggagggcaagaccaaggtcaacaccacaaagatcttcctcgccaagtacgggatatacaccgccgacctgaagggcctcgacaaaaagatgcaaccccttaagtggcgcatcgaggccctgaacaagcaggtcgacaaggaggtgttgactttcgtggtcagcgacctgaaggggcagatcgagaagacatccggcctgctgggcgagatcagcgaccggtccaaggagctctatttcaacaagcagacggtggggcagtacgtctgggcgtcgctcaaggagaacccgcacgtgagcatcaagaataagcccttctatcgccaagactacctggacgagttcgagaagatctgggaaacccaggccgccttccacaaggagcttacccccgagctgaagaaggagatccgggacatcatcatcttctaccagcgtcccctgaagtccaagaagggcctcattagcatctgcgaactggagcagaagaaagagaaggtgatcatcgaggggaaggagaaggagattctgatcggctccaaagtcgcccccaagtcttcccccatgtaccaggagttccggatctggcagaacctcaacaacgtgttactgatcgacaccgaaatcaatgagtctcgccccctcgacgaggaggagaaggccctgttatacaacgagctatccgtgcgggcgaaactttctgagacagaggcactgaagaccatcaacaagaaggggaagcactgggatctgaatttcaaggagctggagggcaaccgcacccaggccgtcctgttcgagtgctacaaccgcataatcacccagacgggccacgaggaatgcaacttcaagaagatctcggccgaggacatccgccactacgtggcaaccattttcaaaaacctggggttcaacacagacatcctcgacttcaaccccagcctggagaagcacgagctggaaaagcagccgatgtaccagctgtggcacctcctgtattcttacgagtctgacaagtcccgaaccggcaacgagagcctgcttaacaagctggaggcgaacttcgggttcccccaggagtacgcctctgtgttagctgacgccacgttcgaggacgactacggtaacatctccgtcaaggccattagaaaaatcctgccacacttacacgacggctacgactattccgaggcgtgtgagagagccgggtataatcacagcgtgcggtccctgacgaaggaggagttagctcagaaggtgtacaaagaccgcttagacctcctgcccaagaacagcctgcggaacccggtggtggagaagatccttaaccagatgatcaacgtgattaacgcaatcatcgtcgagtacggcaagcccgacgagatcaggatcgagatggcgcgtgagttaaaaagctccgccgccaagcgcgaggaacggaccaagagcatcaaccagaacgccgccgaaaacaagcgcatcacagagatcctgcagacagagttcgggctgtcgtacatcagccggaacgacatcgtaaaatacaagctgtaccaggagctggaggcgaacggcttcaagaccctctactctaatacttacatccccaaggaaaagctgttcagcaaagacttcgacatcgagcacatcgtccccaaggcccgcctgtttgacgactccttcgggaacaaaaccattgaggcacgggacgtgaatctcgccaagtctaataagacggcgttcgacttcgtgaaggagaagtacggcgagcaggggatagaggagtacaagaagaagctggacaccttgctcaaggagaatgcgatctctagtggcaagtacaagaagctgatgatgtccgaggccgacatcccgagcgacttcatcaaccgcgacctgcggaacacccagtacatcgcccgcaaggcatatgaaatcctcggcgagctggtcaagaccatcacccccaccacggggaaaatcaccgacaggctgcgcgaggactggcagctaatcgacgtgatgaaggagctgaatttcgagaagtacgaccgcctgggcctcaccgaggtgatcgaagaccgggacgggcgcaagatcaagcggatcaaggactggacgaagcgcaacgaccaccggcaccacgctatggacgcgctgaccatcgctttcaccaagccctcctatatccagtacctgaacaatctcaacgcccgcagcgacaagtccggctccatctacgcaatcgagacgaaggagctccaccgggagaacaacacgctgaggttcaacgcgcccatgccgctcaacgagttccggaaggaagctaagcgccatctgtccgccatcctggtctcaatcaaggccaagaacaaggtgatgacccaaaacgtgaataagatcaagaccaaaaacggcatcatcaagaaggtccagctcactccgcgcggggccttacacaacgagacgatctacggcaccaagatgcggcccatcatcaagatggtgaagatcggggcggctctggacgaggccaccatcaacaaggtgagctccccaaccatccgggaggcactcttaaagcgcttaaacgaatacagtggcgacgccaagaaggcgttcgccgggaagaacgccatcacgaagaacccgatctacttaaacgccgagcacaccaaaaccgcccccgcgatggtgaagatcgtggagtgggagatgtactaccccatccggaagctgatcaccccggacctgaaaattgagaaggtgatcgacaacggcatcaaggagatcctcaagaagcgccttaaggagttcggcggggacgcaaagaaggccttttccaacctggacgagtgccccatctacctcgacgaggagaagaacatcaccctgaaaagggtcagcatcgaaggggtactgtccgccatccccgtgcacacactcaagaaccacgcggggaaggagatcaaggacgaggacggcaaggctgtcctaggggactacgtgcagacctcaaataaccaccacgtggccatctatcaagacgccaagggcaacctgcaggacaacgtcatctccttcttcgaggccgcggagcgcaagtcacagaacgtgcccatcgtggacaagaacctcaaccgggacaagggctggcacttcctgtacaccatgaagcagaacgagtacttcgtcttcccgaacgaggagacaggcttcgtgccttccgagatcgacctgatggacgagaacaactacgagatgatctcacccaacctcttccgcgtgcagacaatgtcgcgggtcgactacggaaagaccatcatacgcgaatatgtcttccgcaaccacctcgagaccatcttgaacgacaacctcaaactgaaagggctggtgttcaagaagatcaagagcctcaaggcccttgagggcatcgtcaaggtgcgggtgaacgccatcgggaagatcgtcgccgtgggcgagtatgattga

SEQ ID NO: 7844 - RNA, 4143 nt, synthetic construct
  misc_feature 1..4143: note = Cas9 variant
  source 1..4143: mol_type = other RNA
atgaagaagaagtacgccatcggcatcgacatcgggaccaacagcgtaggctggtccgtcgtgaccgacgattacaaggtgccctccaagaaaatgaaggtgttcgggaacacggagaagcgctacatcaagaagaacctgctcggtaccctgctgttcgacgaggggaacaccgccgagaaccggcgcctcaagcggaccgctcgccggagatacacgcgtcgccggaaccgtatactgtacctgcaggagatcttcgccgaggagattaataagatcgacgactccttcttccagcggctcgacgacagcttcctgatcgttgaggacaagcagggctccaaacaccctatattcggtaccctgcaggaggagaaggagtaccacaagcagttcccgaccatctaccacctccgcaagcaactggctgacagctcccagaaggccgacatccggctgatctacctcgccctggcgcacatcatcaagtaccgtgggcacttcctgttcgagggtgacctcaagagcgagaacaaggacgtgcagcacctgttcaacgacttcgtcgagatgttcgacaagaccgtggaggggtcctacctgagcgagaacctccccaacgtggccgacgtcctggtggagaaggtctccaagagccgacacctggagaatatcctccactacttccccaacgagaagaagaacggcctgttcgggaacttcctggcactcgccctgggcctgcagcccaatttcaagacgaacttcgagctcgcggaggacgccaagatccagttctcgaaggagacatacgaggaggacttggaggagttgctcggcaagatcggtgatgactacgccgacctattcatcgcaaccaagagcctgtacgatggcatcctcctggccggcatcctgtccaccacgaacagcaccaccaaggcacccctcagctcatccatggtcaacagatacgaggagcaccaaaaggacctggccctgctcaagaacttcatccatcagaacctgagcgacagctacaaggaggtttttaacgacaaactgaaggacggctacgcaggctacatcgaaggcaagaccacgcaggagaacttctaccgcttcatcaagaaggccatcgagaagatcgacggttccaactacttcatcgagaagatcgagcgcgaggacttcctccggaagcagcgcaccttcgacaacgggagcatcccccaccagatccacctccgggagatgcaggcgatcatacgccgccaggcgaaattctaccccttcctggaggagaaccaggacaagatcgaaaagatccttaccttccggatcccgtactacgtgggccccctggcccgcgggaagagtgagtttgcctggctgaaccgcaagagcgacgagaagatccgaccctggaacttcgacgagatggtcgacaaggaaacctcggccgagaacttcatcacgaggatgaccaactacgaccagtacctccccgaccagaaagtgctgccgaagcacagcctgctgtacgagaaattcgccgtttacaacgaactcaccaaggtacgctacgtgacggagcagggcaagtccttcttctttgacgcgaatatgaagcaggagatcttcgacagaacgttcaaggtgtaccgcaaggtcaccaaggagaagctgatggacttcctgagcaaggagttcgacgagttccggatcgtggacctcctgggcctggacaaagacaacaagtccttcaacgcgagcctcgggacctaccacgacctgaagaagatcgtgtccgaggacttcttagataacagcgagaacgaggacatactcgagaacgtcgtgctgaccctgacgctgttcgaggaccgcgagatgatccggaagcgccttgagaagtacaaggacgtcctgaccgaggagcagcggaagaagctcgagcgcagacactacaccgggtgggggcgcctgtccgccaagctgatcaatggcatccgggacaaggtgacgcgcaagacgatcctcgactacttaatcgacgacgggaccagcaaccggaacttcatgcagctgatcaacgacgacaccctctccttcgtggacgagatccgcctggctcagggctctggcaaggccgaggactaccgcgcggaggtccagaacctggccgggtcccccgccatcaagaagggcatcctccagagtctgaagatcgtggacgagctgatcgaggtgatggggtacgaccccgagcacatcgtcgtggagatggcccgggagaaccagttcaccaaccagggccgccggaactcccagcagcgctacaaaaagatcgagaacgcgatcaagaacctcgacagcaacctgaacagcaagatcctgaaggagtacccgacgaataaccaagccctccagaacgaccgtctgtttctgtactacctccagaacgggaaggacatgtacacagacgaggagctggacatcgaccagctgtcccagtacgacatcgaccacatcatccctcaggccttcatcaaggacgacagcctcgacaacaaggtgctaaccaagagtgccaaaaaccgcggcaagagcgacgacgtcccctccctggagatcgtgtacaagaagaagaacttctggaagcagctcctggacagccagctgatatcccagcggaagttcgacaacttaaccaaggctgagcgcggcgggctgaccaacgaggacaaggcccggttcatccagcgccaactggtggagacacggcagatcaccaagcacgtcgcccgcatcctagacacccggttcaacaccaaactggacgaggccggcaaccgcatccgggacccaaaggtgaacatcatgacgctcaagagctcgctcgtgtcccagttccgcaaggactaccagctctacaaggtccgggagatcaacaattaccaccacgcccacgacgcctacctgaacgcggtggtggccaccgccctcctgaaaaagtacccccagctggccccggagttcgtgtacggggactaccccaaatacaattcctacaagagccgcaagtcggccacagagaaagtgctgttctacagcaacatcatgaacttcttcaagcgggtgctggtctactccaagaccggcgaggttaggatccggcccgtgatcgaggtaaacaaggagacgggcgagatcgtgtgggacaagaagtccgatttccggaccgtgcgcaaggtcctgagctacccccaggtgaacgtggtcaagaagaccgaggtgcagaaccacgggctcgaccggggcaagccgaaggggttctacaacgcgaacctgagtccccgcccaaaggagggcagcgtggagaacctggtccccgccaagcagtccttcgacaccaagcggtacgggggctacgccggcatcagcaactcctacgccgtgctcgtgaacgggatcatcgagaagggcaagaagaagtccaaggcggaggtcacggagttccaggggatcagcatccttgcccgcaaggacttcgacaaaaacccgaagcagtatctgctcaacctgggctacaaggacatcaagagcattataaagctgcccaagtactccctcttcgagctggagaatgggagtcggcgcatgctggcatcgattctcagcaccaataacaagcgtggcgagatccacaagggcaacgaaatgtacctgcccgacaagttcgtcacccttctatatcacgccatgcgcgtgaaccggaccctggagccggggcacaagaagtacgtagaggcacaccgccacgtgttcgacgagctgctcacgtacatcctggagtacaacgagaagatcgtgggcgcgaaggccaacgggaagcggatcgtcgaggcctactccgcccgcaaggacaccgacaacctggaggaactctgcaacagcttcatcaacttgctgaacctcaccgcccttggctccgcggtggacttcgagttcttagggaccaagatcccccggtaccgcgactacacgccctcttccctcctgaaggccaccctgatccaccagagcgtgaccggcctctatgagacccggatcgacctctccaagctgggcggggactga

SEQ ID NO: 7845 - RNA, 4143 nt, synthetic construct
  misc_feature 1..4143: note = Cas9 variant
  source 1..4143: mol_type = other RNA
atgaagaagatcctgggcctcgacctggggaccaccagcatcggctgggccctggtgtacgagtccgagaacgccgacgagaagtcctccattgtccgcctcggggtgcgggtgaaccccctgagcgtcgacgagaagggcaacttcgagaaagggaagtccatcacgaccaacgcggatcgccagcagacccacggcgcccggatcaacctacagcgctacaagctccggcgcgagaacttaaaggactgccttcagaagcagggatggatagggaccgaggccctctacgaggagggcaagacgagcaccttcgagacctacatgctgcgggccaaggccgcggaggaggagatctccctgcatgagctctgccgcgtgttattcatgctgaacaagaagcggggttacaagtctaaccgcaaagccaacaacaaagaggacggcaagctgttcgacgggatgaccgtggccaagaagctgtacgaggagcacctgacgccagctgagtactccctcaagctgctgagctccggcaagaagtttaagcaggagtactaccggagcgacctcaaagaggagttcgaccgcatctggaacgagcagcagaagtactacccagagatcctgaccgacgacttcaagcagcagctgcagggcaagtccaaggggaacaccagcaaaatcttcctcggcaagtacgggatctactccgcggacctgaagggcctggaccggaaactccagcccctgaagtggcgcgtcgaggccctgaagcagaaggtggacaaggaggtgctcgccttcgtcatcagcgaccttaacggccagatcgcctccaccagcggcctgctcggcgccatctccgaccggagcaaagagctgtacttcaacaagcagacggtggggcagtacctgtggaccagcctcaaggagagcccccacgtgagcatcaagaacaagccgttctaccgccaggactacctggatgagttcgagaagatctgggagacccaggcgacataccacaaagagctgacgcccgagctcaagcaggaaatccgggacatcatcatcttctaccagcgccccttgaagtccaagaagggcctgatcagcgtctgcgagctcgagcagcggaaagtgaaggtgaccatcgacgggaaggagaaagagatctccatcggccccaaggtcgcccccaagagctcccccatgttccaggagtttcgcatctggcagaacctgaacaacatcctgctcatcgacaagggcaacaacagcaaccggcccctgtatgaggaggaacgcaacctgctctacgaggagctgtccgtgaaggagaagctgagcaaggccgaggccctgaaggtgctcaacaagaacggcaagcagtgggacctgaactacaaggagatagagggcaaccgcacccaggccgtcctctacgactgctacaaccggataatcgggatgaccggccacgaggagtgcaacttcaagaagctcaaggcgtccgacatccgctacaacgtgaagacgatcttcaagaacctggggttcagcaccgacatcctggacttcgattctagcctgcagggccacgagctggagcggcagccctcctaccagctgtggcacctcctgtacagctacgagtccgacaacagccgcactggcaacgacgccctgttacggaagctggagaccgccttctccatcccgaaggagtacgccgccgtgctgagtgacgttgtgttcgaggacagctacgggaacctctccgtgaaggcaatgcgcaacatcctaccccacctccaggccggcctcgactacagccaggcctgcgagaaggccgggtacaagcactcccggcgcagcctgacgaagaacgagctggacaaaaaggagtacaaggagaagctcgagctgctgcccaagtccagcctccacaaccccgtcgtggagaagattctgaaccagatgatcaacgtcatcaacgccgtgatcgacgagtacggcaagcccgacgagatccggatcgagctcgcgcgcgagctcaagatcggggccgccgagcgggagaacatgacccgctccatcaaccagggcaacgccgagaacaagcggatccgcgagatcctggagaaggagtttgcgctgagctacatctccaggaacgacatcatcaagtacaagctctacgaggagctcaagagcaacggcttcaagaccctgtactccgacacctacatctcgaaggataagctgttctcaaaggacttcgacatcgagcacatcattcccaaggcccgcctgtttgacgacagcctgtccaacaagacgatcgaggcccgggacgtgaacatcgccaagagcaacaagacagccttcgacttcatctccgagaagtacgaccagcaggggatcgaggcgtacaagaagaagctcgacatcctgctgcaggacggtagcatcagcaaggccaagtacaaccgcctcctgatgaaggaggccgacatcccctccgggttcatcgaccgggacctgcgcgacacccagtacatcgccaagaaggcctacgagatcttaagcgacctggtccgcaacgtgacccccacgaccggcgcggtgacctcccggctgcgcgaggactggcagctcgtcgacgtgatgaaggagttaaactttgagaagtaccagaagctgggcctcgtggaggtcatcgaggaccgggacgggcgcaagatcaagcgtatcaaggactggaccaagcgcaacgaccaccggcaccacgccatggacgccctgacgatcgccttcaccaagccgagctacatccagtacctcaacaacttaaacgcccgctcagacaagaacagctccatctacggcatcgagaacaaggagctgcaccgggaggacaacaagctgcgcttcaacgcgcccctccccatcaacgagttccgggccgaggcccgccggcacctcaagagcatcctggtgtccgtgaaggccaagaacaaggtcatgacccagaacgtgaacgtgatcaagaccaagcacggggtcatcaagaaggtgcagctgaccccgcgcggggagctgcacaacgcgacgttctacgggaccaagaagcggccgatcatcaagatggtgaaggtcggcgccgccctggacgaggtgaccatcaagaaggtgagcagcagcttcatccgcgaggccctcctggaccggctgcacgagtacaacggcgacgccaagaaagcgttcaccgggcgcaactccatcgacaagaaccccatctacatagacgaggagcacaagaagacggtccccgccctcgtgaagaccatcgagtgggagatgtaccaccccacccggaagatgatcagcccggacctgaagatcgacaaggtgatcgacaagggcatccgcgagatcctgcggacccgcctcgccaagttcaacggggacgcccagaaggccttctccaacctggacgagaatcccatctacaaggacgaggcgaagaagatcacgctgaagcgcgtcagcctcgagggcgtgtccagcgtgatccccctgcacaagctgaaggacatgggcgggaagccggtcgtgggcaaggacgggaagcccgtgtggggcgattacgtccagacctccaacaaccaccacatcgccttctacatggacgagaacgggaacctccaggacgacgtggtgaccttcttcaaggccgcccggcgcaagagccagggcgtccccgtgattgacaagaactacaaccacgacaaggggtggcacttcctgttcaccatgaagcagaacgagtacttcgtgttccccaacgaggccacgggcttcatcccgaccgaggtcgacctgatggatgaagcgaactacgacatgatcagccccaacctctaccgggtgcagaagatgtcgaagacaaagcagggcatcaccgataagcgcgactactggttccggcaccacctggagacggtgctgaacaacgacctcaaagtcaggaacagcatcttcaagcagatcaactccctgaagcccctggaggggatcgtgaaggtgcggatcaacgccatcggcaagatcgtcgccatcggggagtacgactga

SEQ ID NO: 7846 - RNA, 4143 nt, synthetic construct
  misc_feature 1..4143: note = Cas9 variant
  source 1..4143: mol_type = other RNA
atgaagcgcatcctggggcttgacctgggaaccaccagcatcggctgggccctggtgaacgaggccgagtccaacaacgaagcgagctccatcgtccggctcggggtgcgcgttaaccccttgacggtcgacgagaagtccaacttcgagaagggcaaggccatcaccaccaacgccgacagacagctgcgccacggggcgcgtatcaacctccaacgctacaagctgcgccgccaaaacctgcacgactgcttgcagaagcagggctggctgggcaccgaggccatgtacgaggaggggaaggcgagcacgttcgagacctataaacttcgggccaaggccgccgaggaggagatcagcctccacgagttcgcgcgcgtgctgttcatgctgaacaagaagaggggctacaagtccaaccgcaaggccaacaacaaggaggacggtcagctgttcgacggcatgaccatcgccaagaagttatacgaggaacacctgaccccggccgagtacagcctccagctgttaaataaggggaagaagttcacgcagggctactaccggagtgacctcaacgctgagctggagcgcatctgggacgaacagaagaagtactaccccgagatcctgacagacgagttcaagcagcagctcgagggcaagaccaagaccaacacgagcaagatcttcctggcgaagtacgggatctactccgccgacctgaagggactcgaccggaagctgcagcccctgaagtggcgcgtggaggccctcaagcagcaggtcgacaaggaggtgcttgccttcgtgatcagcgacctgaaggggcagatcgccaacactagcggcctcctaggcgcgatcagcgaccggtccaaggagctgtacttcaataagcaaaccgtcgggcagtacctctgggccagcctggaggagaacccccacatctccatcaagaacaagccgttctaccgccaggactatctggacgagttcgaaaagatctgggagacccaggccacgttccacaagcaactcacccccgagctgaagcaggagatcagagacatcatcatcttttaccagcgacccctcaagagcaagaagtccctaatcagcgtgtgcgagctggagcagcggaaggtgaaggccaccatagacggcaaggagaaggaaatcaccatcgggcccaaggtcgcccccaagagctcgcccgtgttccaggagttccgcatctggcagaacctgaacaacgtgctgctgatcgacaacgacacgaacgagaagcgccccctcgacgaagacgagcggtacctcctctacaaggagctgagcatcaaggcgaagctgtccaagaccgaggccctcaagatcctgaacaagaagggcaaacagtgggacctgaactacaaggaactcgagggcaaccggacccaggccatcctgttcgactgttataaccggataatcaccttaacgggccacgaggagtgcgacttcaagaagatcaaggccagcgagatccgccactacgtatccaccatcttcaagaacctggggtttagcaccgagatcctcgactttgacccctccctcgagaagcacgagctcgaaaaacagccgatgtaccagctgtggcacctcctctacagttacgagtccgacaacagccgcaccgggaacgagtccctactgcgcaagctcgagacgaccttcggcttccccgaagagtacgccaccgtgctgtgcgacgttgtcttcgaggaggactacgggaacttgagcgtgaaggcgatgcggaagatactaccctacctgcaggccggcaacgactactcccaggcctgcgcctatgcggggtataaccacagccggcactccctgaccaaggaggagctcgaccagaaagtgtacaaggagcggctggagctgctcccaaagaacagcctgcgcaacccggtcgtggagaagatcctgaaccagatgatcaacgtgatcaatgcgatcatcgacgagtacggcaagcccgatgagatccggatcgagatggcccgcgagctcaagagcagcgccgccgaccggaagaagacgacccacgctatcaaccagggcaacgacgagaatcagtgcatcagggagatcctggagaaggagtttgcactgtcctacattagccggaacgatatcatcaagtacaagctctacgaggagctgaagcctaacgggttcaagaccctctacagcgacacctacatccccaaggacaagctgttctccaaagacttcgacatcgaacacatcatcccgaaggccaggctgttcgacgacagctactccaacaagacgctggaggcccgggacattaacctcgccaagagcaacaagaccgcgttcgacttcgtcaaggagaagtacggcgagcagggggccgaggcctataagaaaaagctggacatgctgctcggcaacaacgtgatctccaaacccaagtacaacaaactgctgatgaccgaggccgatattcccagcgactttatcaaccgcgacctccggaacacccagtacatcgcccgcaaggcgtgcgagatcctgggggagctggtccgcaccgtgacgcccaccaccggcaagatcacgaaccggctccgcgaggactggcagctggtggacgtcatgaaggagctgaacttcgagaagtacgagaagctcggcctcactgagatcgtggaggaccgggacgggcgcaagatcaagagaattaaggactggaccaagcgcaacgaccaccggcaccacgccatggacgccctggccatcgcgttcaccaagccgtcctatatccagtacttaaacaacctgaacgccagaagcaacaagggcgactccatctacgccatcgagaacaaagagttacactacgaggaggggaagttgcgtttcaacgcccccatccccgtgaacgtcttccgcgccgaggcgaagcggcacctgagcgccatcttggtgtccatcaaggccaaaaacaaggtgatgacccagaacgtcaacaagatcaagacgaagcacggcatcatcaagaaaatccagctcaccccgcgcggcccgctgcacaacgaaaccatatacgggaccaagatgcggcccattatcaagaaggttaaggtgggcgccgccttagacgaggcgactattaacaaggtcagctcccccgccatccgcgaagtgctcctgaagcggcttaacgaatacagcgggaacgccaagaaggccttcaccggcaaaaataccctcgacaagaacccgatctacctgaacgccgaacgcaccaaaactgtgcccgcgtccgtcaagaccgtggagtgggagaactaccaccccatccggaagcccatcaccccggacctgaaggtggacaaggtaatcgacaaggggatcggcgagatcctcaaggcccgcctggaggagttcaacggcgacgccaagaaggcctttagtaacctggaggagaaccccatatatctcgaccagaccaagaagatcgcgctgaagcgggtgtccatcgagggtgtgctgagtacgattcctctccacaccctgaagaaccaggccggcaagcccatcatggggaaggacggcaagccggtcctggggaactacgtgcagaccagcaacaaccaccacatcgccttctactacgacgaggacgggaacctccaagacaacgccgtttccttcttcgaggccgcggagcgcaagagccagggcatctccgtcatcgataaggattacaaccgggacaaggggtggcgctttctgttcaccatgaagcagaacgagtacttcgtgttccccaacgaggccacgggcttcatcccaagcgaggtggacctgaccgacgaggccaactacgggatcatcagccctaacctctaccgtgtacagaagatgagccggatcgagaagggcaccagcgtgagccgcgactactggttccggcatcacctggagaccatcctgaatgacgactcccgcctcaagaacagcgccttcaagcggatcaactccctgaagccgctagaagggatcatcaaggttcgcatcaacagtatcggtaagatagtcgccgtgggcgagtacgactga

SEQ ID NO: 7847 - RNA, 4143 nt, synthetic construct; identical to SEQ ID NO: 2047
  misc_feature 1..4143: note = Cas9 variant
  source 1..4143: mol_type = other RNA

SEQ ID NO: 7848 - RNA, 4143 nt, synthetic construct
  misc_feature 1..4143: note = Cas9 variant
  source 1..4143: mol_type = other RNA
atgaatctacgacacgtaggcaactacaacatcgggctcgacatgggcaccgcgagcgtaggatgggccgcaatcgacgaacaaggagaactactgcacttcaagggtaaaccaacatggggctcgcgcctattcgacagtgccaacacagcagcaacagctcgtatgcccaggggccaacggcggcgatatatcagacggcgatggcgcctcgacttactacaaaaattcttctccgaagaaatggcggagaaggaccctgaatttttcattagactccgccaatcgagcctatggcccgaagaccgggagggaggtcacaccgcctaccactggcccctattcaatgactcagactttaacgaaaaagaatactacgaaaagttccccaccatctttcatctccgacaatggctaatggaaacagatgaaaaagcagatatacggctgatctatctcgccttccacaacatagtgaagcaccgcggcaacttcttacaagaaaacaacgactcgctaagtgctcagaacgccaacatgcgggagtccttagaatcgttctgtatagccctcgaagaatggtgcgacgagaaggaactcacctgttcctgcgacccacaaaagctggaacacctattcaaagaagtaaaatatagatcggacatacgggatggcttcgccgccttgctcggactggcctgttccggggagaacgaagttgatgtgaaagcaatggccaaagaaatgggcaaagcaatagtgggctacaaagctgacttctccaagatatttaccgagtgcgacaaagaagggtcgagctttcgcctatcggacgacgaaggaccggaagccttcctagacatatgccccgacgacgggatcgccctattcgaagcgatccaaatggtctacagctcattcatcttaaccggaatgctgacggaaaaaggcctaagcctcagcaaaatctcagcatacaaccaatacggacaagacctcgaatcactcaaagcccttgtgaaagaatatgtgcccaacgaatacagctcattcttccgcggaccgacctacagcggatcaaccgagtacgacccatcaaaggcccaaggctacacacgttacaacctcggaccgagcaagaaaggctccggcgccaaaccaatggcttacgaagatttcaagaagtcagtcgaacagctgttcgctaacacaaacgcaatcaacgacgaaagatacaaagagatgatgggaaggttcgcagaggaaaagtttctacgacggctacggacctccgacaatgggcgcatcccgtttcaactcaaccttgaagaaatgaccgccatcatcatcaaccagggaaagtactacccgtttctcctcgaacagcaagaaaaactagaaagccttgtgcgcttccgcataccctattacgtcggtccactgacgaggatcaacgcgcgcttagactccaagggtaacgcatgcttcgcatggtccaaaagaaaagacggaatggacagcgccagcattaagccgtggaactgggacgaagtaatcgacaaacacgctagtgcccaagcattcatagaaagaatgaccggaacatgcacatacctacgaggcgagccagtcctaccaagatgctcgctactctatgaggaatactgcgttcttaacgagctcaacggcgcccgctggacccaggacggggacaagttcattcgctttgactacaaagacaggtccgacataattgaagaactgttcaagaaacgcagggggcgcatacaatacgcagcagtcgccgactggatgaaacaggagcgaagccacgcgaatgtacacgtaagcggcggacaaggagagaacgcattcgagagcagactttcttcctatcatttcttttgcaacgatgtctttggggtggacgaactcccaggcagctacgtcgacatggtcgaggaaataatactctggagcacactattcgaggaccgttccattctccgagaagaaatccagagaaaatacggcgacgttctcaacgaggaacaaataaaaacgatatgtaagaaacgcttctccggatgggggagactgagccgtaagctcctatgcagcctaaaagcccaaactgacaacgggcccaaaagcatcatggacatactacaagagggcgatcagaataacggtagagtcggcagagcaatggtattccaggaaatcctacatgatgagcaactgggattcgaacagaaaatagaagaagaaaacacacaatccatgctagagggagaaaacctcctaatcgaagacctcccaggcagccccgcaataaggcgcagtatcaaccaagccgtgagaatcgtcgacgaaatcgtgggcatcgcgggccacgcacccgacaacatattcattgaggtcacacgggaagacgacacaaagaagaaagggaagcgcaccacaaccagatactccaacatacaaaaagcactagaggcgctgaaggaagaaggtgcagaagccctacgggaactgaaaacctacaagcacaatgagctagacaaacgattaagcctatacttcatgcaaaatggaaagtcattatacagtgggatcccgctagacatccgacgcctcagcgaataccagatagaccacatcatcccacagtcgtacataaaagatgactcatacgaaaacatggcattagtccttccaggagaaaaccagagcaaagcagacaatctattaatctcacaagacatacgcatcaaaatgaaggcgacatggacagccctgcacaaagcaggcctcatgggagacaagaagtacaacaacctaatgaactcttcgatatcagacgcgaaaatgaaggggtttataaataggcaattagttgaaacaagccaatctgtgaaactcacacagatgatgctctcccagaagtatccaggagccaaagtccgccccataaaagcatccatcagctcccagctacgtgatgcatgcgacctagtcaagtgccgagaagccaacgattaccaccacgcccacgacgcataccttgcctgccaagtcggacgattcgtgctcaagcggcacagttccatgttcgacaacccaatcgggatgacaaaggtaataagagacttcgtcaagagacaaggacaggagttcaaacgaaacggcaaactacccgcttacgcctcccgctccgggttcatagtgcaatccttcatgcgaagcggcttcgacgcggaaaccggcgaactcttaagggatgactggaacgccccattcgagatcgcccgcataaaaaggtgcctaaattatcgggactgttatatctcgcgcatgcccatggaagacagcggagccttctgggacgctacgatatattccccaaaagcgggaaagaaaggcgcactacccgtaaaacaagggctaccagtggaaaaatacgggagctacagcagggaacaatttgcgtactttttcgtctacaaggcctacaaccccaaaaagaaagcgtacagactagagttcgaagccgtcccagtacgcgtcgcctccgcagtcgaaacgcgagaaaacgccctggaagaatacgctaaaagcgtagccaaacaggcgggcctagagttcgtcgaagtagcacggcccaaagtatataaatatcaacttatcgaactaggagaagaccgtctctacataacaggaaaacgcgaagtaaggaacgcaagccaactagcgttctccctcgacgagatagacctactaaaaagactggccgaaggcgaggaaacatcctcagaagaaagagaacgactgttcgatgtactcatcgaaaaatatgccaggtacgccccacgcctagcgcggcaactaagcgtagacagtatgtcagccaccttcgaaacactcaacgcagaggagcaactgggcatactgctatccctcgtagaaatagccaacggaaaacgcaacatgatcgacctctcatcagccggagggtcgaagaacgcaggatgcatgaacccaacgttctcatctgaactcagctcgccaggcagcaacttcaccttcatagaccaatcggttaccggaatgttcgaaagaagacaacggctagaactgtga

SEQ ID NO: 7849 - RNA, 4146 nt, synthetic construct
  misc_feature 1..4146: note = Cas9 variant
  source 1..4146: mol_type = other RNA
atggtgaagaagaagtacgccatcggcatcgacatcgggaccaacagcgtaggctggtccatcgtgaccgacgactacaaggtgcccagcaagaagatgaaggtctttgggaacacggagaagcgctacatcaaaaagaacctgctaggcacgctgctgttcgacgaggggaacaccgccgagaaccggcgcctcaagcggaccgcgcgccggcgttacacccggcgccgaaaccgcatcctgtacctgcaggagatctttgccgaggagatcaacaaaatcgacgactccttcttccagcggctcgacgacagcttcctgatcgtcgaggacaagcagggctccaagcacccgatcttcggcaccctgcaggaggagaaggagtaccacaagcagttccccaccatctaccacctccgcaagcagctggccgactcctcccagaaggccgacatccggctgatctacctcgccctggcgcacatcatcaagtaccgcgggcacttcctcttcgagggcgaccttaagagcgagaacaaggacgtccagcacctgttcaacgacttcgtcgagatgttcgacaagaccgtggaggggtcctacctgagcgagaacctccccaacgtggccgacgtcctggtggagaaggtgtccaagagccggcgcctggagaacatcctccactacttccccaacgagaagaaaaacggcctgttcggtaacttcctggccttagccctgggcctgcagccaaatttcaagaccaacttcgagctcgcggaagacgccaagatccagttctccaaggagacctacgaggaggacctggaggagctgttaggcaagatcggagacgactacgccgacctgttcatcgccaccaagagcctgtacgacggcatcctcctggccggcatcctgtctaccacggacagtaccaccaaggcgcccctctccagctccatggtcaaccggtacgaggaacaccagaaggacctggctctgctcaaaaacttcatccaccagaacctgagcgacagctacaaggaggtgttcaacgacaagctgaaggacggctacgccggctacatcgaggggaagaccacgcaggagaacttctaccgtttcatcaagaaggccatcgagaagatcgagggctccaactacttcatcgacaagatagaccgggaggacttcctccgcaagcagcggaccttcgacaacgggtctatcccgcaccagatccacttgcaggagatgcacgccatcatccgccgccaggcggagttctatcccttcctggtggagaaccaggacaagatcgagaagatcctcaccttccggatcccgtactacgtcggccccctggcacgcgggaagtccgagttcgcctggctgaaccgcaagagcgacgagaagatccggccctggaacttcgacgagatggtggacaaggagacctccgccgagaacttcatcacgcggatgaccaactacgaccgctacctccccgaccagaaggtgctgcctaagcacagtctgctgtacgagaaattcgccgtctacaacgagctcaccaaggtgaagttcatcgcggagggcatgcgggactaccagttcctggacagtggccagaagaaggacatcgtgaagaccctcttcaagacgaagcgcaaggtcaccgccaaggacatcaaggcctacctcgagaacagcaacgggtacgccggcgtggagctgaaggggctggaggagcagttcaacgcctccctccccacctaccacgacctgctgaagatccttcgggacaaggcgttcatcgacgccgaggagaaccaggagatcctagaggacatcgtgctgaccctcacgctgttcgaggaccgcgagatgatccggaagcgcctggagaagtacaaggacatcctcaccgaggagcagcggaagaagctggagcgccggcactacaccggctgggggagactgagcgccaagctcatcaacggcatcctggacaaggtcacccggaagacgatactgggctacctcatcgacgacgggacctccaaccgcaacttcatgcagctgatcaatgacgacaccctgagcttcgtggacgagatccggctcgcccagggttccggggaggcggaggactaccgcgccgaggtccagaatctggccggcagccccgccatcaagaaggggatcctgcagtccctcaagatcgtggacgagctgattgaggtgatgggctacgagcccgagcacatcgtcgtggagatggcccgcgagaaccagttcaccaaccagggccggcgcaacagccagcaacggatcaaccgcctggagaacgcgctcaaggacttcgggtccaagatcctggaggagcagaagccgtacggcgtgagcaaggtcaacaacatccacctccaatccgaccggctgttcctgtactacctgcagaacgggaaggacatgtacacggacgaggagctcgacatcgaccacctgagcgagtacgacatcgaccacatcatcccccaggccttcatcaaggacgacagcctggataacaaggtactcaccaagtccgccaagaaccgcggcaaaagcgacgacgttccctccatggagatcgtccacaaccggaagaacttctggcgccagctgctcaagagcaagctgatctcccagcggaagttcgacaacctgaccaaggccgagcgcggtgggctgaccaacgaggacaaggcccggttcatccagcgccagctcgtggagacccggcaaatcacgaagcacgtggcgcgcatgctggacacccgtttcaacaccaagctggacgaggccggcaaccgtatccgggaccccaaggtaaatatcatcaccctcaagagcaacctggtgtcccagttccgcaaggactaccagctgtacaagatccgggagatcaacaactaccaccacgcccacgacgcctacatcaacgccgtggtcgcgacggccctcctgaagaagtacccgcagctggcccccgagttcgtttacggtgagtatcccacctacaacagctacaactcccgcaagagcgcaaccgagaaggtgctgttctactccaacatcatgaacttcttcaagcggatcgtcgtgcacagcaagaccggcgaggtgcgcatccgccccgtcatcgaggtgaataaagagacgggggagatcgtgtgggacaagaagtccgacttccggaccgtccgcaaggtgctgagctacccccaggtgaacgtcgtaaagaagaccgaggtgcagaaccatggcttggaccggggcaagcccaaggggttctacaacgcgaacctctccccgcgccccaaggagggcagcgtcgagaacctggtgccggccaagcagtctttcgacaccaagcggtacgggggctacgccgggatcagcaacagctacgctgtgctggtcaacggcatcatcgagaagggcaagaagaagtccaaggccgaagtgacggagttccaggggatcagcatcctcgcgcgcaaggacttcgacaaaaaccccaagcagtacctgctgaacctcggctacaaggacatcaagtccatcatcaagctgcccaagtacagcctgttcgagctcgagaacgggtcccggcgcatgctggccagcatcctgtccaccaacaacaagcggggcgagatccacaaggggaacgagatgtacctcccggacaagttcgtgacgctgctgtaccacgccatgcgcgtcaaccggaccctcgagcccggccacaagaagtatgtggagacgcaccgccacgtgttcgacgagctgttgatctacatcctcgagtacaacgagaagatcgtcggcgccaaggccaacgggaagcggatcgtcgaggcgtacagcgcccgcaaggacaccgacaacctggaggagctgtgcaactccttcatcaacctcctgaacctgaccgccctcgggagcgccgtggacttcgagttcctggggaccaagatcccccggtaccgcgactacacgccctccagcctgctcaaggccaccctgatccaccaatccgtcacgggcctgtacgagaccaggatcgacctcagcaagctcggaggcgactga

SEQ ID NO: 7850 - RNA, 4146 nt, synthetic construct
  misc_feature 1..4146: note = Cas9 variant
  source 1..4146: mol_type = other RNA
atgaactacgtaaaggaatatcacatcggtctcgacatcggcacctcctcaatcggttgggcagtgaccgactcacagttcaagctgatgcgaataaaaggcaagaccgccatcggagttcggttgttcgaagaagggaagacagccgcagaaaggcgcacatttcgcactacacgccgccgacttaaaaggagaaaatggcgcctccactacctggacgaaatcttcgcaccacatctccaagaggtcgacgagaattttctacgaaggttgaaacagagcaacatccacccggaagacccggccaaaaaccaagcattcatcggaaaactcctctttcccgatctcctcaagaaaaacgaacgcggataccctaccctcattaaaatgcgcgacgagctacccgtagaacagcgggcccactacccggttaccaacatatacaaactgcgtgaagcgatgatcaacgaggacaggcaatttgacctccgagaagtctacctggctgtccaccacatcgtcaaataccgaggccacttcttaaacaacgcatccgtcgataaattcaaagtcggccgaatcgactttgacaagtcgttcaacgtactcaatgaagcctacgaagaactgcaaaatggagaaggatcgttcaccatcgaacccagcaaagtcgagaaaataggacagctcctcctcgacaccaagatgagaaaactcgaccgccaaaaggccgttgcgaaattcttagaagtcaaggtggccgacaaagaagaaaccaaaaggaacaaacaaatagcaactgccatctcaaaactcgtgctcgggtacaaagccgacttcgcgacggtcgcaatggccaacggcaacgagtggaaaatagacctcagctcagagacgtcagaagacgaaatagaaaagttccgagaggaactcagcgacgcacagaatgacatcctcacagagataacgtcactgttcagtcaaatcatgttgaacgaaatcgtacctaatggaatgagcataagcgagtcaatgatggacaggtactggacccacgaacgacaattggcggaggtcaaagagtacctcgccacccaacccgccagcgcacggaaggagttcgaccaagtctacaacaaatacataggtcaagccccaaaggaaaagggcttcgacctagaaaaaggactaaagaaaatactctccaagaaagaaaactggaaagaaatcgacgaactcctaaaagccggcgacttcctcccaaaacagcgcaccagcgcgaacgtcgtcatcccacaccagatgcaccagcaagaactcgaccgcataattgaaaaacaagccaaatactatccctggctcgcaacagaaaatcctgcgactggagaacgggatcgtcaccaggctaaatacgaactcgaccagctagtgagtttccgaatcccgtactacgttggacccctagtaacacccgaagtccaaaaagcgaccagtggggcaaagttcgcctgggccaaaagaaaagaagacggcgaaatcaccccgtggaacttatgggacaaaatagaccgagcagaatcggcggaagcctttatcaaacgtatgacagtcaaagacacgtacctattaaacgaagacgttctacctgcgaacagcctactctaccagaaatacaacgtcctgaacgaactcaacaacgtacgagtcaacgggcgccgcctctcagtaggaatcaaacaagacatctactcagaacttttcaaaaagaagaaaacagtaaaagcgagcgacgtagcctccctcgtgatggcgaaaacacgaggagtcaacaaaccgagcgtggaaggcttatccgacccgaaaaagttcaactccaacctcgcaacctatctcgacctaaagtccatagtaggcgacaaagtggatgacaactgctaccaaacagacctagagaacataatcgaatggaggtccgtattcgaagacggcgaaatattcgccgacaaactaaccgaggttgaatggctcaccgacgaacaacgctccgccttagtcaagaagagatacaaagggtgggggagactcagcaagaaattactaactggcatcgtagacgagaacggccagcgcataatagatttaatgtggaacaccgaccaaaacttcatgcaaattgttaaccagccagtattcaaagagcaaatagaccaactaaaccaaaacgccatcaccaacgacggcatgaccctacgagagagggtcgaatcggtactcgacgacgcatacacatccccacaaaacaagaaagcaatctggcaagtagtccgtgtcgtagaggatatcgtcaaagcggtcgggaacgcaccaaaatccatttcaatcgagttcgcaaggaacgaaggtaacaaaggcgaaataacgagatctcgacggacgcaactccagaaactgttcgaggaccaagcacacgagctcgttaaagatacaagcctcaccgaggaattggaaaaagcgcttgacctatccgacaggtactacttatacttcacacagggcggaaaagacatgtatacgggcgacccgatcaacttcgatgagatcagcacaaaatacgacatagaccacatcctaccccagtccttcgttaaagacgactccctcgataacagagtcctagtaagccgggccgaaaataacaaaaagtccgacagggtaccggcaaaactctacgccgccaaaatgaaaccatactggaaccaactcctcaaacagggcctaattacacaacgaaaattcgagaatcttaccatggacgtcgaccagaacataaagtacagaagcctaggcttcgtcaaacgccagctagtagagacccgacaagtgatcaaactaacggccaacatcctcggctccatgtaccaagaagcagggacagacatcatagaaacacgcgcaggactaacgaaacaactccgggaggagttcgacctgcccaaagtacgcgaagtaaacgactaccaccacgccgtagacgcctacctcacgaccttcgccggtcaatacctcaatcggcgctacccaaaactccgttcattcttcgtttacggcgaatacatgaagtttaaacgcggcagtgaccttaagctgcgcaacttcaacttcttccacgagctcatggaaggagacaagtcacaaggaaaggtggtggaccaacaaacgggggaactgataaccacacgcgatgaagtcgcaaaatcattcgaccggttactaaatatgaaatacatgctagtctccaaggaagtccacgaccggtccgaccaactatacggcgcaaccatagtgaccgcgaaggagagcgggaaactaacatcacccatcgaaatcaagaaaaaccgccccgtagacctctacggagcatacaccaacggaacatccgccttcatgacgatcataaaattcaccggcaacaagccgaaatacaaggtaatcggcgtccccaccacctccgccgtaggcctaaaacgggtaggcaagccaggctcagaaagctacaaccaagagctacaccgcatcataaaatccaaccccaaagtaaagaaagacttcgaaatcgtggtcccccacgtgtcctacagccaactcattgtggacggagactgcaagttcacgctagcatccgacacataccaacacccggcaacacagctcgtcctatccaaagaaagcatggagataatagccgacgacttcaagttcgtaaaagagaatccagccacagccgacgagcaactcgtgcgggtcttcgacgaaatcgtaaaccagatgaaccactacttcacgatcttcgatcaacgatccaaccgacaaaaagtcacgaaagctcgcgataagttcgtatcactgcccacggaatcagagtacgagggtgcaaagaaaacgcaagtcggcaaaacggaagtaatcacgaacctactaatgggcctgcacgccaacgcagcccaaggcgacctcaaagtcctcggactatccacgttcggattcttccaatcatcgggaggactcaatctatcggaagatgcaatgatagtataccagtccccaaccggcctattcgaaaggcgcatctgcctcaaagacatctga

SEQ ID NO: 7851 - RNA, 4146 nt, synthetic construct
  misc_feature 1..4146: note = Cas9 variant
  source 1..4146: mol_type = other RNA
atgaagcagatcctgaagaaggtgcaggggtacaacatagggctcgacatcggtaccaacagcgtcggctgggtggtgacagacgagaacgccaacctgctgcaattccgcaagaagaatatgtggggcgcacgcctcttcgagaaaggggacacggcgcagggccggcggctttcgcgcagtacccgccgccggtacgaccgtcggcgccagcggatccactacctgcaggagatgctcgccaccatggtcctgccaatcgacgagtcctttttcatccgcctgaacgaggctttcctctggaaggaggacaagagcgtgcagcgggactacatcctgttcgctgacaagcagttcaccgaccgcgacttctacaagcagttcaaaacgatctatcacctgaggaagttcctcctggacaccaaggagaaggcggacccgcgcttcatttacctggcgctacaccacatgatcaagtatcggggcaacttcctgtaccaggggcaatccttcgacgtggtcgagaacgtgcaagagagcttccgcgtgctgctcgaggagatgtacgagcagttaggcaaagagtgggagtacggggagcacttcgatgacatccagcggatcctcgagaataccaccatcggcaagaagtccaagcaggagcagatcgccgccatcctcactgagcagtacgggaacaagaagctggccaacgaggtcacccgcgcgtgcttgggctacagctttgacctcaccgtggttatggagaacgagaacctgctggacgagtccggcaagaaaatcaagatcagcttcagtgacagcaaatacgaggagcaggagctcgaactgcagaatcggctagaggagaagtttgctgtcatcgaggccctcaaacggatctacaactggttagtgctgaaggataccctccgcggcaagaaatacatctcagaggccatggttaacaagtacgaggcccaccacgaagacctggtcaagttaaagcgcctattcagaacgtacctgagcaccgaggagtactcttgcttcttccgaaaggagaagcagaaggacaagtacataagcaattacgtgaactatcgcaagggagcggagcggtgctccaaggaaaagctgtacaaggccatccacgagctgttcgacacagtggccaaggatgacgttgtgtaccaagagatcgtggagaaaatggaccagggggagttcctgaccaagcagaacgaggtcagcaacgcctacatcccctaccaatgcaacgaggtcgagatgaagcgcatactgaagcagcagggcgagttctaccccgagctcaaggagaacgcagataagatcctgcagttactcctgttcaggatcccctactacgtgggccccctggttgacgaaaagcagagtaaattcgcgtggatgaagcgccggacggggatggaacaggtcaagatctacccttggaacttcgagcaagtcgtcgacatcgaccagacggccgaagcctttatcacccgcatgaccaactactgcacgtacctccccgaggagaaggtgctgcccaagcagagcctcttgtacagcgagtacgagctcctgcaggagctgaacaagatcaagatcaacggcaagttctcgctcgagacccgtaacaagataatcgaacagctgttcaagaagcagaagaaagtgaccgagaaacagctgaagaagtggctggtgcgcgagcagtattgcacaacgaaggtaaccgagaagatggtcaagctggatgaaaacgcctactacatcaccgggtttcagaaggagaacgagttcgccagctccctgactagctacatcgatttcacgaagatcctcggcgagatcaccgaacggaaccgcaagatgatcgaggagatcatctactggctgaccgtgtttgaggagaagtccatcgtgaagcggaagatacagaaaaagtacggaaacgagatcaacgacaagcagctggcccagatcttgaagctgaactacagcggctggggaaggttctctgagaagttcctgaacggcatcaagggcttcgaccggcaggggcagaaaaagaccattatggagctcctgcgcgaggacagccggctgcttaacatcatgcagataatcaacaacgaggagatgggcttctgtaagatcatcgaggccaaccagaagaagctatacgggaacgaaaacctgttagacgtcgtgcaggaactgcacggcagtccggccatcaaacgcggcatctggcagagcctgaagatcgtggaagagatcatctccatcatgggcggggtccctcagaacatcttcatcgagttcgcacgcgaggacgacgaccgggtgcgcacgaacagccgggtaaagcagatcgagcggttgtacaagaagttcaaggaggaggtcaacgacttcaacgagcacgcggcgaacgagctgaaggagaagcggtaccagaaccgcatcgacgaggagaaggtgtttctgtacttcatgcagaacgggaagtccctctatagcggcgtgacactggacatcgaccggctgaacgagtacgaggtcgaccacattattccccgcaccctcgtgaaggatgactcactggagaacaaggccctcgtgctcaagggggagaaccaacggaaaggcgagggcctgatcccgcacgaatggcagaaccgacagaaggaggtctggaagaagttgctctcctgcgggctgatgggcaagaagaagtacgccaacctgtgcaaggagtccttcgggaacgagaaggagcaaaagcactttatcgcacggcagatcgtggagactcggcagatcatcaagcaggtcgcgaacattttagcccagtactaccagggcgtgaacgttgccgccgtcaaggctagcctgggctccgagctgcgggagaactacacgatcgagaaaaaggacgacaacggctttttcatggagaacaagagctataccatgctcaagagcagaaagatcaacgacttccatcacgcgcaggacgcctacctggcctgcgccgtcggtctgtacatcaaggccgcgttcccgaagtacgagaaggagatcgactacgagggctaccggaagtactaccagaagaagaaccaacagaaggacggcgtgcgcaacgagaagcggcagttcttctcctacgtgatgagccgcttctccgagcaaatcgtcgacaaggagaccggggagatcttgtgggacggcacccagaagctggcctacatcaagaaaatcttcggctatcgggactgcctgatcaccaagaagctggaggagaacacgggcgagttctacaagcagaccatcaacgccaagccagagaagggcaaggaaaacaacaccaagctgctgcctataaagaaggggcttagcgtggagaagtacggcgggtaccagggcggcgaggctgcctactcctgcctggtgcgctaccagcaagggcgaaagacaaaactgtcattggagaaaatctccgtcattatcgcgaagaagatcgccgaaaaagaagtgagcttggaccgctacctgaaggagaagttgggcgtggaagagatcgtcatcctacgcaagaaggtgatgaagaaccagctgatcgaggactccgatgggaatcggttctacctaacggcggccaccgaggtggtgaatgcgaagcagttcatcctggacggcaagcaccaacacttgcttcgcaccatagccataatggagaaaggagagtactatggctacaggctggacgagctggagaacagcatggacgagttatatgcctactaccgcatgaagatccaacaacagtaccccgcctatgagagcatcgtgaagaagatcgtggagagccacgtttacgaatcacttcacgtcgaggagaagattaaggccgtgcaagagaagggcaagttcttgatccagttactgcggctgaccgaagcgaacgccgagtgcattgatctcaagacgatcagcgacgggcgcttggccgaccggatcggccgcaagaaccactacaccataaaagaggggatcaagttcatagatcagtccatcaccggcctgtatgagcggtacatgaccgtctga

SEQ ID NO: 7852 - RNA, 4146 nt, synthetic construct
  misc_feature 1..4146: note = Cas9 variant
  source 1..4146: mol_type = other RNA
atggactacgtgaaggagtaccacatcggcctggacatcgggacgagttccatcggctgggccgtcaccgacagccagttcaagctcatgcgcatcaaggggaaaacagccatcggcgtgcgactgttcgaggaggggaagaccgcggccgagcgccggaccttccgcaccacgcggcgccggctgaagcgacgtaagtggcgcctccactacctggacaaaatctttgcaccccacctccaggaggtggacgaaaacttcctccgtcgcctgaaacagtccaacatccaccccgaggaccccgcgaagaaccaggcgttcatcggtaagctcctctttcccgacctgctgaagaagaacgaacggggctaccccaccctcatcaagatgcgcgacgagctgccggtcgagcagcgggcccactatcccgtgaccaacatctacaagctgcgcgaggccatgattaatgaggacagacagttcgacctccgcgaggtgtacctggccgtccaccacatcgttaagtaccgggggcattttctgaacaacgccagcgtggacaaattcaaggtcggccgtattgacttcgacaagtccttcaacgtgctcaacgaggcgtacgaggaactgcagaacggggagggcagcttcaccatcgagccatccaaggtagaaaagatcggacagctgctcttggacactaagatgcggaagctggaccgccagaaggccgtcgccaagctcctggaggtgaaggtggccgacaaggaggagaccaagcgcaacaagcagatcgccaccgcgatgagcaagctggtacttggctacaaggccgacttcgccaccgttgccatggccaatgggaacgagtggaagatcgacttgagcagcgagacctccgaggacgagatcgagaagttccgggaggagctgtctgacgcgcagaacgacatcctcaccgagatcacctccctgttcagccagatcatgctcaacgccatcgtgccgaacggaatgtccatcagcgagtccatgatggaccgctattggactcacgaacggcagctcgcggaggtcaaggagtacctggcgacgcagccggccagcgcgcgcaaggagttcgatcaagtgtacaacaagtacatcggacaggtacccaaggaaaaggggttcgacctggagaagggcctcaagaagatactgtccaagaaggagaactggaaggagatcgacgagctgctcaaggccggcgatttcctgcccaagcagcggaccagcgcgaacggtgtcatcccccaccagatgcaccagcaggagctggaccgcatcatcgaaaaacaagccaagtactacccgtggctcgccaccgagaaccccgcgaccggcgagcgggacagacaccaggccaagtacgagctggaccagctggtgagcttccggatcccctactatgtgggtcccttagtcacgccggaggtacagaaggccacatccggcgccaagttcgcgtgggctaagcggaaggaggatggggagatcaccccctggaacctgtgggacaaaatcgaccgggccgagtctgccgaggccttcatcaagcgcatgacagtgaaggacacgtacctgctcaacgaagacgtgctgcccgcgaactccctgctgtaccagaaatacaatgtgctcaacgagctgaataatgtccgggtgaacggccgccggctgagcgtgggcatcaagcaggatatctacacggagctatttaagaagaagaagaccgtcaaggccggggacgtggcctccctggttatggccaaaacacgcggcgtgaataagcccagcgtagaggggctgtccgacccaaagaagttcaacagcaacctcgccacgtacctggacctgaagtccatcatgggcgacaaagtggacgacaatcggtaccagatggacctcgagaatatcatcgagtggcgcagtgtcttcgaggacggggagatcttcgcggacaagctcacagaggtcgagtggctgaccgacgagcagcggtccgccctcgtgaagaagcgctacaagggttggggcagactgagcaagaagctgctcaccgggattgtcgacgaaaatggccagcgcatcatcgatctgatgtggaacacggaccagaacttcatgcagatcgtgaatcagcccgtgttcaaggagcagatcgaccagttaaaccagaaggcaatcaccaatgacgggatgaccctccgcgagcgagtcgagtccgtgctggacgacgcctacaccagcccccagaacaagaaggccatctggcaggtcgtgagagtggttgaagatatcgtcaaggcggtgggtaacgcccccaagtccatcagcatcgagttcgcccggaatgaagggaacaagggcgagatcacacgctcccggcgcacccagctgcagaagctgttcgaagaccaggcccacgagttagtgaaagacaccagtttaaccgaggagctcgagaaagcgccagacctgtccgaccggtattatttctacttcacccagggcgggaaagacatgtacacgggcgaccccatcaacttcgacgagatcagcaccaagtacgacatcgaccacatcctgcctcagagcttcgtcaaagacgactccctcgacaaccgcgtgttggtgagccgggctgaaaacaacaagaagtccgacagggtccccgccaagctgtacgcggctaagatgaagccgtactggaaccagctcctgaagcagggactgatcacccagcggaagttcgagaacctcaccatggacgtcgaccagaacatcaagtaccgcagtctgggcttcgtgaagcggcagttggtggagacaaggcaggtaatcaagctcaccgcgaacatcctgggctcaatgtaccaggaagccgggactgacatcatcgagacccgggccggcctgacgaagcagttgcgcgaggagtttgacctgcctaaggtgcgggaggtcaacgactaccaccacgccgtggacgcctatctaaccacctttgcagggcagtacctcaaccgccggtaccccaagctccgcagctttttcgtgtacggcgagtacatgaagttcaagcacggtagcgacctgaagctcaggaacttcaatttcttccatgagttaatggagggcgacaagagccagggcaaggtcgtggaccagcagaccggcgagctgatcacgacccgggacgaggtggcaaaatctttcgaccgcctcctgaacatgaagtacatgctggtctccaaggaggtgcacgaccggtccgaccagctatacggtgccaccattgtgaccgcaaaggagagcgggaagctgacgtccccgatcgagatcaagaagaaccgtccagtcgacctgtacggcgcctacaccaatgggaccagcgcgttcatgaccatcatcaaattcacgggcaacaagcccaagtacaaggtgatcggcgtgcccaccacctccgccgtcgggttaaagcgggttgggaaaccggggagcgagtcatacaatcaggagttacaccgcatcatcaagagcaaccccaaggtgaaaaaggacttcgagatagtcgttccccacgtctcgtactcccagcttatcgtggatggagattgcaagttcaccctcgccagcgacacataccagcaccccgcaacccagctggttctgtccaaagagagcatggaaatcatcgcagacgattttaaattcgtcaaggagaaccccgccaccgccgacgagcagcttgtgcgggttttcgacgagatcgtcaaccagatgaatcactacttcaccatcttcgaccagagatccaaccggcagaaggtgacgaaggcccgcgacaagttcgtgagcctgcccaccgagtccgagtacgagggtgccaagaagacacaggtcggcaagaccgaggtgatcacgaatctcctcatgggcttgcacgcgaacgcggcccagggggatctgaaagtgctcggcctgagcaccttcggcttctttcagtcaagcggcgggctgaacctctccgaagatgccatgatcgtctaccagagccccaccggcctgttcgagcggcgcatttgcctgaaggacatatga

SEQ ID NO: 7853 - RNA, 4146 nt, synthetic construct
  misc_feature 1..4146: note = Cas9 variant
  source 1..4146: mol_type = other RNA
atgaagaagtcctacgccatcggcatcgacattgggaccaacagcgtgggccactgcgtcatgtacaccgagaactacaaggtgcccagcaagaagatgaaggtgttcggcaacacggagaagcgctacatcaagaagaacctgctcggcaccctgctgttcgacgaggggaacaccgccgagaaccggcgcttaaaacggaccgcgcgccggcgctacacgcggcgccggaaccgtatcctgtacctgcaggagatcttcgccgaggagatcaacaagatcgacgactccttcttccagcggctcgacgacagcttcctgatcgtcgaggacaagcagggctccaagcacccgatcttcggcaccctgcaggaggagaaggagtaccacaagcagttccccaccatctaccacttacgtaaacagctggccgatagctcccagaaggccgacatccggctgatttacctcgccctggcgcacatcatcaagtaccgcgggcacttcctgttcgagggggacctcaaaagcgagaacaaggacgtgcagcacctgttcaacgacttcgtggagatgttcgacaagaccgtcgagggttcctacttaagcgagaacctccccaacgtggccgacgtgctggtcgagaaggtgtccaagagccggcgcctggagaacatcctccactacttccccaacgagaagaagaacggcctgttcgggaacttcctggcactggccctgggcctgcagccgaacttcaagactaacttcgagctcgcggaggacgccaaaatccagttctccaaggagacctacgaggaggacctggaggagctgctcggtaagattggggacgactacgccgacctgttcatcgccaccaagagcctgtacgacggcatcctcctggccgggatcctgtccaccacggacagcaccaccaaggcgcccctctccagctccatggtgaaccggtacgaggagcaccagaaggacctggccctgctaaaggacttcatccgccagaacctgagcgatagctacaaggagttctttaacgacaccctgaaggacggctacgccggctacatcgaggggaagacgacccaggagaacttttaccggttcatcaagaaggccatcgagaagatcgaaggctccaactacttcatcgacaagatcgaccgcgaggacttcctccggaagcaacgcaccttcgacaacgggagcatcccccaccagatccacctccaggagatgcacgccatcatccgccggcaggccgagttctaccccttcctggtcgagaaccaggacaagatcgagaagatcctcaccttccgcatcccgtactacgtgggccccctggcccggggcaagagcgagttcgcctggctgaagcgcaagagcgacgagaagatccggccctggaacttcgacgagatggtggacaaggagacctccgccgagaacttcatcacccgcatgaccaactacgaccagtacctccccgaccagaaggtcctgccgaagcacagcctgctgtacgagaagttcgccgtgtacaacgagctcaccaaggtgcggtacgtcacggagcaggggaagtccttcttcttcgacgcgaacatgaagcaggaaatcttcgacggcgtgttcaaggtgtaccgcaaggtcaccaaggagaagctgatggacttcctggggaaggagttcgacgagttccggatcgtggacctcatgggcttggacaaggacaacaagagcttcaacgcctccctggggacctaccacgacctcaagaagatcgtgagcaaggacctgctggacaaccccgagaacgaggacatcctcgagaacgtcgtgctgaccctgacgctgttcgaggaccgcgagatgatccggaagcgcctggagaagtacaaggacgtcctgaccgaggagcagcggaagaagctcgagcgccggcactacaccggctggggccgcttgtccgccaaactgatcaacggcatccggaacaagaccacgcgcaagaccatcctcgactacctgatcgacgacggcaccagcaaccggaacttcatgcagctgatccacgacgataccctgagcttcgtggacgagatccgcctggcccaggggagcggcgaggccgaggactaccgcacggaggtgcagaacctggcggggtcccccgccatcaagaagggcatcctccagagcttgaagatcgtggacgaactgatcggcgtgatgggctacaaccccgagcacgtggtcgtggagatggcccgggagaaccagttcaccaaccagggccgccggtccagccagcagcgctacaagaagatcgagaacgccatcaagaacctcgactccaacctgaacagcaagatcctgaaggagtacccgaccaacaaccaggcgctccagaacgaccggctgttcctgtactacctccagaacgggaaggacatgtacaccgacgaggagttagacatcgaccagctgagccagtacgacatagaccatatcatcccgcaggccttcatcaaggacgactccctcgacaacaaggtgctgaccaaaagcgccaagaatcgcggcaagtccgacgacgtccccagcctggagatcgtgcacaagaagaagaacttctggaagcagctcctggactcccagctgatcagccagcggaagttcgacaacctcacgaaggccgagcgcgggggcctgaccaacgaggacaaggcccggttcatccagcgccagctggtggagacccggcagataaccaagcacgtcgcgcgcatcctcgacacgcggttcaacaccaagctggacgacgccggcaaccgcatccgggatcccaaggtgaacatcatcaccttaaagtccagcctcgtgtcccagttccgcaaggactaccagctgtacaaggtccgggagatcaacaactaccaccacgcccacgacgcctatctgaacgccgtggtggccaccgccctcctcaagaagtacccgcagctggcccccgagttcgtctacggggactaccccaagtacaatagctacaagagcaggaaaagcgccacggagcgggtgctgttctacagtaacatcatgaacttcttcaagcgcgtggtcaagagctccaagaccggaaccgtgaagatacggcccatcatcgaggtgaacaaggagaccggggagatcgtctgggacaagaagtccgacttccgcacggtgcgtaaggtgctgagctacccgcaggtcaacgtggtgaagaaaacggaggtccagaaccacggcctggaccgggggaagcccaagggcttctacaacgccaacctcagcccccgccccaaggaaggtagcgtggagaacctggtgccggcgaagcagtccttcgacaccaagcggtacgggggctacgcagggatcagcaactcctacgccgtcctggtgaacggcatcatcgagaaggggaagaagaagtccaaggccgaggtgaccgagttccagggcatcagcatcctcgcgcgcaaagacttcgagaagaaccccaaacagtacctgctgaacctcggctacaaggacatcaagagcatcataaagctgcccaagtactccctgttcgagctcgagaacgggagccgacgcatgctggcctccatcctgagcacgaacaacaagcggggcgagatccacaaggggaacgagatgtacttgccggacaagttcgtcaccctgctgtaccacgccatgcgcgtgaaccggactctcgaacccggccacaagaagtacgtggagacccaccgccacgtcttcgacgagctgctgacgtacatcctcgagtataacgagaaaatcgtgggggccaaggccaacggcaagcgaatcgtggaggcgtactccgcccgcaaggacaccgacaacctggaggagctgtgcaatagcttcatcaacctcctgaacctgaccgccctcggaagcgccgtcgacttcgagttcctggggaccaagatcccccggtaccgcgactacacgcccagctccctgctcaaagccaccctaatccaccaaagcgtgaccggcctgtacgagacccggatcgatctctccaagctcgggggcgactga

SEQ ID NO: 7854 - RNA, 4146 nt, synthetic construct
  misc_feature 1..4146: note = Cas9 variant
  source 1..4146: mol_type = other RNA
atgaagaagatcatcgggttagatctcggcacgacatccattggctgggcgtatgtccacgaggcagaaagtgcccaagagcgctcagaaatcgtcagactaggagctcgagtcgtgcccctgacaaccgacgaacaggatgagttcaagaaaggcaaaagcataacgacgaacgcagccagattatcaaagcgctccctccgaagaaacgcggacaggttccagcttagacgcgatgaactcgcaggggtgatgaaagaagccgggtggatagacgaaacaacagtcctcgccgaacagggacccagaagcacattcgaaacactccgcttgcgggcaaaagcagcaagcgaagaggtgacactcgccgagttcgccagaatactccttcagatcaaccgcaaaagggggtacaaatccaatcgcaaaacagacggcgacgaagaaggagcactgattgacggtatggacgtaagcaagcaactgaacgcaagcggccaaacacccggcgaatgggtgttagccagaatgcaggagggaaacgcagtgatcccagccttttactgcagcgacttaagcgaggagttggacagaatctggaggaaacaacaagccagtcaccaagcatggatgaccgaggaactccacacagtactacgacacgcggacggaaggagtgccatacgcctgatggacaaagcaggagtagtcccagacagcgtcaacgtgaaagaacgaagaagagttatgtacgaatggcgcgcggccgcagtccgggactgtctccccgccgggcgagttgcagccgccctaatgcaagtgtcaaaggagatcggacgggctgactcatacttgggtcgaatcggggacaggagcaaggaactctacttccaccgacagacagtcggccagtacctctggaggctaatatgcgacaaccccaaccagtcactgaaaaacctagtcttctaccgacaagactatcaacacgagttcgaaaccctatggtcgatccagacaaagtaccatgtcgaactcactgaagacctcagaaaacgagtcggccgaataatattcttccagcggcccctcaaatccaagaagggcctggtcaaccggtgcgagctagtacactactcagtctgcgaaaacagcggggacgacttaaccgaaaaagttgacgtagggccaaaagtatgcccgaaatcttcacccctcttccaggagtttaaagtctggcaagtactcaataatgtagaagttatccacccgtccacacaggaggcacgcaggctcgagatggaagagaaagaactactcgcgagtgagcttttgttcagggaccgcatgaagaaaatcgacgtcctaaaactcctcttcagcaactggcgagacctagacctcaactataaggaacttgaagggaacagaactatggccgcattctaccgtgtatacgaacaagtgatcgcgcagaccggacatggggactacgatttcgccaaaatgagagctgcgaaggtcaaggaactagccgaaggagtattcgccggcctcggcttcgaagtcggactcctcacgttcgacgccgaactggacagtccagcatacgaacaacagccatgctaccgactatggcacctattatatagctacgaaggtgataagtccgcaaccggaaataaatgcctattgaagaaactgtgcagactgacaggaatgaacgcagagctcgtgggcctattcatgcagattagattcagcggggactacggatcactaagcacgaaagccatgaggcggatactgccttacctcaaagcgggcaacacctatgacgtcgcctgcgagtacgcaggcttcagacacagtgcccggagcctaacccgcgaggaactggctcagaaagagtacaaagattacctcgacctattaccgcggaactcactacgcaaccccgtagtcgaaaagatactaaaccaaatgatacacgtagtaaacggcctatcatccacgtacggcaaaccagacgaaataagagtagaaatggcaagggaactcaagaaaagcgcacgcgagcgggaagaaatgacaagcgcaatatcaaagaccaccaaagaaaatgcagaaatcactgcaatcctgcaaagagacttcggactaagatacgtaagcagaaacgacatattacgctataaactatactgcgaactaagaataaaaggcaacggatgcagaacgctgtatagcaacacgtatatcaatcccaacgaacttttcagcagagagttcgacatagaacacatcatcccccagtcccgtctattcgacgacagcttctctaacaagaccctcgagtcacgaaccgcaaacctggagaaaggagacagaaccgcgtgggactacgtgaacgagaaatacggagcggaacgagccgacgaataccgtgcccaagtggaggctttgtaccgggacggcacgatatcaaaagcaaagcgcgacaagctcctaatgccaggcgacaaaatccccgaagacttcatcgatagagacatcagaaacacacaatatatagcaaagaaagccctcgaaatcttcgaagatttcgtcccgagcgtggtagcaacgtcgggcaacgttacagcacgcctcagagaagactggggacttgtggacgtaatgaaagaacttaactggagcaaatacgaatctcagggaatggtgcacatagaatacgaccgagacggaagaccaatccgccgaatagtagactggaccaaacgcaacgaccaccgtcaccatgcaatggacgccctggcagtggcattcactaaacggtcctacatacaatacctaaaccatctaaacgcccggaaggaggcgacaagcgtagcgtacgccatacaacacaaagagatggaactggatgggagtaatagatggcgcttcaaatgcccctttggcgaccgcagcgctttcagacgggaggccaaagcacaactagagcggattctagtatcgatcaaatccaagaacaaagtcctaacccccagtgtcaatcgaacaaagaaacgaggaggtttcaataagaaggtagagtggacccccagaggggcactgcacaacgagaccgtatacggcaggatccggcgctacgacgtaaaagagctacgcgtgggaagctcattcactgcagaggtgatcggaaaagtggccgacagcagataccgggctgctctcatgcacagactcgctgagttcgggggcgaccccaaaaaggcctttacgggtaaaaattcattagagaaaaacccgctctatacagatgaagcacacacagcttgcgtccccagctcggtaaaggtagtcagcttcgtagaaatcgggacgatccgaaagggagtagaccccaacctcaacgttgacaaagtcgtggacacccacatcaagaacatcctgctagcacgtctgtcggcatacgggggcgacgcaaagaaggcattcagtaacctggatgccgacccgatctggctaaacaaggaaaaagggatcgcgataaaaagagtcacgatctcggacgactccgaggtccggccaatacacgtcaaacgcgacatgagaggcaggcttgtatgtgacgaacacggacgaccggtcccatcggactacgtacagctcagaaacaatcaccacgtcgccatattcagggacgccaatggggagctcaaagagcgagtcgtcacattcttcgaagcggtcgaacgggtcagacaactgcgctccgaaggccgggcggtcgaagtcatcgacaagaactacaagtgcgaagaagggtggaccttcctcttctccatgaaaatcaatgaatacttcgtctttccggacgccgcttcaggattcgaccccagagaaatcgacctaacagatccagcaaactacgcactgataagcccccacttatttcgagtacagaaactttcatcaaaggactactacttccggcaccacctagagaccacggtaaacgacgtaaagcaactacgcgacataacatggaagcgcatcagctcgctccaagatcttgccggaacggtaaaagtccgcgtaaaccacatagggcaaatcgtcgcggtaggagaatattga

SEQ ID NO: 7855 - RNA, 4146 nt, synthetic construct
  misc_feature 1..4146: note = Cas9 variant
  source 1..4146: mol_type = other RNA
atggtgaagaagaagtacgccatcggcatcgacatcgggaccaacagcgtcggctggtccatcgtgaccgacgactacaaggtgcccagcaagaagatgaaggtcttcgggaacacggagaagcgctacatcaagaagaacctgctcggcaccttgctgttcgacgaggggaacaccgccgagaaccggcgcctcaagcggaccgcgcgacggcgctacacgcggcgccggaaccgcatcctgtacctgcaggagatcttcgccgaggagatcaacaagatcgacgactccttcttccagcggctcgacgacagcttcctgatcgtggaggacaagcagggctccaagcacccgatcttcggcaccctgcaggaggagaaggagtaccataagcagttccccaccatctaccacttgcgcaagcagctggccgacagctcccagaaggccgacatccggctgatctatctcgccctggcgcacatcatcaagtaccgcggacacttcctgttcgagggcgacctcaagagcgagaacaaggacgtgcagcacctgttcaacgacttcgtcgagatgttcgacaagaccgtggaggggtcctacctgtcggagaacctccccaacgtggccgacgtcctggtggagaaggtctccaagagccggcgcctggagaacatcctccactacttccccaacgagaagaagaacggcctgttcgggaacttcctggccctcgcactgggcctacagccgaacttcaagacgaacttcgagctcgcggaggacgccaagatccagttcagtaaggagacctacgaggaggacctggaggagctgctcggcaagatcggggacgactacgccgacctgttcatcgccaccaagagcctgtacgacggcatcctcctggccgggatcctgtccaccacggacagcaccaccaaagcgcctctctccagctccatggtcaaccggtacgaggagcatcagaaggacctggccctgctcaagaactttatccaccagaacctgagcgacagctacaaggaggtgttcaacgacaagctgaaggacggctacgccggctacatcgaggggaaaaccacgcaggagaacttctaccgcttcatcaagaaggccatcgagaagatcgagggctccaactacttcatcgacaagatcgaccgggaggatttcctccgcaagcagcggaccttcgacaacgggagcatcccccaccagatccaccttcaggagatgcatgccatcatccgcagacaggcggagttctaccccttcctggtagagaaccaggacaagatcgagaagatcctcaccttccggatcccgtactacgtcggccccctggcccgcgggaagtccgagttcgcatggctgaaccggaaatccgacgagaagatccgcccctggaacttcgacgaaatggtggacaaggagacctccgccgagaacttcatcacgcggatgaccaactacgaccagtacctccccgaccagaaggtgctcccgaagcacagcctgctgtatgagaagttcgcagtctacaacgagctcaccaaggtgcgctacgtgacggagcagggcaagtccttcttcttcgacgcgaacatgaagcaggagatcttcgaccggacgttcaaagtctaccgcaaggtgaccaaggagaagctgatggacttcctgagcaaggagttcgacgagttccggatcgtggacctcctgggcctggacaaggacaacaagtcgttcaacgccagcctcgggacctaccacgaccttaagaagatcgtctccgaggacttcctggacaacagcgagaacgaggacatactagagaacgtggtcctgaccctgacgctgttcgaggaccgcgagatgatccggaagcgcttggagaagtacaaggacgtgctgaccgaggagcagcggaagaagctcgagcgccggcactacaccggatgggggcgactatccgccaagctgatcaacggcattcgggacaaggtgacccgcaagacgatcctcgactacctgatcgacgacgggaccagcaaccggaacttcatgcagctgatcaacgacgacaccctctccttcgtcgacgagatccgcctggcccagggcagcggcaaggccgaagactaccgcgcggaggtacagaacctcgccgggtcccccgctatcaagaagggcatcctccagagcctgaagatcgtggacgagctgatcgaggtcatggggtatgaccccgagcacatcgtggtggagatggcccgggagaaccagttcaccaaccagggccgccggaactcccagcagcgctacaagaagatcgagaacgcgatcaagaacctcgacagcaatctgaacagcaagatcctgaaggagtaccccacgaacaaccaggccctccagaacgaccggctgttcctgtactacctccagaacgggaaggatatgtacaccgacgaggaactggacatcgaccagctgagtcagtacgacatcgaccacatcatcccgcaggccttcatcaaggacgactcgctcgacaacaaggttctgaccaagtccgccaagaaccgcggcaagagcgacgacgtgccctcactggagatcgtatacaagaagaagaacttctggcagcagctcctggactctcagctgatctcccagcggaagttcgacaacctcaccaaagccgagcgcggcgggctgaccaacgaggacaaggcgcgtttcatccagcgtcagctggtcgagacgcggcagatcaccaagcacgtggcccgcatcctcgacacccggttcaacaccaagctggacgaggccggcaaccgcatccgggaccccaaagtgaacatcatcatcttaaagagcaacctcgtctcccagttccgcaaggactatcagctttacaaggtacgggagatcaacaactaccaccacgcccacgacgcctacctgaacgcggtggtcgccacggccctccttaagaagtacccccagctggccccggagttcgtgtacggggagtaccccacctacaacagctacaactccagaaagagcgccaccgagaaggtgctgttctactccaatatcatgaacttcttcaagcggattgtcgttcacagcaagactggcgaggtgcgcatccggcccgtcatcgaggtgaacaaggagacgggcgagatcgtgtgggacaagaagtccaacttccgcaccgtccgcaaggtgctgagctacccccaggtgaacgtcgtgaagaagaccgaggtgcagaaccacgggctggaccggggcaagccgaaggggttctacaacgcgaacctcagcccccgccccaaggagggcagcgtcgagaacctggtgcccgccaagcagagcttcgacaccaagcgatacgggggctacgccggcatctccaacagctacgccgtgctggtcaacgggatcatagagaagggcaagaagaagtccaaggcggaggtgacggagtttcaggggatcagcatcctcgcccgcaaggacttcgacaagaacccgaagcaatacctgctgaacctcggatacaaggacatcaagtccatcatcaagctgcccaagtacagcctgttcgagctcgagaacgggtcccggcggatgctggcaagcatcctgtccaccaacaacaagcggggcgagatccacaagggcaacgagatgtacctccccgacaagttcgtgactctgctgtaccacgccatgcgcgtcaaccggaccctcgagccggggcacaagaagtacgtggaggcccacagacacgtgttcgacgagctgctgacgtacatcctcgagtacaatgagaagatcgtcggagcgaaggccaacgggaagcggatcgtggaggcctacagcgcccgcaaggacaccgacaacctggaggagctgtgcaactccttcatcaacctcctgaacctgaccgccctcggaagcgcggtggacttcgagttcctggggaccaagatcccccggtaccgcgactacacgccctccagcctgctcaaggccaccctgatccaccagtccgtcaccggcctgtacgagacccggatcgacctcagcaagctgggcggggactga

SEQ ID NO: 7856 - RNA, 4146 nt, synthetic construct; identical to SEQ ID NO: 2056
  misc_feature 1..4146: note = Cas9 variant
  source 1..4146: mol_type = other RNA

SEQ ID NO: 7857 - RNA, 4146 nt, synthetic construct
  misc_feature 1..4146: note = Cas9 variant
  source 1..4146: mol_type = other RNA
atggtgaagaaaaagtacgccatcggcatcgatatcggaaccaacagcgtaggctggtccgtggtgactgacgactacaaggtacccagcaagaagatgaaggtgttcgggaacacggagaagcgctacatcaagaagaacctgctcgggacactgctgttcgacgaggggaataccgccgagaaccggcgcctcaagcggaccgcgcgccggcgctacacgcggcgccggaaccgcatcctgtacctgcaggagatcttcgccgaggagatcaacaagatcgacgactccttcttccagcgcctcgacgacagcttcctgatcgtggaggacaagcagggctccaagcacccgatcttcggcaccctgcaggaggagaaggagtaccacaagcagttccccaccatctaccacctccgcaagcagctggcagatagctcccagaaggccgacatccggctgatctacttggccctggcgcacatcattaagtaccgcggacacttcctgttcgagggcgacctcaagagcgagaacaaggacgtccagcacctgttcaacgacttcgtggagatgttcgacaagaccgtggaggggtcctacctgagcgagaacctccccaacgtcgccgacgtgctggtggagaaggtctccaagagccggcacctggagaacatcctccactacttccccaacgagaagaagaacggcctgttcgggaacttcctggcgctcgccctgggcctgcagccgaacttcaagacgaacttcgagctcgccgaggacgccaaaattcaattctccaaggagacctacgaggaggacctggaggagctgctcggcaagatcggggacgactacgccgacctgttcatcgccaccaagagcctgtacgacggcatcctcctcgccgggatcctgtccaccacgaacagcacgaccaaggcgcccctctccagctccatggtgaatcgctacgaggaacaccagaaggacctggccctgctcaagaatttcatccaccagaacctgagcgacagctacaaggaggtgttcaatgacaagctgaaggacggctacgcaggctacatcgaggggaagaccacgcaggagaatttctaccggttcatcaagaaggcaatcgagaagatcgacggctccaactacttcatcgagaagatcgagcgcgaggacttcctccggaagcagcgcaccttcgacaacgggagcatcccacaccagatccacctccaggagatgcaggcgatcatccggcgccaggcgaagttctacccgttcctggaggagaaccaggacaagatcgagaagatcctcacattccgcatcccgtactacgtcggccccctggcccgggggaaaagcgagttcgcctggctgaatcgcaaaagcgacgagaagatccggccctggaacttcgacgagatggtggacaaggagacctccgctaagaatttcatcacgcgcatgaccaactacgaccagtacctccccgaccagaaggtgctgccgaagcacagcctgctgtacgagaagttcgccgtctacaacgagctcaccaaggtgcggtacgtaaccgagcagggcaagtccttcttcttcgacgcgaacatgaagcaggagatcttcgacggcgtcttcaaggtgtaccgcaaggtgacgaaggagaagctgatggacttcctggggaaggagttcgacgagttccggatcgtcgacctcctgggcctggacaaggagaacaagagcttcaacgcctccctcgggacctaccacgaccttaaaaagatcgtgagcaaggacttcctggacaactccgagaacgaggacatcctcgagaacgtcgtgctgaccctgaccctctttgaggaccgcgagatgatccggaagcgccttgaaaagtacaaggacatcctgacggaagaacagcggaagaagctcgagcgccggcactacaccggctgggggcgcctgagcgccaagctgatcaacggcatccgggacaaggtgacccgcaagaccatcctcgactacctaatcgacgacggcacgtccaactgcaacttcatgcagctgatcaacgacgacaccctcagcttcgtcgacgagatccggctggcccagggctccggcgaggccgaggactaccgcgcggaggtgcagaacctggccgggagccccgccatcaagaagggcattctccagtccctgaagatcgtggacgaactgatcgaggtcatggggtacgaccccgaacacatcgtggtggagatggcccgggagaaccagttcaccaaccagggccgcagaaacagccagcaacggtacaagaagatcgagaacgcgatcaagaacctcgactccaacctgaacagcaagatcctgaaggaataccccaccaacaaccaggccctccagaacgaccgcctgttcctgtactacctccagaacggcaaggacatgtacacggacgaggagctggacatcgaccagctgagccagtacgacatcgatcacatcatcccgcaggccttcatcaaggacgactccctcgacaacaaggtcctgaccaagagcgccaagaaccgggggaagtccgacgacgtgcccagcctggagatcgtgtacaagaaaaagtccttctggaagcagctcctggacagccagctcatctcccagcgcaagttcgacaacctcaccaaggccgagcggggcgggctgaccaacgaggacaaggcgcggttcatccagcggcagctggtcgagacccgccagatcacgaagcacgtggcccggatgctcgacacccgcttcaataccaagctggacgaggccggcaaccggatccgcgaccccaaggtgaacatcatcaccctgaagtccaacctcgtctcccagttccggaaggactaccagctgtacaaggtgcgcgagatcaataactaccaccacgcccacgacgcctacctgaacgcggtggtagccacggccctcctgaagaagtacccccagctggccccggagttcgtgtacggcgagtacccaacctacaacagctacaactcccgtaagagcgccaccgagaaggtgctgttctactccaacatcatgaacttcttcaagcggatcgtcgtgcacagcaagaccggggaggtgcggatccgccccgtcatcgaggtgaacaaggagacgggcgagatcgtgtgggacaagaagtccgacttccggaccgtccgcaaggtgctgagctacccccaggtgaacgtcgtgaagaagaccgaggtgcagaaccacgggctggaccggggcaagccgaaggggttctacaacgcgaacctcagcccccgccccaaggagggcagcgtcgagaacctggtgcccgccaagcagagcttcgacaccaagcgctacggcgggtatgccggcatctccaacagctacgccgtgctggtcaacgggatcatcgagaagggcaagaagaagtccaaggcggaggtgacggagttccaggggatcagcatcctcgcccggaaggacttcgacaagaacccgaagcagtacctgctgaacctcggctacaaggacatcaagtccatcatcaagctgcccaagtacagcctgttcgagctcgagaacggctcccgccggatgctggccagcatcctgtccaccaacaacaagcgcggggaaatccacaagggcaatgagatgtacctccccgacaagttcgtgaccctgctgtaccacgccatgcgggtcaaccgcactctcgagccggggcacaagaagtacgtggagacgcaccggcacgtgttcgacgagctgctgatctacatcctcgagtacaacgagaagatcgtcggggccaaggcgaacgggaagcgcatcgtcgaggcctacagcgccagaaaggacaccgacaatctggaggagctgtgtaactccttcatcaacctcctgaacctgaccgccctcggctccgccgtggacttcgagttcctgggcactaagatcccccgctaccgggactacacgccctccagcctgctcaaggcgaccctgatccaccaatccgtcaccgggctgtacgagacccgcattgacctcagcaagctgggcggggactga

SEQ ID NO: 7858 - RNA, 4149 nt, synthetic construct
  misc_feature 1..4149: note = Cas9 variant
  source 1..4149: mol_type = other RNA
atgaagaagatagtgaactacaacctgggccttgacatcgggacgagctccatcggctacgccgccatcgacgaccaggggcgccccgtccggcaccagaacaagacagtgatgggcgtgcgcctgttcaaggaggggaagacggcggagagcacacgcatcttccgcggcacccgtcgccggctgtcacaccgccactggcggctcggctacctggaccgcatcttcgacaacgaaatagccaaggtcgacgagaacttcctgccgcggttgaaggcctctaagcgcgctcggtccgacgagaagcgcagcttccgcgggtccctgctgttccccgagaccggcgacgacgcctactaccagaagtaccccacaatctaccacctccgctacgctctgatcacccagaagaagcagttcgacatccggctgatctacctcgccctgcaccacatgatcaagtaccgcgggaacttcctagacacgacccccgtgagcgcctttaacatccacgacatcgacctcacggaccaattcgcctccctgaacgactgctaccagctgctcgacatggacttcgagttccagttcgacctgaacaacatcgagcaggtccagaagctgctcctggacgagaccctgagcaagaccaagaggcaggcggccgtgtccaaggtgctcgtgatgtcaaccggcaacaaggccttcgacgaccagcagaacgggatcgcctccgagttcatcaaggccctgctgggcggcccgttcgacctcagcaagatcctgaacctgagcgtcgcggacgtcaagtcgtggaaactccacatgacggacaaggacgtggacgacaccctgaactccctggtagaggagcttgacgagaatcacaagcagatcgtgaacctactgcagatgatctacagtcaggtgatgatgctcgggctgctgaacggccagcagtccatcagcgccagcatgatcgagcgctacgacgaccacgccaagcactgggccgccctcaagaagctgctgcccgcgctcggggaacaggagcagtccaccatcatccacgcctacaccgcctatacgggccacagcagaaccaagcagctgtcccgcgccgagttctacaccaaggtcaacagcatccttaagaagcacgagaacatcgccgaggcgacaggcctcatcgagctgatcgaccgcaacgagttcatgcccaaacagcgggacgccgtaaacggggtgatcccccaccagctgcaccagcgcgagctccagctgatcatccagaaccagcagaagtactatccgttcctggccgcgaaagcctaccccgacgcggacgagacgatgatcgagcagctgctctcctttcgggtcccctactacgccggacccctggtggaccgcgacttcataaatgagagctccgaccaggagcaggccatgcagaacaccaagttcagctggctgaagcggcgcgaggccggtgagatcaccccgtggaacttcgagcagaaggtggacgtccaggagaccgcgaaccggttcatcaagcgcctcacgaccaaggacacctaccttatgaccgaggacgtgctgcccaaggagtccctcatctaccagcggttcgaggttctgaatgagctgaacgccatccgcatcaacgaccggcgcctcacggccgagaacaagcagctggccttccagcagctattcatggccggcaacaccaaaaacgtcagcatcaagaagttccggaacttcgtgttcgactccctcaaattccccgaaaaggtcaagatcaccgggttcgcgggccagcacaacttcctggccaagctgagcacctaccacgacttcaagaagatcttcggcgagcgcgtggaccacacggacctccagcccgacttcgagcggattgtggagtggtgcaccatcttcgaggaccgccacatctaccgggagaagctgaaggagatccagtggctgtcccagagcgagatcgaccagctcgtcctgatccgcaaccacgggtggggccggctgtccaagcgcctcctgaccgggatccgcgacagcgacggccggacggtgatggaccagctgtggttcgggacggataacttcatgcgcatcatctcacagagcgacttcgccgccgccatcgcgaacgagaaccggacccagctcaaccagcacggcctggaggacgtgctggactccgccttcatgagcccgcagaacaagaaggccatccgccaggtcctcaaggtggtggacgacattgagcagaccctgggctgcccgcccaagaaggtcatgatcgagttcacgcggagccccgacaagaagaagcagcgcaccgtgacgcggctggagaaggtgcagcaggcctacaaggccgtcgcggaccagctcgccgggcagtccatcgtgagcgagctggatcagtacgccaacacccactccaagctgagcgacacctactacctctacttcatgcagctgggccgcgacctgtactccgggaagcccatcgacatcgacagcccgatgctcgacgacgaccacatactgccccgggccttcatgaaagataactccctggacaaccgcgcgctcacggagaagcccatcaacaacacgaaggccgccaagttcccgagcaaggtgtttggccagcagaaggaggtcaccgacttctggaagctgctgcggcgctgcgggctcatgtccaacatcaaggagaagcacctgtacctggaccccgacaacgtggacaagtggacccggcgcggcttcatccaccggcagctcgtggagaccagccaggtcatcaagatcgtggccaacatcctgaacgaccgataccagcagtcccagacggaggtgctggaggtccccgcccggctcggcaccgagctgcgcgagtgcttcgggtggtacaaggtgcgggaggtaaacgactaccaccacgtcttcgacgcgtacctggccgccttcatcggcaactacctctaccgccggtaccccaagctgcagccgtacttcgtgtacgggaacttcgccgagctgaacaaggcccagctcaagaacatcaagagcttcaacttcctatacaacatcaccgataacaagcgcgtggtcaaggacatcgagaccggccagacactgtgggacgaccagatccgccagcagatccagcacatctacgagtacaagtacatgctcacctcccacgaggcgttcacccagcacaaggagctgtacggccagaccatctacccccggcgcgagttcaagcccgggaccctgaaggccatcaagcaggaccagccgcaggagctctacggcgggtacaagaacctgaccgccgcctacatgtgcatcgtgaagatccaggcccgaaagcgccgggcggccgagtaccgcgtggtccgggtggccaccgagtccctgtccgccctccagcaggcgaagcgcctgggggtgcaagcctacgagcggtgcctgcgccaggagctggtccggaacaacgagatcctgcgcaccaacgccgaccccaacagcgcgccccgggagttcgaggttctgctcgaccgcgtactgtgccaccagatgatcatctccgacgggcagaagtacctgctcggcagccacgcctacaagatcaactgcatgcagctggtcctgagcaacaactccatgaagatcctcagcacgagtattgtgaagctgaagcagatgaccaacgagcccctggtgcaggtctaccgggagatcctcgacgtggtgaacaagtacttcaccctgtacgacgtcaacagcttccgcgagaacctgaaccagttcttcgacaagttccggaccctcccgatcacgaacgagtacgagtcaagcaagtccggcaagaagctgatccaccgcgggcagctggagaccctcaccctgatcctgcggggcctccacgccaacagcgacaaggtgcagtacggggatcagtccaccctgctgggcgggttccagacgaaggacggcatcaagctcagcaaggactccgtgatccagtacaccagcccggccggcctgaacgtccgcaccgtgaagctgcgcgacctcgagcagaaggaggcccaaaagtga

SEQ ID NO: 7859 - RNA, 4149 nt, synthetic construct; identical to SEQ ID NO: 2059
  misc_feature 1..4149: note = Cas9 variant
  source 1..4149: mol_type = other RNA

SEQ ID NO: 7860 - RNA, 4155 nt, synthetic construct
  misc_feature 1..4155: note = Cas9 variant
  source 1..4155: mol_type = other RNA
atgaacaagccctacagcatcggcctggacatcgggaccaactcagtcggctggagcatcatcaccgacgactacaaggtcccggccaagaagatgagggtgttaggaaacacggacaaggagtacataaagaagaacctgatcggcgccctcctcttcgacgggggcaacaccgcggccgaccggcgcctaaagcggaccgcccgccggcgctacacccggcgccggaaccgcatcctgtacctccaggagatcttcgccgaggagatgtcaaaagtggacgacagcttcttccaccggctggaggacagcttcctggtggaggaggacaagcgcggcagcaagtacccgatcttcgccacgctccaggaggagaaggactaccacgagaagttctcgaccatctaccacctccggaaggagctggcggacaagaaagagaaagccgacctgcgcctgatctacatcgcccttgcccacatcatcaagttccgggggcacttcctcatcgaggacgacagcttcgacgtgcgcaacaccgacatctccaagcagtatcaggacttcctggagatcttcaacaccacctttgaaaataacgacctgctctcccagaacgtggacgtcgaggccatcctgaccgacaagatctccaagagcgcaaagaaggaccgaatcctggcccaataccccaaccagaagtccaccggtatctttgccgagttcctcaagctgatcgtggggaaccaggccgacttcaagaaatacttcaacctagaggacaagacgcctctccagtttgcgaaggacagctacgacgaagacctggagaacctgctcggccaaataggggacgagttcgccgacctgttctccgccgcaaagaagctgtacgacagcgtgctcctatccggcatcctgaccgtgatcgacctcagcactaaggccccgttatccgcgagcatgatccagcgctacgacgagcaccgggaggacctgaagcagctcaagcagttcgtgaaggccagcttgcccgagaagtaccaggagatcttcgccgactccagcaaggacggctacgccgggtacatcgagggcaagaccaaccaggaggccttctacaagtatctgtccaagctcttgaccaagcaggaggactcggagaacttcctggagaaaatcaagaacgaggacttcctccgcaagcagcggacgttcgacaacgggtcgatcccccatcaggtgcacctgaccgagctgaaggcgataatccgccgccagagcgagtactacccatttctcaaggagaaccaggaccggatcgagaagatcctgaccttccgcatcccgtactacatcggtcccctggcccgggagaagtccgacttcgcctggatgacccgcaaaacggacgacagcatacggccctggaatttcgaggacctcgtcgacaaggaaaaatccgccgaggccttcatccaccgcatgaccaacaacgacttttacctgcccgaggaaaaggtgctgccgaagcacagcctgatctatgagaagttcacagtgtacaacgagctcaccaaggtccggtacaagaacgagcagggcgagacgtacttcttcgactccaatatcaagcaggagatcttcgacggggtgttcaaggagcaccgcaaggtgtcaaagaagaagctgctggattttctcgcgaaggaatacgaggagttccggatcgtcgacgtgattggcctggacaaggagaacaaagccttcaacgcctccctggggacctaccacgacctcgagaagatcctggacaaggacttcctggacaacccagacaacgagagcatcctcgaggacatcgtgcagaccctgaccctgttcgaggaccgcgagatgatcaagaaacggctcgagaactacaaggatctgttcacggagtcccagctgaagaagctctaccggcggcactacaccgggtggggacgcctgagcgccaaactgatcaacggcatccgggacaaggagtcccagaagaccatcctcgactacctgatcgatgatggccgcagcaaccggaacttcatgcagctgatcaacgacgatgggcgctccaatcgcaacttcatgcagctcatcaacgacgacggcctgagctttaaaagcatcatctccaaggcgcaggctgggtcacactccgataatttaaaggaggtcgtgggcgagcttgccgggtcgcccgccatcaagaagggcatcctgcagtctctgaagatcgtggacgaactcgtgaaggtgatgggatacgagcccgagcagatcgtcgtggagatggctagggaaaaccagaccacgaaccaggggcgccggaacagccgccagcggtacaagctgctcgacgacggtgtgaagaacctcgcgtcggacctgaacgggaacatcctgaaggagtacccgactgacaaccaggccctccagaacgagcgcctgttcctgtactacctccagaacggccgggacatgtacaccggagaggccctggacatcgacaacctgagccagtacgacattgaccacatcatcccccaggccttcatcaaggacgactccatcgacaaccgcgtcctcgtgtcatccgccaagaaccggggaaagagcgacgacgtgccctccctggagatcgtcaaggactgcaaggtcttttggaagaagctactagacgcgaagctgatgagccagaggaagtacgacaacctgaccaaggccgagcggggagggctcacgtccgacgacaaggcccgcttcatccagcggcagctggtggagacccgccagatcaccaagcacgtcgcccggatcctggacgagcgctttaacaatgagctcgactccaagggccggcgcatccggaaggtgaagatcgtgaccctgaagtccaacctggtcagcaacttccgcaaggagttcgggttttacaaaatccgggaggttaataactaccaccacgcccatgacgcatacctcaacgccgtggtcgcaaaggccatcctgaccaagtacccccagctggagccggagttcgtgtacggcgactaccccaagtacaacagctacaagacgcgcaagtccgcgaccgaaaagttgttcttctacagcaacatcatgaacttcttcaaaaccaaggtgactctggccgacggcacggtcgtggtgaaggacgacatcgaggtgaacaacgacaccggggagatcgtgtgggacaagaagaagcacttcgccaccgtgcggaaggtcctgtcctacccccagaacaacatcgtgaagaagaccgagatccagacgggcgggttcagcaaggagtccatactcgcgcacggcaacagcgacaagctgatcccccgcaagaccaaggacatctacctggacccgaagaagtatggaggcttcgactcccccatcgtggcttacagcgtcctcgtggtggcagatattaaaaagggcaaggcccagaagctgaagaccgtcaccgagctgctcggcataacgatcatggagcgctcccggttcgagaagaaccccagcgcattcctggagtccaagggctacctgaacatccgagccgacaagctcatcattctccctaagtacagcctgttcgaactcgagaacgggcggcgccggctgctagcctccgcgggtgagctccagaaggggaacgagctggccctgccgacccagttcatgaagttcctgtacctggccagccgctacaacgagtccaaggggaagcccgaggagatcgagaagaaacaggagttcgtgaaccagcacgtgagctacttcgacgacatcctgcagctcatcaacgacttctccaagcgggtcatcctggccgacgccaacctggagaaaatcaataagctctaccaggacaacaaggaaaacataagcgtggacgagctggcgaacaatatcatcaacctgttcacctttacctccctcggagcccccgccgccttcaaattcttcgacaaaatcgtggaccggaagcgatacacgtcgaccaaggaggtactgaacagcaccctgatacaccagtccataaccgggctctacgagaccagaatcgacttgggcaagctgggggaggactga

SEQ ID NO: 7861 - RNA, 4155 nt, synthetic construct
  misc_feature 1..4155: note = Cas9 variant
  source 1..4155: mol_type = other RNA
atgaaacttcgaggaatagaagacgactactcaatcggactagacatggggacctccagcgtcgggtgggccgtcacggacgagcgcggcaccctagcacatttcaagcgaaaaccaacatggggtagccgcctgttccgagaggcacagacagcagcggtagcgagaatgcccagagggcagcgccgccgctatgtacggagacgatggcgcctggacctgctccaaaaattattcgaacaacagatggagcaagccgacccagacttcttcatcagactacgacagtcgcgcctcctgcgagacgaccgagccgaggaacacgcggactaccgatggcccctgttcaacgactgcaaattcaccgagcgagattactaccagagattcccaaccatctaccacgtaaggtcctggctgatggaaacagacgagcaagccgacataagactaatctacctcgccctccacaatatagtcaaacaccgaggcaacttcctccgcgaggggcaatccctatcggccaaatccgcgcgcccagatgaagcccttaatcatctgcgcgagacactccgggtatggagcagcgagaggggattcgaatgctccatcgcagacaacggttccatcctagccatgctgacccaccctgatctatccccaagcgacagacgcaagaaaatagcgcccctgttcgacgtgaaatccgacgacgccgccgcagacaagaagctcggaatcgcactagccggcgcagttataggcctgaaaaccgagttcaaaaacatcttcggcgacttcccctgcgaagattcatctatctacctctcaaacgacgaagccgtcgacgcagtaagaagcgcctgtccagacgactgtgcggagttgttcgaccgtctatgtgaagtatactcggcctatgtactacaagggctgctgagttacgcacccggccaaacaataagtgcaaacatggtagaaaaataccgccggtacggagaagacctggcgttgctgaagaaattagtcaaaatctacgcgccagatcaataccgcatgttctttagtggcgcgacatatccaggcaccggaatttacgacgcagctcaggcacgagggtacacaaaatacaacctgggacccaaaaagtccgaatacaaaccaagcgagtccatgcagtatgacgacttccgcaaagcagtcgaaaagctattcgccaagacagacgcccgcgccgacgagcgataccgaatgatgatggaccgtttcgacaaacaacaattcctgcgccgcttaaaaacctctgacaacgggagtatataccaccaactacacttagaggaactaaaagccatcgttgaaaaccaaggccgattctacccttttctaaagcgagatgccgacaaactcgtgtcactcgtctcattccgcattccctattacgtcggcccactcagtactcggaacgctcgcacggaccaacacggggaaaaccgattcgcctggtccgaaaggaaaccggggatgcaggacgaacccatattcccatggaactgggaatccatcatcgaccgctcgaaaagcgccgagaaattcatcttgcgaatgacgggaatgtgcacatacttacaacaagagccggtcctccccaaatcatccctactctacgaggagttctgcgtccttaacgaactgaacggggcacattggtcgattgatggagatgacgaacacagattcgacgccgccgacagagaaggcatcatcgaagaacttttcaggaggaaacgcaccgtcagctacggtgatgtggcaggttggatggaacgagaaagaaaccagatcggtgcacacgtgtgcggcggccagggggaaaagggattcgaatccaaactgggaagctacatcttcttctgcaaggacgtcttcaaagttgagcgactagaacaatcggactacccgatgatcgagcggataatcctctggaacaccctcttcgaagaccgcaaaatcctcagtcaacgcctgaaagaagagtacggcagccgactctcggccgaacagatcaagaccatctgcaagaagcgtttcacggggtggggcaggctatcagaaaaattcctcaccggcataaccgtacaagtcgacgaggactcagtatcgatcatggacgtccttcgcgagggatgcccagtctccggcaaacgcggccgtgcgatggtcatgatggagatcctgcgagacgaagaactcggattccagaagaaggtagacgacttcaacagagcattcttcgcagaaaacgctcaagccctcggcgtcaacgaactgccaggttcaccggccgttagacgctccctcaaccagtcaatccgcatcgtcgacgaaatagcaagcatagccggcaaagcacccgccaatatattcatcgaagtcacgagagacgaggaccccaaaaagaaaggtaggcgaaccaaaagacgatacaacgaccttaaagacgcactcgaagccttcaaaaaggaagaccccgaactctggagagaactctgcgagaccgcgcccaacgacatggacgagcggctgtcattatatttcatgcaaagaggcaagtgtctatactcaggacgggctatcgacatacaccaactctcgaacgccgggatatacgaggtcgaccacatcatcccccgaacctacgtgaaagacgactcactggaaaacaaagccctcgtataccgagaagagaaccaacgaaaaacagacatgctgctcatagaccctgaaatcagacgccgcatgtcgggttactggcggatgctccacgaggcaaagctcatcggagacaagaaattccgcaacctgctccgcagcaggatcgacgacaaagcactaaaagggttcatcgcacggcaactggtggaaaccggacaaatggtcaagctagtgcgctctctcctcgaagcaagatatccagaaaccaatatcataagtgtgaaagcatctatttcacacgatctacgcaccgcagcagaacttgtcaaatgccgcgaagccaacgacttccaccacgcccatgacgcattcctcgcttgccgcgtaggcttattcatccagaaaagacacccttgcgtctacgagaaccccatcggcctatcacaagtagtccgcaactacgttcgccaacaggcagacatcttcaaacgctgccgaacaatccctggcagctcaggcttcatcgtaaacagcttcatgacatcaggattcgacaaagaaaccggcgaaatatttaaagacgactgggatgcggaagcagaagtcgaaggcataaggcgaagccttaatttccgacaatgcttcatatcccggatgcccttcgaagaccacggcgttttctgggacgccaccatctactcgccaagagcaaagaaaaccgccgcgctgccattaaaacaagggcttaacccctctagatacggctccttcagccgggagcaattcgcttacttcttcatatacaaagcccgaaacccgcgcaaagaacaaacattatttgaatttgcccaagtacccgtacgtttaagcgcccagatccggcaagatgaaaacgcactcgaaagatatgcacgggaacttgcaaaggaccagggacttgagttcataaggatcgaacgatctaagatactcaaaaaccaactgatagaaatagatggcgaccgactatgtataacaggcaaagaagaggtacggaacgcgtgcgagctagccttcgcccaagacgaaatgcgcgtcatccgaatgttagtgagcgaaaaacccgtgagccgagaatgcgtcatctcgttgttcaaccggattttgctacacggcgaccaagcaagccggcgactatccaaacaactaaaactcgcgcttctcagcgaagccttctccgaggcatctgacaacgtacaacggaacgtcgttctcggcctcatcgcaatattcaacggaagcaccaacatggtcaacctctcagacataggaggcagcaagttcgctggcaacgttagaataaaatacaagaaagaactagcatctcccaaagtaaatgtacacctgatcgaccaatcagtcacaggtatgttcgaaagaagaacaaaaatcggcctatga

SEQ ID NO: 7862 - RNA, 4158 nt, synthetic construct; identical to SEQ ID NO: 2062
  misc_feature 1..4158: note = Cas9 variant
  source 1..4158: mol_type = other RNA

SEQ ID NO: 7863 - RNA, 4158 nt, synthetic construct; identical to SEQ ID NO: 2063
  misc_feature 1..4158: note = Cas9 variant
  source 1..4158: mol_type = other RNA

SEQ ID NO: 7864 - RNA, 4158 nt, synthetic construct
  misc_feature 1..4158: note = Cas9 variant
  source 1..4158: mol_type = other RNA
atggacgagctgcagaacttcgagaagggcaagagcatcaccaccaacgccgaccgcacggccgggcgctccatgcgccggaatctccagcgctacaagctgagacgcgagaacctgatcgaggtgctcaaggagtacaacttcatcaccgacgagatgatcctgagcgagaacggcaaccggaccaccttcgagacgtaccgcctgcgggcgaaggccgccgtagaggagatctccctcgagcagttcgcccgcgtgttactgatgatcaacaagaagcgggggtacaagagcagtcgcaaggccaagggcgcggagaacgggaccctcatcgacggcatggaggtggccaagaagatgtacgacgagggcatcacccccggggagctgtgcctgcagttactgaccgccgggaagcggtacttcccggacttctaccgcagcgacctgcaggccgagtttgaccggatctggaacttccagaagcagttctaccccgactccctcatcgacaaggtcaaggacgaggtgcgcgggaagaacaagagccagacgtgggcgatcctggccaagtacttcgtgtggaaggaggtggaaaattcctggaacgaggaggaggcccagacccggcgcgtggagaaggagtaccggctggtgggcatcaagcgcggggtcaagagagaggagctcaagctggagaatttccagtggcgcgtgaaggccctgagcgagcgcatgaaccccgaggagctcgccatcgtgctgcaggagatcaacgagcagatctccaacagctcaggctatctgggcgcgatcagcgaccggtccaaggagctctacttcaaccgtcagaccgtcgggcagtaccagatggccgtgctggacaacaaccccaacatcggcctacggaacatggtattctaccgccagggttacctcggagagttcaacaccatctgggagaagcaggccgagttccacaaggagctgacggaggacctgaagaaagagatccgggatatcgtcatcttctaccagcgccggctcaagagccaaaagggcctgataaacatctgcgagttcgagcgccggcagatcgaggtggagatcgacgggaagaagaagatcaaaaccatcggctcccgcgtgatcccgcggagcagccccctgttccaggagttcaagatctggcagaccctgaatgacatcgaggtcagcgtgctgggggtgaagaacaagcgcaagaagcaggacgacaacagcaccacgctgctcgactccgccgaaaacattgatagcctgaagctgaacgtctcgcggcccctcgacgccgacgagaagtccctgctggcgaaggagctgttcatccgcgacaagctcaccaagtccgacgtgctgaagctcctgttcaacaacccccagaacctgaacctcaatttcaagaatatcgacggcaaccgtaccggcagcgccctgtaccaggccttctccaagatcctggagatcagcggccacgagtccatcaacttcaagaagtccgccgatgagatcgtggagcaggtcaagaccatattcagcgccctgggttggaacacggaggtgctctgcttcgacagcgagaaggagctggacaagcagccgtactttaagctgtggcacctcctgtactccttcgagggggacagcacccccaccggcgacgggaacctgatccagaagatcgcggacttgtgcggcttcgagaaggactacgcctccatcctggccaacatcaccttccaggaggactacgggagcctgtccacgaaggccatccgcaagattctcccccacctcaaggacggcaaccagtacgacgtcgcctgcgagtacgcgggctacaagcacagcaagtccagcttgaagaaggaggagatcaagaacaaggtgctcaaggacaagctggagctgctccccaagaacagcctgaggaacccggtggtcgagaagatcctgaaccagatggtgaacgtgatcaacgccatcatcaccacctacgggaagcccgacgagatccgcatcgagctcgcccgggagctgaagaagaaggccaagaagcgcgaggagctgaccaagacgatcgtcgacacaaccaagacccacgagggtatccgcgcgatactccagaacgacttcggaatgtcccacgtgagccggaacgccatcatccgctacaagctgtacgaggagctgaaggataacggctacaagacgctctactccaacacctacatccccaaggagaagctgttcagcaaggacttcgacatcgaacacatcatcccgcaggcccggctgttcgacgactctttcagcaacaagacactcgaggtgaaatccatcaacatcgagaaggggagcaaaaccgcctacgacttcgtcgaggagaagtacggcgagcagggcctgcaggagtacctgaaccgctgcgaagtcctcttccgggacaagaagacgaagctgcgcaagctgaagatgcaggagtccgagatcccggaggggttcatcgaccgggacctccgcaacacccagtacatcgccaagaaggcgctgagcatgctgaacgagatctgccggcgcgtggtagccaccaccggcgccatcaccgacgagctccgggaggactggcagctggtggacgtgatgaaggagctgaactgggagaagtacaaggtcctcgggctggtggagtacttcgaggacaacgacggccgcctgatcggccggatcaaggactggacaaagcgcaacgaccaccggcaccacgccatggacgccctcaccgtggcgtttaccaaagacgtcttcatccagtacttcaacaataagaacgcctccctgaagcccgacaccaacgaggccgccatccgcaacaagtacttccagaacgggaaggccatcccgcccatgagcctggacgagttccgggcggaggccaagaagcacttgaacgacacgctgatctccatcaagaccaagaacaaggtggtgaccatcaatctgaaccgcaccaagaagaagaacggcatcaataagaagcagcagcagacgcccagagggcagctccacctggagaccgtctacggcagccacaagcagtacgtggtgaaggaggaaaaggtcaacgccagtttcgacgccgcgaagatcgccaccgtgaacaagcccgcctaccgcgacgccctgctccggcgcctgcaggagaacgggaacgacagcaagaaggcctttaccggcaaaaactccctggacaagcagcccgtgtggctcgacgcgaagcagaacgagtgcgtccccgagaaggtgaagacggtaatgctggagaccgtctacaccgtgcgcaagccgatcgacgagaagctgaacgtggacaaggtagtggacgcccggatccgcaagctcctgcaggaccggatcaaggagtacggcaacgccaagagcgccttcgccaacctggacgagaaccccatctggctcaacaaggagaaggggatcaccatcaagcgcgtgtcggtctccggcatcagtaaggcgcagtccctgcacgagaagaaggacaaggacgggaacttcatcctggacaaggacagccggcgcatccccgtggacttcgtgaacacgggcaacaaccaccacgtcgccatctaccggaagcccgtgctcgacaagaaggggcaggccgtgttcgacgaaaacggcgagctgaagttcgagctggaggaggtcgtggtgtccttctttgacgccgtcacccgcgtgaatcttagccagccgatcatcgataaggactacaagcggtccgagggctggaagttcctgttcagcatgaagcagaacgagtacttcgtgttcccgaacgagaagaccgggttcgaccccaaggagatcgacctgctcaacccggagaactacgccctgatctcccccaacctgttccgcgtccagaagatcgcgagcaaggactacgtgttccggcaccacttggagaccgtggtcgccgaccgtaaggagttacaggagataacgtggaagcggatctccagcctgtccatcctcaaccgcatcatcaaggtgcgggtcaatcacatcggccagatcgtgatgatcggcgagtattga

SEQ ID NO: 7865 - RNA, 4158 nt, synthetic construct
  misc_feature 1..4158: note = Cas9 variant
  source 1..4158: mol_type = other RNA
atgaccaagccctacagcatcggcctggacatcgggaccaactccgtgggctgggctgtcatcacggacgactacaaggtgccaagcaagaagatgaaagtgctcgggaacacctccaaaaagtacatcaagaagaacctgctgggcgccctcctgttcgacagcgggatcaccgcggagggccgccggctgaagcgcaccgcccggcgccggtacacgcgccggcgcaacaggatcctctacctacaggaaatcttctccaccgagatggccaccctggacgacgccttcttccagcgcctcgacgacagcttcctggtccccgacgacaagcgggactccaagtaccccatctttggcaacctggtggaggagaaggcttaccacgacgagttccccacgatctaccacctccgcaagtacctggcggacagcacgaagaaggccgacctgcggctcgtgtacctggccctggcccacatgatcaagtaccgcgggcacttccttatcgagggcgagtttaactccaagaacaacgacatccagaagaatttccaggacttcctggacacctataacgcgatcttcgagagcgacctgtccctcgagaacagcaagcagctggaggagatcgtcaaagacaagatttccaagagcgccaaaaaggaccggatcctgaagctgttcccgggggagaagaactccggcatttttagcgagttcctgaagctgattgtggggaaccaggccgacttcaagaagtacttcaatctcgacgagaaggcgcccctgcacttctcaaaggagagctacgacgaggacctggagaccctcctgggctacatcggcgacgactactccgacgttttcctgaaggccaagaagctctacgacgccatcctgctgagcgggatcctcaccgtcacggacaacggcaccgaggcgcccctaagctccgcgatgatcatgcgctacaaggagcacgaggaggacctggccctcctgaaggcctacatccggaacatcagcctggagacctacaacgaggtgttcaaggacgacaccaagaacggttacgccggctacatcgacggcaagacgtcccaggaggacttctacgtgcacctcaagaaacttctggtcggacttgagggcgccgactacttcctggagaagatcgaccgcgaggacttcctgcggaagcagcgcaccttcgacaacgggagcatcccctaccagatccacctccaggagatgcgggccatcctggacaagcaggccaagttctacccgttcctggccaagaacaaggagcgcatcgagaagatcctgaccttccgcatcccctactacgtgggccccttagcgcgcgggaactccgacttcgcctggtccatccgcaagcggaacgagaagatcaccccctggaacttcgaggacgtgatcgacaaggagtccagcgccgaggcgttcatcaaccgcatgacgtccttcgacctgtacctgccggaggagaaggtcttgcccaagcacagtctgctgtacgagaccttcaacgtgtacaacgagctcaccaaggtgcggttcatagccgagtccatgcgcgactaccagttcctggacagcaaacagaagaaggacatcgtccggctgtacttcaagaacaagcgccgggtgaccgataaggacatcatcgaatacctccacgcgatcgacggctacgacggaatcgagctgaaggggatcgagaaacagttcaactccagcctgtccacgtaccacgacctcctgaacatcatcaacgacaaggagttcctcgacgacagctccaacgaggccatcatcgaggaaatcatccacaccctcaccatcttcgaggaccgcgagatgatcaagcagcggttaagcaagttcgagaacatcttcgacaagagcgtgctcaagaagctcagccgccggcactacaccggctgggggaagctgagcgccaagctgatcaacggcatcagggacgagaagtccgggaacacgatcctcgactacctgatcgacgacggcgtcagtaaccggaacttcatgcagctgatccacgacgacgcactctccttcaagaagaagatcaagaaggcgcagatcatcggcgacaaggacaacatcaagcaggtcgtgcaggccctgcccgggcgccccgccatcaagaagggcatccttcagagcatcaagatcgtggacgagctcgtgaaggtcatggggcggcgcccggagtccatcgtggtggagatggcccgggagaaccagtacaccaaccagggcaagagcaactcccagcagaggctgaagcgcctggaggagagcctcaaggagctggggtccaagatcctgaaggagaacatccccgccaagctcagcaagatcgacaacaacgcgctgcagaacgaccggctgtacctctactacctgcagaacggcaaggacatgtacaccggcgaggagctggacatcgaccgcttatccaactacgacatcgaccacatcatcccccaggccttcctgaaggacaacagcatcgacaataaggtcctggtgtccagcgcctccaaccgggggaagtccgacgacgtgcccagcctcgaggtcgtgaagaagcgcaagaccctgtggtaccagctgctcaagagcaagctgatcagccagcggaagttcgacaacctgacgaaggccgagcgcggcggcctctccccggaggccaaggcgggcttcatccagcggcagctggtggagacccgccagatcaccaagcacgtcgcccggctgctcgacgagcgcttcaacaacaagaaggacgaagacaacaagaccctgcggacggtgaagatcatcaccctcaagagctccctcgtgagccaattccgcaaggactttgagctgtacaaggtccgggagatcaatgacttccaccacgcgcacgacgcctacctgaacgccgtggtggcgtccgccctcctgaagaagtatcccaagctggagcccgagttcgtctacggcgactaccccaagtacaacagcttccgcgagcggaagtcggccaccgagaaggtatacttctacagcaacatcatgaacatcttcaagaagtccattagcctcgccgacgggaccgtgatcgagcgccccctgatcgaggtcaacgaggagaccggcgagagcgtgtggaacaaggtggcagacctgaacacggtccggaaggtgctctcgtactcccaggtgaacatcgtcaagaaggtggaggagcagaaccacgggctggaccgcggcaagcccaaagggctgttcaacgccaacctcagctccaagcccaagcccaacagcaaggagaacctggtgggcgccaaggagtacctggacccgaagaagtacggcgggtacgccggcatctccaacagcttcgccgtcctcgtgaaggggaccatcgagaagggcgcgaagaagaagatcaccaacatcctggagttccaggggatctccatcctggaccggatcacctaccgcaaggacaagttcaactttctcctggagaagggctacaaggacatcgacctgatcatcgagctccccaagtacagcctcttcgagctgagcgacggctcccggcgcatgctcgccagcatcctgtcaacgaacaacaagcgcggggagatccacaagggcaaccagatcttcatcagccagaagtacgtgaagctgctctaccacgccaagcggatctccaacacctttaacgacaaccatcgcaagtacgtcgagaaccacaagaaggagttcgaggagctgttctactacatcctggagttcaacgagaactacgtgggggccaagaaaaacggcgagctcctcaagagcgccttccagtcctggcagaaccacagcatcgacgagctgtgctccagcttcatcgggcccaccggctccgagcggaagggcctctttgagctgaccagccgcgggggcgcggccgacttcgacttcctgggggtgaagatcccgcggtaccgcgactacacgccctccagcctcctgaaggacgcgacgctgatccaccagtcagtcaccggcctctatgagacccgaatcgacctggggaagctgggcgaggactga

SEQ ID NO: 7866 - RNA, 4158 nt, synthetic construct; identical to SEQ ID NO: 2066
  misc_feature 1..4158: note = Cas9 variant
  source 1..4158: mol_type = other RNA

SEQ ID NO: 7867 - RNA, 4161 nt, synthetic construct
  misc_feature 1..4161: note = Cas9 variant
  source 1..4161: mol_type = other RNA
atgaaccagaagtacagcatcggcctggacatcgggaccaactccgtgggctgggccgtcatcaccgacgactacaaggtgcccgccaagaagatgaaggtgctcgggaacactgacaagcagagcatcaagaagaacctgcttggcgcgctgctgttcgattccggggagaccgccgaggccacccgactgaagcggaccgcccgccggcgctacacgcggcgccggaaccgcctccggtaccttcaggagatcttcgccgaggagatgatgcaggtcgacgagagcttcttccagcgcctggacgactccttcctcgtggacgaggacaagcggggcgagcgccacccgatcttcggcaacatcgcggccgaggtgaagtaccatgacgagttccccaccatctaccacctccggaagcacctggccgacatcagccaaaaggccgacttgagactggtctacttggcgctggcccacatgatcaagttccgggggcatttcctgatcgaaggccagctgaaggccgagaacaccaacgtgcaagccctcttcaaagacttcgtggaggtctacgataagaccgtggaggagtcccacctgagcgagatcacggtggacgccctgtccatcctcaccgagaaggtcagcaagtcccgccggctggagaacctaatcgcgcactaccccgccgagaagaagaacaccctcttcgggaacctcatcgccctgttcctcggcctgcagcccaacttcaagaccaacttccagctgagcgaggacgccaagttgcagttctccaaggacacgtacgaggaggacctggaggggctgctcggcgaggtgggcgacgagtacgccgacctgttcgcgagcgccaagaacctgtacgacgccatcctcctgtccgggatcctgaccgtggacgacaacagcaccaaggcccctctctccgccagcatggtcaagcgctacgaggagcaccaaaaggacctgaagaaattcgaggacttcatcaaggtgaacgcgctggaccagtacaacgccatcttcaaggacaagaacaagaagggctacgccgggtacatcgagtctggtgtgaagcaggacgagttctacaagtacctcaagggcatcctgctgcagatcaacgggagcggcgacttcctcgacaagatcgaccgggaggacttcctgcgcaagcagcggaccttcgacaacgggagcattccccaccagatccacctccaggagatgcacgccatcctgcgccgccagggggagcactaccccttcctgaaggagaaccaggacaagatcgagaagatcctgacgtttcggatcccctactacgtcgggcctctggcccgtaagggctcccggttcgcgtgggccgagtacaaggccgacgagaaaatcaccccctggaacttcgacgacatactcgacaaggagaagtccgccgagaagttcatcacccgcatgaccctgaacgacctgtacctccccgaggagaaggttctgcccaagcacagcctgctctacgagacgttcaccgtgtacaacgagttaaccaaggtcaagtacgtgaacgagcagggcgaggcgaaattcttcgacgccaacatgaagcaggagatcttcgaccacgtgtttaaggagaaccggaaggtcaccaaggacaagctgctaaactacttgaacaaggagttcgaggagttccgcatcgtgaacctgacggggctagacaaggagaacaaggtcttcaacagctccctgggcacctaccacgacctgcggaagatcctcaacaagagcttcctggacaacaaggagaacgcccagatcatcgaggacatcatccagacgctgaccctcttcgaggaccgcgagatgatccggcagcgcctgcagaagtattccgacatcttcacgaaggcccagctgaagaagctcgagcggcgccactacaccgggtggggccggctaagctacaagctgatcaacgggatccgcaacaaagagaacaagaagaccatcctcgactacctgatcgacgacggctacgccaaccggaacttcatgcagctgatcaatgacgacgcgctctccttcaaggaggagatcgccaaggcccagatcatcggcgacgtggacgacatcgccaacgttgtccacgacctgcctgggagccccgcgatcaagaagggcatcctgcagtccgtgaaaatcgtggacgagctagtcaaggtgatggggcacaaccccgctaacatcatcatcgaaatggcgcgcgagaaccagaccacggaccggggccgccggaacagccagcagcgcctgaagctgctccaggactccctcaagaacctggacaaccccgtgaacatcaagaacgtcgagaaccagcagctccagaatgaccgtctgtttctgtactacatccagaacgggaaggacatgtacaccggcgaaaccctcgacatcaacaacctgagccagtacgacatcgaccacatcatcccgcaggcctacatcaaggacgactccttcgacaaccgggtgctgaccagctccagcgagaaccgcggcaagtccgacaacgtgcccagcatcgaggtcgtgtgcgcccggaaggccgactggatgcgcctccggaaggcggggctgatctcacagcgcaagttcgacaacctgacgaaggccgagcggggagggctgaccgagaacgacaaggccggcttcatcaagcgccagctggtggagacccggcagatcaccaagcacgtcgcccaggtgctggacgcgcgcttcaacgccaagcacgacgagaacaagaaggtgatccgggacgtcaagatcatcaccctcaagtccaacctggtgagccagttccgcaaggacttcaagttctacaaggtgcgggagatcaacgactaccaccacgcccacgacgcctacctgaacgccgtgattggcacggcgctcctgaagaagtaccccaagctggcctcagagttcgtgtacggggagttcaagaagtacgacgtgcgcaagttcatcgccaagagcgacaaggaaatcggcaaggccaccgccaagtacttcttctactccaacctcatgaacttcttcaagaaggaggtaaagttcgcggacgggaccgtggtggagcggcccgacatcgagaccagcgaggacggcgagatcgcctggaacaaacagacggacttcaagatcgtccgcaaggtgctgtcctacccccaggtgaacatcgtcaagaagaccgaggtgcagacccacgggctggaccggggcaagccgcgcggcctcttcaacgccaaccccagccccaagccgaagcccgactccagcgagaacctggtgggggtcaagcggaacctggaccccaagaagtacggcgggtacgccggcatctccaacagctacgccgtgctcgtgaaggcgatcatagagaagggggtcaagaagaaggagaccatggtgctggagttccagggcatctccatcctggaccgcatcacgttcgagaaggacaagagagccttcctcctgggcaaggggtacaaggacatcaagaagatcatcgagctgcccaagtactctctcttcgagctgaaggacggctcccgccgcatgctggccagcatcctctccaccaacaacaagcgcggggagatccacaagggcaacgagctgttcgtgccgcagaagttcaccaccctgctctaccacgccaagcggatcaacaaccccatcaacaaagaccacatcgagtacgtcaagaagcaccgggacgacttcaaggagctgctgaactacgtgctcgagttcaacgagaagtacgtgggagcgacgaagaatggcgagcgcctgaaggaggccgtcgccgacttcgacagcaagagcaacgaggagatctgcacctccttcctgggggccgtgaatagcaagaacgccgggctgttcgagctgacctccctgggcagcgcgtcggactttgagttcctaggggtgaagatcccccggtaccgcgactacaccccgagctcgctgctgaaggacagcacgctcattcaccagtccattaccggcctgtacgagacccggatcgacctgagcaagctcggggaggactga

SEQ ID NO: 7868 - RNA, 4161 nt, synthetic construct; identical to SEQ ID NO: 2068
  misc_feature 1..4161: note = Cas9 variant
  source 1..4161: mol_type = other RNA

SEQ ID NO: 7869 - RNA, 4164 nt, synthetic construct; identical to SEQ ID NO: 2069
  misc_feature 1..4164: note = Cas9 variant
  source 1..4164: mol_type = other RNA

SEQ ID NO: 7870 - RNA, 4167 nt, synthetic construct; identical to SEQ ID NO: 2070
  misc_feature 1..4167: note = Cas9 variant
  source 1..4167: mol_type = other RNA

SEQ ID NO: 7871 - RNA, 4167 nt, synthetic construct
  misc_feature 1..4167: note = Cas9 variant
  source 1..4167: mol_type = other RNA
atgaccaagccctacagcatcggcctggacatcgggaccaattccgtgggatgggccgtcatcacggacaactacaaggtgccgagcaagaagatgaaggtgctcgggaacacctctaagaagtacatcaagaaaaacttactgggcgtcctcctgttcgacagcgggatcaccgccgagggccgccggctgaagcgcaccgcgcggcgccggtacacgcgccggcgcaaccggatcctctacctgcaggagatcttctccaccgagatggccaccctggacgacgcctttttccagcgcctcgacgacagctttctggtgcccgacgataagcgggactccaagtaccccatcttcggcaacctggtggaggagaaggtctatcacgacgagttccccaccatctaccacctccgcaagtacctggccgatagcacgaagaaggccgacctgcggctcgtgtacctggcactggcccacatgatcaagtaccgcgggcacttcctcatcgagggcgagttcaactccaagaacaacgacattcaaaagaacttccaggacttcctggacacctacaacgccatcttcgaaagcgacctgtccctcgagaacagcaagcagctggaggagattgtgaaggacaagatttccaagctggagaagaaggaccggatactcaagctgttcccgggggagaagaacagcggcatcttctccgagtttctgaagctcatcgtcgggaaccaggccgacttccggaagtgcttcaacctggacgagaaggcgagcctgcacttctccaaggagagctacgacgaggacctcgagaccctgctgggctacatcggcgacgactactccgacgtgttcctcaaggccaaaaagctatacgatgccatcctgctcagcgggttcctgaccgtgaccgacaacgagaccgaggcgcccctgagctccgccatgatcaagcggtacaacgagcacaaggaggacctcgccctgctgaaagagtacatccgcaacatcagcctcaagacctacaacgaggtcttcaaggacgacaccaagaacggctacgccggttacatcgacggcaagacgaaccaagaggacttttacgtgtacctgaagaacctgctcgccgagttcgagggagccgactacttcctggagaagatcgaccgggaggacttcctgcgcaagcagcggaccttcgacaacgggtccatcccctaccagatccacctccaggagatgcgcgccatcctggacaagcaggccaagttctaccccttcctggccaagaacaaggagcgcatcgagaagatcctgaccttccggatcccgtactacgtgggccccctcgcccgcgggaacagcgacttcgcctggtccatccggaagcgcaacgagaagatcaccccctggaacttcgaggacgtcatcgacaaggagagctccgccgaggcgttcattaaccggatgacgagcttcgacctgtacctgcccgaggagaaggtgctcccgaaacactccctgctgtacgagaccttcaacgtgtacaacgagctcaccaaggtccgcttcatcgccgagagcatgcgggactatcagttcctggactccaagcagaagaaggacatcgtgcgactgtactttaaggacaagcggaaggtgaccgacaaggacatcatcgagtacctccacgccatctacggctacgacgggatcgagctgaagggcatcgagaagcagttcaacagctccctgagcacgtaccacgacctcctgaacatcatcaacgacaaggagttcctggacgactccagcaacgaggccatcatcgaggagattatccacaccctcaccatcttcgaggaccgcgagatgatcaagcagcggctgtccaagttcgagaacatcttcgacaagagcgtactgaagaagctctcccgccggcactacaccggctgggggaagctgagcgccaagctgatcaacggcatccgcgacgagaagtccgggaacacgatcctcgactacctgatcgacgacggcatcagcaaccggaacttcatgcagctaatccacgacgatgcgctcagcttcaagaagaaaatccagaaggcccagatcatcggggacgaggacaagggcaacatcaaggaggtagtgaagtccctgcccggcagccccgccatcaagaaggggatcctgcagtccataaagatcgtcgacgagctcgtgaaggtcatgggcgggcgcaagcccgagagcatcgtggtggagatggcccgggagaatcagtataccaaccagggcaagtccaacagccagcagcgcctgaaacggctggagaagtccctcaaggagctggggagcaagatcctgaaggagaacatcccggcgaagctctccaagatcgacaataacgccctgcagaacgaccgcctgtacctctactacctgcagaacggcaaggacatgtacaccggcgacgacctggacatcgaccgcctcagcaactacgacatcgaccacatcatcccccaggccttcctgaaggacaactccatcgacaacaaggtcctggttagctccgccagcaaccgggggaagtccgatgacttccccagcctggaggtggtcaagaagcgcaagaccttctggtaccagctgctaaagagcaagctgatctcccagcggaagttcgacaacctgacgaaagccgagcgcggcgggctgctccccgaggacaaggcgggcttcatccagcggcagctggtggagacccgccagatcaccaagcacgtggcccggctgctcgacgagaagttcaacaacaagaaggacgagaacaaccgcgccgtccggaccgttaagatcatcacgctcaagagcaccctggtgtcccagtttcgcaaggacttcgagctttacaaggtccgggaaatcaacgacttccaccacgcccacgacgcctacctgaacgcggtgatcgccagcgccctgctcaagaagtacccgaagctggagcccgagttcgtgtacggcgactaccccaagtacaactccttccgcgagcgcaagagcgccaccgagaaggtctacttctactccaacatcatgaacatcttcaaaaagtccatcagcctggccgacgggcgggtgatcgagcggcccctcatcgaggtgaacgaggagaccggcgagagcgtctggaacaaggagtccgacctggcgaccgtgcgccgggtgctgagctacccgcaggtcaacgtggtgaagaaggtcgaagaacagaaccacgggctcgatcgcggcaagcccaaggggctgttcaacgccaacctgtccagcaagcccaagcccaactccaacgagaacctcgtgggcgccaaggagtacctggacccgaagaagtacggcgggtacgccggcatcagcaactccttcgcggttctggtcaaggggacgatcgagaagggcgccaagaagaagatcaccaacgtgctcgagttccaggggatcagcatccttgaccggatcaactaccgcaaggacaagctgaacttcctcctggagaagggctacaaggacatcgagctgatcatcgagctccccaagtactccttattcgagctgagcgacggctcacggcgcatgctcgcctccatcctgagcaccaacaacaagcgcggggagatccacaagggcaaccagatcttcctgtcccagaagttcgtgaagctcctgtatcacgccaagcggatcagcaacaccatcaacgagaaccaccgcaaatacgtcgagaaccacaaaaaggagttcgaggagctgttctactacatcctcgagttcaacgagaactacgtgggggccaagaagaacggcaagctgctgaactccgcgttccagagctggcagaaccactccatcgacgagctctgcagctcctttatcgggcccacgggcagcgagcggaagggcctgttcgagctgacctcccgcgggagcgccgccgacttcgagttcctcggcgtgaagatcccgcggtatcgcgactacaccccctcctctctgctgaaggacgccaccctcatccatcagtccgtcacggggctgtacgagactcggatcgacctggccaagctgggcgaggggtga

SEQ ID NO: 7872 - RNA, 4167 nt, synthetic construct
  misc_feature 1..4167: note = Cas9 variant
  source 1..4167: mol_type = other RNA
atgactaagccctacagcatcggcctggacatcgggaccaactccgtaggctgggccgtcatcacggacaactacaaggtgccgagcaagaagatgaaggtgctcgggaacacctccaagaagtacatcaagaagaacctgctgggcgtcctcctgttcgacagcgggattaccgccgagggccgccggctgaagcgcaccgcgcggcgccgttacacgcgccggcgcaaccggatcctctacctgcaagagatcttctccaccgagatggccaccctggacgacgccttcttccagcgcctcgatgacagcttcctggtgcccgacgacaagcgggactccaagtaccccatcttcggcaacctggtggaggagaaggcctatcacgacgagttccccaccatctaccacctccgcaagtacctggccgacagcacgaagaaggcggacctgcggctcgtctacctggccctggcccacatgatcaagtaccgcgggcacttcctcatcgagggagagttcaactccaagaacaacgacatccagaagaacttccaggacttcctggacacctacaacgccatcttcgagagcgacctgtccctcgagaacagcaagcagctggaggagatcgtgaaggacaagatctccaagctggagaaaaaggaccggatcctcaagttgttcccgggggagaagaacagcggcatcttctcggagttcttaaagctcatcgtggggaaccaggcggacttccgcaagtgcttcaacctggacgagaaagccagcctgcatttctccaaggaaagctacgacgaggacctcgagaccctgctgggctacatcggcgacgactactccgacgtcttcatcaaggccaagaagctctacgacgccatactgctgagcgggttcctcaccgtgactgacaatgagaccgaggccccgctgagctccgcgatgatcaagcggtacaacgagcacaaggaggacctggccctcctgaaggagtacatccgcaacatcagcctgaagacctacaacgaggtgttcaaggacgacaccaagaacggctacgccggctacatcgacggcaagacaaaccaggaggacttctacgtctacctcaagaacctgctggccgagttcgaaggcgccgactacttcctcgagaagatcgaccgggaggacttcctgcgcaagcagcggacctttgacaacgggtccatcccctaccagatccacctccaggagatgcgcgcgatcctcgacaagcaggccaagttctaccccttcctggccaagaacaaggagcgcatcgagaagatcctgaccttccggatcccgtattacgtgggccccttggcccgcgggaacagcgacttcgcttggtccatccggaaacgcaacgagaagatcacgccctggaacttcgaggatgtgatcgacaaggagagctccgcggaggccttcatcaaccggatgacgagcttcgatctctacctgcccgaggagaaggtcctgccgaagcactctctcctgtacgagaccttcaacgtgtacaacgaactgaccaaggtgcgctttatcgccgagagcatgcgggactaccagttcctcgacagtaagcagaagaaggacatcgtccgcctgtacttcaaggacaagcggaaggtgaccgacaaggacatcatcgagtacctgcacgccatctacggctacgacgggatcgagctcaagggcatcgagaagcagttcaacagctccctgagcacgtaccacgacctgctcaacatcatcaacgacaaggagttcctggacgacagcagcaacgaggccatcatcgaggagatcatccacaccctgaccatcttcgaggaccgcgagatgatcaagcagcgactctccaagttcgagaacatcttcgacaagagcgtacttaagaagctgtcccgccggcactacaccggctgggggaagctcagcgcgaagctgattaacggcatccgcgacgagaagtcggggaacacgatcctggactacctcatcgacgacggcatcagcaacagaaacttcatgcagctgatccacgacgacgccctgagcttcaagaagaagatccagaaggcccagatcatcggggacgaggacaagggcaacatcaaggaggtcgtgaagtccctcccgggcagcccagccatcaagaaggggatcctgcagtccatcaagatcgtggacgagctggtcaaggtgatgggcgggcgcaagcccgagagcatcgtcgtggagatggcgcgggagaaccagtacaccaaccagggcaaatccaatagccagcagcgcctcaagcggttagagaagtccctgaaggagctcgggagcaagatcttaaaggagaacataccggccaagctgtccaagatcgacaacaacgccctccagaacgaccgcttatacctgtactacttgcagaacggcaaggacatgtacaccggcgacgacctggacatcgaccgcctgagcaactacgacatcgaccacatcatcccccaggccttcctcaaggataactccatcgacaacaaggtgctggtcagctccgccagcaatcgggggaagtccgacgacttccccagccttgaggtggtgaagaagcgcaagaccttctggtaccagctcctcaagagcaaactgatctcccagcggaagttcgacaacctgacgaaggcggagcgcggcgggctgctgcccgaggacaaggccggcttcatccagcggcagctcgtcgagacccgccagatcaccaagcacgttgcccggctgctggacgaaaagttcaacaacaagaaggacgagaacaaccgcgccgtgcggaccgtcaagataattacgctcaagagcaccttggtgtcccagttccgcaaagacttcgagctgtacaaggtgcgggagatcaacgacttccaccacgcccacgacgcgtacctcaacgccgtcatcgccagcgccctgctgaagaagtacccgaaactcgagcccgagtttgtgtacggcgactaccccaagtacaactccttccgcgagcgcaagagtgccaccgagaaggtgtacttctactccaacatcatgaacatcttcaagaagtccatcagcctggcggacgggcgggtcatcgagcggcccctgatcgaggtgaacgaggagaccggcgagagcgtgtggaacaaggagtccgacctcgccaccgtccgccgggtgctgagctacccccaggtgaacgtcgtgaagaaggtggaggagcagaaccacgggctggaccgcggcaagccaaaggggttgttcaacgcaaacttatccagcaagccaaagcccaactccaacgagaacctggtcggcgccaaggagtacctcgacccgaagaaatacggcgggtacgcgggcatcagcaactccttcgccgtgctggtgaaagggacgatcgagaagggcgccaagaagaagatcaccaacgtcctggagttccaggggatcagcatcctcgaccggatcaactaccgcaaagacaagctgaacttcctgctcgagaagggctacaaggacatcgagctgatcatcgagctgccaaagtactccctcttcgagctgtccgacggcagccggcgcatgctggcctccatcctctctacgaacaacaagcgcggggagatccacaagggcaaccagatcttcctgtcccagaagttcgtgaagctgctctaccacgccaagcggatcagcaacaccatcaacgagaaccaccgcaagtacgtggagaaccacaagaaggagttcgaggagctgttctactacatcctggagttcaacgagaactacgtcggggcgaaaaagaacggcaagctcctgaactccgccttccagagttggcagaatcactccatagacgagctgtgcagctccttcatcgggcctacgggcagcgagaggaagggcctcttcgagctgacctcccgcgggagcgcggcggacttcgagttcctgggtgtgaaaatccaacggtaccgcgactacaccccgtccagcctcctgaaggacgccaccctgatccaccagtctgtgacggggctctacgagacccggatcgacctggcgaagctgggcgaggggtga

SEQ ID NO: 7873 - RNA, 4167 nt, synthetic construct; identical to SEQ ID NO: 2073
  misc_feature 1..4167: note = Cas9 variant
  source 1..4167: mol_type = other RNA

SEQ ID NO: 7874 - RNA, 4170 nt, synthetic construct
  misc_feature 1..4170: note = Cas9 variant
  source 1..4170: mol_type = other RNA
atgatcatccgcacctatgagctgaagaccattacgacgatcgccatactcaagatgttccagttactgaccggcgggctcagcatgaccaagctgggcaagccatatggcattggcgtggacatcgggtccaatagcatcggcttcgccgcggtcgacgagaactcccatctgatccggctcaagggcaagacggtgatcggggcccgcctgttcgaggagggtaaagccgccgccgaccggcgcgcgagccggaccacccgcaggcgcctctcccggaaccgctggcggctcagcttcctgagagacttctttgagtcgcacatcaccccgacggggcccaactttttcatgcggcaaaagtacagcgagatctctccaaaggacaaggcccgctataagtacgagaagcggctgttcaacgaccgcaccgacgccgagttctaccagcagtaccccaccatgtaccacctcaggaaccgcctgctgaccgacccgagcaaggccgacgtgagagagatctattttgcgatacaccacatcctcaagtcccgcggccacttcctgacgagcggttacgccaaggacttcaacaccaacaaggttgcactaaacgagatcttccccgccttgcaggatgcctacgcccaggtgtacccggacctggacatcaccttcgacgagaataaggtgaacgagttcaagaccgtcctgctcaacgaaaaggcgaccccctccgacacccagagggccctggtgaacctgctgctggccgaggacggcgacaaagacatcctaaagcagcagaagcaggtcctcaccgagttcgccaaggctgtggttggactcaagaccaagctgaatgtggccctcggaacggaggtcgacagctccgaggctaccgtctggaacttctctctgggccagctggacgacaagtgggccgggatcgagtccgccatgaccgacgaaggcaccgagatactcgaccagatccgcgacctgtaccgcgcgcggctgctcaacggcatcgtgccggccgggaagacgctgtctcaggccaaggtcgacgactacgcccagcaccacgaggacttagagctgttcaaggactacctgaagcagctggaggacgacggaaccgccaaggccatcaggcagctctacgaccggtacatagacggggatgatgcgaagcccttcgtgcgcgaggacttcgtgaaggcccttaccaaggaggtcaccgcccatcccaacgcgaagtcccccgagctgctcgaacggctggcccagccggacttcatgctgaagcagcgcaacaaggccaacggcgccatccccgttcagatgcagcaacgggagctcgaccagatcatcaagaaccagagcgtgtattatgactggctggccgcgcccaaccccgtcgagaagcacagaaagagcatgccgtaccagctggacgagctgctcaattttcggatcccctactacgtggggcccctggtgacggcgaaagaacagaaggccgcccagggcggcgtcttcgcctggatggtgcgcaaggaccctgatgggaacatcacgccgtacaatttcgacgagaaggtcgatagggaggcgtccgccaacaccttcatccagcgcatgaagaccaccgacacctacctaatcggcgaggacgtcttacccaagcagtccctgctgtaccagcggtacgaggtgcttaacgagctgaataacgtccgcgtgaacaacgagaagctgtccatcgagcaaaagcagcaggtcatccgggagctgtttgagagacacaacagcgtgaccatcaagcagttcgccgagaaccttcgggcccacggggactacgcccacatccccgagatccgcggcttggcggacgagaagcggttcctctccagcttgtccacctacagacagctcaagagcctgctgcccgacgccatcgacgaccctgccaagcaggccgacatcgagaacatcatcgcgtggtccacggtgttcgaggatgccgccatcttcaaaaccaagctaaaagagatcaactggctcgactcacagaccatcaccaagctgtccaacatccgctaccgggggtggggccaattcagccacaagttcctgaacggcctaaccctggggaacggccacacgataatccaggagctgttcctctcgaacaacaacctgatgcagatcctgaccgacgagaccctccagaagaagatgaccgagctgaacgccgacaagctgaaggcagccaacataaacgacgccatcgacgacgcctacaccagcccctccaacaagaaggcgctccgtcaggtgctgcgcgtcatcgaggacatcaagcgcgccgcggacgggcaggacccaagctggctgtacgtggaaaccgccgacggcgggggcacccccggcaagcgaacgcgcgcccggcaacaccagctccaggagatctacgccaacgccgcccatgagctgatcgactccgccgtgcgcggtgagctcgaggacaagattgcggacaaggccgacttcaacgatcggctcgtcctgtacttcatgcagggcgggcgagacatctacacgggcacgccgctgaacatcgaccagctgtcttcctacgacatcgaccacatcctgccccagagcctgatcaaagacaacagcttagacaaccgtgtcctggtgcacgcgatcataaaccgcgagaagaacgccaccttcgcctcaaccatctacgcccagaaaatgaacgctacgtggcggcaatggcacgaggcgggcttaatcagtggtcgcaagctccgaaacctgcaaatgcgccccgaccagatcgacaagtacgcttccggcttcgtcgcccggcagctagtggagacccgccagatcatcaagctcaccgagcagatcgtggccgcccagtatccggaaaccaagatcatcgcggtcaaggcgggactaagccaccagctgagagaggagctcgagttccccaagaaccgcgacgtgaaccactaccaccacgcctttgacgccttcctggctgcgcggatcggcacgtacctactcaaacgcttccccaacctgcaggccttcttcacctacgggaagtttaaaaaggccgacgtgaagaagctgcgcggcttcaacttcatccgggatataacccacgccgaggacaaaatcgtcgtgaaggacaccggggaggttatctgggacaagaagagagacgtcgacgagctcgacaggatatacaacttcaagcgcatgctgataacgcacgaggtgcacttcgagaaggccgacctgttcaagcagaccgtgtatggggcgaaggactccaaggaagccggcgggaaaaagcagctcataagcaagaagaagggctaccccgtcgacatttatgggggctacacccaggagaccggctcctacctgtctgtggtgcggctgacgaagaaggccatgtacgcggtcgtaaaggtatctacccgagacgcggccaagctagccgtcgccaaaagcatctccgagcagaaggagaacgagaccctgaacgacatcatcgacgagaagctgtcgaagatctccaagaacggaaagatcacccacgagttattcgaggtcgtcctcccgcgagtcgggcagaagacgctgttcaagaacagcaagtacaacctcttcctggtgaactccgacacctacatgcacaactaccaggaactgtggatgccacgcgagtaccagaagatgtggaaggacataagcctctctaagtacggggatgcccagaccgaggaccagctggaccaaatcttcggctttatcgtgagccaggtcaacagctacttcaacctgtacgacatcaaccagtttaggaagaaactcaacgacgcggccgacaagttcgccaccctgccaatgagggacacagacgacatgcagggcaagatcgccaccatcggccagctgctcattggcctgcaggccaacgcggcccggtccgatctgcgcaacctcgacatcaagacgccccttgggctgctccagatcccgaacggcatcagtctggactccgataccagcgttgtgtaccagtcccccaccgggctgctcgagcgggaggtccacctgagcgacctgtga

SEQ ID NO: 7875 - RNA, 4170 nt, synthetic construct
  misc_feature 1..4170: note = Cas9 variant
  source 1..4170: mol_type = other RNA
atggcgcgcgactacagcgtgggcctggacatcgggacctccagcgtcggctgggccgctatcgacaacaagtaccacctcatccgggccaagtccaagaacctgatcggggtgcgcctgtttgacagcgccgtgaccgccgagaagcggcgcggctaccggacgacccgccggcgcctctcccggcgccactggcggctgcgcctgctcaacgacatcttcgccgggcccctgaccgacttcggggacgagaacttcctggcgcggctcaagtacagctgggtccacccgcaggaccagtccaaccaggcccacttcgccgctggcctgctgttcgacagcaaggagcaggacaaggacttctaccgcaagtaccccaccatctaccacctccggctggcgttgatgaacgacgaccagaagcacgacctccgggaggtgtacctggccatccatcacctggtgaagtaccgggggcacttcctcatcgagggcgacgtcaaggccgactccgccttcgacgtgcacacgttcgccgacgcgatccagcgctacgccgagtctaacaactccgacgagaacctgctggggaagatcgatgagaaaaagctcagcgccgccctgaccgacaagcacggctccaagagccagcgggccgagaccgcggagaccgccttcgacatcctggacctccagtccaagaagcaaatccaggccatcctcaagagcgtggtcgggaaccaggccaacctgatggccatcttcggcctggactccagcgcgatctccaaggacgagcagaagaactacaagttcagcttcgacgacgccgacatcgacgagaagattgccgacagcgaggccctgctgtccgacacggagtttgagttcctctgtgacctgaaggccgcgttcgacggcctgaccctcaagatgttactgggggacgacaagaccgtgagcgccgccatggtgcgccggttcaatgagcaccaaaaggactgggagtacatcaagtcccacatccgcaacgccaagaacgcgggcaacgggctctacgagaagtccaagaagttcgacggcatcaacgcagcctacttagccctgcagagcgacaacgaggacgaccgcaagaaggccaagaagatcttccaggacgagatcagcagtgcggacatccccgacgacgtcaaggccgacttcctcaagaaaatcgacgacgaccagttcctgcccatccagcggaccaaaaacaacggaacgatcccgcaccagctgcaccgcaacgagctcgagcaaatcatcgagaagcaggggatctactaccccttcctgaaagacacctaccaggagaacagccacgagctgaacaagatcaccgccctcatcaacttccgggtgccctactacgtgggccccctggtcgaggaggagcagaagatcgccgatgacgggaagaacatcccggaccccaccaaccactggatggtgcgcaagtccaacgacacgatcaccccctggaaccttagccaggtggtcgacctcgacaagtccggccggcgcttcatcgagcggctaaccgggaccgacacgtacctgatcggcgagcccaccctgccgaagaacagcctcctgtaccagaagttcgacgtgctgcaggagctcaacaacatccgcgtgtccggccggcgcctggacatccgggccaagcaagacgcgttcgagcacctgttcaaggtccagaagaccgtgagcgccaccaacctcaaggacttcctcgtgcaggcagggtacatctccgaggacacgcagatcgaggggctggccgacgtcaacgggaagaacttcaacaacgccctcaccacctacaattacctggtgagcgtcctgggccgcgagttcgttgagaacccctccaacgaggaactcctggaggagatcaccgagctgcagacggtgttcgaggacaagaaggtcctccgacgccagctggaccagctggacgggctcagcgaccacaaccgggagaagctgtcccgcaagcactataccggctggggcaggatcagcaagaaactgctcaccaccaagatcgtgcagaacgcggacaagatcgacaaccagacattcgacgtgccccgcatgaaccaaagcatcatcgacaccctgtacaacaccaagatgaacctgatggagatcatcaacaacgcggaggacgacttcggagtccgggcctggatcgacaagcagaacaccactgacggcgacgaacaggacgtgtactccctaatcgacgagctggccgggcccaaggagatcaagcgcggcatcgtgcagagcttccgcatcctggacgatatcaccaaggcggtcgggtacgccccaaagcgggtgtacctcgagttcgcccgcaagacccaggagtcccacctgaccaacagccggaagaaccagctgtccaccctcctgaagaacgccggcctgagcgagctcgtgacgcaggtctcccagtacgacgccgcggccctgcagaacgaccgcctgtacctctactttctgcagcagggcaaggacatgtacagcggggagaagctgaacctcgacaatctgtccaactacgacatcgaccacatcatccctcaggcctacaccaaagacaatagcctggacaaccgggtgctcgtgtccaacatcaccaaccgccgcaagagcgactccagcaactacctgcccgccctaatcgacaagatgaggcccttctggtccgtcctcagcaaacagggcctgctgtccaagcacaagttcgccaacctcacccggacgcgcgacttcgacgacatggaaaaggagcggttcatcgcgcgcagcctggtggagacccggcagatcatcaagaacgtggccagcctgatcgactcccacttcgggggcgagaccaaggccgtcgctatccgcagctccctcaccgccgacatgcggcgctacgtggacatcccgaagaaccgggacatcaacgactaccaccacgcgttcgacgccctgctgttcagcacggtgggccagtacaccgagaactccgggctcatgaagaagggacagctgagcgactccgccgggaaccagtacaaccgctacatcaaggagtggatccacgcggcgcggctgaacgcccaaagccagcgcgtcaaccccttcggcttcgtggtggggtccatgcggaacgccgccccaggcaaactcaaccccgagaccggcgagatcaccccggaggagaacgcagactggagcattgcggacctggactacctgcacaaggtcatgaacttccgcaagatcacggtgacccgtcggctcaaggaccagaaggggcagctgtacgacgagtcccgctaccccagcgtactgcacgacgccaagtccaaggcctcaatcaatttcgacaagcacaagcccgtcgacctctacggcgggttctccagcgccaaacccgcctacgcggccctgatcaagttcaagaacaagttccggctggtgaacgtgctccgccagtggacctactccgacaagaacagcgaggactacatcctggagcagatccggggcaagtacccgaaggccgagatggtcctgtcccacatcccctatgggcagctcgtgaagaaggacggcgccctggtgacgatcagcagcgccacggagctgcacaacttcgagcagctgtggctgcccctggcggactacaagctcatcaataccctgctgaagaccaaggaggacaacctcgtcgacattctgcacaaccgcctggacctcccggagatgaccatcgaatccgccttctacaaggccttcgacagcatcctgtccttcgccttcaaccggtacgccctgcaccagaacgcgctcgtgaagctgcaggcccaccgcgacgacttcaacgccctgaactacgaggacaagcagcagacactcgagcggatcctggacgccctgcacgcgagccccgcctccagcgacctgaagaagatcaacctgtccagcggcttcgggaggctgttctcccccagccacttcaccctcgcggacaccgacgagttcatcttccagtccgtgaccggcctgttcagcacgcagaagaccgtagcccagctgtaccaggagaccaagtga

SEQ ID NO: 7876 - RNA, 4170 nt, synthetic construct
  misc_feature 1..4170: note = Cas9 variant
  source 1..4170: mol_type = other RNA
atgaagaactacaacatcagcctggtgccctccccgagcggcgtcgggtacgccgtgaccgacgacaacctcaacatcatcaagcccgtgcaccacgtctccggcattgggagccgcctgttcaacgagggctccagcaagcaggatcggcgcaactcccggagcgccagacggtcccgccaccggcagcaggggcgcatcaaggcgctgaacagcatcatgaaggacgagatcatcaaggtggaccccacattcttcgaccggctctaccagtccgagctgagccccctggacaagaacaagaagtaccgcaacatcatcttcgacaagccgtccgtggagagctactactacaagaagttccccacgatctaccacctcgagaaatacctgatcaacaccgacgggaaggccgacatccggctgatctactgggccctccactccctgctgacccaccgcggccacttctacaacaccacgcccgtcagccagttcaaacccggggccctcaacataaaggacaagttcatcgagctgaaccagctgaaccaggtgaagaccttcgagttctccgtggccaacaccccggagatcgagcacatactcaaggaccggtacatcagcaagcagaacaagatcaaccagctggcggagctcctcttcgagcaggagcccgaaaaggacatccagaaggccaacaccaaggtcgccaagacgatcgccaaggcgattctgggcaacaagttccagctggacgagatcatcgggctcgacgtgaacaagtccgagaagaaggagtggagcctgcagctgtccgacctcaacctggactccaagatcgacgagctgagcgactccttgaccgaccagcagctgcgcatcctggagatcctccaggagatgtacgcggccaccaccctgctggacatcctccaggggagcgattccctgctggacgccaagatcaagagctacaatgagtacaagcagaaccggctcctgttcttcgatctcctcaagacgctgcccgacaagaaggcgcacctcctgcgccaggggtacaccctttacctgaacaaccaccaccgggacctcgcgtccgcccgcaaggacctgggcatcgtggccgcgaccaacttcagcaagaccgacctgtacgccctcatcaagaagacgctgaaggacgagcccgagaccccagagtccaagaaggtcctgggcctgatcgacaagggggagttcctcaacaagcagcggaccgacctgaacacctacataccgtaccagctgaacgcgctcatcctgaacaaaatcctgaagaaccagggcaagcactacccctttctcatcaaggaaaaccctgccgagccggaccgcaaggaggccccctacgagatcagccagctgatgcagttcacgatcccctactactgcgggccccttgccaccccggaggagcagaaaaacctccccgagtccagccggttcggctggctggtgcgcaaggaggagggacgcatcaccccctggaacttctacaacaagatcaacgtgatagagaccgcgaacgcgttcatcaagcggtccatcgggaaggacacgtacctgctcagcgagcccgtcctgccggacaactccctgctctaccagaagtacaaagtgctgaacgagctgagctccatcagcctcgtggacgccaacaccaagaaggagaagaagctgacggccaagatcaagcagctgctctacaaggagggcttcaagaagcacgtcaccgtgtccaagacgatggccctgaagatcctgaacgacaacaacgttcccaccagcgacatcctcgggttgagcaccggcaagaagttcgacaactctctgagcacctataactcctggaaaaaggccttccccgagcagatcgacaacccccactaccgacaggacctcgagtacatgatcgagtggagcacggtcttcaccgaccggaagatcctggtggagaagctgaaagagatcgagtggctccgcccggagcagatcaagttcgtgctggagcaccggctgaccgggtggggcaagctctccaagcgcctgctggtcgagctcaaggacaacaagggcaaaagcaacatcgacaacctgttcaacaccaagaagaacttcatgcagatcgtttcccagcaggtctacaacacgcagatcgaggcgatcgccctgaagaccaccaagaaccagagcctcgacaacatcctggaggccgcctacacctcccccgcgaaccggaaggccatccgccagaccatgaaggttgtgaacgagatcgtcacgctggccgggaagggcacccaccccgacaagatcttcctcaccttccagcggtctaaagaacaggaggggaaactgaccacggaccgcgcctccagcctgctcaagatctaccggggcataaaggacccgctgtgcaccaaggagctggtggatgagctctccaagaacgtgcgcgccaacttaatcaagaccaaggagtacctgtactaccagcaactcgggcgggacgcgctgaccggcgagatcatcgacaagacggacctgcgcaactacgccgtcctccacatcatcccccggagcgtggtggtcgacgactccatcaacaacctggtgctcaccaaggtgaagaacgcgaaggagagcatcgtcgtgcagtacggatccaagaacatcagcgacatcagcatgtccgtgaaggatttctggaaccgcctccagaagctggggctgttcagcaagggcaagctccggaacctgaccaccgacctgacggagctcaaccagtacgagaagcaggggttcatcgcccgccagctggtagagaccaaccagatcgtgaagctgctcgccaccatcctgcagggccagttcccgcacaccaagatcatcgaggtgcggcaggagcagatcgcgaacatacgctaccagctggacatctaccgcctccgcgacctgaacgtctactaccgcgggatggacgcctacctggccgccgtggtgggtacgtacctctacaccgtctacccgaaggcccggcgcttcttcgtgtacggcaagtacctgaaacaagacaagaacaaccgggaggaggggcaattcaagacctccgggcacagcttcaatttcctgtggaagctgttctacgggggcgaggacgagatctacgtgcagggcaccaacaacattgcgttcaacaagaaggacctgctgcagaagattaaggaggtcaataactacaagttccagaacgtgtccctcgccacggggacacgcagaagcgacctgttcaagcagaccatctacccgcgccaggagcgcgacgtcaagaagtcccgcaccctgatcacgaagaagaacggcctcttcaccgacatctacgggggctacaccgggaacgtcaacagctacttcgtgctggtgcagaccaaatacaagaaggaccccgacaagttcaatctgtacggcgtccccaaccggtacgtggccatgctcgagcagtccaagagcaagggcaactacgagacgaagctgaaggaggtgatggagcccatcatcaaaaattccaacaagcgcatgatcgggtacaagatcctgaaggaccggatcctctacaaccagatcatcgaggacaacgggtataagttcttcatcaccagctcccagtaccgccacaacttccggcagatgatcttgagcgaccaatccaagaagatcctgatggactacgtcttcgacccgaacttctaccgccacaagaagaccgaggacgtgaacaacgacaaggacgccaagttgatcaaggtgtacgacgagatcctgtaccagatcgaccactacctgcaaatcttcaccatcgggcaccacatcgataagctcaagaaggcgcggcccttgtttgagaagtgcacgctggccgagaaggcccaggtcctgaacgacatcctcatcatcgccggcagcaaccagaccgagctggccctgaagcccctcaagaccaccaagctgacgttctccaagcagaactgccccctgaccaaggacgcgatcttctactaccagagcccgaccgggatgatcacccgcaaggaatccatcaaggacatcctcaagcagaacatctga

SEQ ID NO: 7877 - RNA, 4173 nt, synthetic construct
  misc_feature 1..4173: note = Cas9 variant
  source 1..4173: mol_type = other RNA
atgtcaaggaaaaacattgtcgaggactacgctatctccctcgacataggaaacgcaagcgtagggtgggtagccttcacccccaactacaggctcgtccgggccaagggccacgaactcattggcgcccgtctcttcgaaccagcctcaaccgcggaagaaagacgaatggcacgaacaacgcgacgacgctacagtcgcaggcgatggcgcctacgcatgctagactcgatgttcgaccaggctctctccgaagttgaccccagcttcctaatgcgacgcaaatactcatgggtacacccggaggacaagaacaacgaggcacactggttcggcggagttcttttcgactcaaacgaacaagacaaaaggttttacgagaaataccccactatataccaccttcgaaagagcctcatggaagacgacgaacgacacgacataagagaagtttacctggcgatccatcatatgatgaaatatcgaggaaactttctaaccgaaggagaactcgccccatcctcagtcttcgatgtcgaagacttcctcaaacttttaacggaaatcctccagtacgcagatgaaggcgagacggacgaagatctcgaacttcaagcagacgcaaacgggctaacagaagcactctgtaccaccaagggatcccggtcgataagggcgaaaaacgcgatcagcatactcaaagagggagcggcgctctccaagcgtcaagaggcaataatctccgctgttttcgccgggctagagggcaacaagctggacctcaccaaagtattcccgaacaaggaatacacccccgaagacaaaaagaccctggcgctctacttcaacaaagccgattacgacgaaaagagagtcgcgatcggagacagtgggttactcgaagacaacgaatgcgattttctagactgcatacgaagacagtacagcgccatcgcactcaaacaactcttgggagacttcacaagtatcagcgagagtatgtgcgcccgatacgaacagcaccagcgcaattgggacctaataaaacgctattgccgggaagagtcgaacgccgagaacataaataagaactacggtgcgctcgtcggctgggaaatagtagggggacaacggcgctccatcagaggagcgaaagactacgaaaacaaaaggaaggccgcaaacaaattcttcgaggaactcatcaaaggatccgccctccccgaccaagagaaagaaaggctgctccacgacatcgaaaacgacgaactcttccccgtgcagcgagacagcggcaacggagttatcccctaccagctgcacctgaacgagctgaagaaaataatacaaaaacaaggacgatactacccctttctactcgagacttacatcaaagatgggaaagaggtcaacaaacttgaagggctcctcgcctttagagtcccatactacgtaggcccgctagtaagtcgagacgacatgcaatcctcggacaacagggaaaaccattggatgatccgaagaaagaagggtgtgatcaccccatggaacttcgacgaaatggtagacaaggacaaatcgggacatgagttcataaaatcgctcgtaggaactgacagctacctattaggagaaacaaccctccccaagaacagcctactgtaccaagagttcgaggtactcaacgaacttaacaacgttcgtctaagcatacgcaccggcaaccactgggccgacaaacgcagagtccggttgggacacaacgaaaagaagctactcctagaggaactcttcgccaaacaggccacagtgacaaagaaagccgctgaaaacctcctaagacgaacctacggcaacacctacgagatttccgggctggcagacgaaaagaaattcgtcagctccctttcatcctacggaaaaatgtgccgaacactcaaggccagttacgtaaacagccacaaagacgtagttgagaaaatcattgagctacaaacagtattcgaagacaagaaaacactcaaacaccaacttcagcttctcggcgagctggcggaaaccaactgcgaactactcagcaacacacactacaccggctgggggaaactcagccgtaaactgctcacatccaaagtagtcgtctgcaagataggaaacgacttcgcccccgcaaaacacagcattatagaaataatgcgcgagaccgaccgaaacttcatggaaatcatcacggataaagacttaggagtaggagagtggatcaaccaacagaacgttggcgccgaggacggcaactcctaccaagacatcatcgacgacctccgcgtgtcaccaaaggtaaaacgtggaattaaccaagccatcagagttattgatgacatctctaaagctgtcggaaaggagccaagccgaatctttctagagctggccggcgacgtccagcaaagcgcaaggaccgtcagtaggaagtcccgactccaagggttatacaaaagcgccggcctacagaaagagttccgagacctagctgaatccctaaacgaatgttcagacaacgacctgcgagacgacagactcttcctttattatacacaacttggaaaagatatgtataccggcgaaccactaaacctagaccggcttagcagcgactacgacatcgaccacatcattccccaagcggtgacgcaaaatgacagcctggacaaccgcgtcctagtagcaagagtagcaaacgcgcgcaaaactgatagctttcaatatctccccgaaattgcgaatcggatgaggaacttctggcaagaactattagacgccgggctaataagccgcgtgaaattcgacagacttaacagacagaacgacttctcctcccatgaaaaggaacgcttcgtacagagaagcctcgtagagacacgacagattatgaagaacgtcgcaacaattatgcgcaaaagatacgggaacagcgccgcggtaatcggacttaacagcgaacttacgaaagaaatgagacagtacttaggattcagccacaaaaatcgggatatcaacgattaccaccacgcccaggacgcgctttgcctagggatcgccggacaattcgccgtcaacagaggatttttcgccaacggcatggtcagcgacggtgcggtgaacagttacaatctatatctgcaagattacctccgcggctacagagagaaaatgtcagccggcgaacggaggcgtaataaggccttcggattcatcgtaggcagcatgaacagtcaagactcggacaaacgaatcaaccccaaaacaggagaaatcgcatgggacgacgaggacaaggtatacctacggaaggtcatgaattatcgaaaaatgttgatcacacaaaaggtcggagacagtttcggcgcattatacaacgaaacgcgatacggaaccagcgccaaggaaggggtcaatgggataccgttcgacaaacacaagcaagacaccgcgctttacggaggcttcagctccgcaaaaaccgtctacgtggtcctcatagaggccaaaaagaaaaccagactggtcaacatcactatgcaagagtacgcagagctgggggaccaccccagcgacgacgccctacgcgcagtgttagcaaagaagaaaccagaatacggaaaagcgcggatactactccgacacatacccccaatgcaacttattcgatatggaggtgcgctagtaacagtcaaatcagcgacagagctcaataacgcacaacagctctggctcccctacaaagagtactgcctcttcgacgacgtaatttctagcgcgatcgacgtcgacgaggcccgcctctgccagatgctagacgtgatcctggacgccatccagaagtactaccccaaacaaagattcgacgagactgggctgagcgccttccacaatgcattcaacgaagtaagcgccgaagacaagaaaagaatcgtcggcgaaatggtgggaatgctccatgcagacgccaaaaatgcgaacctcaaggctctcggcatgagcggaaggtggggccgaatgagcaatcagagtggctacaccttcgccgacagcgatgagttcatcttccaaagcccttcggggcttttcgaaaagagaattagtgtgggagaactcaaaaagaggagggcacgctga

SEQ ID NO: 7878 - RNA, 4173 nt, synthetic construct
  misc_feature 1..4173: note = Cas9 variant
  source 1..4173: mol_type = other RNA
atgaaggaggtgaaggactacatcatcggcctggacatcgggaccaacagctgcggctacgtcgtgaccgacaagcaaaacaatatcctcaagctgaaggggaagacggccatcggcgcccgcctgttcaaggaaggggaggcggccgccgaccggcgcgcctttagaaccacccgccggcgcctggcccggcgccggtggcgcctcggcctgctcgaggagatcttcgacgaggagatggcgaaggtggactccagcttcttccggcgccttaaggagtccgactacagccccaaggactcccggaagcagttcaactcaatcgtcttcgagtccagcgaagccgacaaggacttctatgacaagtacccgaccatctaccacctccgcaacgccctcatgcacgacgaccagaagcacgacctgcgggagatcttcctggccgtgcaccacatcgtgaaataccgcgggaacttcctccgggaggactccgtcaaggcgttcaaggccgccaagttcacgctgcagggggaggatggcatcgggccagtggacaagctgaacgacctcctgaaggagatctacatcgaggccgcccccgagctggcgaccgacaacctcagcaagatcgaggagatcatcaaggacaagaagctgtacaagcaggacaagctgaagcaggtcgccaccctcctgaccaaggaggccgacacgaaggacaaggccaagctgaacaaggacgtggccaagcaggtcgcgaacgccttcatgggctacatgatcatcttcgacaccatcttcaacctctccgacgtggacagcaaggactacaaggtgaagttctccgacgccaacatcgacgagaagctggacaccctgaccagcctcctgacggacaagcagaccgagttcgtgctggagctccagaacatctacaacaccatcgtgctgaacgagatcgtccccgacgggaagtccctgagcgagtccatggtgaaaaagtacgacgaccacaaggaggatctcaagctgttcaaggcctacctgaacagcctcaccgacgtgaagaaggtaaaagagctgaaggccgcgtacgtgctgtacgtgaacaaccgcaaggccaacctcctggccgccaagaagctgctcggcaagaaggccgacaacatgaacaacttcgagatcttctcgaagttcgtcgcggacaacctggacgacagcgagctggccaacaagatccgggcccgcctcgacctgggcgagttcctgccgaagcagcgcacgaaccagaacggggtcatcccctaccagctccaccaggtggagctgacccagatcctggagaagcagggaaagtactatcccttcctgatcgcccccaacccggtcgaatcacaccgcaacaacgcgccctaccgcatctccgaactcgtgagcttccgggtcccctactacgtggggcccctgatcgacccgaacaacgctgagtccgagcaggacaaggccaactcatccttcgcctggatggtgagacagaagcagggccagatcaccccctggaacttcgaggagatggtcgacacgacggagagcgccaacaagttcatcaagcggatgacaaccaaggacacctacctgctcggcgaggacgttctgcccgcttccagcctgatctaccagaagttcgtgatcctcaacgagctgaacaacatcaaggtcaacgggatcaagctgacgtccgaggagaagcaccagattttcgacgagctgttcaaggtgcagaagtccgtgagcctgaagaacctggtcaacttcctcaccgcccacggctgcgtggcccccaacgtgaccggtcttagcgacggcaccaagttcaactccagctattccacgtacatcgactaccgcaagatcttcggcgccgagatcgacaacaaggacaagcaggccgacttcgagaagatgatcgagtggagcaccgtcttcgaggaccggaagatcttcaagcggaagctggaggagatcacatggctcaccccggaccagatcaagcaggtctccagcaagcggtactccggctggggccgcctgagcaagaaacttctcacgcagatcaccgacgagaacggggtgaacatcctgcagcggctgtggaacgagagcgagaacctcatgcagatcctgtccgaccccgtgatcaaggaaaagatcgtagcggccaacagctccttcaccaaggccaccgacatggaggatattctggccgaggcctacacgagcccccagaacaagaaggctatccgccaggtgatgcgggtcgtcgacgacatcatcgccgccgcccacggcaagaagccctcccagatcgcgatcgagttcgcccgcgaggaccaggacaacccgcaaatgaccaagagccggaaggcccagctcgaccaaatctatgctaagatcagtgacgagttcctggacaacgccgtgaagaacgagctgaagaacatgaaggacaacaagcccctcgcgaaggacaaggtcttcctgtacttcaagcagatggggcgcgacgcctacaccggcgaaaagctgagcctcgataacctgcaggactacgacatcgaccacatctacccccagtccttcatcaaggacgacagcttcgacaaccgggtgctggtgcagcgcgctgtcaacaacgggaagtccgacaacgtgcccgtgctcctgttcgggaacaaacaggccgccgacctgggcatgaccatccggcagatgtggaagaagtggctcgagctggggctgatcagcaagcgcaagttcaacaacctcatcaccgacccggagaagatctccagctacatggcgtccggcttcgtcaaccggcagctggtggagacgagccaggtcatcaagctggtcgccaacatcctccaggccaagctgcccgacaccgagatcatcgaggtgaaggcctcctacaacagcatcctgcgcaaggagttcaacctctacaagagccgcgaggtgaacgactaccaccacgccatcgacgcgtatctgactaccatcgtcgggaactacttatatcaggtgtaccccaagctccggccctacttcgtgtacggccagttcaagaagttcgggaaggccgagtccaaggaggacgacccggtcaagaagatcaagcagttcaacttcatctaccagctgctgtggggcaaggacgacgccatctgcatcagccacacggaccagcaggtcttctcccgcagcgacatcatcaacaagctcaccaccgcctacaacttcaagtacatgaacgtgtcccaggaggtgtacaccaacagcaacaacgtgttcaagcagacggtgttccccatcatcgagcgggacaccgcgaagtcccgcagcctgatccccaagaagctggaccggccgaccgacatctacggcgggtactccaacaacaacgacgcgtacctcgccctggtcaaggtggacaagaagaagggcagcgagtaccgcgtggtcgggatccccatgcgggccgccgcgatgctgaaggcatccaagaactatgacgaggacctccgcaaggtgatcgagcccatggtgatgctggacaagaacggcaaggccaagaggggcatcgaggggttccgcgtcctggtgggcaagatgcccttcaagcaggccgtgctcgacggggacaagaagttcatgctgaccggcacgaacgacatgccgaacctgaagcagctcgtcctcagtcagcagaacatgaagtacatcctggactacatcgacgacatcgactgccggaagcacaagttcgggaacaagacccaggacggcaacaagtgcctcctggaggtgttcgacgagatcatccagatcgtcgacaagcacttcgagctgttcgacaacaggtccttccgggagaagctccgcaacagccgggtgaacttcatcaacctggccctgtccaagaaggcggaagccctcctggccatcctgaacggcctccacgccaacagcatgcgtaccaccatcaaggagctgaagatctccgacctggggcggatacagagctccgtgatctcgcccgaggcccagctcatctaccagagcccgacgggcctgttcgagcgccgggtgaaggtgaaggacctgtga

SEQ ID NO: 7879 - RNA, 4176 nt, synthetic construct; identical to SEQ ID NO: 2079
  misc_feature 1..4176: note = Cas9 variant
  source 1..4176: mol_type = other RNA

SEQ ID NO: 7880 - RNA, 4176 nt, synthetic construct
  misc_feature 1..4176: note = Cas9 variant
  source 1..4176: mol_type = other RNA
atgaaggagatcaaggactacatcatcggcctggacatcggaaccaacagctgcggctacgtggtcaccgacaagcagaacaacatcctcaagctgaaggggaagacggccatcggcgcccgactgttcaaggagggggaggcggccgccgaccggcgcgccttccggaccacccgccggcgcctcgcccggcgccggtggcgcctgtccctacttgaggagatcttcgacgaggagatgaacaaggtggaccccagcttcttccggcgcctgaaggagagcgactacagcccgaaggaccggcgcaagcagttcaactccatcgtattcgaaagcagcgaggcggacaaggccttctacgagaagtaccccaccatctaccacctccggaacgccctgatgcacgacaaccaaaagcacgacctgcgcgagatcttcctggccgtccaccacatcgtgaagtaccggggcaacttcctccgcgaggacagcgtgaaggcgttcaaggcagccaagttcactctgcagggcgaggacgggatcggccccgtcgacaagctgaacgacctcctgaaggagatctacatcgaggccgcccccgagctggcgaccgacaacctctccaagatcgaggacatcatcaaggacaagaagctgtacaaacaggacaagctgaagcagatcgccaacctcctgccgaaggccgtggacagcaaagacaaggccaagctgaacaaggacatcgccaagcaggtagcgaacgccctcatggggtacatgttccggctggacaccctgttctccttcaccgacgtggacgtgaaggactacaagctcaagttctcggacgccaacatcgacgagtccctggacgccctgacgagcctcctgaccgacgcccagatcgagttcgtgctggagctccagtccatctacaacaccatagtcctgaacgagatcgtgcccgacggcatgagcctgtccgagagcatggtgaagaagtacgacgaccacaagaaggacctcaagctgtacaaggagtacatcgactccctgagcgaccagaagaaagcgaagcagctcgaggccgcctatgccctgtacgtcaactaccgcaaggccgacctgctcgcggcaaagaagctgttcgagaagaagaaaatcggggacaagaagttcgtggacgtcatcagcaacttcgaggtattcggcaagttcgtgagtgacaacctggacgacagcgagctagccaacaagatcaaggcccggctggacctgggcgagttcctccccaagcagcgcaccaaccagaacggggtgatcccctaccagctgcaccaggtcgagctgacccagatcctggagaagcagggcaagtactacccgttcctcatcacccccaaccccgtggagtcccaccgcaacaacgcgccctacgagatcagcgagctggtgtccttccgggtcccgtactacgtggggcccctgatcgacaaccagagcatcaaggacaagcagaacaagaacaagttcgcctggatggtccgccaaaagcagggccagatcaccccctggaacttcgaggagatggtggacaccacggagtccgccaaccagttcatcaagcgtatgaccagaaaggatacctacctcctggccgaggatgtgctgcccaagagctccctcatctaccagaagtttatgattctggacgagctgaaccggatcaagatcgacggcaagaagctcaccagcaagctgaagcacgacatcttcgagaagctgttcaagaagcagaagtccatcaacctcgacaacctgaagaattacctgctcgccgaggggaacatcccgggcctgatcgaggggctaagcgacggcatcaactttaacaactccttcagcacgtacatcgactataggaacatcttcggggacgagatcgacaaccccaacaagcaggcggacttcgagaagatgatcgagtggtccaccgtcttcgaggaccggaagatcttcaagcgcaagctcaaggagatcacttggctgacccccgagcagatcaagcaggtcagctccaagcgatacagcggctggggccgcctgtccaagaagctcctgacgcagatcaccgacgagaacggggtgaacatcctgcagcggctctggaacgagcccgagaccctgaccgaggtgctggccaacccggtgatcaagcgcaagatcagcgaggccaacagcctcttcgtgcagatcaacaaggtcgagaacatcctggacgacgcctacacgagcccccagaacaagaaggccatccgccaggtgatccgggtggtcgacgacatcatcgcggccgcccacggaaagaagcccagccagatagccatcgagttcgcccggtccagccaaaacaaggcgaaggtgcccgacacccgcaagaagcagctggacaagatctacaacaagatctccagcgaaatcctcgactcctccatcaagaacgagctgaagaacctgaagtccaacaaatacctcagcaaggacaaactgttcctctacttcaagcagatggggcgggacgcctacaccggagacaagctctccctggaccagctgcagaactacgacatcgaccacatcttcccgcgcagcttcatcaaagatgactccctcgacaaccgggtgctgacccagaagccaataaacgccaagaagtccgactacgggatccccgccctggagttcggcaacaagtacgtccccgacctcggcatcacggtgaaggagatgtggaagctgtggcaggagaacggcctgatcagtaagagcaagctcatcaacctgtgcaccaacccgaagaagatcggctccaagagggcgtcagggttcataaaccgccagctggtggagaccagccaagttatcaagctcgtggctataatcctgcaggccgagttccccgacaccgagatcatcgaggtgaaggccctgcagaatacgaccctccgggaatccttccacctgtacaagaatcgcagcgtcaacgactaccaccacgccatcgatgcgtacctcaccaccatcgtgggcaactacctctaccaggtgtaccccaaactgcggccgtatttcgtctacgggcagttcaagaagttcaatcaggagaagaatatcgacatcctgaagcggctaaagaacttcaacttcctgcggcagctgatcttcaacaccgacgacaacatctacatctccggcacgaaggagatcgtgttcaacaagaaggacatcatccacaagctcgaaaccgcctacggctacaagtacatgaacatcagccgcgagtgctaccaggagacctcctctctgttcaaccagaccctgtacgcccacaacagcagcgtgaagaactccctcattcccaagaagaaggggctgcccacggagatctacggcgggtactctggcaacaaggactccttcttcgtcctggtgaagatcgtgaagaagcggaccaacctctaccgcatcgtcggcatccccaccagagagctggccaagctgaacagctccaacaactacaaccaggccctcaacaagatcgtggagagcaagctgtgcctgaaggagaccgagtccttcaagatcctcatcaagcgcctgctgtacgggacgctcatcgtggacaacggccagaagttccggatcgggagcttcaaggagaagcacaacgtccagcagctggtgctgcagctcaagtccatgaagtacatcaagttctacatcgatggcgggcagaactacttcacagacgtggagcgcaagaagctggagaagcaggaccgggacaagtgcctgctctacgtcttcgacgacatcatgaacgtggtgaacaagcgcttcaccctgttcgacatgagcaagtacgagaaggacggcgactccctgcgggagaagttcaactgcctcgacttcaacgacaaggtaagtatcctgagcgacctgctcaaagcgttccacgccaactccgaccgcaccagcatcacgaagctgaagatcaccaacctgggccggcaccaggccgggaagaacggcatcaccctcaccacgaacgcccagataatctaccagtccccgaccgggctgttcgagcgccggatcaagatcaaggacctgtga

SEQ ID NO: 7881 - RNA, 4176 nt, synthetic construct
  misc_feature 1..4176: note = Cas9 variant
  source 1..4176: mol_type = other RNA
atgaagaagatcctgggcctcgacctggggaccaacagcatcggctgggccctggtgaacgaggccgagcacgagcacgagcagtccagcatcgtcaagctcggggtgcgcgtgaaccccctgtccgtcgacgagaagaccaacttcgagaagggccggccgctgagcatcaacgcagaccgcacgtctaagcggagcgcccgccggaacctccagcgctttaagctgcggcgcaagaacttgatcaacctcctgctgaagcaccacatcatctccaacgagaccatcctcaccgaggtggggaagaacaccacccaccagaccctgaagctgcggagcaaggccacccaggagaagatcagtctcgaggagttcgcccgcatcctgctgagcatcaataagaagcggggatacaagtccagccgcaaggagaaaaacgaggacgagggcttcaccatcgacgggatggccatcgcgaaggagctctacgacaaccagctgacgccgggccagtacgtgtacaacatcctgcaggacgggaagaattacatccccgacttctaccggtccgacctccaggccgagttcgacgacgtctggcagttccagaagaagttctacagctccatcctgaccgacgagttctacctgaagctcaagggccaggggaaggagaacacccgcaagctgttcctggccatccaccaggtgtacaccgccgagaacaagggcaagcgggacgcggtgaagctccagtactacaagtggcgcagcgaggccgtcaagaagcaactgtccatcgaagaggtggcctacgtgctggtggagatcaacaacaacatcaacaagagctccggctacttgggggccatctcggaccggagcaaggccctgtacttcaacaacgagacggtgggtgagtacctgtacgggcagctcgtgaagaaccgccacaactccctgcggaaccaggtcttctaccgccaggactacctggacgagttcgagaagatctgggagacccaggcgaagttctacgatgagctcaccaacgagctgaagcaggagatccgggacgtggtgatcttctaccagcgcaagctcaagtctcagaagcacctcatctccgactgcctgttcgagaagcaccacaaggccatccccaaaagctccccgctgttccaggagttcaagatctggcagaacctcaactacctggagttcgtccacacccagagcaaggagaagatcttcttctccgagctggacgacgagacccgccagttcgtgttcgccgagctcaacatccggggcaccctgaagataaaggagatcaagaaactgatcggcctcgagacccccgtgtactggaagtccaactttgacgagatcgaagggaaccgcaccaaccaggtcctgtacaacgtgtaccagaacatcgccgacgacctgggctatgggttcgactggagcaagaagcacgccttcgagataaacgcggagctgcaggccatcttcaaggacgtgggcatcgacacggccatactcaacttcgacgccagcatcgaggagaacgacttcgacaaacagaaatcctaccagctgtggcacctcctgtacagcgccgaggacaccgacaaggcgaccgaggaggacaagctgatctacgggaacatcaacaccaagctgaagaagcagctccaccagaagtacggcttcgaggccaagtacggcaacctgctggccaacatctccctacagcaggactacgggaacctgagcgccaaggccatcaagaagatcctgccctacctcgagtccggcaacagtttctacgaggcgtgcacgatcgtcgggtacaacccctccaacagcctgaccaaggagcagcagcagaaccggaagctcaaggacaagctcgagctgctgccaaagaactccctccgcaaccccgtggtcgaaaagatcctgaaccagaaggtgaacctgatcaaccagctaatcgacgagtacggcaagcctgacgaggtgcggatcgagctggcccgcgagctgaagaagtccgccaagcagcgggccgacctcagcaagcacatcaacgacgcgaccctgaagaaccagaacatccgcaagaccctgcagaaggacttcgggatccagaaccccagcaagaacgacgtcatccgatacaagctctacgacgagctgaaggacaacggctacaagactctgttcaccaacaagtacatcccgaaggagcagctgttctctaaggacgtggacatcgagcacatcatccccaaggccatcctgttcgacgactccttcagcaacaagaccctggcctaccgcaacgtgaacctcgccaaggccgacgcgaccgccttcgacttcatctccagcaagcacttagacgacctggacaactacaaggcccgggtcgagaccctcttccagtccaagcgcatcagcaagggcaaatacaagaagctgctgatgacccggcagaacctccctgaggactttatcgagcgggacctgcggaactcccagtacatcgccaagaaggccaccgcgatgctgaaggaggtgttccgcagcgtggtccccacctccgggcggatcacggacaagctccgtgaggactgggacctggtgaacgtgatgaaggagctgaacctcccgaagtaccggaccctgggcctgaccgagttcatcgagcgcaagaacgggaacaagatcgagcaaatcatcgactggaccaagcgcaacgaccaccggcaccacgccatggacgcgctcaccgtcgccttcacgacccacaaccacatccagtacctgaacaacctgaacgtgacgcacggtctcaacggggtggacaccgatcacgagaagtcccgcctgtatgccatcaagcaggcgatcacaaaggtctacatcgtgggcaagaccaagaaacggaagttcatcccgcccatggagaacttccgcagccacgccaagaaccacctggagggcatcctcatcagcttcaaaaataagaacaaggtggtcactaagaacaagaaccggaccaagacgaagaccaagggggtgttcaacgagaagatccagctgacgccccgcggccaactgcacaaggagaccatctacggtcacgccaagaaagtgatcgtcaccaaggagaaggtgtccagcaagttcacccacgagaagatccttcaggtgaccaaacccgcctaccgggaggcgctgctgaagcgcctcgcctccttcaagaacgaccccaagaaggccttcagcggcaagaacgccctgagcaagaaccccctgtactttgacatcacctccggcaagaaggtccccgacacggtgaagctcagctacttcgagaactcctacgtgatccggaaggaggtcaacagcgacaacttcaagaacgagaagtccctgcagaaggtgctggacgtggggatccgtcggatcctagagaagcgcctggccgactacaacggcaatgcgaaggaggccttcagcaacctggagaagaacccgatctggaaggacaaggagaagggggtctgcatcaagaaggtgcggatcgaggccctcaagaacgccgagcccctgcacgtgaagaaggaccacctgggcaagatcatcctcgacgacgagaacaagtccacccccgtcgacttcatcagcaccgggaacaaccaccacgtggccatctacgaggacaaggacggcaagctgcatgacaaggtggtctccttctacgaggtggtgagccgcgtcaacctgggcctacccattatcgacaagtccttcaacagccacctggattggaaattcctgttctccatgaagcagaacgagatgttcgtgttcccgagcgaggacttcaaccccaaggaaatcgacatcgggaaccccaaaaacaacgagctcatctccaagtacctgttccgggtgcagaagttcagcaaggtcacctacggcaactccgcggtgcgcgactacgtattccgtcaccatctggagacggagctcatcgacaagaaagagctgaaggggatcacctactaccagctcaagagcatcggcatgctggaaaagctggtcaaggtgcgcatcaaccacatcgggaagatcgtgcacatcggcgagtactga

SEQ ID NO: 7882 - RNA, 4176 nt, synthetic construct
  misc_feature 1..4176: note = Cas9 variant
  source 1..4176: mol_type = other RNA
atgaagaccatcctgggactcgacctggggaccaacagcatcggttgggccctggtgaaggaggccgagaacgagaacgaggtctccgacatcatcaagctcggggtgcgcgtgaaccccctgacggtcgatgagttaaccaacttcgagggcgggaaggcgtacagcaacaacgccgagcggaccctcaagcgcggcgcccggcgcaacctgcagcggtacaagctgcgccgggagaacctcatcgagatcctgctgaagaacggcctcatcaacaaggacaccgccctgacggaggtggggaaggagaccactcaccagaccctgaagctccgctccaagagcgccaacgagaaggtgtccctggaggacctggccaagatcctcctgagcatcaacaagaagcggggctacaagtccagccgcaaggtcaatgccgaggacgacggggtagccatcgacggcatggaggtggccaagctgctctacgacgaaaacatgacgccgggggagtacgtcctgcggctgctcgagtccggcaagaaacacctccccgacttctaccgcagcgacctgcaggaggagttcaacctcgtgtggaagaagcagtccgagttctaccccctgatcttaaccaaggagctgttcttcgagctgcacggcaagaacaagagccagacctgggcgatctgcaaggagcccctggggatcgtgggcgtcaaactcaaggggtccgccaaggagcagaagtttgcccggtaccgcctgcggaaggaggccttaacccagcagatcgagctcgagcacctggccatcgtgctgcaggacatcaacaacgacagcaacaagtccagcggctacctcggcgcgatctccgaccgcagcaaggagctgttcttcaacaaggagacggtggggcagtaccagtacaagcagctgcagaaggacccgaacacctccctcaaaaaccaggtcttctaccggcaggactacctggacgagttcgaagttatctggcgcaaccaggccaaattctacccccagctgaccaacgagctcaagcaggagatccgggacgtggtcatcttctaccagcgcaagctgaagtcccagaaaaacctgatctccttctgccagttcgagtccacccagcagaactacgtggagaaggagacgggaaagaccaagatccggaccatcgggcgccgcgtgatccccagaagctctcccttgttccaggagttcaagatatggcagagcctgaacaacctgaagttcgtcaactccgagagcaaccagatcatccagttcatcgagcttgaggacgacgtgaagaaggtggtcttcgacgagctcaacctgcgcggcgacttaaagccgaaccaggtgctcaagatcctgtccaagtacatgaagatcgggaagctgacccaatggaagtgcaacctcgaggagatcgagggcaatcggacgaacagcgccctctacaacgtcttccagatgatcgccgaggaggagggctatgggttcaactggggcaagaagtccgccctggagatcaagagcgagctcaaggcgatcttctccagcatcgggatcaacgactccatcctggacttcgacttcagcaagaaacttgaccagcagctctcctatcagctatggcacctcctgtacagcgccgaggagggcaactccaaaatcaccgaggaggacaagttcacctacgggaacaccggtgtggccctgaagaagaagctgcacctcaagttcggcttcaagcccgagtacagcacgctgatctccaacctgcgcttcaccagcgactacgggaacctcagctccaaggccatcagcaagatcctgcccttcctgcgggacggctccgactacagcaaggcctgccagtacgccgggtacaaccactccaacagcctctccgccgacgagctggacaaccgcgagctgaagcccaagctcgagctgctgaagaagaacagcttgcggaacccggtggtcgagaagatcctgaaccagatggtgaacgtggtcaaccaggtgatcgacaattacggcaagcccgacgaggtgcgcatagagctcgcccgggagctcaagaagtccgccaaagagcgcagccagatgaccaagaatatcagcgacgccaccaggcgcaacgcggagatcaagaagtacctgagcaaggagttcgggatccccaaccccacgaagggcgacgtcatccgataccgcctgtgggaggagctagcttccaacggctataaggacctgttccgcgacaagtacatcccgaaggagaagctgttcagcaacgagatcgacatcgagcacatcatccccaaggccctcctgttcgacgactccttctctaacaagaccctggcttttaaggtggacaacctcaagaaggctgaccgcacagccttcgacttcatgtccactgacttcagcaaggacgtggacagctacatcgggcggatcgagacgctgcacaaggacggcaagatctccagctccaagtacaagaagctgatgatccccaagagcaagctcgtcgacgggttcatcgagcgcgacctgcggaacacccagtacatcgccaagcaggccaggaagatgctgctcgaggtgttcaagaccgtggtccccaccacggggaagatcaccgacaagttacgcgaggactgggacctgatcaacgtgatgaaggagcttaacttcccaaagtacaaggccctgggcctgaccaaaaagatcgagcggttcgacgtggggtccgagaagatcaagagcatcaacgtcatcgagggctggtccaagcgcaacgaccaccgtcaccacgcgatggacgccctcgccgtggccttcaccacccacaatcacatccagtacctgaactacctgaacgctcgcaaggacatccaccacgagatgcacgggacgattaagagcatcgagaaccagatcatcggcaaggacgtcatggggaaacggcgcttcatcccgcccatctccgacctccggatgaaggcgaaactgcaaatcgagagcatcctaatctccttcaagaacaagaacaaggtcgtgacctggagcgtgaacaagaccaagctcaagggcaaggataactacaacaagcgccggcagctgacgccccgcggccagctgcacaaggagaccgtttacgggaagatcaagctcatcgaccccaagcccctgaagctgaacaacaagttcaccctcgtgcgggcgtccatgatcgtggacaaggtccaccgcgagatcgtgctgcagcacctgagcaagtacgacaacaactccgaggtggccttcgacagcaagaccatcaagatcgaccccatcctcatcgagggcatcgggctgaaggaggtcgtgtgctacgaggacgtgttcaagatccggaagaagatctccggcgacaacttcaagaacgagaaacacctggagaaagtcatcgacgagaaggtgaagcagatcctcaaggaccgcgtgatcaagttccaggggaacttcaaggaggccttcagcaacctggaggagaacccgatctggctgaacaagtccaagggcatcgccgtcaagagcgtggcgattaagggcgtgaacaacgccgagagcctccacgaggggaaagaccacttcggcgaccagatcctggacaagaacaagaagcagatcccggtggacttcgtgtccaccgggaacaaccaccacgtgggcatctacgaggacaaggacgggaacctgcaggagcgggtcgtgagcttcttcgaggccgtgacgcgcgttaacgagggcctccccatcatagacaagacctacaactccgacatcggctggaagttcaagttcaccatgaagcagaacgagatgttcgtgttccccagcgacgactttgacccgaacgagttcgacctgaccgatgggaagaacgccgcgaagatctcccccaatctgtaccgggtgcagaagatcgccacgaagaactacatgttccgccaccacctcgagaccgtcgtgaccaacgacctggagttcacctacaaatcaatccggtccacgggctggctgcgcaacttagtgaaagtccggatcaaccacctgggggagatcgtgtacgtcggcgagtactga

SEQ ID NO: 7883 - RNA, 4176 nt, synthetic construct
  misc_feature 1..4176: note = Cas9 variant
  source 1..4176: mol_type = other RNA
atgaagaagatcctgggactcgacctggggaccaccagcatcggctgggccctggtgaacgagaaggagaacaacgaggagctatccagcatcatccgcctgggggtccgggtgaaccccctgaccgtggacgagaagtctaacttcgagaagggcaaggacatcaccaccaacgccgaccgcaccaagtgccgcagcgcgcgtcggaacctccagcgcttcaagctgcggcgcgaggccctggccgactgcctcaagcggcacgggctgatgacggacgagaccccgctgtgcgagaccaacaactccatcatcttcaagacctacagcaaccgcgccaaggccgtctgcgagaagatcgcgctcgacgacttcgtgcgggtgctgttcatgataaacaagaaacgcggctacaaatccagccggaagctgaacacggacgacgagggcaccctcgtcgacgggatggacgtggccaagctgctgtacaacgagcagatcaccccaggcgaatacctcctgcgcctgttcaagaaggggaagaagacccggcccgacttctatctctccgacctgaaggccgagctggagcgcatctgggacttccagcggacgttctaccccgagatcctctgcaacgccctgaaggaggacctgaagggcaagagccgcacacaatccagcgcgatcttctacgcaaagtacaaagtgtccaccgccaagatcgccgggaaggacaagcggctccaggagctgacctggcgcacggacgccctgcggaaacagctcaccatagacgaggtcgcgtacgtgatctgcagcatcaacggcgaggtgaacggctccagccagcgcctgtccatgatcagcgaccgctccaagctgctctacttcaaccaccagaccatagggcagtacctgatgcagcggctggaggagaacccgaacgccggcctcaagaacatcatcttctaccgccaggactacgaggacgagttcaacgacatttggaacagccaggccacctaccacaaggagctgacgcccgagctgaagaaggaggtcaaggacatcatcttctaccagcgggggctcaagagctgcaagtggctgatcaactactgcgagctggagcatgaggagatcgaggtgaagacccccgagggcaagctccgcaagatcaccatcggctccaagacctgcccaaaaagctccccgctgttccaagagttcaagatctggcaggtcctgaacaacctccaggtgagccccctgaactcccggcgcaaggccaagcggaagaaggacgaggagcccagcctgttttccgacgaggacatgaacacggcctgccgctacctcaacgaggaggagaagctgaccctgttcaaggagctgagcatcaagaaggagctcaagaagaaggacgcgctgaagctcctgttcgagaattacaaggagctggacctgaactacaaagtgatctccgggaacgtgaccatggccaatctctacagggccttccaggacatcatcagcctgaccggcaacggggagttcgacttccaggcaatgcccgccgaggaggcagagaagacggtcgaggagattttcggcgggctgggctacaagacagccttcctccacttcgacgcctccctgcacgacaaggagttcgagcgccagccggcctaccggctgtggcacctcctgtacagctatgccggcgaccagtccaagaccgggatcgaggctctggtgaagcgcatccaggagctctgcggcttcgagcccgagtacgcccggatcctggccaatatcagcttcatccccgactacggcaatctgtccagcaaagccatgcgcaagatcctcccctacatgcaggacggctacgaatactccgaggcgtgcagcaaggccgggtaccggcactccgccagcagcctgaccaaggaggagatcaacaagaagaactacaagacgcacctggacgagatcaagcgcaactccctccggaacccgatcgtggaaaagatcctgaaccagatggtcaacgtggtgaacagcgtcatcgacacctactccaacatcgacgagatcagaatcgagatggcccgggagctgaagaagtccaagcccgagcgcgaggacatgagcttcgccatcagcaaggcgaccaaggagaccgagcgcatcaagggcatcctcgagcaggagttcaagatccagcacgtgacgcggaacgacatcatccgctaccggctgtacgaggagctgaagcccaatggctacaagaccctctattccaacacctacatcccccgcgaggacttgttcagcaagaagttcgacatcgagcacatcatcccgaaggcccgcctgttcgacgactcctacagcaacaagaccctcgagctgcgcgatatcaacatcgagaagggcaaccagaccgcctacgacttcgtcctgtccaagtacggcgaggaggggctctacaagtacgagcagcgggtggaggagttcaagaagaataacgagcaggcaggcacgaagtgccgcaagctgctgatgcgggaggccgacatccccagcgacttcctcaaccgcgacctgaacgactcccagtacatcgcgaagaaggcccacgagttgctccgggagatcgtgcccaccgtcaccgccaccacggggagcatcaccaaccgcctgcgggaagactggaagctggtgaacgtgatgaaggagctcaattgggagaagtacgacaagctgggcttgaccgaggagtacaaggataaggacggcaacaccgtccgccacatcaaggactggacgaagcggaacgaccaccgccaccacgccatggacgccctcaccatcgcgttcaccaagccctccttcatccagtacctgaacaacctgaacgcccggagcaaccgcgggggctccatctacgggatcgagcagaaggagctcgagcgggagaacaataagctggtgttcatcccgcccatcgaccccaagatcttccgcaagcaggccaaggagcacctgagcaacatcctcatcagcatcaaggccaagaacaaggtggtcaccaagaacgtgaacaagacgaagtccaagagcggcaccaaccggaaggtgcagctgacgccccgcggccagctgcacctcgagaccgtctacgggaagatccgcacctacaagaccgaggagatcaaggtgggcaccaagctgaccgaggagctgatcgcgaaggtggccgacaagaagatccgggaggctctcatgcagcgcctgtccgagtacgggggcaacatcaagaaggcgttccagaacatcagcaagcacccgatctggctgaacgggtcccacacgaagcacgtccccgagaaggtgaagatcgtgttcttcgaggacgttttcaccatccggaaggccatcaccccagacatcaagatcgacaaggtgatcgacagcaagatccgccggatcctccaggagcgcctgaacgagttcgggggcgaggcgtccaaggccttcagcaatctggacgagaacccgatctggttcaaccgggacaaggggatcgccatcaaatccgtgaagatccgcggcatcgccaaggggaccgccatccgggtcaagaaggacatccacggcaagacgatcatcgggaacaacggataccccgtggcgaatgactacgtgaacaccggcaacaaccaccacgtcgccatcttccgcgacaaggatgggaacctccaggagcacatcgtgagcttctacgaggccaccgcgcgggccatccagaaccttcccatcgtggaccgcaactacaactccgagaaggactggaagttcctgttcagcatgaagcagaacgagtacttcgtcttccccaacccgaacaccggcttcaacccctccgagatcagcctcaaggacgagaagaactacgcgctgatctcccccaacctgttccgggtgcagaagttaagccactactactacgtgttccgccaccacctggagactaacgttgacacaaacctgcagctcaaggacattacctggaagcggatcaccgccgtgaacaacctgacaggggccgtgaaggtccgcatcgaccacctgggccggatcgtggacgtgggggagtacaagtga

SEQ ID NO: 7884 - RNA, 4176 nt, synthetic construct
  misc_feature 1..4176: note = Cas9 variant
  source 1..4176: mol_type = other RNA
atgaagaactaccacatcggcctggacatcgggaccagctccgtgggcttcgccgcccgcgacgacgacaacaacctcatcagagtcaaggggaagaacgtgatcggcgcgcggctgttcagcgagggtcagaccgcccaggagcggcgcatggcccggacctcccgccggcgctacaatcggcgcaagtggcggctgcgcctcctggacgagatcttccatgacgaaatcatccacaaggacgccgagttcttcaaccggctgaagcagagcttcctctcccccaaggacgagcgcaagcagtacttcggcagcctgctgttcccggagaccggcgactccgagtattaccacaacggaaaccagaccatctaccacctccgccaccgcctgatcacccaggacgagaaggcagacatccgggagatatacctggcgctccgccacatcatcaagtaccggggcaatttcctggacgacacgcccgtgagctccttcgaggccagcgacctaaagctcgcctccttcgtccccaccatcaacgatctgttcgagaccatcgacgtgaactacgagttcagcatggacaacatcaacgagatcgaggacatcctgctcaacaacaagctgcgcaattccgacaagagcaagcagttaaccgacctcttgactgagcccatcgtgaacatcgacgacaagtccctggagaagcagttcaacaaggagcggaccgacatcagcaaggagatcgccaagtctgtcgtggggagcaagatgaacgtgaacaagctcctgtccttcgagagcagcgagggctccaagatcgcgttcagcttctccgacgccagctccgaggacaagatgatggagctgagcgacatcctagacgactcccgcatgaacatcctgaacatcctaaaggtaatctacagccgcgtgcggctcaaccagatcatcccgtccgggatgggtctgagcgagtccatggtggccgcatacgacagccacaagcagcagctgaaggacctcaagaccctgctgaacgttctccccttcaacgagcgctacgccgtgaagatcgcgtacgccgcctacatcggcaacatcgataagcagaagttcaccaagtccgagatcaaggccatcgacaagctgaaggagaagtccgccatcatgaacgtgctggacttcaagtccgggcacatcacgaacgaggagctcagcaacgtcatcaaggccgtgatcgtggacaagtacctgaacgacgaggacttcgagtaccacggcatcgtcgagaagatcaaccaggacatctccaatgggagctacctgcttaagcagcggaacaaccaaaacggtaacattccccaccagctgcaccagatggagctggaccagattatcgagaaccagtccaagtactaccacttcctcggcgagttaaaccccaacagcaaccgcaaccacatcgccaagtacaagatcagcgagctggtggccttccgggtgccgtactacgttggacccctcatcacccccgaggagcaggagaagacctccggcgccagcttcgcctggatgaagagaaagaaggacggggcgatcaccccctggaacttcgaggagaaggtggacaaggaagagacggcctcccggttcatcaagcgcctgaccgtgaaggacacctacctgctgaatgaggacgtcctcccggacaacagcctgctgtacgagaagtttaaggtgctcaacgagctgaacgtcgtgaaggccaacaacaagcgccttaccgtcgaggagaagcagggcgccttcgacaacctcttcaagaagatgaagacggtcaccgccaagcgcctgaagaactacctggtgtccaaccacaaccacatcaacagcgtggaaatcaccgggctctccgacggcgacaaattcaacaacagcctgtccacctacatcgacttcaagaagatctttggcgacaaaatcgacaaccccgggctgctcgacgacttcgaggacatcatcgagtggagcacggtattcgaggaccggaagatcttcgaggagaaggtgcgcaaggacatctcctggatcagcgagtccgagatcaagagcgtggtctccaaacggtacagcggctgggggcgcctgtccaaaaagctgctcaactgcatcaccaacaacgagggccggaacatcatcgacgagctgtgggaggagagcgagaccttcatggaggcggtgagcaagcccgaggtcaaggagcagatcgacgggatcaactccgacttcatcaagaacacagacatcgagagcgtgctggccgatgcctacaccagcccccagaacaagaaggccattcgcgagacccacaagctcgtgaaggacatccagaaggcgatgggcggccaggccccggccagcatctccatcgagtttacccggaacccccaagacaaggggcagctgacccgcagccggcactccgaggtgagccgcaagtacaaggaaatctccaaggagatcagcaagacgctgaatgacgagctcaagtccaagaagaactcgatggacgtcgacaagtactacctgtacttcatgcagatgggcatcgacctgtacgacgggtccagcatcgacatcgacgacctcaacaactaccagatcgaccatatcatcccccagagtttctacaaggacgacagcttcgacaaccgcgtgctgacccattactccaacaaccagaagaagggcaacaacacgcccctgaacggactcaacatcaacgacaagacccgggccatctggaaccacctccgcgacctgggccttatcaccaagaagaagtacaacggcctgaccctgaaagggatggaccagctcagcaagtacaccaagcacggcttcatccggcgccagctggtggagacctcccaggtcatcaagctggtggccaacatcctcagcgatgagttcagcacggacgacacgaaaatcatcgaggtgaaggcgaagatgaactcccagatcagacaggtcttcaacctgtacaaggtgcgcgaactgaacgactaccaccacgccgtggacgcctacctcaccaccttcatcgggggctacctgtataaccggtacccgaacctgcggaacatgttcgtctacggcgactttaagaagttcagcgccgacgtggacaacctcaagaccttcaacttcctgcacgagatcacgaacccctccgacaagttcgaggaccggatcttcgacgagaagtccggggagctgatactcgaccgcaagcacgccatcgaaaccatcaagaagatctaccagtacaagtacatgctgatcacccgggaggtgagcaccaagaacggccagctgagcgaccagacagtctactccgcgaagcgcatcaacaacgtgaaggcccccatcccagtgaagaaggacttcaacccggagctctacgggtttcggaccggcaacgtcgaccaccacatggtaatagtgaagtaccccaagaaggacagctacgactacaaggtcgtgggtatccccctgcgcttcgtgcagaagttgaaggagaccaaggacaacaaggactacgagaacctcctgaaccaaatcgtccagatgaagctgaaccggaagaaacaggacttcatcgtggtggtcgacaacgtgatgtacggccagttgatccaggacggcgggcagaagttcaccctgggctcctcaacgtaccgttacaacgccaagcagctggtgatcgacaacgggtacctcaagctgatcgccgacgagcggtacaagaactccctgaccgacgaggagaagtccaaccagtacatcaccctctataacgagatcctgaaggtcgtgaacggccgcttcgacgtgttcgacgtcaacagcttccggaagaagctgaacaacggggtggacaagttcatcaagctcaacaccgtggacaagcgcatcatcatcatgaagatcctgtcgggtctgcactgcggcccctccatcgtcccgctcaaggagctggggctgacgacgcccctcggccagctgcagagcaccagtgggatcagcctgtccgagaacaccatcatcatctaccaaagccccagcggcctcttcgagcggaaggtgcgcctgggggacctatga

SEQ ID NO: 7885 - RNA, 4176 nt, synthetic construct
  misc_feature 1..4176: note = Cas9 variant
  source 1..4176: mol_type = other RNA
atgaagaactaccacatcggcctggacatcgggaccagctccgtgggcttcgccgcccgcgacgacgacaacaacctcatccgggtcaaggggaagaacgtaatcggcgcgcgcctttttagcgaggggaagaccgcccaggagcggcgcatctcccggaccagccgccggcgctacaaccggcgcaagtggcggctgcgcctcctggacgagatcttccacgatgccatcgtgcacaaggacgccgagttcttcaacagactgaagcagtccagcctctcccccaaggacgagcgcaagcagtacttcggcagcctgctgttcccggaggtcggcgacggggactacttccgggacggcaaccagaccatctaccacctccgccaccggctgatgacccaggacgagaaggccgacatccgcgaagtgtacctggcgctccggcacatcatcaagtaccgcgggaacttcctggacgacacccccgtgtccagcttcgaggcctccgacctgaagctcgccagcttcgtccccacgctgaacgacctgttcgagaccatcaacgtgaactacgagctcagcatcgacaacgtgaaccaaatcgagaacatcctgctgaataacaagctccggaacagcgacaagtccaaacagctgaccgacctgatcgccgagcccgtcaccaacatcgacgacaagagcctcaagaagcagttcgacaaggagcgcaaggacatctccaaggagatcgcgaaggccgtggtgggcagcaaaatgaacgtcaacaagctgctgtccttcgagagcagcgacgggtccaagataagtttctccttcagcgacgcctccagtgaggacaagatgctcgagctgtccgacatcctggacgacagccgcatgaacatcctcaacgtgctgaaggtaatctactcccgggtccgcctgaaccagatcatcccgagcggcatgggtctctccgagagcatgatcgccgcctacgacctgcacaagcagcagctgaaggacctcaagacgttgctggacgtggtgccgttcaacgagaagtacgcggtcaagatcgcttacgccgcctacatcggcaacatcgacaagcagcggttcaccaaggccgaggtgaagaccatcgacaagctccgcgacaagaagtccatcaccagcgtgctggacttcaagtccggccacatcacgaacgaggagctgaacaacgtcatcaaggaggtgatcgtggacaagtacctcaacgacgagaccttcgagtaccacgacatcgtcgagaagatcaaccaagacatcagcaacgggaactacctgctgaagcagcggaacaaccagaacggcaacatcccccaccagctccaccagatggagctggaccagatcatcgagaagcagtccaagtattaccccttcctgggcaaactcaacccgaacagcaagcgctcccacatcgcgaagtacaagatcagcgagctggtggccttccgggtcccctactacgtggggcccctgatcacccccgaggagcaggagaagacttcgggcgcctccttcgcctggatgaagcgcaaggaagacggggccatcacgccgtggaacttcgagaagatggtggacaaggagagcaccgcgtcccggttcatcaagcggctgaccgtcaaggacacctacctcctgaacgaggacgtgctccccgacaacagcctcctgtacgagaagttcaaggtgctgaacgagctcaacgtcgtgaaggccaacaacaagcggctgacggtggaggagaaacagggcgccttcgacaacctgttcaagcagatgaagaccgtcaccgccaagcgcctcaagaactacctggtgtccaaccacaatcacatcaactctgtgaagatcaccgggctgtccgacggcgaaaagttcaacaacagcctctccgtctacatcgacttcaagaagatcttcggcgacaagattgacgacagcaagctgttcgatgacttcgagaacatcatcgagtggtccacggtgttcgaggaccgggacatcttcgaggagaaggtgcgcaaggatatcagctggatctccgagagcgagatcaacgcagtcgtgtccaagcggtacagcgggtggggccgcctgtccaagaagctcctaaacgggatcaccaacgacgagggccggaacatcattgatgagctgtgggaggagagcgagaccttcatggaggcggtgagcaagcccgaggtcaaggagaaaatcgacgagatcaactccaacttcatcaagaacaccgacatcgagagcgtgctcgccgacgcctacacgagcccccagaacaaaaaggccatccgcgagacctacaagctggtgaaggacatccagaaggcgatgggcggtcaggccccgagctccatcagcatcgagttcacccggaacccccaggacaagggcgagctgacccgctcccgccacagcgagatcgccaagaagtataaggagctctcgaaggaggtcagcaagaagctgaacgacgagctgaagtccaagaagaacagcatggacgtggataagtactacctatacttcatgcagatggggattgacctgtacgacggcacgtccatcgacatcgacgacctgaacaactaccagatcgaccacatcgtgccccagagcttctacaaggacgactccttcgacaaccgggtcctcacccactacagcaacaaccagaagaagggaaataacacgcccttaaacggcctgaatatcgactccaacacacgcgaggtgtggaaccacctcatcgggctgggcctgatcaccaagcggaagtacaacaacctcaccctgaagggcatggaccagctgtctaagtacaccaagcacgggttcatccgccggcagctcgtggagacctcccaggtcatcaagctggtggccaacatcctgagcgacgagtactcaaaggatgacaccaagatcatcgaggtgaaggccaagctcaactcccagatccgccaggtcttcaacctgtacaagatccgggagctgaacgactaccaccacgcgctcgacgcctacctgacgaccttcatcggagggtatctgtacaaccgctacccgaacctccggaacatgttcgtgtacggcgacttcaagaaattcagcgccaagatcgacaacctggagaccttcaactttcttcacgacatcaccaacccctccgacaagttcgaggaccgcataatcgacgagaagtccggcgaggtgatcctcgaccgccgccacgccatcgagacgatcaagaaaatctaccagtacaactacatgctgatcacccgggaggtctccaccaaaaacgggcagctgagcgaccagaccgtgtactccgcccgccggatcaacaaggtgaacagccccatccccgtcaagaaggactccaacccggagctctacggctttcgcactgggaacgtggaccaccacatggtgatcgtcaagtacctgaacaaggacaaatacgactacaaaatcatcggcatcccactccggttcgtccaggtgctcaagaacagcaacgacaacaccgagtacaagaacatcttgaacaaaatcgtgcagtccaagctaaagggcaagagcaccgacttccgcgtgatcctcgacaacgtgatgtatgggcagctgatccaggacggcgggcagaagttcaccctgggctccagcacgtacaagtacaacgcgaagcagctcgtcatcaacatggacgacatccggatcctggtggacaaccgctatttcaactccctgagcgacgacgacgcctccggggagttcatcaagatctacaacgagatcctcaaggtgatcaacgcccggttcgacctgttcgacatcaacaagttccgcgagaagctgaacaacggcaaggagtacttcgagaacctcagcatcgacgagaagaaccaggttctgctgaagatgctctccgggctgcactgcggcagcgccaacgtacccatcaaggagctgggcctcaccacgcccctggggaagctgcagatcccgagcggcatcgtgctctccgaggacgccattgtcatctaccagagcccctccggtctgttcgagcgcaagatccggctgaaggacatctga

SEQ ID NO: 7886 - RNA, 4176 nt, synthetic construct
  misc_feature 1..4176: note = Cas9 variant
  source 1..4176: mol_type = other RNA
atgaatctgcgcaattatccgggtgaatacagcataggcctcgacatgggaacaggcagcgtcggatggagcgtggtggacgaaaagggaaacctactccacttcaagaagaaaccgacgtggggcagcaggctattcgacagcgtgatgccagcaagtgaagccagagttcaccgcggtcaaagacgccggtacgaacgccgccgctggcgactagacctcctacaggggctatttaaaaacgaaatgaacaaagtagaccccgagttcttcatgcgcctaaatcaaagccggaccatcgaaggtgatccgatctttacaaaatcattcacaaaagccgactactacgataggttcccgacaatttaccatctgcgcgcatacctgatggaatcaaacgagccagcagacctacggctcatatacctcgcaatgcacaacataatcaagcaccgaggcaacttccttcgagaagaagaaaaatcactgtcggctaagcacgcagactcgaaaaaggccgtgacgcaattcgtcgacgccctaaaagaatggtgcttctcgcgcggctacgagttcggcaaggacccagctaaaagcatagaaaagtgtttatcagacagtaaaagctccagatcgcaattagcatccgaaatcgcgaaagcactggcagtatcgaccgacgctgcagccgcagataagaagctcgcagacaacctcgccaaggcgatggtaggccttcaatgcgagttcaaatacgtatttggcgagttcgactgcgaaagtactaagctcgcactcagcgatgacgaaaagttagaattactaagagcagcatgcccagacgacagcgtcgaattactcgacgccttatgcgcagtatactcggcctacgtgctgcaaggcttgctctcctacgcgcccggccagaccataagccataacatgatagcaaaatacgacctttacaaaacagacctcaaaacgctcagagcgctagtccgcgaatatgcccccggcgcgtacgatgagttcttccggggcgcgacctaccacgacgcgaacccggatgactcaagcaaagactacagctacgcggacgccgaagggtacacggcatacaatctccacaaactgtcctacgacgacttcgcaaaagccgtaaagaaactactaggcggaacggatgcagtcacagacgaaaggtacctgaacatgatggaacgctttgaaaaacaacagtttttaagacgactgaaaacgtccgacaacggagccatttactaccaactccacctcgaagaactaaccgctataataaagaaccaaggcagattctactcattcctaaaagagtacgaaggaaaattcgaatccttagtttccttccgcatcccatactacgtagggccgttaacctccgttaacgcagcccaagactcacacaatcacaaccgattccaatggtcggaacgtaagccaggaatggagcgcgaagtaataaccccctggaactgggacactataatcgacaaaaacaaatcagctgaaaacttcataatgcggatgacaggggactgtacttacctcgccggtgaaaaggtgctacccaagcagtccctcctgtacgaggagttctgcgtactcaacgaactaaacggagtacggtggtccgacgatggagacgattggcaacggttcgatgcagcacaacgcgagggcatcgttcgagaactattccataaatacagaagagttacctacaagatgctcgaagactggttagtgagggaaggagacgccaaccaccccatagtgaaaggtgggcagggcgagacaggtctagagtcaaaaatgggaagctacttattcttcgcaaaaggaatttttgggctcggcgagctaagccccgccgaatacccagcaatcgagaaaatgataaaatggaacaccctcttcgaagacagaagtatcctcaaagaaaaactagaagacgagttcggagagcgcggaaacggcatgctagacgcctcccaaatcaaagctatatgcaagaaaagatttacgggatggggaaggctctccgaacagtttctcaccggcctgaaagtggaaagccctgccggacgcgccgtcagcatcatggacgtactcagagagggaaacccctgcagcgaaaggcgccagggtgagacagtagtgatgatggaagcactgagggacgaaggactagggttccagaagaaaatagacgagcacaaccgtaactactatgggcaacacggcaaagacctaggagttaacgagctgccaggctcccccgccatccggcgaagccttaaccaggccatacggattgtagaggagatagcgagcatagccggccacgcacccgccaacatatttatcgaagtgacccgcggagaagacgcgggcaagaaaggcaaaaggaccgtgaaaaggtgggacaaaataggagaggccctgaagaaacttaaagaagaaggcgtcgctgtcgaagtgatggacgacttcaaagaacaaaaagccatcaacgcaaacctggatgaaaggttatcactatacctcatgcagaacgggaagtgcctatattcgggcaaggcaatcaacctagagaaattacttgccggctcgggggagtatgaggtagaccacataataccccgagcatacataaaggatgactcgatcgaaaacaaggcgctggtactcagagaggaaaaccaacacaagactgaccaactactgatcgacaaaagcatacgctggaagatgcgagagacttggagccaactacacgacgctggcctaattggggacaaaaagtaccacaatctcctgagaagcaacataaacgaaaaccaactgcgcggattcatcgcgcgccagcttgtagaaacatcccagatggtaaagctggcgcaagccctgctcgaagcacgcttcgccaacgaagagacccgaatcgttccggtcaaagcaagcatgagccataatctgcgagaggcagccgacttagccaaatgccgagaggcaaacgatttccaccacgcgcacgacgccttcttagccagcagaataggcctcttcgtacaaatgaggcaccccgggatctacgaaaacccaataggatacagtcacgtgataaagaaatacgtccaagaacagagcgaagtgttcaagaagacgcacaggatgccgggatcagcaggattcgtaataaacagcttcatgagcagcggcttcgacaaggacacgggcgaagtattcaaagacagctgggatgccgaagctgaagtcgatggaatcagaaaagcactcaactacaggcaatgctacataagcaggatgccacaacaagacacaggggcattttggaatgcaaccgtgtacagccctcgggacccaaagatgggacctaaactagcgctgtcaacaaagcaaggcctagacccaaagttatacggaggcttctcatcccagcaattcgcatactttttcatctacgaggccaaaaagaaagggaaacccacgttccgcttcagccaggtccctgtctggctggcggctcggatcgaagccaaccccctggccctagaggagtacgcgcgagggctagcaaaaggcgagggactcgagttcgtcagcatacaacgaccaaaaatatacaagaaacagctaatagaagtaaatggcgacaaactcataatcaccggggcaaaagaagtccgaagcggcgcagaactagcattcaaccaagacgaaatatcagcgatctcaatgtgcagcaaactccgcgccgccgaagcaggacttgacggcgccttctcagaggaagtctcagctatctggaaccgaatcagcaatgcaccagtacaaagctgtggccgactactccggcaactgacactcccgaagtaccaatcaaacttcgatagcagctccaacgaggagaaggcagcagtagttctaggcttaatcgcccttctcaacggaaacaaccgaatcgttgatttaagcggggtgggcgggagcagccatgcaggggcaatgatgatgtcataccccaaactgctcgatgatccgaaagtaccctttttcataatcgaccaatcggttacgggaatgttcgagcgaaaaacaagggttggcctatga

SEQ ID NO: 7887 - RNA, 4176 nt, synthetic construct; identical to SEQ ID NO: 2087
  misc_feature 1..4176: note = Cas9 variant
  source 1..4176: mol_type = other RNA

SEQ ID NO: 7888 - RNA, 4176 nt, synthetic construct
  misc_feature 1..4176: note = Cas9 variant
  source 1..4176: mol_type = other RNA
atgaagaaacgcattgacgactatatcctgggcctcgacatcgggaccaacagctgcggctgggcagtgaccgacaagaagaataacctgcttaagctccggggcaagacggccatcggcagtcacctgttcgaagaggggcacaccgcggccgaccgccggggatttaggacgactcggcgccggctgaagcgtcgcaagtggcgcctccggctgctggaagagatcttcgccgagcccatggccgaggtcgacccaggcttctttgtgcgcctccatcagagctgggtgtctcccctggacaagtctcggaagaaataccaggccatcgtcttcccgacggcgaaggaggaccaggaatattaccagaagtaccccaccatctaccacctccgcgacgccctgatgacccaagaccggcagtttgacctgcgcgagatcttcctggccatccaccacatcgtgaagtaccgggggaacttcttgcaagacaccgccgtgaaggacttcgaggcgtcgaagatcgaggtcggcccgatcctgacgaacatcaacaatgctttcgccgacaagatcgtggaggggcaggacctaatcgagctcaacgtagccaacgccgcggaaatcgaggccgtgatccgcggcaaggacgccgacaagaccctttacaagatggacaaggtgaagaagatcgcgaaacttctaaccgacagcaccgccaaagagcagaagaacgtggccaagcagatcgccaacgccatcatggggtacaagacgcagctcgagaccatcctgggcaaggagatcgacaaaaacgacaaggcccagtgggagttcaaactcagcgacgccgacgacaagctggatgcgctgctccccgacctggacgagagcgaccaaaccgtcgttgccgagatcgagaagctgttctccgccatcaccctcagcacgatcgtggacgagaacaagtccctgagccagtccatggtcgagaagtacaacaaacaccaccaggactataagctgctcaaggcctacatcgagagcctgcccgatagagcccaggcgaagaagctgcttctggcctacgacctgtacgtgaacaaccgccacggccacctcctggaggctaagaccgagttcaagcaggatagtaccctgacgaaggaggacttttacaagacagtgaaagacaacctcgacgacagcgagctggcccataagatagcgcaggagatagccgccgacaacttcatgcccaagcagcgaaccaacagtaacggggtcatcccgttccagctgcaccaaatcgagctggacaagatcattgccaaccaaagcaagtattacccctttctggccgcggagaaccctgtcgaggaccatcgcaaacaggccccctacaagctggacgagctcgtgcgcttccgggtcccgtactacgtgggacccatgatcaccgccgatgagcaggagaaaacctccggcaagagctttgcctggatggtgcgcaaggagcaggggcagatcacgccctggaactttgagcagaaggtcgatcggcaggagagcgccaacaagttcatcaaacgcatgaccatcaaggacacctacttgctaggggaggacgtgctgcccgcgaactccctgctgtaccaacggttcgaggtcctgaacgaactcaacaacatccgcgtgaatgggagccggatctccgtcgacctgaagcagcagatctttaacgacctgttcgaagagaagaaaacagtcacggagaaggccctcatcagctacctgaagcaaaaccttcacttaccgaccgtggagatcaagggcctagccgacccaaccaagttcaactcctctctggcctcctattaccatctcaagaacctgcacgtgttcgacaaggagctggcagacccccagtaccagaaggagtttgagaagataatcgagtacagctccatcttcgaggataagaagatctttcaggacaagctccacgcggagttcaagtggctgaccccagcccagttcaaggccatctcaacgtggcgcctgcaagggtggggccggctctcccgcaagctgctggtagagctccacgacaccaacggacaaaacatcatcgagcaactgtgggacagccagaagaacttcatgcagatcgtcacggagccagacttcaaagaggccatcgcgaaggagaaccagaacatcacccaagagaacggcgtggaggagatactggccgatgcttacacgtcccccgccaacaagaaggccatccggcaggtcgtgaaggtggtcgcagacgttgtaaaagccgcctccggcaaggccccagcccagttcgcgatcgagttcacccgcgaccccgacaaaaacccgcagctctcacacatccgggggacgaagctgctgaaagcctaccaggagaccgcgggagagctcgtcgaccagaacctgaccaacagcctgaaggaggccatgacatccagaaagctcctgaaagacaagtactttctgtatttcatgcagaccggtagagacgcctacaccggcaagaagatcaacatcgacgaggtgagcaccaactaccagatcgaccacatcctcccccagtccttcatcaaggatgactctttcgacaaccgggtgctgacggcgactcccctgaacgctgagaaatcagacgacgtcccgtacaagcggttcgccaacaactacgtttccgacctcaagatgaccgtgggggagatgtggaagcactggcagaaggccggcatcatcaacaagcacaagttgggcaacctgttgctggacccggacaggctgagcaaattccagaaatccgggttcatcaaccggcagctcgtcgagaccagccagatcgtgaagctggtgagcgtcatcctgcagaacaagtatcctgacgcggagatcatcaccgtgaaggccggcgataacagcgctctccggcaacgcctggacctgtacaagtcccgggacgtgaacgactaccaccatgccatcgacgcatacttgagtatcgtgtgcgggaacttcctgtaccaagtgtaccccaagtaccggccgtacttcgtgtacgggcagttcaagaaattctcccaggaccccgacttgcagaaagacctcatcaagcacttcaaggggttcaccttcatgtggcccctgctgcagaaagataacagcgagcggaaagcgctcgaggagatcaaggagaacaactccgaccgcatcgtcttctacaagcaccccgatatcttcgacaagctgagaaaggcctacaactacaagtatatgctagtgtctcgcgagacgtccaccgaaagctccagtatgttcaacatgacgatctacccgcggggagagcgcgacaggaagaaaacccgcaagctcatccccaagggcaacgggctggaccccaagatctatggcgggtactccggcaacaccgacgcctacatggtgatcgtaaaaattgagaaagccaaagagagcatttacaaagtgatcggcatccccatgcgagccctggcggggctcaagcaggccaagaaccagggcaactacaaggaggagctgcacaaggtggtagagccgcaaatcatgctggacaagaacgggaagcccaagcgcggcgttgaggggttccgggttgtcaaggaccacgtgcccttcaaacaggtcgtgctcgatggcgacaagaagttcatgctgtacagcgccaaatatgagaccaacgccaagcagctgaccctcagtcaggagaccatgcgcatcgtgaccgataacctgaagaagtccgaggatcaggataagctgctcgtgaaggcgtatgacgagatcctacagaaggtcgaccagtacctgcctctcttcgacgtgaacaagttccggaacagcctgcacctgggccgcgcgaaattcctcgacctggccgtgaacgataagaagatcacccttagcaacatccttaacgggctgcacgacaacctggtcgtgccgaacctcaagaacatcggcatcaagacgcccttcgggctgatgcagtcacccagcggcatcaccctttccagcaacgcgatcctcatcttccagtcccccaccgggctgttcgagaaacgggtgcgcatcgcggacctgtga

SEQ ID NO: 7889 - RNA, 4176 nt, synthetic construct; identical to SEQ ID NO: 2089
  misc_feature 1..4176: note = Cas9 variant
  source 1..4176: mol_type = other RNA

SEQ ID NO: 7890 - RNA, 4176 nt, synthetic construct
  misc_feature 1..4176: note = Cas9 variant
  source 1..4176: mol_type = other RNA
atgaagcgcaacaacgactactacatcggcctggacatggggaccaatagcgtgggctgggccaccacgaacccccaagggcggctcctacgcttcaacaaaaaggacatgtggggctccagactgttcgaggaggccaagaccgcagccaagacccgaacctttcggacgagccgccggcgctacgaccgggtacgccagcggatcgagttcctccaggacatcttcgcccccataatcgccaagaaggatttcgagttcttcatgcgccttaaggaatccaagttccacctcgaggacaaaaagaccgacgggaagttcgccctcttcaacgacgcggacttcaccgacgtcgagtacttcgatcggtatcccactatctaccaccttcgcgccgccctgatcaagcccaaccatatcacggacccccggctactgtacctggccatccaccacatcatcaagaatcgcggccacttcctcttcgctggcaccgacatggagagcatccggagtttccagatcgtgtacacccagctgagcgagcacctgaagtccatcaacctcgacttcgagctgccggtcgacgcccaggacaagttcgccgccatcctgctcaacgagaagctgaacaagcgcgacaagaaaaagcagctgaaggagttgtgcccccacaaggacaagcggctggaatacgctttcaacgcgatcatcgggggcaagaccaagctgaaggacatcttcggggtggaggagtacgacgagggcacgaagaaggctgtggacttcgagaaggccgactacgacgaggacaaggacgagatcgagagcgtaatcaaagagaacatccacgtgctcaacgccctgaaggccgtttacgattggaccatcctgaccaacatactgggggactacgcgtacatctcggagagccaggtagccctgtacgaggcccacaagaaggacctgcgaatcctcaagtccctgatcaagaagtacgccaagagccagtacgccgacgcgttccggcatgagaacgtgaagggcaactacgccaactacgtgggttccaccaactacgacaacaagcagcccgtcatcgacaaccccagcgtgacgcaggaggacatcaacaagtactttgccgacatcctgctctccatcacccctgacgagagcgatcgcgagtcctatcagtacatcaccgagagactgcacaaaggagaggccctgcccaagctccggaccaaggccaacagcgtgctgccccaccagatccacaagatcgagctggagaagatcctcgcgaacgcggctaagaactttcccttcctgcaggagaaggactcctctggctacacggccgcgcagaagatcgtcaagatcatgatgttccgcattgaatactacgtggggccgctgaacacgtaccaccacgtggaccagggcggccacgcgtggatggtccggaaggccgaggggaagatcaccccctggaacttcgacgagaaggtggacaaggaggccagcgccgagaagttcatccgcaacatgacaaacaagtgcacgtacctcatcggcaaggacgtgatccccaagcagtccctgctgtacagccggtacaaggtcctcaacgagctgaataacctgaaggtgaacggggcgcccatctccgtagccctcaagcagaagatctacgaggagctgttcaagaagcaagtcaatgtgacctttaaccagctgaagaccttcctgaagacccagggcgaggacgccgacgagatcatactcagcggggtcgacgaggccgcccacaagtttaccaacaacctgcagacctaccacaagttccgcgcgatcctgcgggacaagatcgagttcgagccgcagcgctccatggtggaggacattatccggtggaagtgcctcatgggcgatgacatcaccatgtggaagcacaagatagagaaggagtacggcgaccagctgagcgaggagcagctgaagaagatcacgcgcctgaacttcaacgggtggtcgcggctgagccaggagttcctgacggacgtgccaggcgtcgacatcgagtcaggggaggtgtacagtggcatcatggacgccctctggcgcaccaacgagaacatcatgcagctgctgtctagccggttcaccttcgccgccgaggtgaagaagcagaaccaggggaccggccgcatcgagaaaattacgtacgacgaggtcatgaaggacacctacctctcaccagccgtgaagcggagcgtgtggcaggcgatcaccctggtcgaggaaatcagaaaaatccggaaagccgaccccaagcgcatcttcgtggagatgacccggcagccggacgccaagaaggagcggaaactgtcccgccggacgcagctcctgaacgcctaccgcgccatcggaaacgacatagccgagtacgagaaagagcacgtgagcacgctgataacccaattagagtccaagaaggacgaggacctgcggcgcaagaagctgtacctctacttcacccagatggggcggtgcatgtacaccggcgagcgtatcgacctgagctccctgctccgggacacgaacagcaacatctatgacatcgaccacatctatccacgcagcttgaccaaggacgactcgttagacaacaccgtcttatgcaagaaggaaatcaacctgaagaaggggaacaagtacatccaccgggttttcaccgacaaagagctgaagaagcagtacggctactggaaggccctcaaagagaagaagctgatcagcgagcgcaagttctccagattaatgcgcacgaccgatctcaccgccgacgagctggccgggttcatctcgcggcagctggtggagacgtcccagatggtcaaggcgacggccgacatcctcgagaagatataccccaacgtcaccatcgtgtacgtaaaagcccgcaccgttagcgacttccggcacgactacgagctgcccaaagtgcgcgccctgaatgactgccaccacgcccacgacgcgtacctcaacatcgtggtgggcaacgtgtactacgagaagttcactaagtcccccttccggttcatcgccaatcagaagggcaagggagacatcaagtacaacctgtaccgcctgttcgacaaggacgtgaaagtgggcgaccggatcatctggaacgccaaggaagacctagccagagtgaaggccacgctcgaacgggacaccgtgaacgtggtacgcatgcccgtcgagcagcgcggacagttcttcgacgcgacaatccagaagaaaggtaccacgaagaacatgctggtgcttcccctgaagggcagcgacgaacggctgcaggacacctccaagtacgggtactacgtgcggccctctggcatgtccttcatggtcgtgcagcacgaggtgaagggcaagagccgagtcaccatcgagccggccctcttggtctacaagaacaagctgaagtccgaggacgactacgccaagtattgcgaggacgtgctcaagctgcagaagcctaaggtcctgttcaagaacatcaagttcgggtcgaagatactcttcgacgggtaccccttcctcctgaaaggccgcaccgagaatcggatcattatggccgacgcgcagtcccttttcctgggcaaccaggagctaaagatcctcaagcgcgttacgaaaatcagcgacgacatcgaccacaaggtggagtcccggatcaagatcaccgacgaggagtggacgaccctgtggaagtccgtcgtggagcagatcgtgacggggaagttccgcaaccggctgggcaccctcaacgggatcctgcagggccgcaaaatcaagctgtcaaaggacgaggaagcccggctcaacgagctggacagcaaggaccaggagaccttcctgagtcagatccttctggagcgcttcctccagttctccaccgaggagaagacgcggctcctgctgcaggttatcagcttctccgggaacaccaccggcgtggacctccgcctgatcggcgggagcagtggcaccgggacgatcaagaccaacaagaacattactgaccacagcgtgatcctaatcaacgagtccccgaccggcctcttcacgaacagaacggtgctgaaccagccctga

SEQ ID NO: 7891 - RNA, 4176 nt, synthetic construct
  misc_feature 1..4176: note = Cas9 variant
  source 1..4176: mol_type = other RNA
atgaagcgcaacaatgactactacatcggcctggacatggggaccaacagcgtgggctgggccaccacgaacccccaggggcggctcctgcgcttcaacaagaaggacatgtggggctcccggcttttcgaggaggccaagaccgcggccaagacccgcaccttccggaccagccgccggaggtacgaccgggtccgccagcggatcgagttcctccaggacatcttcgcccctatcatcgccaagaaggacttcgagttcttcatgcgcctgaaggagtccaagttccacctggaggacaagaagaccgacgggaagttcgccctcttcaacgacgcggacttcaccgacgtggagtacttcgaccggtaccccaccatctaccatctccgcgcagcccttataaagcccaaccacatcacggatccccggctgctgtacctggccatccaccacatcatcaagaaccggggccacttcctcttcgcgggcaccgacatggagagcatccggtccttccagatcgtgtacacccagctgagcgagcacctgaagtccatcaacctcgacttcgagctgccggtcgacgcacaggacaagttcgccgccatcctactcaacgagaagctgaacaagcgcgacaagaagaagcagctgaaggagctctgcccccacaaggacaagcggctggagtacgccttcaacgcgatcatcgggggcaagaccaagctgaaggacatcttcggtgtggaggagtacgatgagggcaccaagaaggccgtggacttcgagaaggccgactacgacgaggacaaagacgagatcgagagcgtcatcaaggaaaatatccacgtgctaaacgccctgaaagccgtgtacgactggaccatcctgaccaacatcctcggggactacgcgtacatctccgagagccaggtcgctctgtatgaggcccacaagaaggacctgcgcatcctcaagtccctgatcaagaagtacgccaagagccagtacgcagacgcgttccggcacgagaacgtgaaaggcaactacgctaactacgtgggctccaccaactacgacaacaagcagcccgtcatcgacaaccccagcgtgacacaggaggacatcaacaaatacttcgccgacatcctgctctccatcaccccggacgagagcgaccgcgagtcctatcagtacatcaccgagcgcctgcacaagggggaggccctgcccaagctccggaccaaggccaacagcgtgctgccccaccagatccacaagatcgagctggagaagatcctcgcgaacgccgccaagaatttcccctttctgcaggagaaggactccagcggctacacggccgcgcagaagatcgtcaagatcatgatgttccgcatcgagtactacgtggggccgctgaacacctaccaccacgtggaccagggcggccacgcctggatggtccggaaggccgaagggaagatcacgccctggaacttcgacgagaaggtggacaaggaggccagcgccgagaagttcatccgcaacatgaccaacaagtgcacgtacttgatcggaaaggacgtgatccccaagcagtccctgctgtacagccggtacaaggtcctcaacgagctgaacaacctgaaggtgaacggggtgcccatctccgtcgcgctcaagcagaagatctacgaggagctgtttaagaagcaggtcaacgtgacctttaaccagctgaagaccttcctgaaaacccagggcgaggacgccgacgagatcatcctcagcggggtggacgaggcagcccacaagttcacgaacaacctgcagacataccacaagttccgcgccatactgcgggacaagatcgagttcgagccgcagaggtccatggtggaggacatcatccggtggaagtgcctcatgggcgacgacatcaccatgtggaagcacaagatcgagaaggagtacggcgaccagctgagcgaggagcagctgaagaagatcacccgcctcaacttcaacgggtggtcccggctgtcacaggagttcctgacggacgtccccggcgtggacatcgagtccggggaagtgtacagcggcatcatggacgcgctctggcgcaccaacgagaacatcatgcagctgctgtccagccggttcaccttcgccgccgaagtcaagaagcagaatcaggggaccggccgcatcgagaagatcacgtatgacgaggtgatgaaagacacctacctctcccccgccgtgaagcggagtgtctggcaggccatcaccctggtggaagagatccgcaagatccggaaggcggaccccaagcgcatcttcgtggagatgacccggcagccggacgccaagaaggagcgcaagctgtcccgccggacccagctcctgaacgcgtaccgcgccataggaaacgacatcgcggagtacgagaaggagcacgtctccacgctgatcacccagctcgagtccaagaaggacgaggacctccggcgcaagaagctgtacctctacttcacccagatggggcggtgcatgtatacgggcgagcgcatcgacctgagctccctgctccgggacacgaacagcaacatctacgacatcgaccacatctaccctcgcagcctgaccaaggacgactccttagacaacacagtgctctgcaagaaagagatcaacctgaagaaggggaacaagtacatccacagagtgtttacagacaaggagctgaagaagcagtacggctactggaaggccctcaaggagaagaagctgatcagcgagcgcaagttttcccggctgatgcgcacgaccgacctgacggccgacgagctggccgggtttatcagccggcagctcgtcgagacctcccagatggtgaaggccacggcggatatcctcgagaagatctaccccaacgttaccatcgtttacgtgaaggccaggaccgtgagcgacttccggcacgactacgagctgcccaaggtccgcgccctgaacgactgccaccacgcccacgacgcctacctcaatatcgtggtgggcaacgtgtactacgagaaattcaccaagtccccgttccggttcatcgcgaaccagaagggcaagggggacatcaagtacaacctgtatcgcctgttcgacaaggacgtgaaggtgggcgaccggatcatctggaacgccaaggaggacctcgcccgcgtcaaggccacgctggagcgggacaccgtaaacgtggtccgcatgcccgtggagcagcgcgggcagttcttcgacgccaccatccagaagaagggcaccacgaagaacatgctggtgctccccctgaaaggcagcgacgaacggctgcaggacacctcgaagtacgggtactacgtccgccccagcggcatgtccttcatggtcgtgcagcacgaggtcaagggcaagagccgggtgaccatcgagccggcgctcctggtgtacaagaacaaacttaagagtgaggacgactacgccaagtactgcgaggacgtcctcaagctgcagaagcccaaggtgctgttcaagaacatcaagttcgggagcaagatcctcttcgacgggtaccctttcctgctgaagggacgcaccgagaaccggatcatcatggccgacgcccagtccctcttcctgggcaaccaggagctgaagatcctcaagcgcgtgacgaaaatcagcgacgacatcgaccacaaggtcgagtcccggatcaagatcaccgacgaggaatggaccaccctgtggaagtccgtggtggagcagatcgttacggggaagtttcgcaaccggctgggcaccctcaacgggatcctgcagggccgcaagatcaagctgagcaaggacgaggaggcgcggctcaacgagttagacagcaaggaccaggagaccttcttaagccagatcctcctggagcgcttcctgcagttctccaccgaggagaagacgcggctcctgctccaggtgatcagcttctccgggaacaccaccggcgtggaccttcgcctaatcggcgggagctccggcaccgggacgatcaagaccaacaagaatatcaccgaccacagcgtcatcctgatcaacgagtccccgacaggcctcttcaccaatcggacggtgctgaaccagccctga

SEQ ID NO: 7892 - RNA, 4179 nt, synthetic construct
  misc_feature 1..4179: note = Cas9 variant
  source 1..4179: mol_type = other RNA
atgaagtccatactggggttagacctcggaaccacgagcatcggctgggccctggtgaaggaaagcgagaacgacaacgagaagtccgaaatcgtcaagttgggggtacgtctggtgcccctgacgaccgacgagcgtaccgacttcgaaaagggtaagagcattaccacgaacgccgatagaacctccaagcggtccatgcgccgaaacctccagagatacaagctgagacgggaggcgctggtcagcgaactcaaaaaggagcactggatcgacgaggggtatcgcttttccgaggacggcccgggctccaccttcagcacgctgcgccttcgggccaaggcagccgaggaggagatctccctccaggacctggccaaggtgctattgcagataaacaagaagcgtgggtacaagagctcccggaagctcaacagtgcggaggacggccaagccatcgacgggatgtccgtcgcgaaggttctgtacgaccgcggtctcacgccgggggagtatgtgtatcagcggatgctggacggtcagtacgcgatccccgagttctacaagtcagacctgcaggcagagttcgacaaaatatggaacctccagaagtcatattatcccgagctgaccgccgagctgtacgacaaactcactgacaaaaacaagagtcagacatgggccatctgccgcgacgagctaggcgtgcaggggtttaaatcctcattcacgggaaaggaacggctgaaggaggcatattttaaccgccaacaagccagcaagcagaaagtggacctagaggtgcttacctgcgttctgcaggacatcaacgggcagaaggcgtccctatcaggccttttgtcagccatcagcgacaggtccaaggaactctactttaaccgcatgaccgtcggacagatgctagtgcggcaaatccaggaggacccgaaccgcagcttacgcaacacagtattttaccgccaggattacatcgacgagttcgagaagatctggtcagtccaatctcgcttccaccccgagcttacgcaggagcgtaaaaagaagctgaaggatatcattattttctaccagcgccccctgaagtcccaaaaggggctgattagcttatgcgagttcgaatcccgggaggtcgacatctccgtggatggagtcatcaagaaaaagaagatcgggccccgcgtgtgccctcggtccagccccctattccaggagttcaaggtgtaccaaacggtaaataacatactcgtgaacggcgaacccctagacgacaacgaccgcgagaagctggttggggagttagctttccgtgagaagatgaaaggccaagacgtccttaaactcctgtataagacgtccaagggcatgcgaattaactttgaggaggtcgagggcaaccggaccatggccacgatactgaaggcctgcgagaagatcgtcgagggcctcggttacgacacccgcgacctgagcaagatcaccgcgtccgaaaaggtaagccggatcgaggagatcttcgccaaggaaggctttaaatcggacttcctccactttgactcaagcctgccgtctcccgagttcgagagccaggcctcctactcgctgtggcatcttctgtattcctacgaaaacgacaaatcggtttccgggaacgagagcctggtcgagaagatcaagaagctctgctccatggacgaagcgtcagctaagatactgtcgggctgcaccttcctgagcgattacggctcactttcagcgcgcgccatgcggaagatcctgccctatatgaaggacgggctggaatatagtgccgcctgcgccatggcgggctaccgccacagcaagcggtccctcaccaaggaggagctggacagccgcgtgtacgtagaccggttagaactcctccccaaaaacagtctgcgaaacccagttgtcgagaagatcctcaaccagatgatcaatgtggtcaatagtgttgttgacacctacgggaagccggatgagatccggatagagatggcccgagaactgaagaagtcggcgtcagagagggagaaggcacagaaggacattgctgcggccagcaaggtcaacgagtccatcgttgccaccctgaagggctctccattctttatcgactctcccagccgaaacgacatcatcaggtaccggctctgggaggagctgaaaccaaacgggtataagaccctgtacagcggcacctacatacctaaggagcgcctgttcagcaaggacttcgacatcgagcacatcattccccaagcactgctgttcgatgactcattcgcgaacaagacaatcgagagccggcagtgcaacatagagaagtccaaccgcacggccatggattacgtcaagagcaaatacgactccttcggcgtgcaggcttacatcgatcgtgtgaaggggctcaccggtgtgtccaagactaaaatcacacgactgctgatggagtcaaaagacatccccgaagatttcataaatcgagagctccgcgacagccagtacatagcccgaaaggcccgggagatcctggagtccatggtcaagttcgtggtgcccaccaccgggagcgttaccgcgcggctgcgcgaggactggcagctcgtgaacgtgatgcgggagctgaactgggacaagtacgagaaactgggcctcaccagctttcgcgaggaccgcgacggccgcgaaatcccggtgatcgaggattggaccaagcggaacgaccatcgccaccacgccatggacgcgctgaccatcgccttcacccgccggcagttcatccaatacctgaaccacttaaacgcgaagatcgacacggtggacaagaccgacatagacctacgcgactacaacttggaggatatatctttcgacgggctacgggacggggacaagttcggaatcgtgaaggcactgcagaagaagtacctgtacaaggacgacaagcagaaataccgcttcgtgccgccaatgcctctcgacgagttccggattgaagctaagcgccagatcgaggacgtgctggtgagcttcaaggccaagaacaaggtctgcaccaagaacgtgaataccacaaaggtgcgcgggggccagcagcgaaaaatacagctgacacctcgaggcccccttcacgaagacacgatctacggcaagcgcctgcagtatgtcaccaaggaagagaaggtcgggggctccttcgatgaggccaagatcgctagcgtatgcaaaaagagctacagagaggctttaatgcggcggctcatggagtgcggaggcgatcccaagaaggcgttcaccggaaagaacagcctggagaagaacccggtgtgggtggacgagttccacagtggtgaagtgcccctgcgcgtccggacagtgtcaatggcgtccgtttacaccgtccgcaagagcgtgggccagtcgctgaacatcgaaaaggtcctggacaagcacatcaaggagatcctgcgggcccgcctggaagagtacgggggtaacgcgtcaaaggcgttctccaacctggatgaaaaccccatctggcttaataaagagaagggcatcgccgtcaagcgtgttaccatcgatagcggcaagaaccctatcccgctccgctccaagttagacaaggacgggcagataatctatggcgaaggccaaaacccccaggagagcgactttgttgtccccgggggcaatcaccacgcagccatctatcgaacgccctcgggcaaacttcaggacgtggtggtctccttctacgaggcggtgagcaggaagaacctcggactggaagtgatcgatcgcaacttcaagaaggacgaagggtgggagttcctgttcaccctcaagcagaacgaatacttcgtgttcccgaatcccgccactggcttttcacccgaagattacgacttgaccgatcccgccaataacgccatcatcagccccaacctgtaccgggtacagacggtctccgtgggcgactatcgcttccggcaccaccttgaaaccactgtggaggacaacgagaagctgcgcgacatcgcctggaagcggatagggcccagcggcttagtaggggcggttaaggttcgcatcgacaacctcggccggatccttgccgtcggtgagtacgactga

SEQ ID NO: 7893 - RNA, 4179 nt, synthetic construct
  misc_feature 1..4179: note = Cas9 variant
  source 1..4179: mol_type = other RNA
atggagaacaagaactacagcatcggcctggatatcgggaccaactccgtcggctgggccgtcatcaccgacgactacaaggtgcccagcaagaagatgaaggtgttcgggaacacggacaagcacttcatcaagaagaacctcatcggcgccctgctgttcgacgagggggcgaccgccgaggaccgccggctcaagcgtaccgcccgacgccggtacacccgccggaagaaccgcctgcggtacctgcaggagatcttctccgaggagatcagcaagctcgactccagcttcttccaccgcctggacgactccttcctggtcccgaaggacaagcgtggcagcaagtaccccatcttcgccacgctcgaggaggagaaggagtaccacaagaagttccccaccatctaccacctccgcaagcacctggccgattccaaggagaagaccgacctgcggctgatctacctggcgctcgcccacatgatcaagtaccgcggccacttcctgtacgaggagagcttcgacatcaagaataacgacatccagaagatcttcaacgagttcatctccatctacgataacaccttcgaggggagctccctcagcggccaaaacgcccaggtggaggccatcttcacagacaagatctccaagagcgcgaagcgggagcgcgtgctcaaactcttctccgacgagaagtccacgagcctgttcagcgagttcctcaagctgatcgtcgggaaccaggccgacttcaagaagcacttcgacctggaggagaaggcgcccctccagttcagcaaggacacctacgacgaggacctggagaacctgctcggccagatcggggacggcttcaccgacctgttcctggtggccaagaagctctacgacgccatcctgctgtccggcatcctcacggtgaccgacccgagcaccaaggcgcccctttcggccagcatgatcgagcggtacgagtcccaccagaaggacctggccgccctcaagcagttcatcaagaacaacctgcccaagcgctacaacgaggtcttcagcgaccagtccaaggacggttacgccggctacatcgacgggaagacgacgcaggaggcgttctataagtacattaagaacttgctcagcaagttcgagggcgcagactacttcctggacaagatcgagcgggaggacttcctgcgcaagcagcggaccttcgacaacggctcgatcccccaccagatccacctacaggagatgaacgccatcctgcgccgccagggggagcactacccgttcctgaaggagaaccgggagaagatcgagaagatcctcaccttccgcatcccctactacgtgggccccctggcccgggggaaccgcgacttcgcctggctgacccggaacagcgaccaggcgatccgcccctggaacttcgaggagatcgtggacaaggcctccagcgccgaggagttcatcaacaagatgacgaactacgacctctatctgccagaagagaaggtcctgcctaagcacagcctgctctacgagaccttcgccgtgtacaacgagttgaccaaggtgaagttcatcgccgagggcctgcgggactaccagttcctcgacagcgggcagaagaagcagatcgtcaaccagctgttcaaggagaagcgcaaggtgaccgagaaggacatcatccactacctgcacaacgtggacggctacgacggcatcgagctcaaggggatcgagaagcagttcaacgcgtccctgagcacatatcacgatctgctcaagataatcaaggacaaagagttcatggacgaccccaagaacgaggagatcctggagaacatcgtccacaccctgaccatcttcgaggaccgggaaatgatcaagcagcgcctcgcccagtacgacagtatcttcgacgagaaggtgatcaaagccctgaccaggcgccattacacgggctgggggaagctgagcgccaagctcatcaacggcatctgcgacaagcagaccggggacaccatcctggactacctgatcgacgacggcaagatcaatcggaacttcatgcagctcatcaacgacgacggcctgtccttcaaggagatcatccagaaggcccaggtggtcgggaagaccgacgacgtgaagcaggtcgtgcaggagctgcccggcagcccggccatcaagaaggggatcctccagtcaatcaagatcgtggacgagttggttaaggtcatgggctacgcccctgagtccatcgtgatcgagatggcacgcgagaaccagacgaccgcccgggggaagaagaacagccagcagcgatacaagcggatcgaggactccctgaagaacctcgcgcccggcctggacagcaacatcctgaaggagaaccccaccgacaacatccagctccagaacgaccgcctgttcctgtattacctccagaacggcaaggacatgtacaccgggaagccgctggacatcgaccagctgtcctcctacgacatcgaccacatcattccccaggccttcatcaaggacgactccatagacaaccgggtcctcacaagctccaaggacaaccgcggcaagagcgacaacgtgccctccctggaggtggtccagaagcgcaaggccttctggcagcagctgctcgacagcaagctgatctcagaacggaagttcaacaacctgaccaaggccgagcgcggcggcctcgacgagcgggacaaggtgggcttcatccgccggcagctggtggagacccgccagatcactaagcacgtcgcccagatcctggacgcgagcttcaacaccgaggtgaacgagaagaaccagaagatccggacggtgaagatcatcaccctcaagtccaacctggtctcgaacttccgcaaggagttcgagctgtacaaggtgcgggagatcaacgactaccaccacgcccatgacgcctatctcaacgccgttgtcgccaaggcgatcctgaaaaagtacccaaagctggagccggagttcgtgtacggggactaccagaagtacgacctcaagcgctacatctcccggttcaagccctctaaggagatagagaaggccactgagaagtacttcttctacagcaacctgctgaacttcttcaaggaggaggtgcactacgccgacggcatcatcgtcaagcgcgagaacatcgagtactccaaggacaccggggagatcgcctggaacaaagagaaggacttcgcgacgatcaagaaggtgctcagctacccccaagtgaacatcgtcaagaagaccgagatccagacccacggcctggaccgggggaagcccaagggcctgttcaactccaacccgagccccaagccctctgaggacagcaaggagaacctcgtgccgattaaacagggcctggacccccgcaagtacgggggctacgccgggatctccaacagctacgccgtactggtcaaggccatcgtggagaagggggccaagaagcagcagaagacaatcctcgagttccaggggatctccatccttgacaagatcaacttcgaaaacaacaaagagaactacctgctcaagaagcggtacatcgagatcctgagcacgatcaccctgcccaagtactccctcttcgagttccccgacggcacccgcaggcgcctggcgagcatcctgtccaccaacaacaagcggggcgagatccacaaggggaacgagctcgtgctcccgggcaagtacacgaccctgctctaccacgccaagaacatcaacaagaagctggagcccgagcacctggagtacgtcgagaagcaccgcaacgacttcgccaagctcctggagtgcgtgctgaacttcaacgacaagtacgtgggggccctcaagaacggcgagcggatccgccaggccttcaccgactgggagaccgtcgacatcgagaagctgtgcttctctttcatcgggcccgagaactccaagaacgcgggcctgttcgagctcacgagtcagggctccgccagcgacttcgagttcctgggggtgaagatcccccgctaccgggactacgccccgtccagcttactgaaggccaccctgatccaccagagcatcaccggcctgtacgaaacccgcatcgacctcagtaagctgggggaggactga

SEQ ID NO: 7894 - RNA, 4179 nt, synthetic construct
  misc_feature 1..4179: note = Cas9 variant
  source 1..4179: mol_type = other RNA
atgaacaacaacaactacagcatcggcctagacatcgggaccaactccgtgggctgggccgtcatcaccgacgactacaaggttcccagcaagaagatgaaggtgctcgggaacactgacaagcacttcataaagaagaacctgatcggcgccctcctcttcgacgagggggcgaccgccgaggacagacggttcaagcgcaccgcccggcgccggtacacccgccggaagaaccgcctgcggtacctgcaggagatcttctccgaggagatgagcaaggtcgactccagcttcttccaccgcctcgacgactccttcctggttcctgaggacaagcggggcagcaagtaccccatcttcgccacgctggccgaggagaaggagtaccacaagaagttccccaccatctaccacctccgcaagcacctggcggactccaaggagaagaccgacctgcggctcatctacctggccctggcccacatgatcaaataccgcggccacttcctctacgaggagagcttcgacatcaagaacaacgacattcagaagatcttctccgagttcatcagcatttacgacaacaccttcgaagggtccagcctgtccggccagaacgcccaggtggaggcgatcttcacggacaagattagcaagtccgccaagcgggagcggatcctgaagctgttcgcttacgagaagtccaccgacctgttcagcgagttcctgaagctcatcgtcgggaaccaagccgactttaagaagcacttcgacctggaggagaaggcgcccctgcagttcagcaaggacacctacgacgaggacctcgagaacctgctgggccaaatcggggacgacttcgccgacctcttcctggtggccaagaagctgtacgacgccatcctcctgagcggcatcctgaccgtgacggactccagcaccaaggcgcccctctccgccagcatgatcgagcggtacgagaaccatcagaaggacctggccgccctgaagcagttcatccagaacaacctccaagagaagtacgacgaggtcttctccgaccagagcaaggacggctatgcccgctacatcaatgggaagaccacccaggaggccttctataagtacatcaagaacctgctgtccaagttcgagggcagcgactacttcctcgacaagattgagcgggaggacttcctgcgcaagcagcggacgttcgacaacgggtccatcccccaccagatccacctccaggagatgaacgcaatcatccgccggcagggcgagcattatcccttcctcaaggagtacaaggagaaaatcgagaccatcctgaccttccggatcccctactatgtgggcccgctggcgcgcgggaaccggaacttcgcctggctcacccgcaacagcgaccaggccatccggccgtggaacttcgaggagatcgtggaccaggcctccagcgccgaggagttcattaacaagatgaccaactacgacctatacctgcccgaggagaaagtcctccccaagcactccctgttatacgagaccttcgcggtgtacaacgagctgaccaaggtgaagttcatcagcgagggcctccgcgactaccagttcctggactccgggcagaagaagcagatcgtcaaccagctgttcaaggaaaagcggaaggtgaccgagaaggacatcatccagtacctccacaacgtggacggctacgacgggatcgagctgaagggcatcgagaaacagttcaacgccagcctgtccacgtaccatgacctcctgaagatcatcaaggacaaggagttcatggacgatccgaagaacgaggagatcctggagaacatcgtccacaccctcaccatcttcgaggaccgcgagatgatcaagcagcggctggcccagtacgccagcatcttcgacaagaaggtgatcaaggcgctgacccgccggcactacacgggctgggggaagctctccgccaagctgatcaacggcatctgcgacaagaagaccgggaagaccatcctggattacctcatcgacgacggctacagcaaccgcaacttcatgcagctgatcaacgacgacgggctgagctttaaggacatcatccagaaggcccaggtggtcggcaaaactaacgacgtgaagcaggtcgtgcaggagctccccggctcccccgccatcaagaaggggatcctgcagagcatcaagctggtggacgagctcgtaaaggttatgggccacgcccccgagtccatcgtgatcgagatcgcgcgggagaaccagacgaccgcccgcgggaagaagaacagccagcagagatacaagcgcatcgaggacgccctgaagaacctggccccgggcctcgactccaacattctgaaggagcaccccaccgacaacatccagctccagaacgaccggctgttcctgtactatctgcagaacgggaaggacatgtacaccggcgaggccctcgacatcaaccagctgagctcctacgacatcgaccacattgtcccccaggcgttcatcaaggacgacagcctggacaaccgcgtgctcacgtccagcaaggacaaccggggcaagtcggacaacgtgcccagcctggaagtcgtacagaagcgcaaggccttctggcagcagctgctcgactccaagctgatcagcgagcacaagttcaacaacctgaccaaggccgagcgcggtggcctcgacgagcgggataaagtggggttcatccgccggcagctggtcgagacccgccagatcaccaagcacgtcgcccaaatcctggacgcccggttcaacaccgaggtgaacgagaaggacaagaagaaccgaacggtcaagatcatcaccctcaagtccaacctcgtgagcaacttccggaaggagttcaagctgtacaaggtgagagagatcaacgattaccaccacgctcacgacgcctacctcaacgccgtcgtggccaaggcgatccttaagaagtacccgaagctggagcccggcttcgtgtacggcgactaccagaagtacgacatcaagcgttacatctcccgcagcaaggaccccaaggaggtcgagaaggcaaccgagaagtacttcttctacagcaacctcctgaacttcttcaaggaggaggtgcactacgccgacgggaccatcgtgaagcgggagaacatcgagtactccaaggacacgggcgagatagcctggaacaaagagaaggacttcgccaccatcaagaaggtcctgtcactcccccaggtgaacatcgtgaagaagaccgagatccagacccacgggctggaccgcggcaagccgcgggggctgttcaactccaaccccagccccaagcccagcgaggaccgcaaggagaacctcgtcccgatcaagcagggcctggacccccggaagtacggcgggtacgcgggcatcagcaactcatacgccgtgctggtgaaggccatcatcgagaagggggccaagaaacagcagaagacggtcctcgagttccagggaatcagcatcctggacaagatcaacttcgaaaagaacaaggagaactacctgctcgagaaggggtacatcaagatcctgtccaccatcaccctgcccaagtacagcctcttcgagttcccggacggcacccgccggcgcctggcctccatcctgagcacgaacaacaagcggggcgagatccacaaggggaacgagctcgtgatccccgagaagtataccaccctgctgtaccacgcgaagaacatcaacaagaccctcgagcccgagcacctggagtacgtggagaagcaccgcaacgacttcgccaagctgctcgagtacgtcctgaacttcaacgacaagtacgtgggagccctgaagaacggggagcggatccgccaggccttcatcgattgggagacggtggacatcgagaagctctgcttctccttcatcggcccccgcaacagcaagaacgccgggctgttcgagctgacctcccagggcagcgcgtccgacttcgagttcttgggcgtcaagatcccgcggtaccgcgactacacccccagctccctgctgaacgccaccctcatccaccagagtatcacggggctgtatgagacccggatcgacctgagcaagctcggcgaggactga

SEQ ID NO: 7895 - RNA, 4179 nt, synthetic construct; identical to SEQ ID NO: 2095
  misc_feature 1..4179: note = Cas9 variant
  source 1..4179: mol_type = other RNA

SEQ ID NO: 7896 - RNA, 4179 nt, synthetic construct; identical to SEQ ID NO: 2096
  misc_feature 1..4179: note = Cas9 variant
  source 1..4179: mol_type = other RNA

SEQ ID NO: 7897 - RNA, 4179 nt, synthetic construct; identical to SEQ ID NO: 2097
  misc_feature 1..4179: note = Cas9 variant
  source 1..4179: mol_type = other RNA

SEQ ID NO: 7898 - RNA, 4179 nt, synthetic construct
  misc_feature 1..4179: note = Cas9 variant
  source 1..4179: mol_type = other RNA
atgaacaacaacaactacagcatcggcctggacatcgggaccaactccgtgggctgggccgtcattaccgacgactacaaggttccctccaagaagatgaaggtgctcgggaatacggacaagcacttcatcaagaagaacctgatcggcgccctcctcttcgacgagggggcgaccgccgaggaccgccggttcaagcgcaccgcccggcgccggtacactcgccggaagaaccgcttacggtacctgcaggagatcttctccgaggagatgagcaaggtcgactccagcttcttccaccgcctcgacgattccttcctggtgccggaggacaagcggggcagcaagtaccccatcttcgccacgctggccgaggagaaggagtaccacaagaagttccccaccatctaccacctcagaaagcacctggcggactccaaggagaagaccgacctgcggctcatctacctggccctggcccacatgatcaagtatcgcggccacttcctctacgaggagagcttcgacatcaagaacaacgacatccagaagatcttctccgagttcatcagcatctacgacaacaccttcgaggggtccagcctgtccggccaaaacgcccaggtggaggcgatcttcacggataaaatcagcaagtccgccaagcgggagcgcatcctgaagctgttcgcctacgagaagtccaccgaccttttcagcgagttcctgaagctcatcgtcgggaaccaggccgacttcaagaagcacttcgacctggaggagaaggcgcccctgcagttcagcaaggacacatacgacgaggacctcgaaaacctgctgggccagatcggggacgacttcgccgatctcttcctggtagccaagaagctctacgacgccatcctcctgagcggcatcctgactgtgacggactccagcacaaaggccccgctctccgccagcatgatcgagcggtacgagaaccaccagaaggacctggcggccctgaagcagttcatccagaacaacctacaggagaagtacgacgaggtcttctccgaccagagcaaggacggctacgcccgctacatcaacgggaagaccacacaggaagccttctacaagtacatcaagaacctgctgtccaagttcgagggcagcgactacttcctcgacaagatcgagcgggaggacttcctgcgcaagcagcggacgttcgacaacgggtccatcccccaccagatccacctccaggagatgaacgccatcatccgccgccagggcgagcactacccctttctcaaggagtacaaggagaagatcgagaccatcctgaccttccggatcccctactacgtgggcccattggcgcgcgggaaccggaacttcgcctggctcacccgcaacagcgaccaggccatccggccctggaacttcgaggagatcgtggaccaggcctccagcgccgaggagttcatcaacaagatgacgaactacgacctttacctgccagaggagaaggtcctccccaagcactcattgctgtacgagaccttcgcggtgtacaacgagctgaccaaggtgaagttcatctctgagggcctccgggactaccagttcctggactccgggcagaagaagcagatcgtcaaccagctgttcaaggagaagcggaaggtgaccgagaaagacatcattcagtacctccacaacgtggacggctacgacgggatcgagctgaagggcatcgagaagcagttcaacgccagcctgtccacgtaccacgacctcctgaagatcatcaaggataaggagttcatggacgacccgaagaacgaggagatcctggagaacatcgtccacaccctcacgatcttcgaggaccgcgagatgatcaagcagcggctggcccagtacgccagcatattcgacaagaaggtgatcaaggcgttaacccgccggcactacacgggctgggggaagctctccgccaagctgatcaacggcatctgcgacaagaagacagggaaaaccatcctggattacctcatcgacgacggctacagcaaccgcaacttcatgcagctgatcaacgacgacgggctgagcttcaaggacatcatccagaaggcccaggtggtcggcaagaccaacgacgtgaagcaagtcgtgcaggagctccccggctcccccgcaatcaagaaggggatcctgcagagcatcaagctggtggacgaattagtcaaggtgatgggccacgcccccgagtccatcgtgatcgagatcgcgcgggagaaccagacgaccgcccgcgggaagaagaacagccagcagagatacaaacgcatcgaggacgccctgaagaacctggccccgggcctcgactccaacatcctgaaggagcaccccaccgacaacatccagctgcagaacgaccgtctgttcctgtactacctgcagaacgggaaggacatgtacaccggcgaagccttggacatcaatcagctgagctcctacgacatagaccatatcgtcccccaggcgttcatcaaagacgacagcctggacaaccgcgtgctcacgtccagcaaggacaaccggggcaagtccgacaacgtgccctccctggaagtcgtgcagaagcgcaaggctttctggcagcagctgctcgactccaaactgatcagcgagcacaaattcaacaacctgaccaaggccgagcgcggcggcctcgacgagcgggacaaggtggggttcatccgccggcagctggtggagacccgacagatcaccaagcacgtggcccagatcctggacgcccggttcaacaccgaagtgaacgagaaggacaagaagaaccgcacggtcaagatcattaccctcaagtccaacctggtgagcaacttccggaaagagttcaagctgtacaaggtgcgcgagatcaacgactaccaccacgcgcacgacgcctacctcaacgccgtcgtggccaaggcgatcctgaagaagtacccgaagctggagcccgagttcgtgtacggcgactaccagaagtacgacatcaagcggtacatatcccgcagcaaggatcccaaggaggtcgagaaggccaccgagaaatacttcttctacagcaacctcctgaacttcttcaaggaggaggtgcactacgccgacggcactatcgtgaagcgggagaacatcgagtactccaaggacacgggggagatcgcctggaacaaggagaaggacttcgccaccatcaagaaggtcctgagcctcccccaggtgaacatcgtgaagaaaaccgagatccagacccacggcctggaccgcgggaagccacggggcctgttcaacagcaaccccagccccaagccctccgaggaccgcaaggagaacctcgtcccgatcaagcaggggctggacccccggaagtacggcggctacgcggggatcagcaactcctacgccgttctggtgaaggccatcatcgagaagggcgccaagaagcagcagaagacggtcctcgagttccaggggatcagcatcctggacaagatcaacttcgagaagaacaaggagaactacctgctcgagaagggctacatcaagatcctgtccaccatcaccctgcccaagtacagcctcttcgagttcccggacgggacccgccggcgcctggcctccatcctgagcacgaacaacaagcggggcgagatccacaagggcaacgagctcgtgatccccgagaagtacaccaccctgctgtaccacgcgaagaacatcaacaagaccctagagcccgagcacctggagtacgtggagaagcaccgcaacgacttcgctaagctgctcgagtacgtcctgaactttaacgacaagtacgtgggggccctgaagaacggcgagcggatccgccaggccttcatcgactgggagactgtggacatcgagaagctctgcttttcctttatcgggccccgcaacagcaagaacgccggcctgtttgagctcacctcccaggggagcgcgtccgacttcgagttcctcggcgttaagatcccgcggtaccgcgattacactcccagctcactgctgaacgccaccctcatccaccagagcatcacgggcctgtacgaaacccggatcgacctgagcaagctcggggaggactga

SEQ ID NO: 7899 - RNA, 4182 nt, synthetic construct
  misc_feature 1..4182: note = Cas9 variant
  source 1..4182: mol_type = other RNA
atgaagcgcgtgaccgaggactacattctgggcttggacatcgggaccaacagctgcggctgggccgtcacggacaagaagaacaaccttctgaagctccggggaaagaccgccatcggctcccacctgttcgaggaaggtcacaccgcggccgaccgccggggcttccgtaccacgcggcggcggctgaagcgcaggaagtggcgcctccggctgctggaggaaatcttcgccgagcccatggccaaggtggacccgggcttcttcgttcgcctccaccagagctgggtcagccccctggacaagagccgcaagaagtaccacgccatcgtgttccccaccgcgaaggaagacaaggccttctaccagaagtaccctaccatctaccacctccgcgacgccctcatgactcaggaccggcagttcgacctgcgcgagatcttcctggccatccaccacatcgtgaagttccgggggaacttcctccaggacacgccggtcaaagacttcgaggcgtccaagatcgaggtgggccccatccttagcaagataaacggggccttcgccgagaagattgtggaggaccaggaccccatcgagctgaacgtagccaacgccgcggagatcgaagccgtgatccgtggcaaggacgcagacaagaccctctacaagatggacaaagtgaagaagatcgccaagctgctgaccgactccaccgccaaggaggagaagaacgttgcgaagcagatcgccaatgccgtcatgggctataagacgcagttcgagaccatcctcgggaaggagatagacaagagcgacaaggcccagtgggagttcaagctgaccgacggcgacgccgacgacaagctggaggccctcctgcccgacctggacgagaacgatcagaccatcatcgcagaaatcaagaagttgttctccgccatcacgctgagcaccatcgtggacgagaataagtccctgtcccagtccatggtcgccaagtacaacaagcaccaccaggactacaaacttctgaaggcctacatcgacaccctgcaggatcggagcatcgcgaagaagctccttttggcctacgacctctacgtgaacaaccgccacgggcggttgctggaagccaagactgagtttaagcaggacggcacactcaccaaggaagacttctacaagaccgtgaaggacaacctggacgactccgagctggcccgcaagatcgcgcagaagatcgccgccgacaacttcatgccaaagcagcgcaccaacagcaacggtgtcatcccctttcagctccaccagatcgagctcgacaagatcatcgccaatcagagcaagtattatccattcctggcagcggagaaccccgtggaggaccaccggaagcaggccccgtacaagctcgacgagctggtgcgcttccgggtcccctactacgtgggccccatgataacgcctgacgagcaggagaagaccagcggcaagtccttcgcctggatggtgcgcaaggaggacgggcagatcaccccgtggaacttcgagcagaaggtcgaccggcaggagagcgccaacaagttcatcaagcgcatgaccataaaggacacgtacctgttaggcgaggacgtgctgcccgccaacagcctgctgtaccagaggttcgaggtactcaacgaactgaataacatccgcataaatgggtcccggatcagcatcgacctaaagcagcagatcttcaacgatctcttcgaggagaagaagaccgtgaccgagaagtccctgacaagctacctgaagcagaatctccacctcccaactgtggagatcaagggcctggcggaccccaccaagtttaactccagcctggcctcctactaccacctcaagagcctgcacgtcttcgacaaggagctggcagacccgcagtatcagaaggacttcgaaaagatcatcgagtactccagcatcttcgaggacaagaagatataccaggacaagctgcacgccgagttcaagtggctcacccccgagcagtttaaggccatctccacctggcgcctccaggggtggggccggttaagctgccgcctgctcgtggagctgcacgacacgaacggccagaacatcatggagcagctgtgggactcccagaagaacttcatgcagatcgtgaccgagcccgactttaaggatgcgatcgccaaggagaaccagaacgtcacccaggtgaacggggtggaggagatccttgccgacgcctacaccagccccgcgaacaagaaggccatccggcaggtcgtgaaggtggtcgccgacgtggtgaaggccgccggcgggaagaagccggcgcagttcgccatcgagttcacccgcgaccccgacaaaaatccccaactctcccacattcggggcacgaagctgctcaaggcctaccaggagaccgccggggagttggtcgaccagaagctgaccgacagcctcaaggaagccatgacctcccgcaagctgttgaaggacaagtacttcctctacttcatgcagacgggccgggacgcgtacaccggcaagaagatcaacatcgacgaggtgaccaccaactaccagatcgatcacatcctgccccagagcttcatcaaggacgattccttcgacaaccgcgtgctgacggccaccccgctcaacgccgagaagtccgacgacgtaccctacaagaggttcgccaataactacgtgagcgacctgaaaatgaccgtgggggagatgtggaagcactggcaaaaggccggaatcatcaacaagcacaagctggggaacctactgctggaccccgatagactcaacaagttccagaagtccggcttcatcaaccgccaactggtcgagacctcccaaattgtgaagctggtgtccgtcatcctccagaacaagtacccggacgcggagattatcacggtgaaggccggggacaacagcgccctgcggcagcgcttaaacctctacaagtccagagacgtgaacgattatcaccacgccatcgacgcgtacctgagcatcatctgcggcaacttcctgtaccaggtctaccccaagtatcgcccctatttcgtatacggcaagtacaagaagttctcccaggacccggacctccagaaggacctgattaagcacttcaaggggttcaccttcatgtggccgttgctccagaaggacaacagcgagcggaaggcccccgaggagatcaaggagaacaactcagagcgaatcgtgttctacaagcaccccgacatcttcgacaaacttcggaaggcctacaactacaagtacatgctggtctcacgcgagaccaccacggaatccagctccatgttcaagatgaccatcttccccagaggcgagcgcgacagaaagaagacccgcaagctcatcccgaaggggaacggcctggaccccaagatctacggcgggtacagcggcaacaccgatgcgtacatggtgatcgtgaagatcgacaaggccaaggagtccatctacaaggtcatcggagtgcccatgcgggcactgacgcgcctcaaccaggccaagaagcaggggaactaccaggaggagctgcaccaggtgttagagccccagatcatgctcgataagaacgggaagccgaagcggggcgtcaagggtttccgcgtgatcaaggatcacgtgcccttcaagcaagtcgtgctggacggggacaagaagttcatgctgtatagcgcccagtacaagaccaacgccaagcagctcgccctgtcccaggagaccatgcggatcgtgaccgacaacctgaagaagggcgaggaccaggacaagctcttggtcaaggcgtatgacgagatcctgcagaaggtggactgctacctaagcctgttcgacacgagcaacttccgcaacgggctgcacctcggccggaacaaattcatcgacctggaggtgaacgacaagaagatcaccttgtccaacatcctcaacgggctgcacgacaacatggtactgggcaacctgaagaacatcggcatcgggacgcccctgggccagatgcaggagaagtccgggatcaccctgagccccgaggccgtgctcatcttccagagcccgaccggcctgttcgagaagcgcgtgaagatcgccgacctgtga

SEQ ID NO: 7900 - RNA, 4188 nt, synthetic construct
  misc_feature 1..4188: note = Cas9 variant
  source 1..4188: mol_type = other RNA
atgaagaaggagatcaaggactacttcctaggcctcgacgtggggaccggcagcgtcgggtgggccgtgaccgacacggactacaagctgctaaaggccaaccgcaaggacctctggggcatgcggtgcttcgagaccgcggagaccgccgaggtgcgccggctgcaccgcggggcccggcgccggatcgaacgccggaaaaagcgcatcaagctgctccaggagctgttctcccaggagatcgccaagatcgacgagggcttcttccagcggatgaaggagagccccttctacgccgaggacaagaccatcctgcaggagaacgccctcttcaacgacaaggacttcacggacaaaacgtaccacaaggcgtaccccaccatcaaccacctaatcaaggcctggatcgagaacaaggtgaagcccgacccccgcctgctctacctggcctgccacaacatcattaagaagcggggccacttcctgttcgagggggacttcgactccgaaaaccagttcgacaccagcatccaggccctcttcgagtacctgcgcgaggacatggaggtggacatcgacgcggactcccagaaggtgaaggagatcctgaaggacagctccctcaagaactccgagaagcagtcccggctgaacaagatcctgggcctgaagcccagcgacaagcagaagaaggccatcacgaacctgatctccgggaacaagatcaacttcgccgacctgtacgacaacccggacctcaaggacgccgagaaaaacagcatctccttcagcaaggacgacttcgacgcgctgtccgacgacctggcctctatcctcggcgactccttcgagctgctgctcaaggccaaggccgtctacaactgcagcgtgctgagtaaggtgatcggggacgagcagtacctgagcttcgccaaggtcaagatatacgagaagcacaagaccgacctcaccaagctgaaggcggtgatcaagaagcacttccccaacaactacaagaaggtgttcggctacaaccaggacaacgagagcaagaacaattactccggttacgtcggagtgtgcaagaccaagaataagaagctggtgatcaacaacagcgtcaaccaggaggacttctacaagttcctcaagcccatcctgtccgccaagagcgagatcaaggaggtgaacgacatcctggccgagatcgagacgggcaacttcctccccaagcagatctccaagagcaacgccgagattccgtaccagctgcgcaagatggagctggaaaagatcctctccaacgccgagaagcacttcagcttcctgaagcagaaggacgagaaggggctgtcccacagcgagaagatcatcatgctcctgaccttcaagatcccctactacatcggccccattaacgacaaccacaagaagtccttccccgaccggtgctgggtggtgaagaaggagaagtccccgagcggcaagaccactccctggaacttcttcgaccacatcgacaaggagaagacggcggaggagttcatcaccagccgcaccaacttctgcacctacctgatcggggaatccgttctcccaaagaacagcctgctgtattccgagtacacggtgctgaacgagataaacaacctccagataatcatcgacggtaagaacatctgcgacaccaagctgaagcagaagatctacgaggatctgttcaagaagtacaagaagatcacccaaaagcagatcagcaccttcatcaagcacgaggggatctgcaacaagacggacgaggtgataatcctcggcatcgacaaggagtgcacctccagcctcaagagctacatcgagctgaagaacatcttcgggaagcaggtcgacgagatctccaccaagaacatgctcgaggagatcatccgatgggccaccatctacgacgagggcgagggcaaaacgatcctgaagaccaagatcaaggccgagtacgggaagtactgcagcgacgagcagatcaagaagatcctgaacctcaagttctccggctggggtcgcctgagcagaaagttcctggagaccgtgacctccgaaatgcccggcttcagcgagccggtgaacatcatcacggccatgcgcgagacccagaacaacctcatggagctgctgtcgagcgagttcaagttcaccgagaacatcaagaagatcaactccgggttcgaggacgccgagaagcaattcagctacgacggactcgtgaagcccctgttcctgagtcccagcgtcaaaaagatgctctggcagaccctgaagctggtgaaggagatctcccacatcacgcaggcgcccccgaaaaagatcttcatcgagatggccaagggcgccgagctcgagcccgcccgcaccaagacccggctgaagatcctgcaggacctctacagctcctgcaagaacgacgcggacgccttcagctccgagatccagtacctgagcgggaagatcgagaacgaggacaacctgcgcttgagaagcgacaagctgtacctgtactacacccagctcggcaagtgcatgtactgcgggaagcccatcgagatcggccacgtgttcgacacctccaactacgacatcgaccacatctacccccagagcaagatcaaggacgactccatcagcaaccgcgtcctggtgtgctcctcatgcaacaagaacaaggaggacaagtacccgctgaagtccgagatccagagcaagcagcgggggttctggaacttcctccagcgcaacaacttcatctccctggagaagctgaaccggctcacgcgcaccacccccatcagcgatgacgagaccgccaagttcatcgcccggcagctggtggagacgcgccaggccaccaaggtcgcggccaaggtcctggagaagatgttccccgagaccaagatcgtgtactccaaggccgagaccgtcagcatgttccgaaacaagttcgacatcatcaagtgccgcgagatcaacgacttccaccacgcccacgacgcctacctcaacatcgtagtgggcaacgtctacaacacgaagttcaccaacaatccctggaacttcatcaaggagaagcgggacaacccgaagatcgcggacacctacaactactacaaggtgttcgattacgacgtgaagcgcaacaacatcaccgcctgggagaaaggcaagacgatcatcaccgtcaaggatatgctgaagcggaacaccccaatctacacccgccaggccgcctgcaaaaagggcgggctgttcgaccagacgatcatgaagaaggggctcggtcagcaccccctgaaaaaggagggcccgttctccaacatcagcaagtatgggggctacaacaaggtgtccgccgcgtactacaccctgatcgagtacgaggagaaggggaacaagatccggagcctcgagaccatccccctgtacctggtgaaggacatccagaaggaccaggacgtcctcaagtcctacctgaccgacctgctcggcaagaaagagttcaagatcctggttcccaagatcaagatcaacagcctgctcaagatcaacggattcccctgccacatcacaggcaagaccaacgactccttcctgctgcgcccggccgtgcagttctgctgcagcaacgacgaggtcctctacttcaagaagatcatccggttcagcgagatacgctcccagcgtgagaaaatcggcaagaccatcagcccctacgaggacctgtccttccggagctacatcaaggagaacctgtgcaagaagaccaagaacgacgagatcggggagaaggagttctacgacctcctgcagaagaagaacttggagatctacgacatgctgctgacgaagcacaaggacaccatctacaagaagcgcccgaactccgccaccatcgacatcctggtgaagggcaaagagaagttcaagagcctcatcatcgagaaccagttcgaggtgatccttgagatcctgaagctgttctccgccacccggaacgtctcagagctgcagcacatcgggggctccaagtacagcggggtggcgaagatcggtaacaagatctccagcctggacaactgtatcctcatataccagtccatcacgggcatttttgaaaagcgcatcgacctgctgaaggtgtga

SEQ ID NO: 7901 - RNA, 4188 nt, synthetic construct; identical to SEQ ID NO: 2101
  misc_feature 1..4188: note = Cas9 variant
  source 1..4188: mol_type = other RNA

SEQ ID NO: 7902 - RNA, 4188 nt, synthetic construct; identical to SEQ ID NO: 2102
  misc_feature 1..4188: note = Cas9 variant
  source 1..4188: mol_type = other RNA

SEQ ID NO: 7903 - RNA, 4188 nt, synthetic construct; identical to SEQ ID NO: 2103
  misc_feature 1..4188: note = Cas9 variant
  source 1..4188: mol_type = other RNA

SEQ ID NO: 7904 - RNA, 4188 nt, synthetic construct
  misc_feature 1..4188: note = Cas9 variant
  source 1..4188: mol_type = other RNA
atgaacgcaaaccgcgagatggcctactacatcggcatcgacatggggaccggcagcgtggggatggcgatcaccgacgaaaactataatttgctcaaggtcaagggccaggattactggttcgtgcgggagttcgagacggccaacacccagatcaagcgccgaatgcaccgcatcagcaagcggcgcctgcggcgccaccaagtgcgggtcgccctgatccgcagctacttcgcagaggagatcctcaagaacgaccccctgttcttcatccggcaggacaactccatctactaccttgaggacaaggacagcgtgctcaagaccaaggactgcctgttcgccgattacaactatcacgacaagaactactacaaggactacccgaccattttccatctccgccaggcgttcatcaaggacacggtgaaggacgatgagaaccacacccggtacgccaggctcctgtacctggccatcatcaacatgttcgagcaccgggggcacttcctcttaaattccgtcagcgaggacattaacaaggagatggttaaggacgccggcgagggcttcaccctgtacctccaggaacggatcaaggagatcaagcccgtgtcctacagcgacatcctggacgtcctggtggagaagaacatctcccggagcgagaagaaggagcgcatcgtggagctgttcgggatcaagaagtcctgcaagaacggcatggagatcatcaagtgcctgtgcgggctggaggcgaacgtcgccatcatgttcaacctcgacgacatcgaaaacaagctgaccatcgtggtgagcaaggacgattatgaggacaagttagccgaggtccagcccctcgtagacgaggagtccttcgagctgctgagccggatcaagcagctatacgactactcccagctgcagtcgatcctgaagggctacaaggagaaggaggacggggaggacaaatacctctccgacgtgcgcgttgagctgtacgagaagcacaaggccgacctgaagctcctgaagaaggtgtacaagcgtgacttggacaagaaaggcaagatctgcgagggcaaaaacatccagcgcagttccaagtacaacttcatgttccgcagcgggaaggacggcacgtacagcgcctacaccaactccctcaacagcttctgctccaagaccatcgagaacaagtaccggcgcaacatgaagaatcgggaccgcgcgagcctgtacgacaccatcaagaaggacctatccggtatcgagaacgacgacgtgaagaagatcctccgggacatagagacggagaagttcctgcccaagcagatcaccggcgagaacggcgtcatcccgaaccagatccatgcaaaggaactgaaggccatcctcaagaacgcggagaaacacctccccttcctgaccgagaaggatgacagcgggctgaccgtgtccgagcgcatcatcagcctgtttcggtactgcatcccctactacatcgggcctgtcgggaaggactcccgcacgggctgggccagcatcaaggaggaggggcaaatcttcccgtggaacatcgagcagaagatcgacgtcgacaagacctccgaggagttcatcacccggctgatcaagacctgcacgtacctcagcaacgaaaaggttgtccccaagcagtccctggtgtacgagcgatactgcgtgttaaacgagatcaacaacataaagatccggggcaaacgcatcgacccccagctgaagcaagagatcttcaaggaactctatatcggcagcaagtgcgggaagaaggtgacccggaagaacctctgccagtacctggtgaataagggcgcgatagaggaggactccgagatcagtgggatcgacaaggacctgaacacatatatgtccagctacggcaagatgtaccagatcttcggggacaagatcaagcgcgacgacatcaaggaggtggccgaggagatcatctactacggcaccatttacggcggggccaaggagatgttcaagaaaaagatcgagcagtacgtctccgaggacatcctggacgaggcccagatgaaccggatactgggcttcaagttcaaggactgggcccgcctcagcaaaaagttcctgtacttagaggggtacgacaaggggaaccagaaccagctcacgacgctgatgcaggcgctgtgggactacaatctcaacaccatggagctgatgaacagccccatgttcacctttaaggagacgttagagaagcagaaaaacaagatggagaaggtgctctgcgacttcgagtacgaggacctggacgaatactacttctccgccccggtgaagcggatggtctggcagaccatcgcctgcctgaaagaggtggtgcaaatcatggggcacaatcccaagcgcatcttcatcgagatgcctcgggcagacgaggaaaagggagagcagggcagaaaggccagccgtaagaaccggttgctgtccctgtacgaggagatcgaggacgaacgcccctggaagaaggagatcgagaacgcggccgagagcgggcggctcaattcgaagcgcatgtacttatactacctgcagatgggcaaggacgcctacaccggggaggacatcgacatcgaggacctcttcgacaacagcaagtacgacatcgaccacatctacccgcgatccctgaccgacgacaacagcctggagaacaacctcgtcctggtgtccgccacgatcaaccaggacgtgaagaagaacgactaccccatcccctatgataagatccgcggcaacagcaaggtccgggagctgtggcgctttctccacgagaagaagtttatgaacgacgagaagtacaaccgactgatgtccgacgtgccactgacccaagagcagcttgcgggctacatcgcccgccaactggtggaaaccgcccaggggaccaagggcatcgccgacatcatcaagagcgttattccggacgccgacatcatctactctaaggccaagaacgtgagcgacttccggaagcgctacgggatgctgaaatcccggctcacgaacgacttccaccacgccaaggacgcctacctgaacgtggtcgtgggcaacgtgtacttcacaaagttcacccagaatcccagaaagtacatcaaagacgagaacgacatcgaaaacaagaagtacaactataacctgagcaagatgtacgacaaagacgtcatccggaacgggaaggtggcctggatcgcccagaacggcaagaaggcgggcaccatccagaccataaagaaggtgatggacagaaatacgcccatcatcacccggcaggcctttgagcagcgcggggaattatacgacctgcagcccatctccaagcacaaggccaagaaggagaactacgtcccgatcaaggccaccaacgagaaaatgaaggacgtgactaagtacggcgggttcaccagcctgaacccagcctacttcgtgtttgtcgagtacggcagcgcgaagaagagacagcgctgtttcgccgtggtacactcctactgggcctcgtccatcaagaataacgaggacctcgtaacccacctgaaggaccgggggtacgagaaccccatcgtgatcgccgacaagatcaagaagaacagcctaatcaagtacaacggctacttcctctacatcgtgggcatggacgcgcgcaagcaggtcgagttctccaacgccaccagcatgtgcctgaacaacaacttcatccagtacatccagaagatcgagaaggccaacaccctgatcgccgaggccaaaaagcgccggccctacatcgacgagtcaatcacggcggagcgcaacatcgccctctacaacgagctgaagaagaagcacctggacagcatctttaagaaccacccgaaggggatcggctccgtgctcgagagcggggagggcgccttcgtgcagctgtccctggagcagcagatcgggatcctctactcgataatccaattctccagcttcaagaagggcaccttctccctaaccctgatcggcgggcccaaggaagtcggccggatccgcatcagcgggaatatgccgaaggcccgggagctcaagttgatccactactcgatcaccggcatgtataaaaaggagatcaacctgctcgactga

SEQ ID NO: 7905 - RNA, 4188 nt, synthetic construct; identical to SEQ ID NO: 2105
  misc_feature 1..4188: note = Cas9 variant
  source 1..4188: mol_type = other RNA

SEQ ID NO: 7906 - RNA, 4188 nt, synthetic construct
  misc_feature 1..4188: note = Cas9 variant
  source 1..4188: mol_type = other RNA
atgaacctccgcaacaccaccgacgaatataatatagggctagacatgggcacaaactccgtcggatgggcagtcaccgacaaagtcggagccatcgcgcacttcaaaggaatgccgacactagggagcagactgttcgacgccgcccaaactgccgccgaagcacgtgctcacagaggacaaagacgacgatacgtgagacggaggtggaggctcgacctcctgcaatcactcttccaagacgaaatagacaaagtagactcagagttcttcatacgtttacgtcaatcgagactacacgtcgaagacagagaagacggtcatgccgactacaaatggccaatcttcaacgactccgattttacagaagtggattactacaaacgcttccccaccatttaccatctacgaaagtggctcatcgaaacggaccagaaggcagatatacgcttaatctacctagccgtccataacatagtcaaacaccgcggtaacttcctccgcgaaaacaacaaaaacctctcaagccgtaatgccgaccccgctgaagccgtaggccaccttcggctcgcgctcaacaactggtgtctggaaagaggatacgaatgcgcatggaaaagtggtgggaacgacaacgccatcctgaacgtgcttatcgatggggaaaagagacgatccgaccaagtacgcgagatagcaaaactgactggcatagactgcggagatgcaaagcaaagccgacaatgtaacgaagccatagctaaggctatagtagggctcaaggcagaaatgaagaacatattcggagaatttccggcggaaaagacactgatatacctctcatcggacgacgacgttgaagtagtgcgagacgcctgcccagacgacagcgtcgagctattccaagctctgtgcgagctctatgccgcctacattcttcagggcctactatcgtacgcacccggtcaaaccatatccgtaaacatggtcaagaaatacgatcgatacggcgaagacctccacctactcaaagaactaacacggacgtacgcaagcaagcgatacgacgcgttctttcgcggcgaaacttacgaggggtcgagcgactacgtcgtcgacaaggctcagggctatacacgatacaacctaggaacgacccaactcagctacgatgacttccagaaggcagtaaaggagctattcaaaggaaccgacgcactccaagatgaacggtaccaaggaatgatggtcgccttcggtgaacaaagattcctgcgccgtctaaaaacaagcgataacggctcaatttattatcaattacacctcgaagaactacacgcaatcctggagaaccagggaaaacactacccgttccttctcgccgaagaggataagatagaatccctcgtgagcttccggatcccatactacgtagggcccctaaccagagaaaacgccgcagttgggcatgacgggaaagagcgattcgcctggtcgagccgccgtgacggaatggaacacgccgtaatcaccccctggaattgggaagaaataatagacagagacaaatcagctgaagacttcatcatccggatgacgggagactgcacctacctacaaggagaacccgtcctaccaaaatgtagcctcctgtacgaagaattttgcgcactgaacgagctgaatggagcccactggacgatcgacgaagacgacgagcgacgcttcgatgccgcacaacgcgaacgcatcatgtgcgatctattccgatccacccgtaaagtaacatacaagaaagtgtccgactggctcgaacgcgaagacagcttcgtcggagccagagtacacggcggacaaggagagcatggattcgagtcccagcttggcagctatatcttcttctgcaaagacgtcttcaaaacggacagcctcgacgaggcggactacccaatgatcgagcagataatactgtggtccacactatttgaagaccgcgacattctccgccgaaaaatagaagaagcctacggcgatcgactcacaaccgaacaaataaaggtaatttgcaaaaagcgattcgcaggctggggcaggctaagcaagaaactcctcaccggcatcaaagtagacacggataccgggcgcaaaagtatcatcgacgtcctccgggagggtaatccaaacgacggacaaagaagcagaacaatggtcttcatggaagttctcagggacgaggggctagggttccagaaagccgtcgacgactttaatcgcgattacttctcagaacacaacaacggccttatggacgtgaacgacctcccagggtcccccgcgatccgacgctctatcaatcaagcagtcagaatagtggacgaaattgtgagcatagcaaagaaagaaccggctaacatcttcatcgaagtgacacgagaagaggatgacccccgaaagaaagggaaacgcacaaaaaggcgctacgacgcaatcaaatccgcgctagaagtgttcaagaaagacgacccacaactttggaaagaactaaccaagaaagactcaaacaacatggacgaacggctgtcgctctacttcatgcaaaggggaaaatgtatgtactcagggcgaccgatcaaaatagaggaactacacaccggaaaatacgaagtcgaccacattatcccaagaagctatataaaagacgactccctcgagaacaaagtactcgtctatcgcgaggaaaaccagcacaaaaccgacacactgctaatagacagctcaatcagacgcaaaatgggcaaatactggcgcatgctacacaacgccaaactgatcggcgataagaaatttcgcaatctcttcagagaccacatcgacgataaaacaatgaaaggtttcgtcgcccgccagatcgtcgagacaagccaaatggtaaaattagtccagactctccttgaggcccggtacccaggcgccagaatagtaccagtgaaagcgaacatctcacacgacctccgcgacgcagccggactcgtcaaatgccgcgaagccaacgacttccaccacgcccacgacgcatttctcgcctgccgagtgggcctatttatacaaaaacgacacccctccgtttacgacaaccccataggactggcgcacatcatgcgcgactacgcccgagcccaggcccgggaatacaagaaatcacactacctcgctcacacaaaaggattcatcgtcaactcgttcttatcctcaggattcgacaaggaaacgggggaagtatttaaagacgactgggacgccgaggccgaagtcgaaggtatacgccgggtactgaactacagacagtgcttcatctcgcgaatgccagtagaagcaactggcacattctgggaccagacgatctacagcccgaaatgcgggaaaaagctcactctaccactcaaaagaggactagatcccgacagatacggctcctactcccgtgaacaattcgcttatttcttcatatatgaggcacgcgacctgaaacacgagcggcacatcctccagttcgcccaagtcccagtccgcgtcgccgcccacatcgcaaaagaccccagccaactagagtcatatgccgtcaaacttgccggacaagcaaacctcgcctttgtacgcatagtgcgccggcgaatcctcaagaaacaactcctcgagctcaacggggataggctaataatcacaggagtccgagaagtcagaaacgcaaccgagttcgcattctccctagacgaagaaaccctcatagaacgctgcgtacaaatcgcgaaggtaggatcgctaatcggcgtcgttaacgacgaggacgaggaacaactatcagccgacttaaacgaactcttctccagcctcgtcaagagaggccctaaactatgtaataggctctacgcacaactcaaactcgacaaatacctaagcaaattcgacgaattaaccctaaccgacaaggccaaagtcgtcctccaactaatagcgatcaccaacggatctatcaacatggcggacctcagcgctctgggcagctccaagtacgcgggatgcatgcaagtcagctacttcaagcaactaaacgctcctatcggtgaagtaaacatcatcgaccagagcgtcaccggaatgttcgaaagacgcacgcacatcggactgtga

SEQ ID NO: 7907 - RNA, 4188 nt, synthetic construct
  misc_feature 1..4188: note = Cas9 variant
  source 1..4188: mol_type = other RNA
atgaaggagatcaaggactacatcatcgggctggacatcgggaccaacagctgtggctatgtggtcaccgacaagcagaacaatatcctcaagctgaaggggaagacggccatcggcgcacgcctgttcaaggaagggcaggcggcggccgaccggcgctccttccggaccacccgccggcgcctcgcccggcgccactggcggcttggcctgctcgaggagatcttcgaccccgagatggagaagatcgacccgaacttcttccgccggctgaaggagagcgactactcccccaaggacagccgcaagcagttcaacgccatcgtgttcaagtccatcaaggcggacaagcggttctacaagaagtaccccaccatctaccacctccgcaatgccctcatgcacgacaaccagaagcacgacctgcgggagatcttcatggccgtgcaccatatcgtcaagtaccgcggcaacttcctgcgggaggacagcgtgaacgccttcaaggcggcaaagttctccttacgcggggaggacggcatcggacccgtggacaagctgaacgaccttctcaaggagatctacagcgagtactccccggagctggccacgaacaacctgagcaagatcgaggacatcatcaaggacaagaacctctacaagcaggacaagttgaagcaggtcgccacactgctcatcaaggaggccgactccaaggacaaggcgaagctgaacaaggacatcgccaagcaggtcgccaacagcttcatgggctacatgtttcggctggacaccttgttctccctgaccgacgtggacgtgaaggactacaagctgaagttcagcgacgccaacatcgacgagtccctcgacgacctgacgagcctgctcaccgacgcccagatcgagttcgtgctggagctgcagtccatatataataccattgtgctcaacgagatcgtccccgacgggatgagcctgtccgagagcatgatcaagaagtacgacgaccacaaggaagacctgaagatcttcaaggagtacatcgacagcctctccgaccagaagaaggcgaagaagctgctgagcgcatacaacctctacgtgaactaccgcaagtccgacctggtggaggccaagaacctgttcaagaacaagaaggtcggcgacaagaacttcgccgacgtgatcagcaacttcgaggtgttcggcaagttcgtctccgataacctcgacgacagcgagctggccaacaagatcaaggcgcggctggacctcggggagttcctacccaagcagcgcaccaaccagaacggcgtgatcccctaccagctgcaccaggtggagctcacgcagatcctggagaagcaggggaagtactacccgttcctgatcacccccaaccccgtcgagtcccaccgcaacaacgccccctacgagatcagcgagctggtgtcattccgggtaccgtactacgtcggccccctcatcgacaaccagagcatcaaggacaagcagaacaagaacaaattcgcctggatggtgcgccagaaacagggccagatcaccccctggaacctggaggagatggtcgataccacggagtccgccaaccagttcatcaagcggatgacccgcaaggacacctacctgctcgccgaggacgtcctgcccaagagctccctggtgtaccagaagttcatgatcctcgacgagctgaaccggatcaagattgacgggaagaagctgaccagcgagctcaaacacgacatcttcgagaagctgttcaagaagcagaagtccatcaacctggacaacctcaagaactacctgctggtcgagggcaacatcccggggctcatcgagggtctaagcgacgggatcaacttcaacaactccttcagcacgtacatcgactaccgcaacatcttcggcgacgagatcgacaaccccaacaagcaggcggacttcgagaagatgatcgagtggtccaccgtgttcgaggaccggaagatcttcaagcgcaagctgaaggagatcacctggctcaccagcgagcagatcaagcaggtcagctccaagcggtatagcggctgggggcgcctgtccaagaagctgctcacgcaaatcaccgacgagaacggcgtgaacatcctgcagcggctgtggaacgagcccgagaccctcaccgaggtgctggccaaccccgtgatcaagcgcaagatcgtcgaggccaacagtagcttcacgaaggccaaggacatgaaggacatcctggtggaggcgtacaccagcccgcagaacaagaaggccatccgccaggtgatgcgggtcgtggacgatatcatcgccgccgcccacgggaagaagccctcccagatcgcgatagagttcgcgcgggaggaccaggacaacccccagatgaccaagagccgcaaggcccagctcgaccagatctacgccaagatctccgacgagttcctggacgacgccgtcaagaacgagctgaagaacatgaaggacaacaagcccctcgcgaaggacaaggtcttcctgtacttcaagcagatgggccgcgacgcctacagcggcgagaagctgtccctcgacaacctgcaggactacgacatcgaccacatctacccgcagagctttatcaaggacgactccttcgacaaccgcgtgctggtgcagcgggcctacaacaacggcaagagcgacaacgtccccgtgctcctgttcggcaacaagatcgccgccgggctgggcatcaccatccgccagatgtggaagaagtggctcgagctggggctgatctccaagcgtaagttcaacaacctcataacggaccccgagaagatcagccggaacatggcgtccggcttcgtgaaccgccagctggtcgagaccagccaggtgatcaaactggtggccaacatcctccaggccaagctgcccgacaccgagatcatcgaggtcaaggcctcctacaactccatcctgcggaaggagttcaacctctacaagtcccgggaggtgaacgactaccaccacgcgatcgacgcctacctgaccaccatcgtagggaactacctgtaccaggtttacccgaagctccggccctacttcgtgtacggccagttcaagaaattcggcaaggccgagaaccaggaggacgaccccgtgaaaaagatcaagaaattcaacttcatctaccagctgatctgggggaaagacgacgccatctgcatctcccacacaaaccagcaagtcttcagcaagaaggacatcatcgacaagttaaccaccgcctacaacttcaagtacatgaacatcagccacgcggtgtacacgcgcaacaacaacatgttcaagcagacgctgttcccgatcatagagcggaccaccgccaagaccaagagcctgatccccaagaagctggaccgcccgacggacatctacggcgggtactccaacaacaacgacgcctacctcgccctggtgaaggtcgacaagaaacggggcagcgagtaccgcgtggtcggcattcccatgcgggccgcggccatgctgaaggcctccaagaactatgacgaggacctccgcaaggtcatcgagccgatggtgatgttcgataagaacgggaaggccaagcggggcatcgaggggttccgcgtgctggtcggcaagatgcccttcaagcaggctgtgctggacgggaacaagaagttcatgctcaccggcaccgtggacacccctaacttgaagcagctcgtcctcagccagcagaacatgaagtacatcctggactacatcgaggacgtggactgccggaagcacaaattcggcgacaaggtgcagaaccccgacaagtgcctgctcgaggtctttgacgagatcatcgagatcgtggacaagtacttcgaactgttcgactcccgcgacttcagggagaagctgcgcaacagccgcaacaagttcatcaagctcgaggcgtccaagaaggccgacacgatcctggccatcctgaaagggttacaggccaagagcacccgcgcgactatcaaggagctgaacatctccgatttcggccgtatcatcaccagctccatcagcccggaggcccagctgatctaccagtcccccacgggcctcttcgagcgccgcgtgaaggtcaaggacctatga

SEQ ID NO: 7908 - RNA, 4188 nt, synthetic construct; identical to SEQ ID NO: 2108
  misc_feature 1..4188: note = Cas9 variant
  source 1..4188: mol_type = other RNA

SEQ ID NO: 7909 - RNA, 4188 nt, synthetic construct; identical to SEQ ID NO: 2109
  misc_feature 1..4188: note = Cas9 variant
  source 1..4188: mol_type = other RNA

SEQ ID NO: 7910 - RNA, 4188 nt, synthetic construct; identical to SEQ ID NO: 2110
  misc_feature 1..4188: note = Cas9 variant
  source 1..4188: mol_type = other RNA

SEQ ID NO: 7911 - RNA, 4188 nt, synthetic construct; identical to SEQ ID NO: 2111
  misc_feature 1..4188: note = Cas9 variant
  source 1..4188: mol_type = other RNA

SEQ ID NO: 7912 - RNA, 4188 nt, synthetic construct; identical to SEQ ID NO: 2112
  misc_feature 1..4188: note = Cas9 variant
  source 1..4188: mol_type = other RNA

SEQ ID NO: 7913 - RNA, 4188 nt, synthetic construct; identical to SEQ ID NO: 2113
  misc_feature 1..4188: note = Cas9 variant
  source 1..4188: mol_type = other RNA

SEQ ID NO: 7914 - RNA, 4188 nt, synthetic construct; identical to SEQ ID NO: 2114
  misc_feature 1..4188: note = Cas9 variant
  source 1..4188: mol_type = other RNA

SEQ ID NO: 7915 - RNA, 4191 nt, synthetic construct; identical to SEQ ID NO: 2115
  misc_feature 1..4191: note = Cas9 variant
  source 1..4191: mol_type = other RNA

SEQ ID NO: 7916 - RNA, 4191 nt, synthetic construct
  misc_feature 1..4191: note = Cas9 variant
  source 1..4191: mol_type = other RNA
atggcgaacctgcgaaactacaaaggtgactacaacataggactcgacatgggaacggggtctgtcgggtgggcggtcaccgattcggaaggcaaactactccacttcaagaagcaaccaacctggggatcacggctatttgacagcgcggagacggccgcaagcgcaaggatccctaggggccaaagacgccgctacgtgaggagacgatggaggctagatctgctgcagcaactattccaagacgaagtatcgaaagcagacccagagttcttcatccggctccgacaaagccgcttactgaaagaagaccgagaagaagggcaccgcgactacaaccatcccctcttcaacgactcggatttcactgaaacagattactacaaccgattccccaccatctatcacttaaggaaatggctgatggagaccgatgaaaaggccgatataaggctagtatacttggccgcccacaacatagtaaaacaccgagggaacttcctgcgccaagaaaataccagcctcagtgccaagaacgcccgccccctagacgcgctccgcgagttcagatccgccctagtagactggtgcgcagaactcggctatgaatgcaaccccgacgaaagcggtgagatatcaaacgagattcttagcgtactagaggaagaacacgtagcaaacagtgacaaaaagaaaagaatatcatcactgatcggagtcgccatgaacgagggggccaaggaaagcaaagcctgtaacgacgcactcgctggagcaatggtcggactaaaagccgagttcaagaacgtcttcggcgaaatctcagcggaacaaacttccatatatctgagcaacgacgaagccgtagacgcactccgtgagggaataccagacgaaggcttggaactattcggaaaactatgcagcgtatacagcgcctatgtgttacagggcctactcagctacgccccgggacaaaccatcagtgtgaacatggtcgccaagtacgaaaaatacggcaacgacctcaaaaccctaaaagccctcgtgtgcgaatacgcgagagcggaatacgattcgttcttcagaggggaattttacagggaccaagacggtcatgaactaaacatatacaacgcctcaaaagcgcaaggatacaccagatataatctgggaacttccaaaatgagctacgaggacttcgaaaaagccgtcaagaaactcttcgcggggacggccgcagaagaggacgggcgctacctacagatgatgaaagagttcggagaacaacgatttctgcgacgcctgaagacatccgacaatggcagtatatactatcagctccacctagaggagctaaccgcgatacttagcaatcaaggaaaacactaccccttcctggtcgaagacgcagagaaaattaagtcattagtgagcttccgaatcccgtactacgtcggacccctaacagacaggaacgcccgaaaagacaaacacgggaaaaatcgatttgcgtggtccgaacgaaaaagcggcatggaggacgcagtaataaccccttggaattgggacgaagtaatagacaggggaaagtctgccgaggcgtttataaccagaatgaccggaatgtgcacataccttcaaggagaagacgtgctaccaaaatgcagcctactctacgaagaattttgcgtgttaaacgaactcaacggctcacgatggggaatggacggggacaaagaacaccgcttcgacgctgcggatcgagaggcgataatagaagaactattcaagaagaagaagacagtgaaatacaaggacgtcgccaactggctagagagagaagcaggtcgcatgaacgtacacgtaatgggaggccagggggagacgggctacgaaagcaaactgagtagctactacttcttccgccgcgacatattcgacgtggaagaactcgacagagcggactatcccatgatcgaacagataatactttggaacacactcttcgaagaccgaaggatacttaaggagaagctcgaagacgcatacggaccgaaggggaatggccgtcttgacgacgaccagatcaagaaaatatgtcgcaaacgattcacgggttggggccgtctatcgaagaaattcctcacgggaataaaagtcgacacagactgcggccccagatccatcatggacgttctcagagaaggcgaccccaacgcaggtttccgcggcaagacaatggtgatgatggaagtcctgcgtgacgagaacctggggttccaacaaaaagtcgacgagttcaataaaaattactttggacaaaaaggaaaagcgcttgaagtcaacgagctccccggcagcccggccatacgtcggagccttaaccaggcaatacgcatcgtcgacgaaatcgcaaaaatcgccggtaaggacccagaaagcatcttcatagaggtaacacgcgacgacgaactagacaaacggggcaaaaggacaaagcgacgctacgacgccctaaaagaagccctcacagtattcaaaaaggaagatccagagatctgggcagagctccaggcaacaagcccaagcgacctagacgagagactgacactctacttcatgcaaagagggaagtgcctttatagcggagaaccgatagacataaacaagctaagctcaggggagtacgaagtcgatcacataatcccccgaagctacataaaagacgactcactggagaataaagccctcgtgtgcagaaagtacaaccaaagcaagactgacgcaatgctcctggacccaagcatcagacgcaaaatgcgaagctactgggatatgctgttagacgccaagctaataggccctaaaaagcatcggaatctgctgagggaccacattgacgagaaagcgatgaaaggatttgtcgcaagacaattagtagagacaagccaatcagtgaaactcgccgggagcctgctctcggtacgatatccaaacgcaaacatagtcccagtaaaggcgtcgatgtcccacgacctccgtgaagccgccggattcgtcaaatgcagagaagcaaacgacttccaccacgcccacgacgcctacctcgcatgtcgaatgggcctcttcatacaaatgcgacaccctaaagtctacgagaatccaatagcaatgaccagagtcatgcaaaaatacgcccaacagcagagtaaagagttcaaccgaaaccacagagtaccgggaacgagcggattcatagtgaatagcttcatgtcctccggattcgacaaggaaaccggagaaatctttaaagatacatggaatgccgaaaccgaaatcgaaggaatacgcaaagcgcttaattacaggcaatgttacatatcccgcatgcccatggaagacacaggggcgttctggaacgcaacagtctactcccccagggacccaaagatggggccaaagctcgcattaccactgaagaagggcctcgacccaaagaagtacggaggattctcctcccagcaattcgcatacttctttgtgtacgaagccagggacaaaaaggacaagcaggtctttcgctttgcagaagtcccagtatggctcgcatcccagatagaatcagacaagatcgccctcgagagatacgcgaccggactagctgaggcggagaaactaaaatttgtaaggatagaaagagcaaagattctaaagaaacagctcatcgagatagacggcgaccggtttatactaaccggcaagaaagagatgcggaacggacgagagctggcgctctcacaaaaagaaacgctcaacctcatagtggcgggagacgaaaacgcctcactggacgaccgtggcaacgcgagcgacgccgtatttgacgccatcgtgcgccagggagacgagattggactaagactctataaacaattgaaaatcgccgagatcgcagaacggtaccgaagtgtaggcgccgacgcgaaagtcggggccgtcatgagcttactcagctccattaatgccagcagcaacatggtcaacctctcgatggtgggaggaagcaagtatgccggcaatctgcaaccgaactactcaaacctcctaagcgacccggaaactaacttcgtgataatcgatcaaagcgtcacgggaatgttcgagagacgcacgcgaataggattgtga

SEQ ID NO: 7917 - RNA, 4191 nt, synthetic construct
  misc_feature 1..4191: note = Cas9 variant
  source 1..4191: mol_type = other RNA
atgaccaagccatacagcataggcctggacatcgggaccaacagcgtgggctgggccgtcattacggacgactacaaggtgccagccaagaagatgaaggtactcggtaacactaaccgcgactacatcaagaagaatctgctgggcgcgctccttttcgacgggggcgagaccgccgagggccggcgcctgaagcggaccgcccgccggcgctacacgcggcgcaagaaccggctccgctacctccaggagatcttcgccgaagagatgatgcaggtcgacgagagctttttccagcggcttgacgactccttcctcgtggaggaggacaaacaggggagcaagtaccccatctttggcaccctgaaggaggagaaggagtaccacaagaagttcaagaccatctatcacctccgcgaggagctcgccaactccaaggagaaggcggacctgcggctggtttacctcgcattggcccacatgatcaagttccgcgggcacttcctgtacgagggcgatctcaaggccgaaaacactgacgtccaggctctcttcaaggactttgttgaggagtacgacaagacgatagaagagagccacctgtccgagatcaccgtggacgcgctcagtatactgaccgagaaggtctccaagagttcccggctggaaaacttaatcgcccactaccccaccgagaagaaaaatacgctgttcgggaatctgatcgccctaagcctgggcctccaggccaacttcaaaaccaacttccagctctcagaagacgcgaagctgcagttcagcaaggacacctacgaggaggacctggagggcctccttggggaggtgggcgatgagtacgccgacctgttcgtctccgctaagaacctttacgacgccatcctgttgagcgggatcctcaccgtcgacgacaactccacgaaggccccactgagcgcctccatggtgaagcgatataaggagcacaaggaggagctggctgccttcaagcggttcatcaaggagaaattaccgaagaagtatgaggaaatctttaaggacgacacaaagaacggctacgcggggtacgtgggcgccgacaagaagctccgcaagcggagcggcaagctggcgaccgaggaggagttctacaaatacgtcaaggggatcctcaacaaggtagagggagccgactacttcctggacaagatcgaccgcgaggacttcctgcggaagcagcgtacctttgacaacggtagcatccctcaccaaatccatctccaggagatgcacgctatcctgcggcggcagggcgagcactaccccttcctgaaggagaatcaggacaagatagagaagatactgacattccgcatcccctactacgtaggcccgctcgcccggaagggctcccgcttcgcctgggcagaatacaaggccgatgaaaagatcaccccctggaacttcgacgacatcctggacaaggaaaagagtgccgagaagttcatcacccggatgaccctgaacgacctttatctgcccgaggagaaggtcctacccaagcacagcccgctctacgagacgttcactgtgtacaacgagcttaccaaggtaaagtacgtcaacgagcagggcgaggcaaagttctttgacaccaacatgaagcaggagatcttcgaccacgtgtttaaggagaaccgcaaggtgacgaaggacaaactgctcaactacctgaacaaggaatttgaagagttccggatcgtcaacctgaccggcttggacaaggagaacaaggcgttcaacgccagcctgggcacctaccacgacctgcgcaaaatactcgacaagtccttcctggacgacaaggtgaacgagaagatcatcgaggacataatccagaccctgacgttattcgaggaccgtgagatgatccgccaacggctgcagaagtacagcgacatcttcaccacccagcagctgaaggagctagagcgccgacactacacggggtggggccgcctatcgtacaagctgatcaacggcattcggaacaaggagaacaagaagacgatcctcgactacctgatagatgacggctacgctaaccgcaacttcatgcaactgatcaacgacgacgctctcagcttcaaggaggagatcgcccgggcgcagatcatcggcgacgtagacgacatcgccaacgtggtccacgacctgcccgggtcccccgccatcaagaagggcatcctgcagagcgtcaagatcgtagacgagctcgttaaggtcatggggcacaatccaaccaacatcatcatcgagatggcccgcgagaaccagaccaccgacaagggcagacgcaactctcagcagcggctaaagctgctccaggacagcctgaaaaacctggacaacccggtgaatatcaagaacgtcgagaaccagcagctacagaacgaccggttgttcctgtactacatccaaaacggcaaggacatgtacaccggcgagacgcttgacatcaacaacctgtcccagtacgacatcgaccacatcatcccccaggccttcatcaaggacaacagcctggacaaccgcgtgctcacccgctccgacaagaacaggggcaagagcgacgacgtgccttccattgaggtggtccacgagatgaagtccttctggagcaagctgttaagcgtcaagctcattacccagcggaaattcgacaacctgaccaaggcggagcgcggcggcctgacggagaacgacaaggccggcttcataaagcgtcaacttgtggagacacggcagataactaagcacgtcgcccaggttctggacgcccggttcaacgccaagcacgacgagaacaagaaagtgatccgggacgtaaagatcatcaccttgaagtcgaacctcgtgtcacagttccggaaggacttcaagttctacaaggtgcgcgagatcaacgactatcaccacgcgcacgatgcctacctgaacgccgtcatcggaacggcccttctcaagaagtaccccaaactggcgagcgaatttgtgtacggcgagttcaagaagtacgacgttcggaagttcatcgccaaatccgacaaggagatcgggaaggccaccgccaagtacttcttctacagcaacctgatgaacttcttcaagaaggaggtcaagtttgccgacggcacagtggtggagcgtccggacatcgagacctccgaggacggggagatcgcgtggaacaagcagacggacttcaagatcgtccggaaggtgctctcctacccccaggtgaatatcgtcaagaaaaccgaggttcagacccacggactggatcgcggcaagccccgtgggctgttcaacgcaaacccctcccctaagcccaagcccgactcctccgagaacctcgtgggcataaagcgtaacttggaccccaagaagtatgggggctacgccgggatcagcaactcctacgccgtcttagtaaaggccatcatcgagaagggagtgaagaagaaggagacgatggtgctcgagttccaggggattagcatcctggaccggattacatttgaaaaggacaagcgcgcttttctgcttgggaagggctacaaggacatcaagaagataatcgagctgccgaaatactcactgttcgagctcaaggacgggtctcggaggatgctagcatccatcttatccaccaacaacaagcgcggcgagattcacaaggggaacgagctgttcgtgccccaaaagtttaccacgctgctgtaccacgccaaacggatcaacaaccccatcaacaaggaccacatcgagtacgtgaagaagcaccgcgacgacttcaaggagctcctgaactacgtcctggagtttaacgaaaagtatgtaggcgccacgaagaacggcgagcggctcaaggaggccgtcgcggatttcgactcaaagagcaacgaggagatctgcacgagctttctaggggccgtcaactccaagaacgccggtctgtttgagctcacaagcctagggtccgccagcgacttcgagttcctcggggtaaagatcccgcgctaccgggactacaccccctcctctctcctgaaggactccatcctgatccaccagagcatcacggggctctacgaaactcgtatcgacctgagtaaactgggcgaggactga

SEQ ID NO: 7918 - RNA, 4191 nt, synthetic construct; identical to SEQ ID NO: 2118
  misc_feature 1..4191: note = Cas9 variant
  source 1..4191: mol_type = other RNA

SEQ ID NO: 7919 - RNA, 4194 nt, synthetic construct; identical to SEQ ID NO: 2119
  misc_feature 1..4194: note = Cas9 variant
  source 1..4194: mol_type = other RNA

SEQ ID NO: 7920 - RNA, 4194 nt, synthetic construct
  misc_feature 1..4194: note = Cas9 variant
  source 1..4194: mol_type = other RNA
atgaagaaggtgctgggcctcgacctggggaccaatagcatcggctgggccctggtcaacgaggccaccaaggaggagaagaaggaggggaaatcatccgagatcatcaagctcggtgtgcgagtgaaccccctgacggtcgacgagaaaaccaacttcgagaagggacggccgctgtccaccaacgcggaccggaccctcaagcggagcgcccgcaggaacctgcagcgctacaagctgcggcgccggaacctcatcgagatcctgatcaagaacggcttcatcacgaaggacacgcccctgaccgagaccgggaaggacaccacccaccagacactcaagctacgcgccaagtccgccaaggagaaggtggacctgaaggacttcgccaagatcctcctgaccatcaacaagaagcgggggtacaagagctccaggaaggtgaatagcgacgaggacggcctggcgatcgacgggatggcggtcgccaagcatctgtacgagcagaacttaacgcccggccagtacgtgctcaacctcctgcagaaaaacaagaagtacgtgccagacttctaccggtccgacctgcaggaagagttcaagaacatatggaacaaccagaagacctactacttcgatatcctcaccgacaccctgttcgaggagctgaaggacaaaaacaagagtcagacgtgggccatctgcaagaaaccgttcgacatcgcggggatcaagcagatcggcaaggcatccgacaagcgcctcgagcggtacaaatggcgcaccgaaggcctgacccagaagctgaacctcgagtacctggccatcgccctgcaggagatcaacaatgacatcaacaagagctccgggtacctcggcgccatctctgaccggtccaaagagctgttcttcaacaaggagaccgtcggggagaacctgtaccgccagttagtgaagacaccccacactagcctgcggaaccaagtattctaccgccaggattacctggacgagttcgaaaccatctgggagacccaggctaagttctacccccagttaacgcacaccctgaaggaggagatcagagacgtcatcatcttctaccagcgcaagttgaagtcccagaagtccctcatcagcttctgccagttcgagagctgggagcagacctacatcgagaaggagaccggtaagtccaagacgcgcaccgtgggccggaaggtgatacccaagtccagcccgctgtttcaggagttcaaaatctggcagaacctgaactccctcgagttccgcaacagcgacgagggcgagattatcgagttcatcaagctggacgaggacatccggcagaccgttttcgaggagctgaacctccgcggcaacctgaagcccaacgacgtgctgaagatcttagggaactatatttccctcggcaaggtgagccagtggaaatgcaacttcgaggagatcgaggggaaccggaccaacgccgccctgtacaacgtataccagataatcgccgagaacgagggctacggcttcgactgggccaagaagacggcttccgagatcaacaaggagctgaagaacatcttcccccaactcgggatcgacgccagcatcttggacttcgacttcacccaggccaatttcgacaaacagacctcctaccagctgtggcacctcctgtacagcgccgaggaggacttcaagatctccgaggaggacaaggtgctgtacggcaacagctccgtcagcctcaagaagaagctgcaccagaagtacggttttaagcccgagtacaccaagctgctcaccaacatctccctgcagccggactacggcaacctgagcgccaaggcgatctgtaacatcctcccctacctgaaggaaaataacgtctactccgaggcctgcgacttgaccgggtacaaccacagcaacttcctcaccgccgaggagcaggccaagcgccccctgaagcctatcctggagctgctgaaaaagaactcgctgagaaacccggtggtggagaagatcctcaaccagatggtcaacgtggtcaaccaggtgatcgagacctacggcaagcccgacgagatccgcatcgagctgacccgggagctgaagaagtccgccaaggagcgggcgaacatgaccaagagcatcgccgacgccacccggagaaacgacgactaccggaagaccatcatcaaggagtttggcatccccaaccccaccaaaagcgacgtggtccgctaccggctctggcaggagctggccagccgcgggtacaaggacatcttcacggacaccgagatcaaaccgcaggagctattctccaacaagatcgacatcgagcacatcatccccaaggcgctcctcttcgacgacagcttctccaacaagaccctggctttcaagaaggacaatcttaagaaggccaaccgtaccgcgtacgacttcatcgccaacgattatgcgcccaacctggagaactacatcgagcgcgtggagagcctgcacaaggaccgaaagatcacgagggccaagaggaacaagctcctgatgctacaatcgaagctccccgacggcttcattgagcgggacctgcgcaacagccagtacatcaccaaggaggccaagaagatgctgtacgaggtgtgccggaccgtcgtgtccaccagcgggtccatcaccgacaagctccgcgaggactgggaccttatcaacgtgatgaaggagctcaacttcccgaagtacaaagccctcggcctgaccgagaagatagagcggtacgacatcggcgccgagaagatgaaggaggtcgagatcatagaagactggaataaacgcaacgaccaccggcaccacgcaatcgacgccctgaccgtggccttcagcacccactcccacatccagtacctcaaccacctgaacgcccgacgggacgagggccacaagaaacatgccgcgatcatcgccatcgagagcacgatcaccgagaaggagggcaacaagaagcgccggttcattgcgcccctgcccaacttccgcctgcaggctaaggaacacatagagtccatcctggtgagcttcaagaacaagaacaaggtcgtgaccaacaacatcaacaagaccaagcggatcaagaaggacaagttcaacactaaggtgcagctcacgccccgcgggcagctccacaaggagaccatctacggcaagatcaagcagccgctcgagaagcacatcaaattgaacaagtccttcaccttagaacaggccaagctgatcatcgacaagcggcagcgcgagaaggtcctgaaccacctcgagaagtacgcccacaacagcgacatcgcgttcaacagcaagaccctgaagaagaacccccttctcatctccgatgagcccctgaaggaggtgctgtgcttcgaggaggtgttcaccatcagaaaggacatcagctacgacaacttcaagaacgagaagcagctcgacaaggtcatcgacgagaaggtgaagcaagcgctgaaggagcgcatcaaccagtacaacggggatttccgggaggccttctccgacatcgaacgcaacccgatctggctgaacaaggcgaagggcatttgcgtgaagcgggccaccatcaagggcgtcagcaacgccgagcccctccacacggccaagaaccacttaggggaggaggttctgacggagaacaaggagcagatccccgttgactacgtctccaccgggaacaaccaccacgtggccatctacgaggacgaggacgggaacctccaggaaaaggtggtcagcttctacgaagcggtgatccgtgtgaacgagggcctgcccatcatcgataaggagtacaacaagtccctggggtggaccttcaagttcaccatgaagcaaaatgagatgttcgtcttcccgagcgaagacttcaaccccacggagatcgacctcctggaccagaagaacgcgtccctgatcagccccaacctcttccgcgtccagaagttcacgatcaaggactacttcttccggcaccacctggagaccaccgtggagaacaacaacacgctgaagaacaccacttggcgccgggagggcctttcgggcatatacgggatcatcaagatccgcctgaatcacctgggcgagatcgtccaagtgggggaatactga

SEQ ID NO: 7921 - RNA, 4194 nt, synthetic construct; identical to SEQ ID NO: 2121
  misc_feature 1..4194: note = Cas9 variant
  source 1..4194: mol_type = other RNA

SEQ ID NO: 7922 - RNA, 4197 nt, synthetic construct
  misc_feature 1..4197: note = Cas9 variant
  source 1..4197: mol_type = other RNA
atggagacccaggccagcaaccagctgatctccagccatctcaagggctaccccatcaaggactacttcgtcgggctggacatcggcacctccagcgtcgggtgggccgtcacgaacaaggcttacgagctgctcaagttccgctcccacaagatgtggggcagccggctgttcgacgagggggagtccgccgtggcccgccggggcttccgcagcatgcgccgacggctggagcgccggaagctccgcctgaagctgctcgaggagctgttcgccgacgccatggcgcaggtcgacccgaccttcttcatgcggctgcgcgagtccaagtatcattacgaggacaagaccaccggccacagctccaagcacatcctcttcatcgacaagaactacaacgaccaggactacttcaaggagtaccccacggtgtaccacctccggagcgagctgatgaagtccgggaccgacgacatccgcaagctgttcctggccgtgcaccacatcctgaagtatcggggcaatttcctctacgagggggccacgttcgacagcaacgcctccaccctggacgacgtcatcaagcaggcgctggagaacatcacattcaactgcttcgactgcaacagcgccatctccagcatcggccagatcctcatggaggccgggaagaccaagtccgacaaggccaaggccatcgagcacctggtggacacctacatcgcgaccgacacggtggacaccagcagcaagacccagaaggatcaggtcaaggaggacaaaaagcggctgaaggccttcgccaacctcgtcttgggcctgaacgcctccctcatcgacctgttcggcagcgtggaggagctggaggaggacctcaagaagctgcagatcacaggggacacatacgacgacaagcgggacgagctagccaaggcgtggtccgacgagatctacattatcgacgactgcaagtcagtatacgacgcgatcatcctcctgagtatcaaggagcccggtctgaccatcagcgaatccaaggtgaaggccttcaacaagcacaaggacgacctcgccatcctcaagagcctgctgaagtccgaccgcagcatctacaacaccatgttcaaggtggacgagaaggggctgcacaattacgtccactacatcaagcagggccggaccgaggagacgtcctgcaaccgcgaggacttctacaagtacaccaagaagatcgtggagggcctgagcgactccaaggacaaggagtacatcctcagccagatcgagttacagatcctgctccccctgcagcggatcaaggacaacggggtgatcccgtaccagctgcacctcgaggagctgaaggccatcctggcgaagtgcggccccaagttccccttcctgaacgaggtcgccgacgggttctcagtggccgagaaactcatcaagatgctggagttccgcatcccctactacgtgggcccgctgaacacccaccacaacgtcgacaacgggggcttcgcctgggcagtgcgcaaggcgagcggtcgggtgaccccctggaacttcgacgataagatcgaccgcgagaagtccgccgccgcattcatcaagaacctcacgaacaagtgcacctacctgctgggggaggacgtcctccccaagagctccctgctgtacagcgagttcatgctcctgaacgagctgaacaacgttcggattgacggcaagcccctcgagaaggtcgtgaaggagcacctgatcgaggcggtgttcaagcaggaccacaagaagatgaccaagaaccgcatcgagcagttcctgaaggacaacgggtacatcagcgagacccacaaacacgagatcacgggcctcgacggggagatcaagaacgacctggcctcctaccgggacatggtccgcatcctgggcgacggcttcgaccggagcatggccgaggagatcatcaccgacatcaccatcttcggggagtccaagaagatgctcagggagaccctgcggaagaagttcgccagctgcctggacgacgaggccatcaagaagctcacgaagctgcgctaccgggactggggccgcctgtcccagaagctcctgaacgggatcgagggctgcgacaaggcgggggacggcacccctgagaccatcatcatcctgatgcggaatttcagctacaacctcatggagctgctgggcgacaagttctcgttcatggagcgcatccaggagatcaacgccaagctcaccgaggggcagatcgtgaacccccacgacatcatcgacgacctggccctgagccccgccgtgaagcgggccgtctggcaggcgctccgcatcgtggacgaggtcgcccacatcaagaaggccctgcccgcccggatcttcgtcgaggtgacgcgctccaacaagaacgagaagaagaagaaggacagccggcagaagcgtctgagtgacctctacgccgcgatcaagaaggatgacgtgctgctgaacggcctcaacaacgagatcttcggggagctcaagagctccctggccaagtacgacgacgccgccctgcgcagcaagaagctgtacctgtactacacccagatgggccggtgcgcgtacaccggcgagatcatcgagctctccctgctgaacaccgacaactacgacatcgaccacatctacccgcgcagcttaaccaaggacgactcctttgacaacctggtcctgtgcaaacggacggccaatgcccaaaagtccgacgcctaccccatcagcgaggagatccagaagacccagaagcccttctggaccttccttaagcagcaggggctgatcagcgagcgcaagtacgagcggctgacccgcatcacgcccctcaccgccgacgaccttagcggcttcatcgcgcggcagctggtggagaccaaccagtccgtgaaggccgccaccacgctcctgcgccggctgtacccgggggtcgacgtggtgttcgtcaaggccgagaacgtgaccgacttccgccacgacaacaacttcatcaaggtgcggagcctcaaccatcaccaccacgccaaggacgcatacctgaacatcgtcgttggcaacgtataccatgagagattcacccggaacttccgcgccttcttcaagaagaacggggccaaccggacctacaacctggccaagatgttcaactacgacgtcaactgcacgaacgccaaggacggcaaggcgtgggacgtgaagacctccatggacaccgtgaagaagatgatggacagcaacgacgtccgcgtgaccaagcggctcctggagcagacgggcgccctggccgacgccaccatctacaaggcgaccgtggccgggaaggccaaggacggcgcctatatcgggatgaagaccaagtccagcgtgttcgccgacgtgtccaagtacggcgggatgaccaagatcaaaaacgcgtacagcataatcgtgcagtacaccggcaagaagggcgaggtcatcaaggagatcgtgcccctcccaatctacttgaccaaccgcaacacaacggaccaagacctgatcaattacgtggcctccatcatcccccaggccaaggatatcagcattatttacgggaagctctgcatcaaccagctggtcaaggtgaacggcttctactactacctcgggggcaagaccaactccaagttctgcatcgacaacgccatccaggtgatcgtcagcaacgagtggatcccgtacctgaaggtgctggagaagttcaacaacatgcggaaggacaacaaggacctgaaggccaacgtggtctccacccgcgctctcgacaacaagcataccatcgaggtccggatcgtggaagagaagaacatcgagttcttcgattacctggtctccaagctgaagatgcccatctaccagaagatgaaggggaacaaggccgccgagctctccgagaaggggtacggcctgttcaagaagatgagcttagaggagcagtccatccacctcatcgaactgctgaacctcctaacgaaccagaagaccaccttcgaggtgaagcccctggggatcaccgccagccgcagcacggtgggctccaagatcagcaaccaggacgagttcaaggtcatcaacgagtccataaccgggctctacagcaacgaggtgaccatcgtgtga

SEQ ID NO: 7923 - RNA, 4197 nt, synthetic construct
  misc_feature 1..4197: note = Cas9 variant
  source 1..4197: mol_type = other RNA
atggagaagtcctacagcatcggcctggacatcgggaccaacagcgtgggctggtccgtcatcaccgacgactacaaggtgcccgccaagaagatgagagtgctcgggaacacggacaagaagtacatcaagaagaacctgctgggcgccctcctgttcgacagcggagagaccgcggaggccacccggctaaagcgcaccgcccggcgccggtacacgcgtcggaagaaccgcctccggtacctgcaggagatcttcgccaaggagatggccaaggtcgacgagtccttcttccagcgcctggacgagagcttcctcaccgacgacgacaagaccttcgactcccacccgatcttcggcaacaaggcggaggaggacgcctaccaccagaagttcccaaccatataccacctccggaagcacctggccgacagccaggagaaggccgacctccgcctgatctacctggcgctcgcccatatgatcaagttccggggccatttcctgtacgacaacttcaacgacgacaacttcgactggcgcaacatcgacatccagaagcggtacgaggagttcatcgagacgtacgactccaccctgggggagagctacctcgccgatatctccgtggacgccgcctccatcttagaggagaaggtgtccaagaccgagcgcctggagaacctcctgaagtactaccccaccgagaagaagacgaccttcttcggcaacctgatcaagctcatcctggggcagcaggcgaaattcaaggccatctttaacctggaggacgagattagcctccagttcgccacccccacctacgatgaggacctggaggagctgctcggcaagatcgacaacggggactcctattccgagctgttcgtcgccgcccagaacctatacaacacgatcctcctggcgtccttcctgaagacagacaacaaaagcgccaaggccccgctctccaccagcatgatcgagcggtacgagaaccacaagaaggacctggccaagctgaaagactttgtgaagaagaactgccccgaccagtaccacgacatcttccgcgacaagagcaagaacggctacgccggctacatcgacaacggggtgtcccagaatgacttctacaccttcatcggcaagtgtctcgaggagagcctgaagaaggacaagggggcgcagtatttcctggacaagatcgaccgggacgacttcctacgcaagcagcggacgttcgacaatggcgccttcccctaccagatccacctccaggagatgcacgccatcctgcgccgtcagggcgactactatccgttcctcaaggagaaccaggacaagatcgagaagatcctgaccttccggatcccgtactacgtcgggcccctggcccgcaaggacagtcggttcgcctgggcgaactaccgcagcgacgaggccatcaccccctggaacttcgacgaggtggtggacaaagagaagtccgccgagaagttcatcacccggatgacgctcaacgacctgtacctgcccgaggagaaggtcctgccgaagcacagcctcatctacgagaccttcaccgtgtacaacgagctgaccaacatcaagtacgtgaacgaccagggcaacgccatccacttcgactccgagctgaaggagaagatcttcaaccagctgttcaaggagaaccgcaaggtcagcaagaagacgctgatcgacttcctgaacaactccgaggggatctacaccgacaagctcgtgggcatcgacgaggaggtgaagtacctgaacgcgagcctggggacctaccacgacctcaagaagatcctggagtccttcatggacgacgagatcaacgagaagatcatcgaggacatcatccagaccctgacgctgttcgaggacatcgagatgaagcggcagcgcctgcagaagtacgacgacatcttcacccccaagcagctgaaggagctcgcccggcgcaactacaccggctggggccggctgtcgtacaagctgatcaacgggatccgcaacaaggagaacaacaagaccatcctcgactacctgaagaacggcaaccggaacttcatgcagttaataaacgacgaccgcctctcgttcaagcaaatcatcatcgacgcgcggaagatcgagaagctggataacattgaaagcgtcgtgtataacctgcccgggtcccccgccatcaagaagggcattctccagagcatcaagatcgtcgacgagctggtcaaggtgatggggcacaacccggacaacatcgtgatagagatggcccgcgagaaccagacgaccaaccaaggcaagaaccggtcccagcagcgcctgaagcggctccaagacagcatgtccaacttcaaggacagcagcatctccctgaaggacgtcgacaacagcgacctgcagaacgaccgcctcttcctgtactacatccagaacggcaaggacatgtacaccggggaggagctggacatcgaccacctctccgactacgatatcgaccacatcatcccgcagagcttcatcaaggacaactccatcgacaacagggtgctgacctcttccgcgaagaaccggggcaagagcgacgacgtccccgggcgcgacgtggtgctgaagatgaagcccttctggaagaagctctacgacgtcaagctgatctccaagcggaagttcgacaacctcaccaagagcgagcacggcgggctcactgagtctgacaaagcagggttcatcaagcgccagcttgtggagactcggcagatcaccaagtacgtggcccagatcctggacggccgcttcaacaccaagcgggacgacaacaacaaggtcatccgcgacgtgaaggtgatcacgctcaaaagctccctagtcagccagttccggaaggacttcgggttctacaaggtgcgcgagatcaacgactaccaccacgcccacgacgcctacctgaacgcggtggtcggcaccgccatcctcaagaagtacccgaaactggccccagagttcgtgtacggggagtacaagaagtgcgacgtgcggaagttaatcgccaagtccggcgacaagagcgagatcggcaaggccaccgcaaagtacttcttttactccaacctcatgaactttttcaagcgcgtcatccggtacagcaacgggatgatcgtggtgcgccccgtcatcgagtacagcaaagacaccggcgagatcgcctgggacaaggagaaggacttcaaaacggtgtgcaaggtgctgtcctgcccccaggtcaacatcgtgaagaaggtcgagaagcagagtcacgggctggaccggggcaagccgaaggggttctacaacgccaacccctcccccaagcccaagaagggcagcaaggtcaacctcgtaccgatcaaggccaacctgaaccccaagaactacggcgggtacgcgggcatctccaacagctacgccgtgctggtcgacgccaccatcgagaagggggccaagaagaagctaacccgcatccaggagttccagggcatctcgatcatcgaccgggagaagtacgagaagaacaaggtggagttcctgaaggggctgggctacaaggagatctacagcatcatcaccctccccaagtactccctgttcgagctggccgacggcagccgccggatgctcgcgtccatcctgagcacgaacaacaaacgcggggagatccacaagggcaacgagctggtgctcccggccaaatacatccccttactgtaccacgccaaccggatccacaacaccttcgagaccgggcaccgcgagtacgtcgagaagcacatcgccgagttcaaggagatcgccgagatcatcctcgagttcaacaacaagtacgtgaacgccaagaagaactccagcatcatcgagaaggccctggagtccttcgacagcttctccctggacgagatctgcgacagcttcgtgggcaagctcaagaagaacaacaccaagaagaactccgggttgttcgaactggtcagcctcggcagcgcctccgacttcgagttcctggagacgaaggtgccccgctaccgggactacacccccagctccctgctcaacgccaccctgatccaccagagcatcaccggcctgtacgagacgcgcatcgacctctcaaagctgggggaggagtga

SEQ ID NO: 7924 - RNA, 4197 nt, synthetic construct
  misc_feature 1..4197: note = Cas9 variant
  source 1..4197: mol_type = other RNA
atggagacccaggccagcaatcagctgatctccagccacctcaaaggctatcccatcaaggactacttcgtggggctggacatcggcacctccagcgtcgggtgggccgtgacaaacaaggcgtacgagctgctcaagttccgctcccataagatgtggggcagccggctgttcgacgagggggagtccgccgtggcccgacggggcttccgaagcatgcggcgacggctggagcgccggaagctcagactgaaattgttggaggagctgttcgccgacgccatggcgcaagtcgacccgaccttcttcatgcggctgcgcgagtccaagtaccactacgaggataaaaccaccggccacagctccaagcatatcctcttcatcgacaagaactacactgaccaggactactacaaggcctaccccaccatttatcatttacgggccgaactcatgaaggacgggacctacgacatcagaaagctgttcctggccgtgcaccacatcctgaaataccggggcaacttcctctatgagggggcgagcttcgactcgaacgccagcaccctggacgacgtgctgaagcaggccctcgagaacatcacgttcaactgtttcgactccagcgccgccatcggctccatcgggcagatcctgatggagaccggcaaaactaagagcgacaaggcgaagacgatcgagcgcctggtcgacacgtacatcatcaccgatgaggtgaacgcctccggcaagacccagaaggaccaagtgaaggaggacaagaagcggctcaaggccttcgccaaccttgtactggggctcaacgccagcctgatcgacctgttcggcagcgtggaggagcttgaggaggacttgaagaagctgcaaattaccggggacacgtacgacgacaagcgcgacgagctcgcgaaggcctggtccgacgagatctacatcatcgacgactgcaagagcgtgtacgacgccatcatcctgctgtccatcaaggagcccggcctcaccatctccgaatccaaggtcaaggcattcaacaagcacaaggacgacctggccatcctcaagagcctgctgaagtccgaccggtcgatttacaacgcgatgttcaaggtggatgagaagggcctgcacaactatgtgcactacatcaagcaggggcgcaccgaggagacctcctgcaaccgggaggacttctacaagtacacgaagaaggtcgtggagggcctccccgacagcaaggacaaggagtacattctgtccgagattgagctgcagaccctcctgccgttgcagagaataaaggacaacggcgtgatcccataccagctccacctggaggagctgaaggtcatcctggcaaagtgcggccccaagttcccctttctcaacgaggtggccgatgggttctcggtggccgaaaagttaatcaaaatgctagagttccgcatcccgtactatgtcggccccctcaacacctcccacaacgtggacaatggcgggttcgcctgggctgtgcggaaggccagcggccgcgtcaccccctggaatttcgacgacaaaatcgaccgggaaaagtccgccgccgcgttcatcaagaacctgacgaacaagtgcacctatctgctcggggaggacgtactgcccaagagctccctgctctactccgagttcatgctgctgaacgaactcaacaacgttcgcatcgacggcaagccgctggagaccaaggtgaaggcccacctgatcaaggccgtgttcaagcaggaccacaagaagatgaccaagaaccggatcgagcagttcctcaaggacaacaactacatccccgagaagcacaagcccgagatcacggggctggacggcgagataaagaacgacctggcctcctacagggacatggtccggatcctcggcaacaatttcgacctgagcatggccgaggagatcataaccgacatcaccatcttcggggagagcaagaagatgctgcgcgagaccctccgtaaaaagttcgcatcctgcctggacgacgaggccatcaagaagctgagcaagctacggtaccgggactggggccgcctgtccaagaaactgctcaacgggatcgacggctgcgacaaggccggggacggcacgagcgtgaccatcatcgaggccatgagggacttctcctacaacctgatggagctgctcggggaccgcttcctgttcatggagcggattcaggagatcaacgacaaacttacggaggggcagatcgtgaacccccacgacatcatcgacgacctcgccctgagcccggcggtcaagcgtgccgtgtggcaggccctgcggatcgtggacgagatcgtccacattaagaaggccctccccgccaggatcttcgtggaggtgacccggtccaacaaggcggagaagaagaagaaggactctcgccagaagcgcctgtccgacctgtacgccgctatcaagaaggacgacgccctcctgagcggcctgacgaacgaggagttcggcggcctcaagtccgagctcgcgaagtacgacgacgccgcgttacggagcaagaagctctacctgtactacacccagatgggccgctgcgcgtacaccggggaggtcatcgacttgtcccagctcaacaccgacaactacgacatcgaccacatctacccccggagcctgaccaaagacgactcctttgacaacctggtgctctgcaagcgcacggctaacgcgcagaagtccgacacctaccccatctcaaaggagatccagaaggcccaaaaggccttctggatcttcctgaagcagcaaggcctcataagcgagcggaagtacgagcgcctcacccggatcaccccgctgacggccgacgacctgagcgggttcatcgcccgccagctcgtggaaaccaaccagagtgtcaaagcggccacaaccctgctgcggcgcctgtaccccgacatcgacgtagtcttcgtcaaggccgagaacgtgacggacttccggcacgacaacaacttcatcaaggtgcgctcgctgaaccaccaccaccacgcaaaggacgcgtacctgaacatcgtcgtgggcaatgtgtaccacgagaagttcacccggaacttccgcgcgttcttcaagaagaacggggccaaccggacctacaacctcgccaagatgttcaactacgatgtcaaatgcacgaacgccaaggacggcaaggcgtgggacgtgaagacgtccatggacaccgtgaacaagatgatgaccagcaacgacgtccgcgtgaccaagcggctgctggagcagagcggcgccctcgccgacgccacggtgtacaaggccaccgtcgcggccaaggccaaggacggggcctacatcggcatgaagaccaagagctccgtgtttgccgacgtgaccaagtacgggggcatgacgaagattaagaacgcgtacagcatcattgtccagtacatcgggaaaaagggcgaggtggtgaaagagatcgttcccctgcccatctacttaaccaaccgcaacatcaccgaccaggacctcatcgactacgtggcctccatcaccccgcaggccaaggacatcagtatcatctacagaaagttatgtatcaaccagctggtgaaggtcaacggcttctactactacctcggcgggaagacgaactccaacatctacatcgacaacgccgtggaggtggtcgtgcccgccaacatcgcggtgtacatcaaggtcctggagaagttcgccctgctccacaaggacaacaacaatatcaaagccagcaccgtgaccacccgcatctacaacgaggggtccacgaacatcgtgagcatcaccgacaaggacgggctgatcgtctacgactacctgatgtccaagctccggacgcccctgtacatgaagatgaaggggaacaaggtggacgagctgtcaacggtgggacgctccaagttcatgaacatgacactcgaggagcagagcatctacctgctggaggtcctcaacctgctgaccaactcaaagactaccttcgacgtgaaggccctcggcatcacggcgagccgcagcaccataggggtcaagatccacacactagacgagttcaagatcatcaaccagtccatcaccggcctgtacagcaacgagatcaccatcgtgtga

SEQ ID NO: 7925 - RNA, 4197 nt, synthetic construct
  misc_feature 1..4197: note = Cas9 variant
  source 1..4197: mol_type = other RNA
atggagacccagaccagcaaccagctgatcacgtcccacctcaaggactaccccaagcaggactacttcgtgggcttagacattgggaccaactccgtgggctgggccgtgaccaacacctcctacgagctgctcaagttccacagccacaagatgtgggggtcccgcctgttcgaggagggcgagagcgccgtgacgagacgcgggtttcggagcatgcgccggcggctggagcggcgcaagctccggctgaagctgctcgaggagctgttcgcggacgccatggcgcaggtcgacagcacctttttcatcagactgcatgagtccaagtaccactacgaggacaagaccaccggccatagctccaagcacatcctcttcatcgacgaggactacacggaccaggactacttcaccgagtacccgaccatctaccacctccggaaggacctgatggagaacggcaccgacgacatccgcaagctgttcttggccgtgcaccacatcctgaagtaccgggggaacttcctctacgagggcgccacgttcaacagcaacgcgttcaccttcgaggacgtgctgaagcaggccctggtcaacattaccttcaactgcttcgacaccaactccgccatcagctccatcagcaacatcctcatggagtccgggaagaccaagagcgacaaggccaaggcgatcgagcgcctcgtggacacctataccgtgttcgacgaggtcaacacccccgacaagcctcagaaggagcaggtcaaggaggacaagaagacgctgaaggccttcgccaacctcgtactgggcctgtccgccaacctcatcgacctgttcgggagcgtggaggacatcgacgacgacctgaagaagctccagatcgtgggcgacacctacgacgagaagcgggatgagctggccaaggtgtggggcgacgagatccacatcatcgacgactgcaagagcgtctacgacgcaatcatcctgatgtccatcaaggagcccgggctcaccatcagccagtccaaggtgaaggccttcgacaagcacaaggaggacctggtgatcctcaagagcctcctgaagctggaccgtaacgtctacaatgagatgttcaagtccgacaagaagggcctccacaactacgtgcactacatcaagcaggggcggaccgaggagacgagctgctcccgcgaggacttctacaagtacaccaagaagatcgtcgaggggctggccgactcaaaggacaaggagtacatcctgaacgaaatcgagctccagaccctgctgccgctccagcggatcaaggacaacggtgtcatcccctaccagctgcacctggaggagctcaaggtgatcctggacaagtgcgggcccaagttccccttcctgcacaccgtgtccgacggcttcagcgtcacggagaagctgatcaagatgctcgagttccgcatcccgtactacgtggggccccttaacacccaccacaacatcgacaacggagggttctcctgggccgtccggaagcaggccggccgcgtgaccccctggaacttcgaggagaagatcgatcgcgagaaatccgcggccgccttcatcaagaacctgaccaacaagtgtacgtacctgttcggagaggacgtgctgcccaagagcagcctgctctactccgagttcatgctgctgaacgagctcaacaacgtccggatcgacgggaaggcactcgcccagggcgtgaagcagcatctgatcgacagtatcttcaagcaggaccacaagaagatgaccaaaaaccgcatcgagctgttcctgaaggacaacaactacatcaccaagaagcacaaaccggagatcaccgggctggacggcgagatcaaaaacgacctcacgtcctaccgggacatggtgcgcatcctggggaacaacttcgacgtcagcatggcggaggacatcatcaccgatatcaccatcttcggagagtccaagaagatgctgcggcagaccttgcgcaacaagttcggcagccagctgaacgacgagaccatcaagaagctgagcaagctccggtaccgcgactggggccggctgtccaagaagctgctcaagggcatcgacgggtgcgacaaggccggcaacggggcccccaagacgatcatcgaactgatgcgcaacgacagctacaacctgatggagatactcggcgacaagttctccttcatggagtgtatcgaggaggagaacgccaagctggcccagggccaggtggtgaacccccacgacatcatcgacgagctggcgctcagccccgccgtcaagcgggccgtgtggcaagcactgcgcatcgtggacgaagtcgcgcacatcaagaaggccctgccgtcccggatcttcgtggaggtggcccgcaccaacaagagcgagaagaagaagaaggactcccggcagaagcgcctcagcgacctgtactccgccatcaagaaggacgacgtcctgcagagcgggctccaggacaaggagttcggcgccctgaagtccgggctcgcaaactacgacgatgccgccctccggagcaagaagctgtacctgtactacacccaaatgggccgctgcgcctacaccggaaacatcatcgacctcaaccaattgaatacggacaactacgacatcgaccacatctacccccggtccctgaccaaggacgacagcttcgacaacctcgtgctgtgcgagcgcaccgccaacgcgaagaagtccgacatataccccatcgacaaccgcatccagaccaagcagaaacccttctgggccttcctgaagcaccaggggctcatcagcgagcggaagtacgaacgcctgacgcggatcgccccgctgaccgccgacgacctctccggcttcatcgcccgccagctggtggagaccaaccagagcgtcaaggcgaccacgaccctgctccggcgcctgtaccccgacatcgacgtggtgttcgtcaaggccgagaacgtgagcgacttccggcacaataacaacttcatcaaggtgaggtcactgaaccaccaccaccacgccaaggatgcctacctcaacatcgtcgttgggaacgtgtaccacgagaagttcaccagaaacttccgcctgttcttcaagaagaacggcgcgaaccggacctacaacctggccaagatgttcaactacgacgtcatctgcacgaacgcccaagacgggaaggcctgggacgtgaagaccagcatgaacaccgtgaaaaagatgatggcctccaacgacgtacgcgtgacccggcgcctcctggagcagagcggcgcgctggccgacgccacgatctacaaggcctccgtggccgcgaaggccaaggacggcgcctacatcgggatgaagaccaagtacagcgtcttcgccgatgtgaccaagtacggagggatgaccaagatcaagaacgcctactccatcatcgtgcagtacacgggcaagaagggggaggagatcaaagagatcgtccccctccccatctacctgatcaaccggaacgcgaccgatatcgagctgatcgactacgtaaagagcgtgatcccgaaggccaaggatatctccatcaagtaccgcaagctctgcatcaaccagctggtgaaggtgaacggcttctactactacctgggcgggaagaccaacgacaagatttacatcgacaacgccatcgagctcgtggtcccccacgacatcgccacctacatcaagctgctggacaagtacgacctcctccggaaagagaacaagacgctgaaggccagctccatcacaaccagcatctacaacatcaacacctccacggtggtgagcctctccaacaaggtcggcatcgacgtgttcgactacttcatgagcaagctgcgcacgcccctgtacatgaagatgaaggggaacaaggtggacgagctctccagcactggccggtccaagttcatcaagatgaccctggaggagcagagcatctacttactcgaggtcctgaacctactcacgaacagcaagaccaccttcgacgtgaagcccctgggaatcacgggctcccgcagcaccatcggcgtgaagatccacaacctggacgagttcaagatcatcaacgagtccatcacggggctctacagcaacgaggtcaccatcgtgtga

SEQ ID NO: 7926 - RNA, 4200 nt, synthetic construct
  misc_feature 1..4200: note = Cas9 variant
  source 1..4200: mol_type = other RNA
atgaagaccatactgggactggacttagggaccacgagcatcgggtgggccttagtgaaggaggccgagcccttctccgacgagaagtccgagatcgtccgcctcggggtacgggtgattcctctgacagtcgacgaacgcaccagcttcgagaacggcaaatctatcactacgaacgcgctgcggacccagaaacgcgggatgcggcgcaacctccagagatacaagttgcggcgccaggccctgatcgaggagctaaagagcaccggctggatcggcaacgacttcatctttagcgagaccggtcccggctccacgtttcgcaccctgcgtctgcgcgccaagagtgcctccgaggaagtgaccctcggggatctggcccggatccttttgcagatcaacaagaagcgcggctacaagtcatcccggaagatggtgagcagtgacgacggacaggcaatcgacggcatggccgtcgccaaagaaatgtacgataagggccttacccctggggaatacgtgtaccagcgcatgctagagggcaagtacgcaataccggagttctacaagagcgatctccaggaagagttcgaccgcatctgggccctgcagaagtccttccacattgagctgactgacgagctctaccggaaactcagcgacaggaacaagtcacagacctgggctatctgccgcgacgagctgggaatccagggcctcaagagctcctttatcggcaaggagcggctgaaggaggcctaccgctacaggcacttggccgccacccaagaggtgaacatggaggtcctgacatgtgccctacaagaaataaacgggcaaaaagccagcctgagcggcctcctgtccaagatcagcgaccggtccaaggagctgtacctcaacaatctgaccgtggggcagatgctgctcaagcgcatcgaggacaacccgaacaacagcctgaaaaacatcgtgttctaccggcaggactacctggacgagttcgagcgaatctggactgtccagtccaagtatcacactgagcttacccacgagctgaagaagcggctacgcgacatcatcatcttctaccagcggcccctcaagtcgcagaagggacttatctctttatgcgagctcgagacgaaggacatcgaggtggccatcgatggggtgaagaagatgaagaacattggcccccgcgtctgtccccggagctcgccgctgttccaggagtttaaaatctggcagaccatcaataacatcttcgtgaacggcgccgcactggacgatgaggacaagagcgtgatagctaaggagctcatgttcaaagacaaactgaaggactccgacctgctgaaactcctgtttaagacgaccaaggggcaaagcgtcaactttaaagaggtggatggcaaccgcacgatggctaccctgatgaaggcctgtttcaagatcgccgaaaacctcgggtacgacgacatcggtctgagcaagctgagctccgaggaccagatggtccggatcgaggggatcttcaaggagcagggcttcaagaccggcttcctccacttcgatagctccctagcgagccccgagttcgagaaccaggactcctaccgcctgtggcatctcctgtacagctacgagggggacaagagcgcttccggcaatgagagccttgtcaagtgcatcatggatctctgctccatggacgagggttccgccaagatcctggcatcctgcacattcctgccagattacggctcgctctccgccaaggccatgcgcaagatcctgccctacatgaaggacgggttagaatacacggcggcctgcgccatggccggctaccggcacagcaagcggtccctaaccaaggaggagctggacactaaagagtacagcgaccgcctgtccctcctgccgaaaaacagcctacggaaccccgtagtggagaagatcctcaaccagatgataaatgtcgtgaactccgtaatcgacgtgtacggcaaaccagacgagatccgtatcgagatggcccgggagctgaagaagtcggcaaaggagcgcgaagaggcccaacgagacatcgcctccagcaccgccgagtcccagaaggtgatcgagatcctgaagggggaacccttcttcctgcagttcccgacgcggaatgacatcattcgctaccggctgtaccaggagcttgcgcagaatggcttcaaaaccctctacagcaatacctacatccccaaggataagctgttcagcaaggagttcgacatcgaacacattatcccccaggccctgatcttcaacgactccttcgccaataagacgctcgagagccgccagtgcaacttggagaaagggaaggagacagccatggactatgtaaaatctaagtacgacgaaaccggcgtacaaacctattgcgaccgggtgaacggtctgatcgggaagggcatcagcaagaccaaggccaagtggctcctcatggagggtaaggacatccccgaagacttcatcaatcgcgagttgcgggactcccaatacatcgcgaaaaaggcccgcgagatcctcgagagcctggtcaaattcgtggtgccgactacaggctccgtgaccgcccggttgcgggaggactggcagctcgtgaacgtgatgcaggagctgaactgggagaagtacgccaggttggggctcaccggcgtccgcgaggacaaggacggcaggcgcatccccttcatccaggactggactaagcggaacgaccaccgccaccacgccatggacgcactgacgatcgcattcacccggcgccaatttatacagtacctcaaccacctcaactcgaagatcgacgtagtgtcctgggacaagaaagatctagacctgagagactacgacctcgaggacattaagtttggtaacctgagcgccggagaccgctacgggatcgtaaaggccctgcaggacaagttcctctacaaggacggaaacgacaagtaccggttcgtgccgcccatccccctggacgagttccgccgccaggcgaaggagcagctgtccgatatcctgattagcttcaaggccaaaaacaaagtttgcaccagaaacgtcaacgtgaccaagaacaagggcggtgcgaaccgcaaggcccaactgacgccccggggccctttacacaacgagaccatctacgggtccagcctcgagtacgtgaccaaggagaacgagaagatcggctccagcttcgacaccgagcgtattaccacggtttgcaagaagaagttcagggacgctcttgcccgcaggcttgaggagtttggcggcgaccccaagaaggccttcaccgggaagaactccccggagaagaacccaatctgggtggatgagcaccacagcgagcaagtacccgccaaggtgcgcaccgtgacaatgggccagcggtttaccggccgcaaacctatcgacgccactctaaagatagagaaggtaatcgacaagcggatccgcgagatccttcaggcccggcttgacgagtttgacgggaaggcggcgaaggccttctccaatctcgacgagaaccccatttggctgaacaaggagaaaggcatagcgattaagcgcgtcaccgtgagcgggccggctaatcctgtgccggtccggttcaaacgcgacaaggacggcaagcccatcatcgacgacgcagggaagaccatcggcgccgacttcgtgacccccggcaacaaccaccacatcgccatctttagagacagctccgggaaacttcaggagcaccccgtgagcttcctcgaggcgaccattgcaaagtcacacggcctggacgtcatcgaccgcaactacaacaaggacgaggggtgggagttcctgttcaccctcaagcagaacgagtactttgtgttcccgaacagcgagacgggcttcaaccccctggactatgacctgaccgacccccggaattatgccgagatctcccccaacctctaccgcgtgcagagcatctccaccaatgattactttttccgccaccacctggagaccacgagcgagaagaacaactctctctacgggatcacctggaagcggatccgcaacgcctcggccttagaggggctggtcaaggtgcggatagacaacttaggtcgcattgtagccgtcggggagtacgactga

SEQ ID NO: 7927 - RNA, 4200 nt, synthetic construct; identical to SEQ ID NO: 2127
  misc_feature 1..4200: note = Cas9 variant
  source 1..4200: mol_type = other RNA

SEQ ID NO: 7928 - RNA, 4200 nt, synthetic construct
  misc_feature 1..4200: note = Cas9 variant
  source 1..4200: mol_type = other RNA
atgaacctgcgcaacacgaccgatgagtacaacataggcttagacatggggacgaacagcgtgggctgggccgtaaccgacaaggccggggcgatcgcccacttcaagggcaagcccaccctggggtcccgcctcttcgacgccgcccagaccgccgcgggcgcccggatccaccggagccagcgccggagatacgtgcggcgccggtggcgcctcgacctgctgcagtccctcttccaggacgaggtgtctaaggtcgactccgagttcttctgccggctgcgccagagccggctgtacgtgggcgaccgcgaaaaggggcacgccgactacacgtggccgatcttcaacgactccgacttcaacgaggtggactactacaagcggttccccaccatctaccacctccgcaagtggctgatggagaccgacgagaaggccgacatccggctgatctacctcgcgacacacaacatcgtgaagcaccgcggcaacttcctgcgggagaacaacaagagcctatccagcagagacgcgaaccccgcacaggccgtgaagtccctccggctggccctgaatgactggtgcagcgagcgcgactacgagtgcgcgtggaagggggaggaggacgacggcgccatcgacgaggccatccttaacgtgctggcagacggcgagaagggccgcagtgaccaggccaaggagatcgcgaagttaacgggagtcgactgcggggacgccaagcaaagcaagcagtgcaacgaggccatcgccaaggccattgtgggcctcaaggtggaaatgaaaaacatcttcggggagtttcccgcggagaagacctcctacatctacttaagctccgacgaggacgtcgaggccgtgcgggagagctgcccggatgattccggcgagctgttccaggccctctgcaagctgtacagcgcgtacatcctgcaggaactcctgagctacgcagacccctccggccaaaccatcagcgcgaacatggtggccaaatacaagcagtacgggcgcgacctgcggctcctgaaggagctgacccgtacttacgcgccccagaagtacgacctcttcttccggggcgagacctacgccgggtcgtcagactacgtcgtggacgaggcccgcggctacacccggtacaacctggggaccacgaaggccaactacgacgacttccagaaatccgtgaaggagctgtttaagggcaccgacgccctccaggacgagcgctaccaagagatgatggtcgccttcggcgagcagaagttcctgcggcgcctgaaaactagcgacaacgggtccatctactaccagctccacttagaggagctgcacacaatccttgagaaccagggcaagcactaccccttcttactgtctgaggaggacaagatcgagtccctcgtgagcttccggataccgtattacgtggggcccctgacgcgcaagaacgccgcgatcggtcacgacgggaaagagcggttcgcctggtcaagccgcaaggacggcatggagcacgccgtcatcaccccatggaactgggaagagataatcgaccgggacaagtccgccgaggacttcatcatgcgtatgaccggcgactgcacgtacctgcagggggagcccgtgctcccgaagtgcagcctgctgtacgaggagttttgcgccctaaacgagttcaacggcgcgcactggacggtggacggggacgacgagcggcgcttcgacgccgcccagcgggagcgcatcatgtgcgacctcttccgccggacccgctccgtcacctacaacaaggtgagcgactggctggagcggaagtacaacttcaccggcgcgcgcgtccgcgggggccaaggcgagcacgggttcgagtccaagttaggtagctacatcttcttctgtaaggacgtgttcaagacggacgggctcgacgaggctgattacaccatgatcgagcagatcatcctgtggtcgacactattcgaggaccgggacatcctcaagcggaagatcgaggaggcgtacggcggcgaccggctgaccagcgagcagatcaaggtcatctgcaagaagcggttcacggggtggggccgcctgagcaagcggctcctgaccgacatcaaggtcaacactgacaccgggaggaagtccatcatggacgtgctgcgagagggcaaccccaacaacggacagcgcagccggacgatggtattcatggaggtcctccgtgacgaggacctgggcttccagaaggccatcgacggcctgaaccgggactacttcagagagcacaacaatggtctcatggacgttaacgacttgcccgggtcccccgccatccggcgctctattaaccaggccgtccggatagtcgacgagatcgcgtccatcgcccgcaaggagccgacaaacatcttcatcgaggtgacccgtgaagaggacgacccccggaagaaggggaagcgcaccaagcggcgctacgacgccatcaagtcggccctggagaagttcaagaaagacgacccgtcgctgtggaaggagctgtgtgagaaggcccccggcgacatggacgagcgactgagcctctacttcatgcagcgcgggaagtgcatgtactccgggcggccgatcaagatcgaggagctgcacaccggcaagtacgaggtggaccacataatcccccgcagctacatcaaggacgactccttcgagaacaaagtcctggtgtaccgggaggagaatcagcacaagacggacgcactcctgatcgacagctccatccgccagaagatgggcgggtattggcggatgctgcacgacgcgaaactcgtgggggacaagaagttccgcaacctgttcaggaaccacatcgacgataaggccatgaaggggttcgtcgcgcgccagatcgtggagaccagccagatggtcaagctggtccagaccctcttcgaggcccggtaccccaacacccgcatcgtgcccgtgaaggcggggatctcccatgatctgcgggaggccgccggccttgtcaagtgccgcgaggcgaacgacttccaccacgcccacgacgcgttcctcgcctgccggatcggcctgttcatccagaaaaggcacccgagcgtgtacgacaaccccatagggctggcgcgcatcatgcgggactacgcccgaatgcaggcgcgggagtacaagaagtcccactgcctcgcccacacgcagggcttcatcgtgaacagcttcctgtcgtccgggttcgacgaggagaccggcgaaatcttcaaggacgactgggacgccaaggccgaagtcgaggggatccgccgggtgctgaattgccgccaatgcttcatcagccggatgcccgtcgagggagacacccgctacggcgggcggtactggggcgagaccatctactcgcccaaggggaagcacaagcacgagatcccgttaaagcagggcctggaccccaacctgtacggcgggtacagcgacctcctgtactcctacttcctgatctacgaggccagcgacgtctccagcggtgagcgcgtactcaggttcatcgggatccccacgtccatcgcggcccgcatggccaaccaaaagcggctggaggagtacgtgagccgcctggccctccaggagaacctggagcacgtccggatggtgcgcaagatcatgaagaagcagctcatcgaggtggacaactgccggctcctggtcaccgccgcggacgccgtgaccaacgccaccgagctggccttctccctcgatgagatgaagatcatcagcacgtgtgccaagtgcatcaatggcgcggacccgtccgcaatcgacaagatcgggaacgcccaggacagcttcttcgacaacctgaagcgccggggctccgaccgctgtgccctcctgttcagccagcttaagttagacaagctctcccagaacttctacatgatcagctccgacgacaaaagcaagatcctgataagcatcttagaccgtatcagggccaagtccaacagcgtggacctatccctggtcggcggggcgaagcacgcggcccaaatgaagttcgacttcaatgccaagctgaacaatcccgcgagcagtttcgtgctcatcgaccagagcgtgaccggcatgttcgagcgacggacgcgcatcgggctgtga

SEQ ID NO: 7929 - RNA, 4203 nt, synthetic construct
  misc_feature 1..4203: note = Cas9 variant
  source 1..4203: mol_type = other RNA
atgaacctcagaaacgcgaccggagactattcaataggcctggacttaggcaccaacagtgtagggtgggcggtaacggacagcaacggaagcatggcacatttcaaagggaagccaaccctcgggtcaagactattcgacgctgccgaaacagcagccggcgcacgacaacaccgcggccaaagacgccggtacgtcagacgtaggtggcgactagacttgctccaaggactcttccaagacgaagtcaacaaagtcgactcagagttcttcatacggctccgacaatcccgactccacgtagaagaccgagcggagggtcacgcaggttacaggtggccactattcaacgacacagactttacagaaaaggactattacaagcggttccccacaatctaccacctccggaaatggctgatggaaacagacgaaaaagccgacatccgtcttatctacctagccgcccacaacatagtcaagcatcgaggaaacttcctaagagaggacaacaaaaacctatccagccacaacgcaaatcccgccgaggccgtccgaagcctgcgccaagcgctagacgactggtgcgccgaacggggatacgtatgcgcgtggacctcagtagacgacctcgcagaagcagactcccacatattagatatattgaccaactcgaaagaacggagagcggaccaggcaaaggaactggccaaactattcggtgtagattgcggggacacaaaacaaagcaaatcatgcaatagcgcccttgcaaaagcggttgtgggcctgaaaaccgagctaaaagacgtattcggcgaattttgcgccgagaaaacggccatccacttatcttcagatgatgacgtagaggcaatccgggacgcaatcccagacgactccggggagctatttcaagtactatgcgcggtatacagcgcgtatgtactccaagaactgctgtcgtacgctcccggccaaaccataagcgcaaatatggtcgccaagtacgaccaatatgggaaggacctcaagctactcaagaatctggcacgcacatacgtgtcgcgagagaactatgacgcctttttccgaggacagacgtacgaggattcaaacgattacaatgtcgataaagcacaaggctacacaaggtacaatctaggcactacgaaggcgtcgtacgatgacttcaagaaaagcgtggaaaaacttttcaaaggaacacaagccgagcaggataaaaggtaccagggaatgatgaagagattcgcggaggagaaattccttcgccgcctaaagacatcagacaacgggagtatatattaccagctccacttagaagaactgcgagcaatactaaagaaccaaggaaagcaccatccattcctgctggaggaagagaagaaaatcgaatcgctagtctcattccgaatcccctactatgtagggccactcagcagtaaaaacgcgtctctcgaccacaaaggcaaacaaagattcgcatggtcggagcgacgcccggggatgaaagacactgtcatcaccccgtggaactgggaccaaatcatagactgtgatcaatccgcagaaaaattcatcctacggatgacgggcgattgcacatacctacaaggcgaaccagtactacccaaatgctcgctcctatacgaagaatactgcgtcctcaacgaactgaacggagcacggtggaccatagacggcgacgattggcgaagattcgacgtggcacaacgagagggcatactacacgacctgttccgaaaaaccagaagcgtcgcatacaacaaagtcgctgattggctagagcgcgaagagaattgggcaaacgcacacgtaagaggcggacaaggagagaactccttcgaaagcaaacttggatcttacatcttcttctgtaaagacgtattcaagaccgcggccctcgacgaagcagactacccaatgatcgaacagataattctgtggaacacactcttcgaagaccgcgcaatactcaaacggaaaatcgaacaggcctacggggaacaccacggaggaaaattaacagatgagcaaataaaagtgatctgcaagaaacgcttcacaggatggggaaggctgagccggaagctcctaactggtatcaaggtggacgcggacacaggtcgagtgtccataatggacgtactgcgagagggaaatccaaacgaaggacagcggagccgcaccatggtgctcatggaggtgctcagagacgaagacttgggattccaaaagaaaatcgacgacttcaacaaagcatacttcgccggacaaggagaaggactaatgagcgtgaacgacctccccggctccccagcgatccggcgctccattaaccaggcgatcagaatcgtggacgagattgcgtccattgcgggaaaagcaccatccaatgtgttcatagaggtaactcgagaagaagacgacccccgaaagaaaggacggcgcacgaacagacgctacgaggacatcaaaaacgccttggaaaacttcaaaacagaggaccaagaactatggagtgaacttctcggaaaagccccaaacgacctagacgagcgcctatcattatactttatgcaacgggggaaatgcatgtatagcggcaggcccatcaaactagaagaactccacaccggcaaatacgaagtcgaccacatcatcccccgcagttacataaaagacgacagcttcgaaaacaaagtgctagtgtgccgagaggaaaaccaaaggaaaaccaacgaaatgctcatcgacccagcaatcagacgccgcatgggagactactggcgaatgctccacaaagcaaaacttataggcgacaaaaagttcaacaacctcttcatgagagacagaatagacgacaaaacgctaaaaggcttcgtcgcccgccaactcgtagaaacttcacaaagcgtcaaacttgtacaaactctactagaagtgcggtacccgaacaccaaaatagtccccgtgaaagctaacataagccacgacctgcgagaagccgcggacttagtcaagtgccgggaagcaaacgacttccaccacgcacacgatgcttatctcgcatgcagggtgggactgttcattcagaaacgccaccccagcgtgtacgcaaacccaataggcttatcccgggttatgcgggactacgccagaaagcaggccggcgaatttaacaaaacccacagcatggcccacacaaaaggcttcatcgttaatagcttcatgacatctgagttcgataaggaaacaggagaaatcttctgggacgcagaagccgccgtggaagacatccgccgggtcctcaactaccggcagtgcttcatctcgcgaatgccagtggaagacaccggagcgttctgggatcaaacgatatactcaccacggtcaaacaaacgactggaactgcccctaaaagacgacttagaccccaacaaatacggatcctacagccgagaacagttcgcctacttctttatatacgaggcacgagacgcaaagaaaagcaaaaccgtactacgatttgcacaagtccccgtgcgagtaacaagcgcaattgcaagggactccagcaaactagacgaatacgcgtcggggctggctgtccaggaaggcctggagttcactaaaataataagacgccgaatactcaaaaagcaactactggaactaaacggagaccgcctcgtcatcaccggggccaaagaggtgcgaaatgcaacagagttcgccttcacgttagaagaaacagcacttgtggcgatgtgcagcgaaattgcacgcgaaggtgttcccagtgaaatcgccagcgacgtgcaaagcatctcgtcgcaactctcggacctcttccttgccctgatcgagagaggcttaacgatcggcgtccgcctccacggccaactcaaacttggccagtacctcagacaattcgaagatgcagcgctaagagacaaggccaaagtgataatcgggataataagcattaccaacggggcgacaaatacacttgacctgagttccctaaacggctctaaaaatgtcggacaagtccggattacccacaacaagctgctaaacgacaaatcaacctcgtacgtacttatcgaccagagcgtaacgggcatgttcgaaaggcgcacccgtataggcttgtga

SEQ ID NO: 7930 - RNA, 4203 nt, synthetic construct; identical to SEQ ID NO: 2130
  misc_feature 1..4203: note = Cas9 variant
  source 1..4203: mol_type = other RNA

SEQ ID NO: 7931 - RNA, 4203 nt, synthetic construct; identical to SEQ ID NO: 2131
  misc_feature 1..4203: note = Cas9 variant
  source 1..4203: mol_type = other RNA

SEQ ID NO: 7932 - RNA, 4203 nt, synthetic construct
  misc_feature 1..4203: note = Cas9 variant
  source 1..4203: mol_type = other RNA
atgaagaccatcacagaggactacatcctgggcctcgacatcgggacgaacagctgcggctgggccgtgatggacaagaagaaccgcctgctgcggctccgcgggaagcgggccattggctcccacctgttcgaggagggtcacagcgcggcggaccgccggtccttccgcacaacccggcgccggctgaagcgccgcaagtggagactccggctgctggaggagatcttcgccgagcccatggccaaggttgacccggccttcttcgtacgcctccaccagagctgggtgagccccctggataaggaccggaagaagtaccacgcgatcgtcttccccaccgccaaggaggaccacgagttctaccacgactaccccacaatctaccacctccgcgacgccctcatgcgggaagaccgccaattcgacctgcgggagatcttcctggccatccaccacatcgtgaagtaccgcggcaacttcctccaggacaccccggtgaacagcttcgtcgcgtccaagatcgacgtggccagcttcctgaccaacgtgaaccaggcctacgccgacaagtacggcgaggagcagaacttcatcgagctgaacgagaacaacgccgcggccatcgaggccgtcatccgggggaaggacaaggacaagaccacgaagcagctcgacaaggccaagaagattaccaaacttctgcagtccagcaccaacaagtacgagaagaacgtgacccgccagatcgccaacgcgatcatcggctacaagacgcagttcgagaccatcctcgggaaggacatcgacaagaacgacaaggccgactgggagttcaagctgtccgacggcgacgccgacgataagctggagaacctcctgcccgagttcgacgacaacgaccagtacatcgtggccgagatcaagaagctgttcgggagcatcgccctctcccagatcgtctacgagaacatgaccctgagccagtccatgaagtgtaagtacaaggaccatggcgacgactaccacctcctcaagcagtacatcgcgaccctgagcgatcacggccaggtgcgcaagctgcttctggcctacgacctgtacgtgaacaaccggcacgggcgcctcctggaggccaagaaagaatttaagcaggataaggccctgacgcaggacgagttctacaagatcgtccgggaaaacctcgacaactcccagctggcccagaagatcctgcaaaagatcgaggaggagaagttcatgcccaagcaacgcgtgaacaagaatgggttcatcccctaccagctccaccagatcgagctggaccagatcatcgcgaaccaaagcaagtactacccgttcctggccgaggagaatcccgtgaaggagcaccggaagcaggccccctacaagctcgacgagctggtccgcttccgggtgccctactacgtggggccgctgatctcccccgacgacaagcgcaaggacaagcagcagaacaagaaccacgagatgttcaagttcgcctggatgaagcggaaggataacaacggcgcgatcaccccctggaacttcgcccagaaagtcgaccgcgagacaagcgccaaccggttcatcaagcgcatgaccgtgaaggacacgtatctcatcggcgaggacgtactgcccgcccggagcctgctgtaccagaagttcgaggtcctcaacgagctgaacaatatccgcgtgaacgggaagcggctggagcccaagttcaagcagaaggtcttcaacgagctgttcaagcagaagaacaaggtgaccaagaaggccttcaaggagttcatcctgcagaacaccggcatgaaaaccgcggagatcgacgggctggccgaccccacgaagtttaactccagcctctccagctactaccatctgaagtctaccaaggtgttcgacaagcagctggacgaccccgagtaccaggccgacttcgagaagatcatcgagtacagctccatcttcgaggacgccgagatctaccaggagaagctccacaaggagatcaagtggctgatccccgcgcagtttaaggcgatcgccaactggcgcctgcagggctggggacggctcagccgcaagctgctggtcgagctcaagggcaagggcggggagaacataatctaccagctgtggaccacccagaagaacttcatgcagatcgtgaatgagccagagctgaagaaggccatcgtgaaggagaaccaccaggccacggaggagaagggcatcgagaagatcctcgacgactccttcaccagccccgccaacaaaaaggcgatccggcaggtcatcaaggtggtggacgacgtcgtgaaggccgccgggggcaagaagcccgcccagttcgcgatcgagttcacccgcgagcccaagtggaacccgcagctgtcccacatccgcggaaccaagctgcttcaggtgtacgaggacacggccaagaagctggtcgaccagagcctgaccgactccctcaaggagaacatgaccaaccggaacctgctgaaggacgagtacttcctctacttcatccagtgcggccgcgacgcctacaccggcaagaagatcgacatcgccgacatccacaagaagtatcagatcgaccacatcctgccccagagcttcatcacggatgactccctggacaaccgggtgctcaccgagatcgagattaaccagaagaagcacaagaagtacgccagccacctgttcgcgaccaagcccgccttcgggctgaaccagtccatcagcgagatgtggaagacctggcagaaggccggcctcatctcccagcgcaagctgaacaacctgctgttcgaccccgacctggtgaaggacaagcagaagaaggggttcatcaaccggcagctggtagagacgagccagatcatcaagctcgtgtcgatcattctgcaggacaagttccctgacacggagattatcaccgtgaaggccggctacaacacggccctgcgcaaggagctcaagctgtacaagtcccgggaagcgaacgactaccaccacgccatcgatgcctacctgaccgccatcaatgacaatttcctctaccaggtctaccccaacttccgccccttcttcgtgtacgggcagttcaagaagttcagccaggacacggacaagcagaaggaggccatcaagtattacggcctgaagaacttcctggagccactcctggacgactccaccggcgacgaggtgatggtcaaccatacgaagcacgtggtgttccacaagcagcgggatattttcaaccgcctgatccaggcgtacaactacaagtacatgctcgtcagcagagagaccacgaccgagaactccaacatgtttaacatgaccatctacccccgcggggagcgggaccgcaagaagacgcggaagctgatccccaagggcaaggacctggatcccgccatctacgggggctacagcggcaacacggacgcctacatggtgatcgtgaagatcgagaagaccaaggagaccctctacaaggtcgtgggggtgccgatgcgcgccctggcgtccttaaagaaggcccagaaggaaggcaactacgaccaggagctcaacaaggtcctggagcccctgatcatgttcaacaagaacgggaagtccaaggccggcatcaaagggttcaccgtggtgaaggaccacgtccacttcaagcaggtcgtgatcgacggcgactccaagttcatgctctacagcgcccagtaccgggccaacgcgaagcaactgacgctgtcccaggagaccatgaaggtggtgaccgacaacaccgacgacatggaccagaagaacgccgacaaggaccagctcctgctgaacgcctacgacgagatcctcgagaaggtggaccagtacctgcccctgttcgacatcaacggcttccgccaagggctccacgacggccgggccaagttcgccgcgctgaagacgagcgagaagaagtacaccctgaagaacatcttaaacgggctgcacgacaacctggtcacccccaacctcaagaacatcggcatcaagaccccattcgggctgatgcagtccagctccggcatcacgctcagccccaacgccaagctcgtgttccagtcccccaccggcctgttcgagaagcgcgtgaagctgaccaacctctga

SEQ ID NO: 7933 - RNA, 4203 nt, synthetic construct
  misc_feature 1..4203: note = Cas9 variant
  source 1..4203: mol_type = other RNA
atgaagaccatccttgggctcgacctggggacaaacagcataggctgggccctggtgaaggagacggaaaactctaatgagaagtccgagattatcaagttgggggtccgcgtgaaccccttgaccgtggacgagaagaccaacttcgaggccggcaggccgctctccaccaatgcagaccgcacggcaaaacggagcgcccgccggaacctgcagcgctacaagctgcgacgcaagaacctgatcgacctcctgatcaagcaccggctgatcgacaaggacacgcccctcaccgagatcgggaagaataccacccaccagaccctggagttaagggctaaggccgcgcgggagcgcatcgagctcgaggacctggcccgggtcttcctggccataaataagaagagaggctaccggtccagccgcaaggtgaacaacgaagaggagggccaggtggtcgacgggatggccgtggcgaagaagctctatgacgagaacctgacccccggccagtacgcgtacgagctgctctcaaaggggaagaaatacgtgcccgacttctaccggagcgacctgcaggccgagttcgactccatctgggagtatcagaagcagttctacgccgacatcctggacgacgagctctataacgccctgaagggccaggggcagcagaacagccgcaagcggttcctggcgataaagggcgtctacaccgccgagaacaagggcaagcgcgacgaggtgaagctccagcattacaagtggcggtccgaggccatcacgcaaaagctgagcatcgaggaggtggcctacgtcctggtggagatcaacaatgacctcaacaagtccagcgggtacctgggcgccatctccgaccgcagcaaggagctgtacttcaacaaggagaccgtgggggagaacctctggaaacagatccagaagaacccgcatacctccctgaagaaccaggtcttttaccgccaggactacctggacgagttcgagcagatctgggaaacccaggcgcagtttcacccccagctcacgctggccctgaaggaacagatcagggacgtggtgatattctaccagcgcaagctcaagagccagaagggcctgctgtccttctgccagttcgagagctgggagatcgagaggaaagacgagaacggcaatgtcatcctcaacaaaaccacccagctgcctaagcgccagaccgtggggcggcgcgttgcccccaagagcagcccgctgttccaggagttcaagatctggcagaacatcaacaacctcgagatcgccaagatcagcgacggtaacagtaagaacaagaaggagacggaggccctgagcgacgatgaaaggaagctcctgttcgaggagctgaacctgcgcgggaacttatcccagaaggaggtgctgcagatcctgggcctgaaggacaaggagtacaagaccaacttccccgagggtctcgagggcaaccggaccaacgcggccctgtttaacatctaccagcagatcgccgagaacgagggctacggggactggaccaaaaagtccgcccaggagatcaaggaggagctgaaggccgttttcccccagatcggcatccaggctgacatcctcgacttcaacgccgagttggacgggaaggagttcgaaaaccaggcgagctaccagctgtggcacctcctgtacagcgccgaggaggatgacaagatcaacgaggaggaccagatcatctacggcaactccgcagttagcctgaagaagaaactctgcgaaaaattcgggttcacgcccgagtacgccaagtggatcgccaacgtctccctccaggacgactatggcaacttgagcaccaaggccatgaggaagatcatcccgtacctcatcgacggcaacgactactccgaggcctgcgcgctggccgggtacaaccacagcaactccctgaccaaggaggaaaacgacaacagggagcgcctcaataagctggagcttctccccaagaacagcctccggaaccccgtggtcgagaagatcctgaatcagatggtgaacgtggtaaaccaggtgatagagacttacggcaagcctgacgaggtgcgcatcgagctcgcccgggaactgaagaagtccgctgaggagcgcgccgagatgacgaaagggatcaacgaggcgacccggcgcaacgaggacatcaagaagctgatcaccaagaacttcggcatccctaaccccaccaagaatgacgtggtgcggtatcgcctctgggaagaactggcgcccctggcctacaaggacgtgtttacggggcgccagatcaaaaaggaggacctcttcagctccaagatcgacatcgagcacatcatccccaaggccctgctgttcgacgacagcttcagcaacaagacactcgccttccgtgagaccaacctgaagaaggccgaccgcaccgcctacggcttcatcgagtccgactacaacgccacgctggacgactacatccagcgagtcgagaccctctacaacaacgccaagggcaccattagcaaggggaagcgcaacaagctgctgatggcgcagaagaacctcccggacggcttcatcgagcgggacttacgcaactcacaatacatcgccaagaaagccaagtctatgatcgagaaggtgttcaacgatgtgaacgtgacctccgggagtattaccgaccggctgcgcgaggactgggacctcatcaacgtgatgaaggagctgaacttccccaagtacaaggccctgggcctcacggagatcgaggagcggtacgacatcggccaggagaagaccaagaaggtggaggtcatcaccgactggaccaagcgcaacgaccaccggcaccacgccatggacgcgctgacggtcgccttcaccaccaagtcccacgtgcagtacctgaacaacctcaacaccatccacagcctgaagggggacgaggtcgacctggagctcagcaagttatatggcttaaagaacacgatcaccgaggtggtgaacaagaagcgcaagttcatcccgcccatgcccaacttccgggaggaggccaagaagcacatcgagaccatcctcgtcagcatcaagaacaagaacaaggtgtacaccaagaacatcaacaagacgaagaaggagtccgggtaccacaccaaggagcagctgacgccgcgcggccagctgcacaaggagaccgtgtacggcaagagcaagcggcccatgaacaaacccaccaaaatcaacaaaaacttctccctcgagcaggcccagctgatcatcaacgtccaggagaaggagctggtgctccgtcatctggcccagttcgacaacaaccccgcggtggccttcgacaccaagaccctgaagaagatgcccttgctgaagaacggggagcccctgaaggaggtcctctgcttcgaggagatcttcaccatccggaaggacatcacgccggatctgaagatcgagaaagtggtggacgagaagatcaaggccatcctagagcagcgcaagaaggacttcggcgggaacgccaaggaagccttcagcgacctcgacaagaaccccatctggctgaacaaggagaagggcatctgcatcaagagggtcaccattactggcgtgtccaacgcggaagccctgcatcaccagaaggaccacctcggccgcgagatcctggacgataacgggaaccccatccccgccgactttgtctcaaccggcaacaaccaccacgttgccatctacgaggacgagaagggcaagctgcaggagaaagtggtgtccctatacgaggcggtcgcccgggccaaccaagggctgccggtggtagacaagggcctgaacgaagacctcgggtggaagttcctgttcacgatgaagcagaacgaaatgttcgtcttccccaacgacgacttcgacgtgaacgacatcgacctcctcgacgagaacaatgccaagatcatcagccagcacctgttccgcgtgcagaagctggccacaaagaactacatgttccgccaccatctcgagaccaacgtccaggaggtgaaggagctgaacgacatcgcgtacaagagcatacggtccacagagcccctgaagaacatcaagaaggtgcgcatcaaccacattggcaagatcgtccaggtaggggagtactga

SEQ ID NO: 7934 - RNA, 4209 nt, synthetic construct
  misc_feature 1..4209: note = Cas9 variant
  source 1..4209: mol_type = other RNA
atggccaagaaggactataccatcggcctggacatcgggaccaacagcgtgggctgggccattatcgacgacaacctcaagctgctgaagcgcaacatgacgatcaaggggaacaccgacaagaagtccgtcaagcgggacctgtggggcagcctgctgtattccgggaacagcgacaagaccacctctgcggccgacgcccgcagcaagcggggcctccgccggcgcctgcggcgccggaagtaccgcctggaccggctcaagcagatcttctctgagatcatcaacgacaaagcccccaacttcttcgacaagctgaacgagagcttcctgaaccccaaggacaagaaatacggcaagtaccagatattcgacacggagaaggaggagaaggactactaccgccggtaccccaccatctatcacctccgcaaggacctgatcgagtccagcaagaagcaggacatccggcttgtgtacctcgccctggcgcacatcctcaagagccgcgggaacttcctgttcgagggcaacatcgacgacctgaagaacgacttcgccgggatctacgaggaggtggtcgagctgtgcatgaccataaacgccgaggacgtggacctcgagttcgaggaggtggacaagcagagcctgaactccatcatcaagaacgaggacatcagcgagatcgagcagggcctggagaacttcgccgatgagcacgtcatctttaaggagcagaacaagaagaagaacgacctcttctccaactgctgcaagatcatctgcgggcacaccgtgaaggcgaacaagttcgcaagcgagctagacagcgagctgttcatcagcttcaagtccgatgactacgtggacgtcatcgacgtgatccagagcggcaacgagaacatcgccaacctcctgcttgcctgccggaaggcctacgactacatcatgtttaaccgcctcgtggacctgaacatcgacagccccgcgaagctgtccagcaatatggtctccctctacaaccagcacgagaaggacctcaaggcctacaagaagctgatcaaggagttcaacaagttcaagcggagcaacggctgcaaggacctcgagatgatcatcctgacggccgacgacatcgactccttccgcaagaaagtggacaagaaggaggggaagctgaacggcatcaacaagaaaatcacccacgagcaggccctcaagaagcagctgaaggacatgaagaagatcctggaggacaagaacaccgaggccgaggacaagcagatcaacgacatcctcaagatgattaccagcatcgaggagcgggtaaacaagtcctgcttcctgaagaacctgcgctccacggacaacgcgtccatacccaaccagatccagcgccaggagatggaggccatcctcgacaaacaggccaagttctacccgttcctgaacgagcacaaggacgagctgctccagctgctgagctttcggatcccctattacgtcgggcccctggtgaacaagaagtactcccgcttcgcctggctcgtgcggaaggagggccaggtccagaagatcacccccaccaacttcgatggcgtggtagacaagcacaagactgccgagaagttcatggagcgcctgatcgggaaggacgtctacttaccgaacgagcgggtgctccccaaggcgtcactgctgtaccaggagtactgcatcttcaacgagctcacgaaggtggcctacatcgactccaccggcaagaagaacaacttcagctccgaggagaagctgaacatattcgagaagctgttcaagaccaagcgcgaagtcaccaagacggacctctgcaagtgcctgaacaacgtttgcaagctgaaggaaaaggtcaaggagaccgagatcatcggtataaaggcgaagttcaacgccaaatacagcacctaccacgacctcaagaagatcaacggcatggagcagctgatcgccgacgaggaggggaagcccctgtgcgaggacatcatctccatcctcaccatcttcgaggacaaggatatccggctggttcgccttaaggagctcctgtgccagaataaggacctgatcaacaagttcagcctctccgcggagaagttagccaaggtgctgagcacgaagcactacaagggcttcggcaacgtctccgccaagctcatcaacgggatccgggacaagaactgcaagaccatcctggactacctgatcgaggacgacaaggaggcctactacggccgcaacaaccccaatcggaacctcatgcagctggtgaacgactcccgcctggcgttcaaagggcagatcgaccgggagcagaacacccacctcgaggacctgagcctggatgagttcctcgacgacctgtacgtgagtccgtccatccgccggggcatccgcctgaccatccggttagtcgacgagctggtggagatcatgggatacctgcccaagaacatcgtgatcgagatgccccgcgaggacggcgagaagggcaagatcgccgacacgcggtattccaagctcgagaagatgctgaagaaggacgccgccctggaggacctctaccgcgtgctgaagacctatgagaagaacaagaaggctctggcgaacgacgccctctacctgtacttcctgcagaacgggcgcgatatgtacaccggcaaggagatcaacctcagcgaactgcactcctacgacatcgaccacatcatccccaagagcttcaagtacgacgactccctggacaacaaggtgctcaccgccaaaaagatgaacatggacaagcggacgggggccctagaccacaacatcatcgagaaccagtgcggcttctggcgcgtgctgctccagcaggacaagatcagcctggaaaagtacaccaacctgatgaagaccgagttcaccgaggccgacaaggcggggttcatcatgcggcagctcgtcgagacgcgccagatcaccaagttcgtcgcccggtacctggacaacaagttcaacggcctgatctccgacccgaacgacaaggtgaacatcctcctgccccgcgccagcctgtgccaccaatttcgggagaccttcggcttctacaaggtccgcgagctcaacgacatgcaccacgcccacgacgcctacctgaacgcggtgatcgccaacaccctgaacaagaacgcctacctctccgacctgcttaagtacggggcctacagcaagtacaagaagaacggcttcaacaactccaacgggatcatggactacttcggcaacacccagttcaactgcctcttcgtggtcgagcggacgctggacaagtgccgcgtgaacatcgtcaagcaccccgagaccgcgagcggcgagttctacaacgagaccatccagaagaacaaggtcaacggcggcagcagcacccggagcctgaagtccagcgtgaaggtgctccagaacacggagcagtacgggggcttcaccaacgtcaacaacgcctacttcatcctgttcgactacaaagccaagtccaagctgaagagaaagctcatcggggtgcccatcgtggaccggcagaagttcgaacaggacccggtcacctacctggaggccaagggcttcgacgagcccaagctggtgcagaagctcctgaagtacaccctgctcgagtacgaggacggcaagcgccggtacctgacgggggtgaccggcaagcgctgcgagctggtccgggccaaccagctcctgctgccccgcaacatgatggcgctcctgcaccacctccaggagtggcagaagcacgacttcgggatcaaggagatgaccaaggtgataaagaacaccaacaacatcgaggccaagttcgacaagctgttcgagcacatgatgaagttcatcgacaagtactcggaaccacccaagatcgtgtccagcaagatctccgaggagtaccacaagctgcgggagagcctgtgccaggatgacaacaagatcaagatctacgccgagatcgggaaggctctcctgtccctgctgcacctcgtcgacagcaaatccgcctgcgtgttcaagttcagcggtctggagatcaaccgcatcagataccagtcaatcaacgagaagaaggagcccgtgatcatcttccagagcctgtccggcctccgcgagagccgctacaagtacaaccagtga

SEQ ID NO: 7935 - RNA, 4209 nt, synthetic construct
  misc_feature 1..4209: note = Cas9 variant
  source 1..4209: mol_type = other RNA
atgaagctgcggaacgccaaagactacagcatcggcctcgacgtggggaccggctccaccgggtgggccgtcacgacccttgacggcgacctgttcaccttcaaccaccgacccaccctcgggagccgtctgttcgagtccgcgagcacggcccaggagacccgggaggcgcgcggcgcccggcgccggctgaagcgccggcgctggcggatctccctcctgcaggagcagttcgccgcggagatggagagctgcgactccaacttcttcatccgcctgaaccagtcccggctctggcaggaggatcgcaccgagcagggcaaggggtacctgttcggcgggaagcctatcctgtgcggcgcacaaatcttcgccaacgaacaggagtactaccaacagttccccaccatcttccacctccggaagttcctagtggagtgctccgagcaggtcgacctgcgcctcatctacctggccctgcacaacatcgtgaagtaccggggaaacttcctctaccaggacaataagacgctgaacgtgcgcaacttcaatctggacagccagatagcggacttcctcgaccagctgcagctgtggtgcgagaacaacgacctctgcttccacgagatcgacggcaccaccaccctggcctcccagctgaacacgtgcttccaccagcaaagcaaccagcaaaagaaggacaccctcaagaccttcttcgcgacgtgcatcgagaacgacaagatcgccggcgagctgacgaaggcactgctcgggtacaagaccgacttcaagatcatctttaacatcgaaggagagaaggacgagtacaaggccaagtgcaacgaggaggagaagatcctgaagctgcaggagaccatcgatgacgccaaccaggtcctcctgcagtccatcctgaacctctacagcgggatcatcgtcgagaagatcctgaacaacaccgccgtgaagaacgagtccgcccagtgcacgttgagcgcctaccactgctactcctacgcgctctacagcaagcagctccggaccctgaagaagctcgtgcgcaagtacaacccccagcggtataacgagtgcttcaacctgtccgccgaggaccccaaggccaagaagcagctgtgcacctacgcccgctacaacgcccagcacagcaccgactacgacgagttcaagaagtacatcaaggacctcttcgagaacacggatgcggtcaacgacgccgcctaccagcagatgaagcaggacttcgacgaggagaagttcctgcgccggcagaagaccagcgacaacggcgtgtacccgtaccagttccacctggaggagatgcagctcatcatcgagaaccaggcccagcattaccctttcctgaccaagataaagcccaagctggagtccctggtgaccttccgcatcccatactacgtcggcccgctcacgcagaaggggatccagcggaacggccgcaagttcgcctggagcaagcggaacaaggacgcggagaaccagcgcatttacccctggaactgggactccataatcgacaagagcgcctccgccgaggcgttcatcctgcggatgaccgggaagtgcacctacctgtacggcgaggacgtgctccccaaggagagcctgctgtaccaggagttctgcgtgctcaacgagctgaacggggcgcgctggaactgcgacggcgagcgccgcatgcccctgtccaacaaggactgcaaggccatctaccggcagctgttcctaaagaagcagaaggtcagctacgccgatgtgtccaactacctgaaggcccagggccacatcaacaacagcgttgccgggggccagggggagcacggcttcgagtccaccctcagctcccaccacttcttccgcaagctgttcaacgtcgacgctgccaacgacctgacggcgcagcagatcgagaccgccgagcagctcatcctatgggggaccatcttcgaggacaaggagatcttcgagcagaagatcaaggagcggttcggcgacatgttcagcaaggacgagatcaagaccatcgcccgccggaagttctccggttgggggaagtgcagcaagcagctgctctccggcctgacggtggagaccccgcgcgggcgggagagcatcatcgacgtgctgcgcaacggccaccccgagaacgggcgcaccctcgtcttcatgcaggtcatcaccgacaagaagctggagttcgacaagaagatcgaggagtacaacaacgagcacctggcgaagaccaacgagtcagtgctcgacacggccatcatgagccccgccattaagcgcggcgtgaaccaggccctgcacatcgtgggcgagatccgccggatcactaagcacgacccgacctgcatctacatcgagaccacgcgcgacgagaaggacggtaagcacaacacccggaccagctcccgctacagctccctgaagaagaacctcgagaccctcaagagcatcgacaaggccaacgcgcccgccatcaagcactccctggagctcctggagacgtacaagaagcagaacatcgacgacaagttattcctctacttcacccagaacggcaagtgtatgtacagcgggaagtccctggacatcaacaacctgagctcctaccagatcgaccacgtcatcccccagagctacatcaccgacaactccttcgacaaccgggtgcttgtgtatgccagcgagaaccagcgcaagtccgatagcctgctgctctccagcgtcatccaggccaagcaggagcccttctggacctccctggagaaggcaggcctgatcagcgagaagaagcacaacaatctcaagcgcaagagcctgtccgacgcccagatcaagggcttcatcaaccggcagctggtcgagactagccagatcgtgaaggtcctccgggacgagctgtcccgcattctgcccgacaccaagatcatcccggtgaaggccagcctctcccatgacgtgcggatcgcctgcaacctgtacaagagccgcaccgccaactccttccaccacgcgcacgacgcactgctcgccagcaccatggggcggttcgtccagacgcgcttccccgacatgtacgagaaccccgtgcggtacgtgaagatcctgcgcgcctacatcgcccagtccaagctgcagcacagcgcgcagacacgtaacttcgactcccgcagcttcatggcccactccttcttctgcgactacagcaacgagaacggcgataccatctggaactccgccagcgagatcgagcggctccgccgggctctgtcctacaagaatctgtacctcacccgccgccccttcatcgacgccgggcagttctgggaccagaccatctacagcccgcacgacaagaagaagacccccgattccctgatccccctgaagaagaacctcgacacccaaaagtacggcgggtacagcggcaaggactacgcgcacttcttcatctactccgtcctgaacaagcagggcgacgttgagtaccggttcgacggggtgcccctgtacatcgccgccaacatcaaccgcgacgaccggggcgccctcgcgcagtatgccaagcagctggtcgagcacgagaacgtgccgaacgccaagcgcaagaccaaggacctggtgttccagcggatcgagcgcgcctgcgtccccaagtaccagctcatctgcatctcccagtgcagcggggactccgaccggagcgtgtccgattactattacatcacgggcaagaaggaggtccgcaacgctctgcagctggcgttccccatgcacctctacggggccatcaacgccatcgaggacaagaaggagctggacgacagcgcactggaggaactcgtcgtgtacatcttacggaacgccccgcgcatcgcgcccgacgtgttccggcgcctgaatctcaccgagaagctggccgactgcctggacatccccgatcggatcgagctccagaactccatctacggcctgttcaacctgatcaacgccgagagcaacgtcgtgaacctccagatcttcggcggggccaagaccgccggcgtgaagctgatcaacctgaactccctcctgaacgaccccgcgaccacggtcaccttcatcgaccagagcgtgaccgggatgttcgagcgcaaggaaaccatcggcatctcctga

SEQ ID NO: 7936 - RNA, 4209 nt, synthetic construct; identical to SEQ ID NO: 2136
  misc_feature 1..4209: note = Cas9 variant
  source 1..4209: mol_type = other RNA

SEQ ID NO: 7937 - RNA, 4209 nt, synthetic construct
  misc_feature 1..4209: note = Cas9 variant
  source 1..4209: mol_type = other RNA
atgacctaccgtaactaccacatcggcctggacatcgggacctcatccgtgggcttcgccgtgcggtacgacaacggggagctcgtgcacaagaagggcagcaacctggtgggggcccgcctgttcaaggagggcgagacggcggaggagagacgcctcaaccggggcgcccgccggcgctacaaccggcgcaagtggcggctgaacctgctcaaccagatcttcaagcccctgatcgaggtcaacgacccgaccttcttcaagcgcctggagcagtccaacctcgtaaactacgacaagagcgagtccttcagcctgctaaacaaccagtccgacgacaaactccaccagcagttccccaccatctaccacctccgggactacctgatgaagagtaccgagaaggccgacatccgcctcatctacctggccgtgcaccacatcgtcaaataccgggggaacttcctggacgccagccccgtggatagcttcgaggcgtccaacctcaaggtggacgagatcctgacgcagatcaacctgctcctggacaacctgaccgacgacctccgccttaacacccagtacgtcacggacatcgagcagacgctgctcagcaataccgagtccaacaaggacaaggagaaggtgatccagaagctgctgctccacaaggaggccatcaagatcgacaaggaccggacggcccagatcgccaagctggtgctgggctacaaggcggacatcgccaagctgttcgggatcaccgagaaacttcagacgcccaagctggagctcagcgccgccaactccgacgacgctctgatggaactgagcgcggagctcaacgaggaccagatcggcatcttgctgcagctcaagaccctatactcccgcgtccggctgaaccagatcatccccagcgggacctccttaagcaagagcatgatcgagaagtacgagctgcaccacacccagctgaagtccttcaaggagaacatcctcctgaagctgcgccggaacacggccgtgcgccgcaacctggagctcgcctacgccctgtacgtgggcaacgcccaaaccaagcaggaggtcttcgagcccaagaaggctcggttcaccagcgacgacttcgcctccctgaaggccaacgccaagagcgcctccagcgtgaaggaggcgcccaagaacaccaagacgaagctcaccaccgacgacttctacaacatcctgaccgagctgttcgctacgttcgagtccgagctcagcgccgacgaggacatgatcaaggaggtggagcagatcaagaaggccatcaccggggacaactacctacccaagcaacgcaccgaccagaacgggaacatcccgcaccagctgcaccaaatcgagctccggcagatcctgcagaaccagctgccccattaccccgaaatggacaagatcaacgagcagaagcccatcgagaagctcgtcactttccgcgtgccgtactacatcggccccctgatcacgcccgaggaccagcagaagtccagcgccgcgaacttcgcctggatgaagcggaaggagcagggggctatcaccccgtggaacttcgacgacaaggtggaccgcatgcagtccgccaccaacttcatcaagcggatgaccgtcaaggacacgtacctgatcaacgaggacgtgctcccggaccgcagcctgctgtaccagcggttcaaggtgctcaacgagctgaacctggtcaaggtgaacaaccagctcctgtccatcggcgagaagcaggcgatataccacgacctgttcgagaaacagaaaaccgtcagcaccaagaagctccagtcctacctgcagagcgagcagggctacggggacaacatcgagatctccggactgagcaaccccgacaagttcaacaacgggctcacgacgtacatcgacttcaagaacatcttcggcgacctggtggaggacaccaccaagcagaaggagttcgagcagatcatcgagtggtccaccgtgttcgaggaccgcgccatcttcaaggccaagctgcaggaggtcaactggctcaccgaggagcagattaaggccctggtggccaagcggtacagcgggtggggccgcctgagctacaggctcctggcggaattggtgaacgacaacggcgagcgcatcatcgacatcctctggaacaacaaggggtccaacctgatgagcattgtctcacaggacgagttccagcagcagatcgcccggatcaacagccatgaggtgcaggagctgggcatggagtccgtgctcgcaaacgcctacacgagcccccagaacaagaaggccattcgccaggtcatgaaggtggtggacgacatccagctggcgatgaacgggcaggcccccacctccatcagcatcgagttcacccggaagccggaggagaactccgagatcagcaagtcgcgctacgagaccatcacgagcatctaccagtccctgagcaaggacatcgagaaggaggtcaaggacaacctcaacaagaacaagtccagcttaaagaagaacctgtccgacaagtactacctctacttcacccagctgggccgggatatctacaccaaccagcccatccccttcaacgagatcccctactatgacatcgaccacatcgtgccgcgctccgtggagatgaacgacagcctgaacaaccgcgtcctcgtggccaaaagtatcaaccagatcaagaagaacaacgcccccatcgacagctccctgaagattaccagcgagacgcggcagctgtggaagaagctcctggactccgggctgatcaccaagcagaagtactacaagctcagctccagcatcaagaacaccgtgtccccctacgtcaagcagggcttcatcaaccgacagctggtggagaccagccaggtgatcaaactggtcgccaacatcctcggcacgaagtaccagaacgacgacaccgagatcatcgaggtgaaggcgcacctgaactccgagatccggaagaccttcgagttctacaagctgcgcgagctgaacgactaccaccacgggttcgacgcctacctgaccacgctggtcggcgggtacctctacaaccggtatcccaagctacgcagctacttcgtctacggcgaccacaagagactggacaaggcccagctctccgagctgaagaacttcaacttcctgcacgggctcaccaaccccaagagcggctccgacggcctgatcaccgccagcgggagccagcaggtcgtgctggaccgcaacgagaccatcaagcgactcaacaagatctaccgctacaagtacatgctgatcagccgggaggtgttcacgaagcagggccagttctacaacgagaccatctacccggcgaagcccaacaccgctaagatgatcccgttaaaggacaacaaaccctccgaggtgtacgggggctacagcagctccaacgtgtcgaagatcgccctcatcaaggagaagaacaccgacaactaccagttcatcggcatccccatccgctccatcgccaagctgaagcaggccaaggcgaacagcaagacggtctaccagaccgagctgaaccgggtgatcaagtccgtgctcgcctcccagaagaccaagaaacaaaaggagttcgaagtcatcctggataacgtcaagtacaaccaggtggtcgtggaccagggggagaagtactacctgggctccccctactacaagaagaacgccaagcagctcgtgatcagcccggagtccgtcaagatcctggccgacaaggccaccgcggacctgcccgagcaggaggcccacaataagctcatgacggtgtaccaggagatcgtggacgtcctgaacaagcacttcgccctgtacgacatcaacaacgtacgcaagaagctcaacgacgggctgatcaagttcagccagctgcccaactacgacgagacctccaagaaccggttcgacatcagcaagtccatcaagaccaagtacgccgtgatcatgcgcatactcagcggcatcaagaaccagacctccgaggtccccgagctggggctcaagagcccgctgaacaagatgcagacgaagggcggcatcaagatctcccccgaggccaaaatctactactcatcccccactgggatcttcagccacttcaagcaggtcaagaacctgtga

SEQ ID NO: 7938 - RNA, 4209 nt, synthetic construct
  misc_feature 1..4209: note = Cas9 variant
  source 1..4209: mol_type = other RNA
atggaacgcatcctgggactcgaccttggagtgagctccatcggctgggccctggtcgaggaggacgtgaagaatcccgagaacaacaaaatcatcaagctcggtgtgagagtcaacccgctgaccatcgacgagaaaactaacttcgagaagggcaagagcatcacgaccaacgccgggcgcacctccgcgcggagcgcccgccggaacctccagcgcttcaagctccgccgcaagaagctgctggagatcctcatccactacaagataatcaaaaatgacgccgtgctggccgagaccggcaagaacacgaccttccagacccaatatctgcgggctaaggcggcccgcgagaagatcgagctcgacgagctggcccgagtgttgctcctgatcaacaagaaacgcggttacaagtctagccggaaggtccagaacgacgacgacgggaaggccatcgacggcctgtccgtagcgaaagagctttacgagaagaactacacccccgggcagtacgcctacgacctgctgaaacgcgggaaaaagcagattcccgacttctaccggagcgacctgcagaacgagttagaccgcatctgggagttccagaagcagtaccaccccgacatcctgacggacgagttcaagaaggagctcgagggtaagggccagagggccaccgccgccatcttcctcaaccgatacaagatctacaccgcggacaacaagggtaccagagaggaaaagaagatccaggcctaccagtggcgcgtggaggccctgagtcagccgctcgacgtcaaggaggtggcctacgtaatcgccgagatcaacaacaacctcaacaatagctccggttacctgggcgcgatcagcgaccggtccaagaagctctacttcaacgggcagacgataggcgagtacctgttcgaggagctgagcgccaacccccacacacggctcaagaaccaggtcttctaccgccaggactatcaggacgagttcgaaaagatctggaaaatccagacaaagttccacccagagctgaccaaggagctgaaggaacaggtgcgggacattgtgatcttctaccagcgcaagctcaagtcccagaagggcctgatcagcttctgcgagttcgagagccgggagatcgagatcgaggagaacgggaagcgcaagcggaagaaggtgggcctgaaggtggcccccaagagctccccgctgttccaggagttcaagatttggcaggtcctcaacaacatcgagatcaagaacgaggacgagcgccggtatctggagcccgaggaaaaagagctcttgttcaacgagctgaactgcaaggggaacctcacgagccagaagtgcctggagctgctcggcttcaagagcaaagacgccaagctgaacttcaaggtggtggagggcaaccgcacaaacgagaagttatacgacgcgtttctgaagatcctcgagctgcagggctacaacgtgttcgaacttctcaagatcaaggaggacaaggatgaagcgaagctgtcggagttaaaggccagcgccgacgagataaagggtatgatcaaagagatcttcaacgctaacctcatcaacacctccatccttgacttcaacgccgagctggaggggaaggacttcgagaaccaggcgagctatcagttctggcacctgatgtactcctacgagggcgataactcaccctcagggaacgagaagctgtacgagctgctagagaaaaagttcggcttcaagaaggaacacagtaagatcctgtccaccattgtcttctcgcaggagtacgggtccctaagcacgaaggccatgcggcgcatctacccctatataaaagacaacaagtactccgaggcttgtctcctggccggctacaaccacagcaaacactccctgaccaaagaggagctcgagaaccggaaattaaaggagcagctggaggttctcccgaagaacagtctgaggaaccccgtggtcgagaagatcctgaaccagatgatcaacttggtcaacgcgaccatctccgaatacggcaagctggacggggtccggatcgagctggcccgcgaactcaagaagtccgcccaggaacgtgaggacatggccaaatcaatcaacgaggccaccctcctgcatcagaagtacgcgacaatcctcaagcaggagttcggcgtggtgaatcccagccgcaacgacatcatacggtacaagctgtacatggagctgaccgtcaacgggtacaaagatctttacaccaacaccaagatcgagaaggagaacctgttcacggacaagtacgacattgaccacatcatcccgcagagtcgcttcttcgacgacagcttcagcaacaaggtgctggtcccccgtcagtccaacctcgacaagggcaacctgaccgcctacgacttcatgagcaacaaagggtcagaacgcgaggagcacttcctgaacgtcatcaaggagctcctggataagggaagcatctccaaggccaagtacgagaaactgaaaaagaaaggcctcgagatcggggacggcttcatcgagcgcgacctgcgcgacacccagtacatcgccaagaaggccaaggaaatcctgttcgagatcaccaacagcgtggtgacgacatccgggcgcatcaccgataagctccggaaggattgggacctggtcaacatcatgaaagagctgaacctcgacaactacaggcggctgggcctgaccgagatcgtgcgcaacagcaagggcgaggagaaggagctcatccccgactggacgaagagaaacgaccaccgtcaccacgctatggacgcactgaccgtggcctttaccacccggaaccacatccagtacctgaactacctcaacgctcgcaaggacgagaagcacaaggagcaccagaacatctacgccatcgagaatatcatcaccgaggtcatcgagaagaagaacgggtccaagactcgacgcttcaaggcgcccatgaactcattccgtcacgaggccaagcagcacctgaaggagatcctggtgtcccacaagaccaaaaataaggtggtcaccagtaatatcaacaagaccaagaagaaaggcgggatccacaagaagacggagctcacgccccgcggccagctgcacaaggagaccgtgtacgggtccaagaagttcctgcagagccgggaggagaaggtgtccgccaagttcgactacgagactatcctcatggtcgtaaaccccatacaccgcaacgcgctcctgaaccggctcaaggagtacggcaacgacccgaaaaaggcgttcagcggcaagaatgccatcaataagaaccccgtgtacctggatgacagcaagaccgacatcctgtccgagaaagttaccctcagctggtacgagaccgggtacacgatccgcaagtccgtgacacccgacaacttcaaggactacaaaaacctggaaaagatcaccgacctgggcatcaagaagattctcaaggagcggctggaccagtttaaggggaacgcaaaggaggccttcagtaacctggataaggacccgatctggctcaacgaggagaagggtatcgcaatcaagacagtgaccatcacaggggtctccaacgcggagtcactgcacttcaagaaggaccacctcggcaaggagatcctcgacgaaaacggcaacaagatccccggtgatttcgtgtctaccggcaacaaccaccacctggccatctacctcgacgaggaggagaaattggacgacaagatggtgaccttctatgaggccgtcctacgcgtgaaccaggggctgcccgtaatcgacaaggactacaacaaggagaagggctacaagttcctcatgaccctgaaacagaacgagatgttcgtctttccgaacgaggacttcgacccgaacgaaattgatctgctcgacgagcggaacctggagcgcattagcaaacacctgtttcgagtgcagaaaatctccaaagtggggtacggcaacagcttcgtccgggacttcgtgttccggcaccaccttgagacgaccgtggaggagcggaaggagctacgcaacatcacctacatccagctgaaaagtctcgagggcctgcggaacatcatcaaggtccgcctgaaccacctagggaaaattgtgcagatcggcgagtactga

SEQ ID NO: 7939 - RNA, 4215 nt, synthetic construct
  misc_feature 1..4215: note = Cas9 variant
  source 1..4215: mol_type = other RNA
atgaccaagaacatcctgggcctcgacctgggggtgagctccatcggctgggccctggttcaggaggacagcaagaacccggagaacaaccgcatcgtgaagctcggggtgcgggtcaacccgctgaccgtggacgagcagatcaacttcgagaaaggcaagcccatcacgaccaacgcctcccgcaccctggcgcggagcgcccgccgtaacctccagcgattcaagttccggcgcgccaacctgatcgacgtgctgaagaaatgcaacatcctcaagcagggggatctgctgaccgagatcggcaagaactccacgttccagacccaggagctccgcgccaagagcgccaaggagaaggtcgagttatccgacttcgtgcgcgtgctgctcctgatgaacaagaagcgaggctaccgcagctcccggaaggcgaagaacgaggacgaagggcagatcatcgacggcatgagcgtcgccaagaagctgtacgaggagaacctgacccccggggagtactcctaccagctgctgatcgagaacaagaagcagctccccgacttctaccgcagcgacctgcagtctgagttcgaccgggtgtggaagttccagaagcagttcaatccggagatcctgacagacgacctctacaaggagctgcagggcaagaacaagaacgcgacgtgggccgtactgaaggaacccttcagcctcgtcgggataaagcagatcggcaccatccaggagaagaaggcggagaagtacttctggcgctccgaggccgtgaagcggcagctggacttcgaaagccttgccgtggtcttccaggagatcaactccaacctcaacaacagctccggctacctgggggccatcagcgaccgcagcaaggagctgtacttcaacaaccagaccgtgggcgagtacctcttccagcagctgaaggagaactcccacaccaagctgaagaaccaggtgttctaccggcaggactacctcgacgagttcgagaagatctgggagacgcagagcaagtactacaaggagctgaccaaggagctgaaggaggagatccgcgacatcatcatcttctaccagcggaagctcaagtcccagaaggggctgatcagcatctgcgagtttgagaaccgagagattgagatcaccgagaacggcaagatcaagaagaagacggtcggcctgaaggtggcacccaagtccagccccctcttccaagagttcaaaatctggcaggtcctgaacaacctggtgttccagtccatcgagagcaaggagctgttcccgctggacctggacatcaaggagtccatcttcaacgaggtgaacatcaaggggaacctctccgcgaagaacgtgctggacctgatgggctactccgggaaggagtggaagacgaacttcaagaacatcgagggcaaccgcaccaatgagaatctgtacaccgccttcctcaagatcatcgcctcagaggggatcgagttccccaaggagttcaagctgtccatcgacgacgacatcaaggtaagcaagatcgacatctccagcgagaagatcaaggagttcatcaaggagaacttcctgaagctcggcatcaacacctccatcctggacttcaaccccgagctggacggcaaggacttcgagaagcaggagagctaccagctctggcacctcctgtactcctacgagggggacgacagcgccagcggcaacgtgaagctctacgagctgctggagaagaagttcgggttcaagaaggagcactccaagatcctcgccgacgtcggcttcagccccgactacgggtccctgtcgtccaaggcgatgcggaagatctacccgtacatcaaggagaacaagtacagcgacgcctgccacctggccggctacaaccactccaagaacagcttcactaaggaccagctcgccaaccgcatcctgaaggagcagctggaaatcctccccaagaacgccctgcggaaccccgtggtggagaagatcctgaaccagatgatcaacctcgtcaacgaggtgatcaaggcgtacggcaagcccgacgagatccgcatcgagctggcccgggagctgaagaagaacgccgaggagcgcgccaacatgacctccgacatcagcaaggccaccctcctgcaccagaagtacgcggaggtgctgcagaaggagttcgggatcaaggccccgtcgagaaacgacatcatccgctacaagctctacctggaactggagaagaaccttttcaaggacctgtacaccgacgtccagatcaagcgagaggagctgttcacggacaagtacgacatagaccatatcatcccccagagccgcttcttcgacgactccttcagcaacaaggtgctcgtgccccggggcgccaacctgaagaaagggaacttcaccgccttagactacatggagatcgagggcaaggagaagttagagaagttcctgaacatcatcaaggagctgttcgacaagggggcgatctccaaggccaagttcgagaagctccagaagaagggaagcgagatcggcgaggggttcatcgagcgcgacctgagggacacccagtacatcgcgaagaaggccaaggaaatcctgttcggcatcaccaactccgtcatcagcacgagcgggcgaatcaccgacaagctccgggaggactggaacctggtgaacaccatgaaggagctgaacctcgagaagtatcgcaagctcggcctgaccgagctcatcgtgaactctaagggcgaggagaaggagcggatcatcgactggacgaagcgcaacgaccatcggcaccacgcgatggacgcgctgaccgtcgcgttcaccacccacaaccacatccagtacctgaactatctcaacgcccgcaaggacgagaagcacaaggagcaccagaacatcttcgccatcgagaacacgatcaccgaaatcgtggagaagaagaacgggagcaaggagcgccggttcaagctgcccatcaagaacttccgcaccgaggcaaagaagcagctggaggaggtgctcatctcccacaaggcgaagaacaaggtcgtcaccaagaacatcaacaagattaagaagaaggggagcatcatcgctaagaccgagctgacgccgcgggggcagctgcacaaagagaccatctacggctccagcaagttcctcaagaccaaggaggagaagatctccgggaagttcgacctggagatgatccagaaggtgcagaacgaaaagtaccgaaacgccctgctcaagcgcctgcaggagttcggcggcgacagcaagaaggccttcacggggaagaacgtcatctccaagaaccccatcttcctgaacgccgagaagacggagcagctccccgagaccgtgaccctggcttggtacgagaccggatacacgatccgcaaggtggtcaaccccgacaacttcaaggacttcaagaacatcgagaaggtgatcgacaagggggtgcgggacatcctgaccgagcgcctcaaggagttcaacggcaacagcaaggaggccttctccaacctggagaagaacccgatctggctgaacaagagcaaggggatctccataaagaccgtcaccatcacgggcatcaacaacgccgaggccctccactacaagaaggatcacctgggcaaggagatcctggacgagaacgggcagcggatcgcggtggacttcgtcagcaccggcaacaaccaccacgtcgccatctacgaggacgacaacgggaacctccaggagaaggtggtgtccttctacgaggccgtcgaacgcgtgaaccagaacctgccgatcatcaacaaggagtacaacttcgagctaggctggaagttcctcttcaccatgaagcagaacgagatgttcctgttccccagcgacgacttcgaccccaaggaggtggacctgttcgacgacaagtacctctccctgatcagcaagaacctgttccgggtccagtccatcagcatcgtgcagtacgggaactcggtgatccgcgacttcaaattccggcaccacctcgagacctccgtcagcgacgagaagaaactgcagggcgtgacgtaccagcagatcaagtccctgcaaccgctcaaggacatcatcaagatccgcctgaacaacctgggcaagatcgtgcagatcggggagtactga

SEQ ID NO: 7940 - RNA, 4215 nt, synthetic construct; identical to SEQ ID NO: 2140
  misc_feature 1..4215: note = Cas9 variant
  source 1..4215: mol_type = other RNA

SEQ ID NO: 7941 - RNA, 4215 nt, synthetic construct; identical to SEQ ID NO: 2141
  misc_feature 1..4215: note = Cas9 variant
  source 1..4215: mol_type = other RNA

SEQ ID NO: 7942 - RNA, 4215 nt, synthetic construct
  misc_feature 1..4215: note = Cas9 variant
  source 1..4215: mol_type = other RNA
atgagcaagaagatcctgggcctcgacttggggaccacctccatcggctgggccttcgtgagagaggccgaggacttccaggaggagagcagtatcgaacggataggggtccgtgtgaaccccctgacgaccgacgagcagatcaacttcgagaagggcaagccgattagcgtgaacgcggaccggaccctcaagcgcggggcccggcgcaacttacagcggtacaagcagcgccggaccaacctgatccagctgctgaagcagtacaagatcatcaacgagaacacaatccttgccgaggacgataagaacacaacccattccacgtacgccctccgcgccaaggcggtctccgagaagatctccaaggaggcctttgcccgggtcttgttaatgattaacaaaaagaggggctacaagagctcccggaaggccaagaacgaggacgagggccaggcgatcgacgggatgagcgtggccaagcgcctctacgaggaggacatcacgcccggccagctgtgcctgcagttactgaaggaggggaagaagaagctgcccgacttctacttatccgacctgcaggccgagctggagaagatctggaacttccaaaagaaattctaccccgagatcctcaccgacgagttcaagaaggagatcgaggggaagggacagcgtgctaccagcgcctccttctgggcgaagtacaagttcaataccgccgagaacaagggcagccgtgacgagaagaagatgcaggcctgggagtggcgtagcaaggccatcaatactcagctgacccgcgaggaggtcgcctacgtgatcaccgagatcaacaacaacatcaacaacagctccgggtacctgggggcgatcagcgaccggtccaaggagctctacttcaataaggagaccgtgggcgagtacctgttccgccagctgcggtacagcccgcacacccgggtcaagaaccaagtgttctaccgccaggactacctcgacgagttcgagaccatctgggagaaccagagccggtaccacaacgagctgaccaacgagctgaaatccgagatccgcgacgtggtcatcttctatcagcgcaagctcaagagccagaaggggctgatctccttctgcgagtttgagagcaagcagatagagatccagaaggacggcaagatcgtgaagaagatcatcggcctaaaggtatcccctaagagcagccccctcttccaagagttcaagatctggcagatcctgcaaaatctggagttcaccaacaaggagacgaaggaaaagaaggtgcccgacttcgaggccaagaacctcctgttcgaggagctgaacatcaaggggaacctcaaaggcgagaaggccatcgagatcttagggtacaagccaaaggagtggctggtgaactataaggagctcgacggcaaccgcactaaccaagtgctgtacgaaggatacctgaagatcctcgaggtcgagggctacgacattaaggacctgctgaagatcaagtccaacaaggacgaggtgaacctctccgagctgagcaagcccgtgtccgagatcaaggacctgataaagagcatcttcgagtccctgaacatcaacaccgccatccttgacttcaaccccgagctggaaggcaaggacttcgaacggcaggcatcttaccaactgtggcacctcctctactcctacgagggggacaacagcaacactggcaacgacgagctgtacagactcctgtatcaaaagttcgggttcggcaaggagcacgcgcagatcctcgccaacctctcctttagccaggactacgggtcactgagcgccaaggccatgcggaagatctaccccttcatcaaagagaacagctattccgaggcgtgcagtctggcgggctacaaccactccagctctatcacgaaggaggagaacgacaaacgcgagctcaaggagaagctggagctgctcccgaagaacagcctgcggaatccggtcgtggagaagatcctgaaccagatggtcaacgttatcaacgccatcatcgccgacccgtcgatgggccgccccgacgagattaggatcgagctcgcccgcgagctgaagaagaacgcggccgagcgggccgagatgaccatccacatcaacaaggccaagagcgagcacgacaactaccgcaagatcctgaccaccgagttcgggatcccgaaccccacgcggaacgacatcatccgctacaaactttacgaggagctgaaggtgaacggctacaagaccctgtactccaacacctacatccccagggagaagctgttcagcaaggagttcgacgtcgaacacataatccccaaggccctcttattcgacgactcctttagcaacaagacgatctgcgcgcgccaagagaacctcgacaaggggaacaagacggccttcgacttcatccagtccttttatggcaaggagaagtttgaggagtacctgcagcgcatcgagagcctggccaagatcaaggagggggacaccttcgtgatctccaaggccaagtacaagaagctcctgctgccggagatcgagatcggcgagggcttcatcgagcgcgacctccgcaatagccagtacatcgccaagaaggcgaaatccatgctgctggacatatgcaagaccgtggtccccaccacggggagcattacggaccggctcagagaagactggggcctgatcaacatcatgcaggagttaaacttcgagaagtacaagaagctcgggctgatcgagatggtagagaaaaaggacggcagcttcaaagagaggatcaccgactggactaagcgcaatgaccaccgtcaccacgccatggacgccctgactgtggccttcacgaagcataatcacatccagtacctcaactacctgaacgcccgcaagaacgagaaccacaaaatgcacggcaacgtcatcgcaatcgagcagaaggagaccgagctgctggtggattccgtggggaagcggaagcgcaagttcaagctgcccatcagcaatttccgggaggtcgccaagatgcacctggaaaacatattagtgtcctacaaggcgaagaacaaggtggcaaccaagaacaagaaccgattcaagaccaagaacggcgagaaggttaagatcgagctgactccccgggggcagctgcacaaggagaccgtgtacggcaagatgaagaagtacgaaaccaaggaggagatcatcgggagcaagttcgacgaggccaccatcctcaaggtcgccaacctggagcagcgcaacgccctgctacagcggctgaaggagaacaacaacgaccctaaaaaggcattttccggcaagaacagcctgaagtccaaccccctgtactacggcgtcgacagcaagccaatccccgagcgcatcaagatcgtgtggctggaagacgactacacgatccggaaggagatcaccccggacctgaagatcgacaaggtaattgacatcgggatccgccggatcctcgagaaccgcctggccgagttcaacggcaacgcgaaggaagccttctccaacctggaaaagaaccccatctggctcaacgaggggaagcggatcgccatcaagcgtgtcacaatcagcggcgtgaagaacgccgagaccctgcactacaagaaggaccacctggggcacgagatgctcgacaagcaaggcaagcggatccccgtggacttcgtctcaacgggcaacaaccaccacgtggccatctacaaggacgacaagagcgacctgcaggaaaaagtggtctctttctacgaggcggtggagcgcatcaaccaggagctgccgatcatcgacaagtcattcaaccacgacctcgggtggcagtttctgttcaccatgaagcagaacgagtactttgtgttcccccgcgacggcttcgacccctacgagatcgacctgctcaaccccgacaactacaagatcatatccccgaatctgttcagagtccaaaagatcgccactaaaaactacgtgttcaaccaccacctggagaccaaggccgtggacggggagctcctgaagacgaaaaaggacctgagcgacatcacatacaggttcatccagacccccgtcaacctcaagaacatcataaaggtgcggatcaaccacatcggccagatcgtgaagatcggggagtactga

SEQ ID NO: 7943 - RNA, 4218 nt, synthetic construct
  misc_feature 1..4218: note = Cas9 variant
  source 1..4218: mol_type = other RNA
atgaagaccatcctgggcctcgacttagggaccaattcaatcggctgggccctggtgaaggaggccgagaactccaacgagaagtccgagatcatcaagctcggagtgcgcgtgaacccactgacggtggacgagaagaccaacttcgaggcgggacggccgctgtcgaccaacgccgaccgcaccgccaagcggagcgcccgccggaacctccagcgctacaagctgcggcgcaagaatctgatcgacctcctgatcaagaaccagctcattgacaaggacacgcccctcaccgagatcgggaagaacaccacccaccagacgctggagctgcgggccaaggcggctcgcgagcggatcgagctcgaggacctggcccgcgtcttcctggccatcaacaagaagcggggctatcggagctcacggaaggtgaacaacgaagaagagggtcaggcggtggatgggatggccgtcgccaagaagttatacgacgagaacctgacccccggccagtacgcctacgagttgttgtccaaagggaagaagtacgtgcccgacttttaccgcagcgacctgcaggccgagttcaacgcgatctgggagtaccagaaacagttctatgccgacatcctggacgacgagctctacaacgccctgaagggccaggggcagcagaactcccggaagcgctttctggccatcaagggcgtgtacaccgccgagaacaagggcaagcgggacgacgtcaagctccgccactacaagtggcggagcgaggcgatctccaagaagataaacattgaggaggttgcctacgtgttagtcgagatcaacaacgacctgaacaagagctccgggtacctcggcgccatcagtgaccgctccaaagaactttacttcaacaaggagaccgtgggggagaacctgtggaagcagatccagaagaacccgcataccagccttaagaaccaggtgttctaccgccaggactatctggacgagttcgagcagatctgggaaacccaggcccaatttcacccccagctaaccctcgccctgaaggagcagatccgggacgtcatcatcttctaccagcgaaagctgaagtcccagaagggcctcctgagcttctgccagttcgagtcctgggagatcgagcggaaggacgagaacggcaatgtgattctgaacaagacgacgcagctccccaagcgacaaaccgtggggcgacgcgtcgcgcccaaaagcagcccgctgttccaggagttcaagatctggcagaacatcaacaacttagaagtgaccaagatctccgagggcgcatcgaagaacaagaaggagacggagacgctctccgacgacgagcggaagctgctgttcgaggagctcaacctgcgcgggaacttgtctcagaaggaagttctgcagatcctcggcctgaaggacaaggagtacaagacgaacttctccgaagggctggagggcaaccggaccaacgcggccctcttcaacatctaccagcagatcgccgagaatgaaggctacgggttcgactggagcaagaagtccgcgcaggagatcaaggaggagctgaaggccgtcttcccccagatcggcatccaagccgacatcctggacttcaacgctaacctcgacgggaaggagttcgagaaccaggcgagctaccagctgtggcacctcctgtactccgccgaggaggacgacaagatcaacgaagaggaccaaatcatctacggcaacagcgcggtatccctgaagaagaagctgtgcgagaagttcgggttcacccccgagtacgctaagtggatcgccaacgtgagcctccaggacgactacggcaacctgtccacgaaggcgatgcgcaagatcatcccctacctgatcgacggcaacgactacagcgaggcctgcgccttagccggatacaaccactccaacagcctcaccaaggaggagaacgacaaccgggagctgctcgacaagctggagctgctcccgaagaactccctgcgcaaccccgtcgttgagaagatcctgaaccagatggtcaacgtggtgaaccaggtcatcgagacctacggcaagcccgacgaggtgcggatcgagctcgcccgcgagctgaagaagtccgcggaaaagcgggccgagatgaccaagagcatcaacgaggccacgcgccggaacgaggacatcaagaagctgatcaccaaggacttcgggatccccaacccgacaaagagcgacgtggtccgctaccgtctctgggaggaactggcgcccctggcctacaaggatgtgttcacaggaaagcagatcaagaaggaagacctcttcagctccaagatcgacatcgagcatatcatccccaaggccctgctgttcgacgacagcttctccaacaagacgctcgtcttccgcgagaccaacctgaaaaaggccgaccgcaccgcctacgacttcatcgagagcgactacaacgccaccctggatgactatatccagcgggtcgagacgctctataacaataccaagggcaccatctccaagggcaagcgcaacaagttgctgatggcgcagaagaacctccctgacggcttcatcgagcgggacctgcgcaacagccagtacattgccaagaaggccaaggccatgctgtaccaggtgtttaaggacgtgaacgtcacatccggaagcatcaccgaccggctccgcgaggactgggacctgatcaacgtgatgaaggagctgaacttcccgaaatacaaggccctcggattgactgaaatcgaggagcggtacgacatagggcaggaaaagaccaagcgcgtcgaggtcatcacggattggaccaagcggaacgaccaccgccaccacgcgatgaacgcactgacggtggccttcaccacctccagccacatccagtacctcaactacctgaacgctcggaagaatgagtcacacaaggagcacaagaacatcaagggcatcgagaacaagatcacccacaagcagaaggacaagcgcaagttcatcccgcccatgcccaacttccgggaggaggccaagaagcatatcgagacgatcctggtgagcatcaagaacaagaacaaggtctacaccaagaatataaacaagaccaagaagaagtccggccacaacaccaaggagcagctcacgccccgcgggcagctgcacaaggagaccgtgtacggcaagagcaaacgccccatgagcaaacccaccaagatcaacaagaatttcagcctggagcaagcacagctcatcatcaacgtgcaggagaaggagctggtcctccgccacttagcccagttcgacaacaaccccgccgtcgcgtttgacaccaagacgcttaagaagatgcctctgctcaagaacggggagcccctgaaggaggtgctatgcttcgaggaaattttcacaatccggaaggacatcacccccgacctcaagatagagaaggtcgtcgacgaaaagatcaaggccatcctggagcagcgcaagaaggacttcggcgggaacgcgaaggaggccttctccgacctggacaagaacccgatctggctcaacaagaagaagggcatctgcatcaagcgtgtgaccatcacgggcgtgtcaaacgccgaggccctgcaccaccagaaggaccacctggggcgcgagatcctcgacgacaacggcaaccccatccccgcggacttcgtgagcactgggaacaatcaccacctggctgtgtacctggactccgaggggaagctccaggacaacatcgtctcgttctacgaggccgtggtgcggacttcccaggggctgcccgtcgtggacaagggcctgaacaaggacctcggatggaagttcctgttctcactgaagcagaacgagatgttcgtgttcccgaacgacgacttcgacatcaacgacttcgatctcctggacgacaagaaagccgagttgatctccaagcatctctacagagtccagaagatcagcaaggtatccgcggggaacagcttcgtgcgcgacatcgtattccggcaccatctggagacaacggtgaaggaggtgaaggagctgaaggacatctcctatatccaactcaagtccctggagggcctccgcaacatcaagaaagtccggatcaaccacatcgggaagatcgtccaggtgggcgagtactga

SEQ ID NO: 7944 - RNA, 4221 nt, synthetic construct; identical to SEQ ID NO: 2144
  misc_feature 1..4221: note = Cas9 variant
  source 1..4221: mol_type = other RNA

SEQ ID NO: 7945 - RNA, 4224 nt, synthetic construct; identical to SEQ ID NO: 2145
  misc_feature 1..4224: note = Cas9 variant
  source 1..4224: mol_type = other RNA

SEQ ID NO: 7946 - RNA, 4227 nt, synthetic construct; identical to SEQ ID NO: 2146
  misc_feature 1..4227: note = Cas9 variant
  source 1..4227: mol_type = other RNA

SEQ ID NO: 7947 - RNA, 4230 nt, synthetic construct
  misc_feature 1..4230: note = Cas9 variant
  source 1..4230: mol_type = other RNA
atgagcatcatcaacttccagcgccggggcctgatggagactcaggcctccaaccagctcatcagcagccacctgaagggttaccccatcaaggactacttcgtaggcctggacatcgggaccagctcggtcggctgggccgtgacgaacaaggcgtacgagctcttgaagttccgcagccacaagatgtgggggtcccgcctcttcgacgagggcgagagcgcggtggcccggcggggattcagatccatgcggcgccggctggagcgccggaagctgcgcctgaagctcctggaggagcttttcgccgacgccatggcgcaggtcgacccgaccttcttcatgcggctccgcgagagcaagtaccactacgaggacaagaccaccgggcactccagtaagcacatcctgttcatcgacaagaattacacggaccaggattactacaaggcctatcccacgatctaccacctccgggccgagctgatgaaggacggaaccgatgacatccgcaagctgttcctggccgtgcaccacatcctcaagtaccgggggaatttcctgtacgagggcgcgaccttcgactccaacgccagcacgctggacgacgtcatcaagcaggccctcgagaacatcaccttcaactgcttcgactgcaactccgctatcagctccatcgggcagatcttaatggaggccggcaagaccaagagcgacaaggcgaaggccatcgagcacctggtcgacacctatatcgccacggacaccgtcgacacctccagtaagacccagaaggaccaggtgaaggaagacaagaaacgcctcaaggccttcgccaacctggtcctgggcctcaacgctagcctgatcgacctgttcgggtctgtcgaggagctcgaggaggacctgaagaagctgcagatcacgggcgacacatacgacgacaagcgggacgagttggccaaggcctggagcgacgaaatctacatcatcgacgactgcaagtccgtgtacgacgccatcatcctgctgtcaataaaggagcccggcctcaccatctccgagagcaaggtcaaggccttcaacaagcacaaggacgacctggcgatcctaaagtccctcctcaagtctgaccgctccatctacaacaccatgttcaaggtggacgagaaggggctgcacaactacgtgcactatatcaagcagggccggacggaggagaccagctgcaaccgcgaggacttctacaagtataccaagaaggtcgtggaggggctgccagacagcaaggacaaagagtacatcctgagcgagatagagctgcagacactcctgccgctgcagcgaatcaaggacaacggcgtgatcccctaccagctccacttggaggagctgaaagtcatccttgccaagtgcgggcccaagttccccttcctcaacgaagtggccgacggcttctccgtggccgaaaagctgataaagatgctcgagttccggatcccgtactacgtcgggcccctcaacacgcaccacaacgtggacaacggtggtttcgcctgggcggtgcgcaaggccagcggacgggtcaccccatggaactttgacgacaagatcgaccgcgaaaagtccgccgccgcgttcatcaagaacctgacgaataagtgcacatacttactcggcgaggacgtgctgcccaaaagctccctgctctacagtgagttcatgctgctgaacgaactcaacaacgtccgaatagacgggaagccgctggagaaggccgtgaaggagcacctgatcgaggccgtgttcaagcaggaccataagaagatgacgaagaacagaatcgagcagttcctcaaggacaacaactacatccccgagaagcataaacccgagatcaccggcctggacggggagatcaagaatgacctggcctcctaccgggacatggtccgcatcctcggcaacaacttcgacctgagcatggccgaggagatcatcaccgacatcaccatcttcggcgagagcaagaaaatgctccgggagacgctccgcaacaagttctcctcacggctggacgatgaggcgatcaagaagctgtccaagctccgctaccgggactgggggcgcctgagtcggaagttattgaacgtgatcgagggatgcgacaaggccggggacggcactcccgagaccatcatcatcctgatgcgcaacttctcctacaacctgatggagctcctgggggacaagttttctttcatggagcggatccaagagatcaacgccaagctgatcgaaggccagatcgtgaacccgcacgacatcatcgacgacttagccctctcccccgcggtcaagcgcgcggtgtggcaagcactgcgtatcgtggacgagatcgtccacatcaagaagacactcccagcccgcatcttcgtggaggtgacgcgcagcaacaaggccgagaagaagaagaaggactcccggcagaagcgcttaagcgatctgtacgccgcgatcaagaaggacgacgccctcctgtccggcctgaccaacgaagagttcgggggcctcaagagcgggctggccaagtacgacgacgccgcgctgcggtccaagaagctctacctgtattacacccagatgggccgctgcgcctacaccggggaggtcatcgacctgagccagctcaacaccgacaactacgacatagaccatatctacccccggtccctcacaaaggacgacagcttcgacaacctggtgttatgcaagcgcaccgccaacgcccagaagtccgacacctacccgatcagcaaggagatccagaaggcccagaaggcgttctggatcttcctgaagcagcaggggctgatcagcgagcggaagtacgagcgcctcacccggatcacgcccctgaccgccgacgacttgtcgggcttcatcgcccgccagcttgtggagaccaaccagagcgtcaaagccgccacaaccctgctgcggcgcctctaccccggtgtggacgtggtcttcgttaaggcggagaacgtgaccgacttccggcatgacaacgacttcatcaaggtccgctccctcaaccaccaccaccacgccaaggacgcctatttgaacatcgtggtgggcaacgtctaccacgagcggttcacccgcaactttcgggcgttcttcaagaagaatggcgccaaccgcacctacaacctcgcgaagatgttcaactacgacgtgaactgcacgaacgccaaggacgggaaggcctgggacgtcaagacctcaatggacaccgtcaagaagatgatggcatccaacgacgtgcgggtcacgaagcgcctgctggagcagagcggcgcgctcgccgacgccacggtctataaggccgccgtggcggagaaggccaaggacggggcttacatcggcatgaagaccaagtcaagcgtgttcgccgacgtctccaaatacggtggcatgaccaagatcaagaacgcctacagcatcatcgtacagtacgcggggaagaagggcgaggtggtcaaagagatcgtgccactgcctatctacctcaccaaccggaacacgaccgaccaggacctcatcgactacgtggcctccatcatcccccaggcgaaggacatcagcatcatctaccgcaagctgtgtatcaaccagctggtcaaagtgaacggcttctattactacctcgggggaaagaccaactccaagttttgtatcgacaacgccatccaagtgatcgtaagcaacgagtggatcccctacctgaaggtgctggaaaagttcaataacatgcgcaaggacaacaaggacctcaaggctaacgtgatctccacccgggcgctggacaacaagcacacgatcgaggtccgcatcgtggaggagaagaacatcgagttcttcgattacctggtgagcaagctcaagatgcccatctaccagaagatgaaggggaacaaagccgccgagctctccgaaaagggctacgggctgttcaagaagatgagcctcgaggagcagtccattcacctgatcgagctgctcaacctgctgactaaccagaagaccaccttcgaggtcaagccgctcggcatcacggccagccggagcaccgtgggctccaagatcagcaaccaggacgagttcaaggtgatcaacgaatccatcaccgggctgtacagcaatgaggtcacaatcgtgtga

SEQ ID NO: 7948 - RNA, 4233 nt, synthetic construct; identical to SEQ ID NO: 2148
  misc_feature 1..4233: note = Cas9 variant
  source 1..4233: mol_type = other RNA

SEQ ID NO: 7949 - RNA, 4236 nt, synthetic construct
  misc_feature 1..4236: note = Cas9 variant
  source 1..4236: mol_type = other RNA
atggtcaaaaaggagtacttcatcggcctggacatggggacctcttccgtcggctgggccgtggccgacaccaactacaacctcctgcgcgcgaaggggaaggacatgtggggcgtccggctgttccccgaggccagcacggccgccgaccgccggtcccaccgcaccgcccggcgcaacaacaagcggaaggcggcccgcgaggggttccttcgggagatcttcgaggacgagatcaacaagatcgacccgggcttcttcgagcgcctcaaggagagcaagtactacctggaggacaagctcaccgacacccctttcgtcctgttcgccgacaagggctacacggacaaggagtactacgacgagtaccccacggtgttccacctgataaaggagctcatctccgaaaaggggctggagccccacgacatccggctggtgtacctcgcctgcctgaacatctacaagcatcgcggccacttcctgaatgacaccctcagcggtgacggcatcgacaacatcaactccctgtgcaacgatttcaccagctacctggcggattacaaccagaactccgaggacgacgggactgagaagatggacctcgatagcacggtcctggccggcgtgttcgaggaaaccctgtgcaacaagcacctctccaacagcgccaagaagcgggacctgatcgacaagctgggcatcaccaacaagacgaagtacctcacggagatgatggccctgatctccgggctggccagctccgtgagcaacatgttcgcgaaagacacctacgacgaggagcagaagaagttcaagctctccttccgcagctccaacctggacgaggacatggtcaaggtgcaggccatgctgaccccggaggagtacgagatgatctgcatcatgaagaagatccacgactggagcgtggtcagcgtgatcatgggttcacacaagtacatcagcgacgccagggtggagctctacgagaagcacaagcaggacctggccaagctgaaggccatctacaaggaatacctccccgacaagtacgacgcgatgttccgcgagatgacggacaactcctacagcgcctacgtcgggaaggtttccagcaacaagaagtcccaaaccggcaaccacaaggtgcggatgcagcgccggggcgccaagtgcaagcaggaggacttctacgaccgcatcaagaaggagatcaacagcgtcccccaggaggagaagatcgacattctgcaggacatggagaccaactccttcctgcccaagcagttgaccaacgagaacggggtgatcccgtatcagctgcacctggccgagctcaagaagatcctggacaacgccagcacatacctgcccttcctcaactccgcggacgagaccggcatcagcaacaaggacaagatcatccagctgttcgagttccggatcccctactacgttgggcccctgttcaagtccgagaagaacaagaccaacgcctgggtcgtgcgcaaggagagcggcaaggtgtacccttggaacttcaacgagaagatcgacgagaagcagtccgcggagattttcatcgagcgcatggtccggcactgcacctacctcaacaacgagagcgccctgcccaaaaattccctgaagtacgaacgcttccgggtgctcaacgagctgaacaacctgcgcatcaacggggagcggatcagccccgagctgaagcagcgcatctacaacgagctgttcaaggtaaagaagaagcggatcacgaagtccatgctctgcgagtacctgtacaagaatggcatcgccgacaaggacagcgaactaagcggcttcgacgggaccttcgcgaacgccctgctatcctacggcaagttccgcgagctgttcaacgtggacaccctcaccgacaagcaggaggccgccgcggaggacatcatcaagtggagcacggtgtacggggactccaagaagtttctgcaggagaagatcgaggagaactacggcccagagagcgagaacccgctgctggacaacaagcagatcaagcgggtcatggggtacaagttcacggactggggcaacctgtcccgcgagttcctcaacctggagggcgccgacaaggacaatgacaccaccacgggggaggtgatgcccctgatcacccggatgtgggaggagaactacaacctcatggagctgatgagcaacaagttctcctaccgcgacgccctggccgagaagaccgaggagatcgagaagaccctcacggacatcgagtacgaggacctagaggatctgtacatcagcgcccccgtcaagcggatgacctggcagaccctcctgatcctgaaggaaatctaccagataatgggttacgcgcccaagaagatcttcgtcgagatggcccgcgaggaggaggaaaaggtgaacgggaagggcgcccggaagtccagccgcaagaagcggctcgaggacctgtaccgcaactgcaaggatgcctccaaggagctgagcacagggatcaagaacgccgacgaggcgatcctccggcgcaaaaagctgtacctgtactacttgcaaaagggcaagtgcatgtactccggcaaaactatcgacttcaagagcctgttcacgaacaactacgacatcgaccacatctacccgcagtccgtggtcaaggacgacagcctggagaacaacatggtgctcgtggagcgcaactacaacaacaagaagtccgacacctttcccatcttcagcgactggcagaacaagatgaagcccttctggaccatgctgaaggaacaggggttcatcaacgaggagaagtacaagaggctgacccgcacggacgagctcaccgacgacgagctggccaacttcgtcaaccggcagttggtggagacccgccaggccaccaaggtgatcgccgaactcctgaagaacagcttcgacgacatcgactccaagatcgtctatgccaaggcgggcaacgtgagcgagttccggcacaagttctccatgaagtacgacaaggagacggaaaagtcctcggtgatccaccccgagctggtcaagtgccgcatcataaacgacttccaccacgccaacgacagctacttgaacatcgtggtggggaacatctacgacgtcaagttcacccagaacccgtacaactacatcaaggagtacaagaagcagaagaacaactccgccctgagcgagcaggagaaggagaagtaccacatggacaagatcttcaacttcgacgtgaagcggaacggggaggtggcctggatctcccgcggagacaacaagaccctagagaccgtcctcaaggtgatgcggaagaacacgcccatcgtcacccgcatgaacttcgaggagcatggacagctggcggacctgaccatctacagcgcctccgacgccctcagcaagaagggcgtcgggtacatcaaggtgaaggcctcagacgcccggctggacgtgctgaagtacggcgggtacaagaagtacaagggcgcgtacttcttcctcgtcgagcacaccgagaagaacaagcgcgtgcggacgatcgagaacatgcccttatacctgaagaacgagctcaacaccaaggagaagatcgagctgtggtgcgccgacaaggagaacggcctggggctcgtggaccccgacgtccgcctgggcaagatcaagctgtacagcaagatccggatcgacgggttcgacctctacctgaccggccgcaccgggaacaacctgctaacgtccaacgccgtgcagctcaagatcggcagcaacaagccgtccgacaacgacaagctgttctggcggtactacatcaataagctcagcaagtacaccgagaactccgagttcgtgagcatccagaacaacataaagctgtacgacctgttcgtcgagatcaataacgccggcgtgtacagcaagcgccagaaccccatcggggacaagctcctggagggccggtccaagttcatcaacctgaccctcagcaagcaggtcgagaccctgctggggatcatccgcatctactccctcgagaaccagggcgccgacctgagcaacatcgggggccaggagaaaaacggcacgatgaagcctcacaagcggatctccgacaagaaggaagtgctgctcatcaaccagagcgtgaccgggctgtacgagtccaagatcgacctgctcaagatctga

SEQ ID NO: 7950 - RNA, 4236 nt, synthetic construct
  misc_feature 1..4236: note = Cas9 variant
  source 1..4236: mol_type = other RNA
atgaagaacatcctgggcctcgacctggggacgaacagcataggctgggccctgatcaagcagaacgccgaggaacgccaggggtccatcctcggcatggggacccgggtgctgcccatgagccaggacgtcctgggcgatttcggcaaggggaactccgtcagccagacggcggcccgcaccggctatcgggggatccgccggctccgcgaaagattcctgttacgccgggagcgcctccaccgggtgctgaacatcctgggcttcctcccgtactactacgccgcccagatcgacttcgacaagcgcttcggaaagttcaaggccgagaccgagcccaagctgccctacaacaacgagggcttcatcttcaagaactccttcgaggagatgctgagcgacttcaagatctctcagcccgagctcctgagcggcaacaagaaggtcccgtacgactggaccatctactacctgcggaagaaggcggtgtcccagaagatcgagaaggaggagctcgcctggatcctgctgaacttcaaccagaagcgcgggtactaccagctccggggcgaggacttcgacgaggagaaggacaagacgttcgtgaccctgaacgtcgacaaggtgatcgacagcggggagaaggtgaagggcaacatcctgttcgacatctacttcaccaacggctggaagtacgagaagcagaccacgaagcccgaggactggctcggtcgctccaaggagttcataatcaccgagagcctgctgaagaacggcgaggtccgccgcaccttcaaggccgtggactccgagaaggactggatcgccatcaaggcgaagaccgagcaggagatcgagacggcgcacaaaaccgtggggagctacatctacgacgccattctccagaaccccaaacagaagatcaagggcaagctggtccggaccatcgagcgcaaattctacaaggaggagctgcggaaaatcttagagaagcagaaggacttccacctggagctgcagaacgaggacctctactccgactgcgtgcgagaactgtaccgcaacaacgatacccaccagctaagtctcgccaagaagtccttcatccacctgttcctggaggacatcatcttctaccagcggcccctcaaaagccagaagtccagcgtgagcaattgcacgctcgagtgtcgcaagtaccgggacaagaacggagccgagggcatccagttcctgaaggtcatcccgaagtccaacccctactaccaggagttccgcatttggcagtggatgagcaacctcaagatctaccggcgcgacgacgacgtgaacatcacctccgagtgcctgaagaccgcggaggactacgaggacctgttcgtgttcctcaacatccggaaggaggtcgaccagaaggcctgcctgcgccacttcaagctgagcgagaagacccatcggtggaactacgtggaggacaagaagtacccctgcaacgagacgggcaccatgatctccgagcgcctcaagaaggtgggggacagccccgataacatcttcacccgggaaatggagcagcagatctggcacatcatctactccgtcaacgataagaccgagtacgagaaggccctcaagagcttcgcgaagaagaacgaactggacaacgactccttcttcgaggccttccgcaagttcccgcccttcgacagcgagtacggctcctttagcgagaaggcgatcaagaagctgctccccctgatgcggatcgggaagcactggaactgggaggccgtggatgagaagatcaagaaccgcatccagaagatcatcatcggcgagtacgacgagaacatcaaggacaacatccgggaaaagacgctgtccctccagaaggaaagcgacttccaggggctgcccctgtggctcgcccagtacgtggtctacggccgccactccgaggccagcgtggccggcaagtggaactccgtcgacgacatcgaggagtacctgaaggagttcaagcagcacagcctgcggaacccgatcgtggagcaggtcatcatggagacggtgcgcgtggtgaaggacatctggatcaagtacgggaacggcgcggccgacttcttcgatgagatccacatcgagctcgggcgggagatgaagctacccgccaaggagcgcaacaagatgacccagaagatctccgagaacgagaacaccaacctgcgcatcaaggccctcctggccgagatgatgaacgacagcgaggtccagaatgtgcggccctacagtcccatgcagcaggaaatcctgaagatctacgaggacggcgcgctaaactccgagatcagcgtggacgacgacatcctgaagatctccaagacggcccagcccagcccctccgacctgaagaagtacaagctctggctggagcaaaagtaccgcagcccctacaccggggacatcatccccctgaacaagctgttcaccaccgagtacgagatcgagcacatcatcccgcaatcccggtatttcgacgacagcttctccaacaaggtcatctgcgagagcctcgtgaaccgcctgaaggacaactatatcggcctcggcttcatcaagcagttccacgggtacaagatctccgacaagacgaaggtgttcgaggtcgaggagtacgaggacttcgtgaagaagaactacgccaacaaccggagcaagcgctccaagctgttactcgaggagatccccgaggagatgatcgagcggcagctgaacgacacccgctacatcagcaaatacatctccggcatcctcagcaacatcgttcgtaagaaagagaacgacgagggggtcaactccaaagacatcatccccggcaacggcaagatcaccagccagttgaagcaggactgggggctgaatgacgtgtggaacgacctgatcctcccccgcttcgagcggatgaacgagctgaccaagagttcctacttcacggtgtggaacgagaagtaccagaagtttctgccgaccgtacccgtggagttcagcaagggcttctccaagaagcgcatcgaccaccggcaccacgccctcgacgcactggtgatcgcctgcgccaccaaggaccacgtcaacctgctcaacaacaagagcgcgaagtccgagatgaagcgctacgacctgaagcggaagctgatgaagttcgagaagaagacctaccagcacagccagaccggggagcgcatcgtgaaggacgtgcccgtcgagttcctcaagccgtggaacgacttcacggtggaggccaaggagaacctggagaagatcatcgtgtccttcaagcagaacctgcgggttatcaacaaggcgaccaaccactacgagaagtggatcgagaaggacaacgtgaaggtcaagggcctcgtcgagcagcaggggctgaactgggcgatccgcaagcccctgcacaaggacaccgtgtcaggcaaggtggacctccccgggatcaaggtccccaaggggaagatcctgaccgccacgcggaagtccatcgacacgagcttcgacctgaagaccatcaactccatcaccgacacgggcgtgcagaaaatcctcaagaactacctggagtacaaggggaactcttccgaggaggccttcagctccgaggggatcgaggacatgaacaacaacatcgagaagttcaacgaggggaagctgcaccagccgatcaccaaggtgcgcatcttcgagctcggcagcaagttccccctgggccagatcgggaacaagaagcacaagtacgtcgagaccgccaagggcaccaacctgttcttcgcgatctacgaggacgacaaggggaagcggacgtacgagaccatccccctcaacgaggtgatcgaacgccagaagcaaggcctggcccccgtaaccctgaagtccaagaatgacttctacctctgccccaacgacctggtctatgtggccgccgagggggaaagcgtcaacaagatcgacttcaagtacgcctcccaggagttcatccacaacatctacaaggtcgtgagcttcagcggctcccagatcttcttcgtgaagcagaacatcgcggtcagcatcgtgaataaggccgagttctccaccctgaacaagatggagcgcgccgtggacgggaagatgataaaggactgctgcatcaagctcaagatcgaccggatcgggaacatcaccaagagctga

SEQ ID NO: 7951 - RNA, 4239 nt, synthetic construct
  misc_feature 1..4239: note = Cas9 variant
  source 1..4239: mol_type = other RNA
atgatgaccaagaacatcctgggcctcgacctggggaccaacagcatcggctgggccctgatcaagcagaacgccgaggagcgcaaggggtccatactcggcatgggaacgcgggtgctgcccatgagccaagacgcgttaggcgacttcggcaaggggaactccgtcagccagaccgccgcccgcaccggataccgcggggtgcggcggctccgtgagcggttcctgctgcgccgggagcgcctccaccgggtgctgaacatcctgggcttcctcccggactactacgccgcccagattgacttcgacaagcgcttcgggaagttcaaggcggagaccgaacccaagctgccctacaacaacgagggcttcatcttcaagaactccttcgaggagatgctgagcgacttcaagatctcccagccagagctcctgagcgagaacaagaagatcccctacgactggacgatctactacctgcggaagaaggccgtctcccaacgcatcgaaaaagaggagctcgtgtggatcctgctgaacttcaaccagaagcggggctactaccagcttcgcggggaggacttcgacgaggagaaggacaagaccttcgtcaccctgaacgtcgacaaggtgatcgattcgggcgagaaggtgaaggggatcgtcctgttcgacgtgtacttcaccaacggctggaagtacgagaagcagatcacgaagccggaggactggctcggccggtccaaggagttcatcatcaccgagagcctgctgaagaacggggaggtgaagcgcaccttcaaggccgtcgactccgagaaggactggatcgccatcaaggccaagaccgagcaggagatcgagatcgcccacaagacggtgggcagctacatctacgacgccatcctccagaaccccaagcagaagatcaaggggaaactgatccggaccatcgagcgcaagttctacaaggaggagctgcggaagatcctcgagaagcagaaggagttccaccccgagctgcagaacgaggacctatactccgactgcgtccgcgagctctaccgcaacaacgacgcccaccagttaagcctggccaagaaggacttcatccacctcttcgtcgaggacatcatcttctaccagcggccgctgaagtcccagaagtcctctgtgagcaactgcaccctggagtgccgcaagtacaaggacaagaacggtgaggagcggatccagttcctcaaggtgatccccaagagcaacccctactaccaggagttccgcatctggcagtggatgtccaacctgaagatctaccggcgcgacgacgacgtcaacatcaccagcgagtacctgaagacaaccgaggactaccaggacctcttcgtgtttctgaacacccggaaggaggtggaccagaaggcgtgcctgaagcacttcaagctcaacgagaagacccaccgctggaactacgtcgaggacaagcggtacccctgcaacgagacggggaccatgatcctggagagattcaagaaggtgggcgattccgccgacaacatcttcacccgggagatggagcagcagatgtggcacataatctacagcgtgaacgacaagaccgagtacgagaaggccctgaagtccttcgccaagaagaacgacctcgacaacgtcagcttcttcgaggccttccgcaagttcccgcccttcgactcagagtacgggagcttctccgagaaggcgatcaaaaagctgctgcccctgatccggacgggaaagtactggaactgggaggccgtcgacgagaagaccaagaagcgcatccagaagatgatcaccggcgagtgggacgaggacatcaaggacaacatccgggagaagaccctcagcctgcagaaggagtccgacttccaggggctgcccctctggctggcccagtatgccgtctacggccgccacagcgaggcctccgtggcggggaagtggaacagcgtgaacgacatggaggagtacctgaaggagttcaagcagcactccctccggaacccgatcgttgagcaggttatcacggagaccatccgcgtggtgaaggacatctggatcaagtacggcaacggcgccgccgacttctttaacgagatccatatcgagctggggcgggagatgaagttacccgccaaggagcgcagcaagatgacccagaaaatctccgagaacgaaaacaccaacctacgcatcaaggccctgctggtggagatgatgaacgacagcgaggtgcacaacgtccggccctactcccccatgcagcaggagatccttaagatctacgaggacggcgcgctgaacagcgagatcagcgtggacgacgacatcctgaagatttccaagacggcccagcctagcccctccgacctcaagaagtacaagctgtggctggagcagaagtaccgcagcccctataccggggacatcatccccctcaacaagctgttcaccactgagtacgagatcgagcacatcatcccgcagtcccggtacttcgacgacagcttctcaaacaaggtgatctgcgagagctccgtcaaccgcctgaaggacaactacatcggcctcgggttcattaagcagtttcacggctacaagatcagcgacaagacgaaagtgttcgaggtggaggagtacgaggacttcgttaagaagaactacgcctccaactggagcaaacggtccaagctgctactcgaagagattcccgaggagatgatcgagcgccagctgaacgacacccggtacatctcgaagtacatctccggcatcctgagcaacatcgtgcgcaagaaggagaacgacgacggggtgaacagcaaggacatcatccccggaaatgggaagatcaccagccagctcaagcaggactggggcctgaacgacgtctggaacgacctggtgctcccccggttcgagcgcatgaacgagctgacaaagagcaacgacttcaccgtgtggaacgagaagtaccagaagttcctgccgacggtccccgtggagttctcgaagggctttagcaagaagcggatagaccaccgccaccacgccctcgacgcgctggtgatcgcctgcgccacccgggaccacgtcaacctgctcaacaaccagtcagcccgcagcgagatgaagcggtacgacctgaagcgcaagctgatgaagttcgagaagaaggcctaccagcactcccagaccggggagcggatcgttaaggacgtgcccgtcgagttcctcaagccttgggacaacttcatcgtggaggcgaaggagaacctggaccgcatcatcgtgagcttcaagcagaacctgcgtgtcatcaacaaggccaccaatcactacgagaagtggatagagaagaacaacgtgaaggtgaaggccctcgtcgagcagcagggcctgaactgggccatccgcaagcccctgcacaaggacacggtgtccgggaaggtggacctccccggcaccaaggtccccaaggggaagatcctgaccgccacccgcaagagcatcgacacgtccttcgacatgaagaccatcaactccatcaccgacaccggcatccagaagatcctgaagaactacctcgagtacaagggctcctacgaggacgcgttcagcccggagggcatcgaggacatgaacaagaacatcgagaagttcaacgacggcaagcagcaccagcccatcatcaaggtgcggatcttcgagctgggatccaagttccccctgggccagatcgggaacaagaagcacaagtacgtggagacggccaaagggaccaatctattcttcgccatctacgaggacgacaagggcaagcgcacctacgagaccatccccctgaacgaggtcattgagcggcagaagcaggggctggccccggtgacgttcaagagcaagaacgacttctacctctcccccaacgacctggtgtatgtcgccgcggagggcgagagcgtggacaacctggacttccagtccgacagccaggagtatatcaacaacgtatacaaggtcgtgtccttcagcgggagccagatcttcttcgtgaagcagaacgtcgccgtgtccatcgtgaacaaagctgagttcagcaccctcaacaagatggagcgcgccatcgacggtcggatgatcaaggaatgctgcgtcaagctgaagatcgaccgcatcgggaacatgaccaagtcctga

SEQ ID NO: 7952 - RNA, 4245 nt, synthetic construct
  misc_feature 1..4245: note = Cas9 variant
  source 1..4245: mol_type = other RNA
atgaagaagatcctcggcctcgacctcgggaccaacagcatcggctgggctttcgtagaggaggccgaaaacgagtccgagaagtcctccatcatcaaactgggggtccgcgtgaaccccctcactgtggacgagcaacagaacttcgagaagggcaagagcatcacaaccaacgcggaccggaccctgaagcgctccatgcggcgcaacctgcagcggtacaagcagcgccgggagaacctcatcgacatcctgatgaagaacgggttcaccagcgacgacacgatactgtcggaaaacggcaaccgcaccaccttcgaaacctaccggctccgcagcaaggccgtcgccgagaagatctccctgcaagagttcgcccgggtgctgcttatgatcaacaagaaacgcggctacaagagctctcggaaggccaaggggacggaggacggcgaactgatcgacgggatggaggtggcgaagaagctgtacaactacaacctcaccccgggccagctgtgtctgcagctcctgaacgaggggaagaaacacctcccagacttctatcgcagcgacctgcaggcggagtttgaccggatattcgacatccagatgaccttctacaccgagtacctgacgctggagcttaaagaggagctgcgcggcaagaagcgggacgccgtctgggccatctgcgcgaagatcttcaaggagaagggcttcgagctgatcggaaccaaacgccagggctccaccgcggagcagaagcacgagaactacagctggcgggccaaggggctcagcgagaagctggagctggagcagctcgtggtggtgctgcagcagatcaacatccagctgaacagctcctctggctacctcggcgccatctccgatcgcagtaaggagctgttcttcaacaagcagaccgtggggcagtaccagatggccgtactggacaagaaccccaacgcgggcctccggaacatggtcttctaccgccaggactacctggacgagttcaacgccatttgggagaagcaggccttgttccaccccatcttaaccgacaccctgaaggacgagatccgcgacgtgatcatcttctaccagcggcgcctcaagagccagaaggggctgatctccttctgcgagctggagtcacggaagatcgaggtggagatagccggccagaacaagacgaagatggtcgggtcccgcgtgatcccgcggagctcaccgctattccaagagttcaagatctggcagtcactaaacaacatcgaggtgttcggcaagggcaagaagtccaagaagcaaaaagagcagaccctgttcgatcagaccgaggaccccttggagttcgggggccgccgggagctctacgaggaggagaaggagctactagccttagaactcagcatcaagaaggagctgaagaaggcggacatcctgaagctcttgttcgacaaccccaaggagctggacctcaacttcaacgctgtccaggggaatttgacccaggccacccttttcaacgtgtacaagaagattatagagctctccggccacgagatcgacgtggagaaggatagcgcctccaagatcctcaagagcattgaagagatcttcaaggccctgaactacaacaccgagatccttcacttcgactccgagaagtcccaggaccagcaggcgatgtacatgctgtggcacctcctgtacagcttcgagggggacaacagcaacacgggcaacgagaacctgatcaacaagatctccaagctgtacggcttcgagaaggagtacgccaagatcctcgccaacgtcagcttccaggacgactacgggtccctgagcgccaaggccatcagcaagatcttgccgtacctcaaggagggccacaaatccgacatcgcgtgcgacctggccgggtacaagcacagcgcctccagcctgacccgcgaggagctcgagaacaagacctacaaggacaggctggagatcctgcccaagaacaccttaagaaaccccgtggtagagaagatcctgaaccagatgatcaacgtaataaacctgatcatcgactcgcgggagctcaagaagtccgccaaggagcgcgaggagcttaccaagagcatcagcgagacgaccaagttacaccagcagtacaaggacatcctcgcgaaggcgcccttcaacctgaccaacacatcccggaacgacatcatccgctacaagctgtacgaggagctcaaggacaatggctacaagacactgtactcaaacaagtacatctccccggccgccctgttcagcggggacttcgacatcgaacacatcatcccgcagtcacgcttattcgacgactcctttagcaacaagacactggagctgcggtcaatcaacatcgagaagggcaacaagaccgcctacgacttcatcaagggcaagtacggggagactggcgaggacaactgtcttgacaagtacctgaaccggatcgaaaccctctacaagaacgggatcctcaagaagtccaagtacaacaagctgaagatgcaggacaaggacatccccgacggcttcatcgagcgcgacatccgagacacccagtatatcgccaagtacgccaagaccctgctcggcgacctggtgaagttcgtcgtgagcaccagcgggtccgtgacggagcgcctgcgcgaggactggcagctcgtcgatgtgatgaaggagctgaactgggagaaatacatgcagctgggcctcaccgaggagttcaccaacgaggaggggcacagaatccgaaagataaaggactggaccaagcggaacgaccaccgccaccacgccatggacgccctgacggtggcctttaccaagcggcagttcatccagtacttgaacaacttgaacgcgcgcagaatcagcgacgagcagggcatctccaactcggagaaggacgagcgcaacaacgtgtccatcaccaccaacgacatgaagctgaacacgcgggacgtgttaggaatcgagaagaaggaactctaccgcgacaaccggggtaagctgcgcttcaaggcgccgatgccgctgctcgagttccgggaggaggccaagcgccacctggagaacacgctgatcagcatcaaggcaaagaacaaggtgaccaccatcaacatcaacactctcaagaaggccggcggggtctacaagaagacccagctgacgccccgggggcagctgcacaacgagaccatatacgggtcccagaagcaatacatcgtgaaggaggaaaccattaacgcgaagttcgacgtggagaagatcgccacagtcaccaatcccgtgtacagagaggcgctcctgaagcggctggagcagaacaacaacgaccccaagaaggcctttaccggcagcaatgcgctcacgaagaagccgatgtggttcgacgaacagcagaccgagaaggtgcccgagaaggtcaagaccgtgtccttcgagactatctacacgatccgcaaggaaatcagccccgacctgaagatcgagaaggtggtggacgagaaggtgcggcagatcctgaacaaccgcctcaacgagtacaacgggaacgccaaacaggccttctcaaacctggacgagaaccccatctggctgaataaggagaagggcatcaccatcaagcgggtgaccatcaccggcatcaacaacgcccaggcgctccacgagaagctggacaaggacggtaagccgatcctggacggcgaggggaagaagcagcccgtcgacttcgtgaacacgggcaacaaccaccacgtggcggtctattgcgacgccgacgggaacctccaagagaacgtgatcagcttctacgaggccgtgacccgccgcaacctgggcctgcccataatcgacaaagactacaagaaggacgacggctggcagttcctcttctccatgaagcagaacgagtacttcgtattccccaacgagagtaccgggtttaacccgaacgaggtggacctgctgaaccccgacaactactccctcatcagccccaacctgttccgggtgcagaagttcaccatcaaggactatttcttccgccaccacctggagacgaacgtcgagtccaacagcaccctcaaggggatcacctggctgcggtgcgggctgaacaacatcgacaacatcatcaaggtgcgcattaaccacatcggccagatcatccacgtgggggaatactga

SEQ ID NO: 7953 - RNA, 4248 nt, synthetic construct; identical to SEQ ID NO: 2153
  misc_feature 1..4248: note = Cas9 variant
  source 1..4248: mol_type = other RNA

SEQ ID NO: 7954 - RNA, 4248 nt, synthetic construct
  misc_feature 1..4248: note = Cas9 variant
  source 1..4248: mol_type = other RNA
atgaacctcaggaacgtcgcaaaagaaggcattaactacaacatagggcttgacttaggaaccggcagcgtaggatgggcagtaacagatgagcaaggagagcttttctcattcaaaggaaaaactacctggggaagcagaatattcccaacggcagaaaccgcggcagacacgcgcctaaagcggggtcaacgccgccgctacgcgagacgccgatggagactggacctattacaaagcctcttcgaagaggagataaagaaggtggaccctgagttcttcaccagactacgccaaagccatctgctaaaagaagacaagacatacgcagcaattcttagtagtaaaggggccaccagaccactattcccagaaggcgaagcagaagtcgagtactacaaaaagtacccgaccatctaccacctacgaaaggctctgatggagagcaataaccaggaagacatacggctcatctacctagcattccacaacatagtaaaagccagaggcaatttcctccaccaagacacacccggccttacggcaagcaacgcaaatatgggagatgccgtagagaaactctgctccgcgctcgaagactggtgcagcagtcaaaacattgagtgcgccatccgaaagaaccagaaaagcatccaggacctgatggaagggaaaaccatagagcccagtgaaagcaacgcgctaaaagagaccttcgacgcatcacggtcaagcagaaaagacaaggccagtgtgctcgcaggatggatagcaatacagcccggcgagcagttcgaacctaagcaagcaaaggacgcatcaaaagaaatagccaacgcagtattcgggttgtcagcaaacatgaagaaggtcttcgtggaactcgaagaagaccagaaaatatacctaaataacgacgaacaagtggaagcattctacaccgtctgcccggacgaaggagtggcactcttcgaagccttgcaaagcatgtatagcgcctacgtgctaatggggatcctcaaaggagccgacggagggtcgatatccagctgcaaagtggcggcttacgagcaatacaaagaagaccttaaactcctcaaaaccctagtacgggagttcgcgcccaaaaagtatgacgagttcttcagaggggacatctttgacgccaaaaagggctttagaacgcgcaactacgaccccgccaccgcgaaaggatacacaaaatacaactcggtacgcggcgcaagctacgacgcgtttaaaaaggaagttgaaaaactattcgagggaacagcagccgaagaagacgtccggtacacagacatgatgcaacgcttcgacgaaggaacttttctcagacgcttaaagacgagcgataatggcagcatcccataccagttacacctcgaagaaatggtagcgataatcgaaaaccagaaaacgttctacccattcttagaggaaaacaaagagaaattcgaaagcctagtgactttccgcataccatactacgtcggacccctaacacagaagaacgcccgcccagacaaccacggaaacgcccgatttgcatggagccaacgaaaagagggccaagaaaacgcaagagtctacccctggaactgggaagaggtcatcgaccgcaaacaatcagccgccaaattcatggaacgactaacagggacctgcacatacatcttagaggaaccagtcctgccaagatactccttactgtacgaggaatactgcctactaaacgagctaaacggcgcacgatggcgggatatgggcggagactggcacagatttgactacgagacacgcatggacataatagaggacctgttcaaaaagaagaaaggcacggtaaaatacgcaacggtcgcagattggctagtgcgggaaaaacaccgcagctgcgccgaagtcaaaggaggccaaggcgagacaggttttgaaagtaagctaagcagctacgtcttcttcaaaggcgtcctccacgtcgacgaaatcgacgaggcagacataccaatgatagaggaacttatatggtggaacacactattcgaagaccggtccatacttaaagagagcatagaggacaaatacggggatagactcaacgacgaacaaatcaaagccatctgcaagaaaagattcacaggatgggggaggctaagcaagaaactgctgtgcggaatcaaagcacagacagacaacggaccctgctcaatcatggatgtactaagggaaggcaacccaaataacgatgcgcgcagcgccaccatggtattcatggagatcatccgagacgacaaattcggattcaccaaactaatagaagaagaaaacaagaaacgaatcagtagcgtcgatgacttcgacgtaaacgacctacccggcagccccgccgtaagacgcaccgtaaaccaagcaaagcgtatcgtcgacgaaatagtcggaatcgcaggttgtgcaccccaaaacatcttcatcgaagtcacgagagacgaagacggacggaacaaaggccgacgaacaaaacgtcgttacgacgcgatacaagaagctgtcaaagtccttaagaaagagcagaaggagtacttcgacgcaaatgtagcggacctcctgaaaaacacagcacccgcggcattagacgatgaacgactcgccctgtacttcatgcaaaacggcaaatgcatgtactgcggcaaagacctcgacatcaaccagctcgacaaatatcaagtcgaccacatattgccccaaagctatgtaaaagacgactcgttcgaaaacaaggcactggttcacagcgacgacaaccaacgcaaaagcaacagcatgctcttagacgacagcataatccgcaaaatgaagccatactgggaagccttacgatctgcgggccttatcggcgagaaaaagttcaagaacctaacgcgcgtacgggtaagcgacaaggagcttggcgggttcatcgccagacagatggtggaaacgtcgcagagtatgaaactcaccagcctactcctagagcaagcatacccagaaacacaagtgagacccgtcaaggcagggttctctagcgacctacgacgtcggctcaagctagtcaaatgtcgggaaattaacgactaccaccacgcccacgacgcatatctggcatgtgaggtcggacaatttatagccctcagacacaacaaactgtacgaaaacccgataggctacagccacgcggtgaaagacttcatagcaaagagagccaaatacgcaagcgagcacggaaaaccgatggacacctacggtatgcccggatcgtcctcatttgtcatctcatccttcatgacaagtggcttcgatgaagaaaccggggaaatcttcaaagacgcatgggacgccagcttggccgcggtaaggattcaccaagccctgaatcgaaaagactgttacatctctaggatgcccgaggagacctcgggagcattttgggacgccaccatttattcccccaaacaaaccaagaaaaagctgtcgctccccttaaagaaaggactcgacccacagaagtacggctcatacagccgggaacagttcgcctacttcttcgtctacgaagcaaagaaaatcaaaaagaaagaagaaacaaaagaatacgtcttcgcttcggtaccagttcaagtagcagccctagtggcagcagacccaaacgcgctaatagagttcgccaaagcagatgccgaggaacggggcctcaaatttgccaagatcgtaagggaaaaagtttataagtaccaactgatagaagttaacgacgaacgatttttcgtgaccggactaagaacagtccgcaacggcctgcaaatagcattttcagaacaagaccgaaatatagtctccggaatagtagaaggcaactcaagcaacaacaacctcctagacatatatgacaagatcacgaatagatatgcactatacgccagccgattcggcaaactgctaaacctaagcggataccgcgagaacttcatccaggcatccctagaagaccaagaacgcgtagtgctcgctctcatatcactattcaacgcacgaaccaacatgatcgacctctccgcaataggctcaagcaagaccgtcggaaatatgtccatgacctttgccaaagaaatggcgatggcggacaacaggttcgccttcatagaccaaagcgttaccgggatgctagaacgaaaaacgtacttatga

SEQ ID NO: 7955 - RNA, 4251 nt, synthetic construct; identical to SEQ ID NO: 2155
  misc_feature 1..4251: note = Cas9 variant
  source 1..4251: mol_type = other RNA

SEQ ID NO: 7956 - RNA, 4257 nt, synthetic construct
  misc_feature 1..4257: note = Cas9 variant
  source 1..4257: mol_type = other RNA
atgaaggtgaagaacatcctgggcctcgacatcggggtcaccagcatcggctttgcccacgtgaccgagaacgagaaggacaacaagtcccacatcaagcagttaggggtgcgcatcaaccccctgacggtcgacgagcagaccaacttcgagaagggccggccggccagcgtgaacgcggaccgcaccctcaagagaggggccagaaagatgctgtcccggtacaaggaccgccggaagaacctgatcgagatcctcagcaagaccggcttcatcaactccgagagcatcctggcggaggacggcaagaacacgacccactccacctgggccctgcgcgccaaggcgagccgggagcgcatcgagaaggacgagctcgggcgggtcctgctggccatcaataagaagcgcggctacaagtccagccggaaggccaagaacgaggacgaggggcaggccattgacggcatggcgatcgcgaagcgcctttacgaggagaacctgacccctggacagctggtctatcagctcctgcgggagggcaagaagtacatccccgacttctaccgatccgacctacaggacgagctcgacaaagtgtggaacttccaaaagcagttccaccaggagatcctgacggacaccttctacaaggacattcaaggcaaggggcagcgggcgaccagcgcttccttctacggcgtgtacgggttcaacaccgccgagaacaagggcagccgcgaggagaagcggctgcaagcgtacgcctggcgctccgacgccctcacgaagcagctgacccgggaggaggtcgcctttgtgatcaccgagatcaacaacaacctgaacaacagctccggctacctcggggccatcagcgaccgctccaaggagctattcttcaacaagaagaccgtgggccagtacctgtacgagcagctccagcagaacccccacactcgcctgaagaaccaggtcttctaccgccaggactacctggacgagttcgagaccatctggaccatccaaagccgctactacccggagctcaccgacgacctgaagagagagatccgcgacgtggtgatcttctaccagcggaagctcaagagccagaagggcctcgtaagtttctgcgagctggagagcaaggagatcatgatcgagaagaacggcaaggcggccgtgaagaaaatcgggtccaaggtggcccccaagagcagccccctgttccaggagttcaagatctggcaggtcctccacaacgtggacatcaagaacaagaaggacaagacgaagcgccccctggacgactccgagaaggagtacctgttcaacgagctcaacatcaagggtaacctgaaggccgccaaggtgattcagctgctcaccctgaataagaacgagaccgaactcaactacacccaactcgagggcaatcggacgcagaaggcgctgtacgaggcgtacctgaagatcctcgataccgagggttacgacgtcaacaacctgctgggcatcaagtccaacaaggacgaggtgttcctggacgatttggacgtgaacgccttagaaatcaagaccatgatcaagcagatattcaacgccctgaacatcaacaccgggatcctagacttcgacgccgagctagacggcaaggcgttcgagcagcaggccagctaccacctgtggcaccttctgtactcctacgaggaggacgggagcaagtctggcaacgagcacctgtacaagctcctggagaacaagttcggctttaagccagagcacgcccgcatcctggccgggatcacgctcagcgacgactacgggaacctgtccgcgaaggccatgcggaagatctacccccagatcaaggagaacaacttcagcaccgcctgcgagctggtcgggtaccgccactccaagaacagcctcaccaaggaggagaaccaggagcggcccctgaagaacaagctggagctccttaagaagaactccctgcgccagcccgtggtcgagaagatcctgaaccagatgatcaacctggtgaacgagctgatcgacaagaacagcgagaaggatgagcagggctccatcatcgagtacttccggttcgacgagatccgcatcgagctcgcccgggagctgaagaagaacaccgacgagcgccgggacctggacgccgcgatccgcgaggggaacctccggaatgagaagatctacaagctgctgcaggctcagttcggcatcaagaacccgacgcgcaacgacatcatccgctaccggctctacgaggagctgaagaacaacggatacaaggacctgtacaccaacagctacatcccccaggagaagctgttcgggaaggagatcgacatagaccacatcatcccccagagcaagctgttcgacgacagcttcagcaacaagaccctgacctacaacacgaccaacaaggacaagggcaaccagaccgggttcgactatatcgagtccaagtacggcatcgacggcatcgaggcctacaccgcccgcatcgagaacctcttcgagagcgggaagaaaaacaaggaggagggcgtgtccaaggccaagtaccagaagctgctgaagaaggagagcgagatcggggacggcttcatcgagcgggacctccgcgagtcccagtacatcgcgaagaaggccaaggagctgctgctccagatcacccggagcgtcgtggccacgtccgggagcatcaccgcccgcctgcgggaggactgggacctggtgaacgtcatgaaggagctcaacctgcccaagtaccgcgccctgggcctcaccgagatggaggagcggaagtacggccagaaggtggaggtgatcaaggactggaccaagcgcgacgaccaccggcaccacgcgatggacgccctgacgatcgcattcaccaagcacaaccacatacagtacctgaaccacctcaacgcccgcaaggacgagcagcacaaggagcacaagatcatcaacgcgatcgagaacaaggagaccatcctgattaccgacaagtccgggaaccggaagcgcgtcttcaaggccccgatgcccaacttccggcagactgccaagcagtacctggaggaggtgctcatcagccacaaggccaagaacaaggtcgtcaccaagaacaaaaacaagatcctgggcaaggagaagatccaggagaccctgacgccccgcgggcagctacacgaccagaccatctacggctttaactggtggtcccggataaccctgagcaagaaggtgtcccgcaacgagatcgagaagatcatcgacaacaacaccaagttcttcctgcaggagttcatccagctcaagggatccatcgccaaggcgttctccgacgccgagctgaacaagctgatgtacaagggcaagatcctcaaggagatcgaggtggccatcccctgttacacccagcggatcgacatcagcaaggtcttcacggacagccagaagtccaacagcgccaaggagaagaacatcaagaacatcctggacctgaaggtgcgcaacatcctccagaaccggctgtccgagttcaagggcgacttcaagaaggccttcagcgacctggacaagaacccgatctggttcaacaaggagaaggggatcagcatcaagcgcgtgatcatcagcggagtcaagaacgtggagcccctccactataagaaggaccacctggggaacgacatcctggacggcaaggagaaccgcatccctgtggacttcataagtaccgggaacaaccaccacgtcgcgatctaccaggacgagaagggcaacctccaggagaaggtggtgagcctgttcgacgccgtcaagctggtgaacgccgacgagcccgtgattgacaagacctacaaccaggggctcgggtggcagttcctgttcaccatgaagcagaacgagatgttcgtcttcccgaacgataacacgggcttcgaccccaaggagatcgaccttctcgacccctccaacaagaagctgatcagccccaacttattccgggtgcaatccatcagcatcgtgcagtacgggaacaacatcgtccgcgacttcaagttccggaaccacctcgagtccgtgctgaacgacgacaaggtgctacacggcatcaccttccagcagatcaagagcctcgggccgctgctgaatatcgtcaaggtccgcatcaaccacctcggcgacatcgtgtccgtcggcgagtactga

SEQ ID NO: 7957 - RNA, 4260 nt, synthetic construct
  misc_feature 1..4260: note = Cas9 variant
  source 1..4260: mol_type = other RNA
atggccaagccccagaactacactatcggccttgacatcgggaccaacagcgtgggctggacagtcacagacgaccaaaacaatatcctccgcatcaagtcgaagaaggcaatcggggcgcggctgtttgaagagggcaaggtggccgccgagcgacggagcttccgcaccacacggcgcaggttgtcccgcagaaagtggcgcatcaagctcctggaggaactgttcgacgaggagatctcaaaggtggacccgaacttcttcgccaggtcccacgagtcttggatttcacccaaggacaagcgcgagcggtacagcgccatcgtcttccccacgccggaggaggacaagaagttccacaacgagtacccgaccatctaccaccttcgcgacaggctcatgaaggacgaccagaagcacgacatccgcgagatctacgtggcgatccaccacatcatgaagtacagagggaacttcctgcacgacgaatccattgagacctatcgctctggcatgagtagtcttggcgggggcgacgagcggacgatcctgaacacgaaaatcctggacgaccttaacgacgccttcgccgacaatctcgcgacacagggtatctccgttaacagcgcgagtgccgaccagatcaatgaaatcgtcaccagcggccacctgaacgtggatagccaaaaagccatcgccaagctcctgctgcccaccaccctctcgtccgacgacaaaaagcaggacaagaaaatcaagaagctggcgaccgacgcggccaaaaatgtggcctcagcctggctggggtacaaggccaattttgcggccatccttaacatccaggaggttgacaaggacaagaaaaagatctatagcttcgccctgcagggcgccgacgaggaggacaaggtggagactctggagagtgtgctcagtcaggaccagatagagatcgtagaccgcatcatccgcatccgccacgcaatcgttctgggcgaaataatccccgtgggtatgaccctgtccgaggccatgatcgaaaagtacgatcagcacgccaaggaccttaagaacctaaagaccgtcatccgcaacctgaaggacaggaagaacgccgtgaagctccaagccatctacgacttatatgtgaacaaccgccacgccgataccgcgaaagctatgaagctcgccggcgtcaagaaacggaccgagctactagagcccgaggagttcaacaagtccatcgagaagctactcgacgacagtccggtgagcgccgagatcaagaagcgcatagcggagaaggacttcctccccctgcagcggtccaacagtaacggggtgatacccaatcaactccaccagatcgagctcgatgagatcatcaagaagcaatctaaatactatccattcctgggtgagaccaacgagcatgccagcgccgacgtcgcccgcaaggccccgacgaaacttgaccagctgctgacgttccgggtaccctactacgtgggccccctgatcactaaggaggagcaggaggagcaagacgggcactccttcgcgtggatgattcgcaagaaccccaaggaccacgagaaaataaccccgtggaacttcgacgagaaggtcgacaggatggccagcgcaactcaattcatcaagcgcatgaccaccaaggacacctaccttctgggcgaggacgtgctcccatcctcatccctgaagtatcagctgttcaccgtcctgaacgagctcaataacctgcggataaaccacaagaagctgacccgcgaggagaaagaacaggtgatagaagacctcttcaaaaagtacaagaccgtgaaggccgacaagtttaagaactactggcagaaggggcacgccggcctcgatgtgaagatccagggtatggcggaccccgaaaaattcaatagcaccatgtccacttatatcgacctgcaaaagatcttcggcgaccaactcgacgacgcacaacgtcaaaacgatttcgagaagattatcgaatacagcacgatcttcgaggaccgcaagatcctgggcgagaagctgcgggcggacttcgtgtggctctccgaggaccaaatcaagagactgtgtcggctgcgcctgcaggggtggggccggcttagcctaaagctcctgacccgcctgaccgacgccgacgggcaaaacgtgctcgagcgcttactaaattcaaacgacaactttatgcagatcgtgaaagaccctgtgatcaaggccaagatagagcaaaagaaccagaagctcctgcgagcagactggtccgagaacgccacggagagcatcctggacgaagcctacacctccccgcagaacaagaaggcgatccgccaggtgatgcgggtcgtgcacgacatcgtgaaagcatgcgacggcaacctccccgccaaatttgccatcgagtttgccaggagccaagatgacgaccctaagaggaccgtcgcccgcgcggatagactgcagaagatatacgcccagatctccgacgaggtggtgagccaaggggtcaaggaccaactgtccggcatgaagtccctcaaggatcgctattatctatacttcatgcagggtgggcgggacgcctacaccggcaagcctctgaatatagaccgcttgtccgattacgatatcgaccacatcatgccgcagagcttcataaaggacgactcactcgacaaccgagtcctagttacccgtgccgtgaacaaccaaaaatccgacaacgtgcccgtcttgctgtacggcaaccacctggtcgccgacctcgggatcacgatccgggagatgtgggaccggtggcagaagtccgggatgatctcgaagcgaaagctagcgaatctgctcaccgaccccgcaactctgagcgagtaccgcgccgagggcttcattaatcggcagctggttgagacctcccaggtgattaagctcacggccaccatactgcagtccgaatttccggactccaagatcatcgaggttccggcaaaatacaacagcatcctacgcaagcagttcgacctctacaaatcccgggaggttaatgactaccaccacgcgatcgatgcttatctgagcacaatcgtgggcaattacctgtaccaggtctaccccaacctccgccgactcttcgtttacggggagttcaagaagttctcccacggagaagaggagagttctcaccaggccgtacgccgcgtcaagagcatgaacttcctagacgatctattgagaggtaaacacggcgacgatatctattgccgcgtgaccggcgaggtaatcttctcacggaaggatatcatcagcaagctgaaacaggcctactccttcaagcagatgctcgtcacgcaggaggtgttcaccaagaagagtgcgctgttcgaccagaccgtctaccccagccctgcccgcgacagcaagacccggtccggactgatcccccgcaagcagggcatggacaccgagatctacgggggttatagcgggaacaaagacgcctacttcgtcctcgcccaggttgtgaagtccaagggacacaccctgcaagttgtgggcgtgcccatccgggccctgcgagcgttagccaactgtagcaactatagtgaacagctgttgaagatcgtcaaagctcaggttctcttcaacaagaagaccggtaaggccaagaagggcatcagcgacgtgcggatactactggacaagatcccctaccgccaaccggtgttggacgggtccgccttctacatgctgggctcctccacctacaagtataacctgaagcagatctccctgagccagcagtccatgaaatacatcctggattacatcgacgatcccaacttcaataagcacgagatgacaaagatcgaccaacagaacgagaaagagtgcttactcagcgtgtacgatgagatcctggacaagatggacaagtacttaagcctatacgacatcaacggtttcaggaagaagctgcacgtgggccgcgacaagttcatcaagctggaggtagagaagcaagcggaggccatcaaaaatgtgctccgcggcttccatgcaaacagtgatatgacgaaactgagcgacttggggctcagcacctccctgggcttcatgcaggcttctgacgggatcaagctgtccgacaacgcggttttcatctaccagagccctaccgggcttttcgagcgccgagtcaaggtgtccgatttactgaagtga

SEQ ID NO: 7958 - RNA, 4260 nt, synthetic construct; identical to SEQ ID NO: 2158
  misc_feature 1..4260: note = Cas9 variant
  source 1..4260: mol_type = other RNA

SEQ ID NO: 7959 - RNA, 4263 nt, synthetic construct
  misc_feature 1..4263: note = Cas9 variant
  source 1..4263: mol_type = other RNA
atggccaagcccaaggactataccataggcttggacatcgggacgaacagcgtgggctgggtcgttacggacgaccagaacaacatcttacgcatcaaggggaagaaggctataggcgcacggctgttcaccgagggtaaggtggccgccgagcgccggtccttccgcaccacccggcgtcggctgagccgccgccgctggcggataaagatgctcgaggaactgttcgacgaggagatcgccaaggtcgacccgtccttcttcgcccgcctgcacgagagctggatctcccccaaggacaagcgaaagcgctacagcgcgatcgtgttcccctcccccgaggaggacaagaagttccatgagagctacccgacgatctaccatctccgggacaaactgatgaaggacgaccagaagcacgacatccgagagatctacatcgcggtacaccagatgatcaaagcccggggaaactttctgcacgacgagtccgtggagacctaccgcagcggcatgtcaagcctcggcgggcgatccgagcgcaccatcctgagcgtgcagacgctggaggagctcaacgacctgttcgccgagaacgaggggacggaggaagtggagctgaacgtcgcgtccgccgagcagatcaacgacatcttgaccggagggcacctgaacgccgacagccagaaagagatctccaacctgctcctgccctcatccttcccgagcttcgacgacaaggctaaggaaaagcaggtcaagaagctgatcaacaacgttgccaccaacataagcaaggcatggctcggatacaaggccgacttctcaaccatcctgaacctggccaaggtggacaaggaccagaagaagatcttcgccttcgccctccagggcgaggacgaggaagacaaggtgcaggagctggagtccctgttggagcagtcccaaacggatatagtggaccggctgatcgagatccgacacgcgatagtcttaagcgagatagtacccgttgggatgaccctctccgaggccatgatcgacaagtacgaccagcacaaggaggacctgatcaccctgaaggctgtcatccgcaataccaaggacaagaagaaggccgctaaactccaggcgatctacgacctgtacgtgaagaaccggcacgccgatctggccaaggccatgaagctcacgggcatcaagaagcgctcggagctgctggacccggaggagctcaagaaggggatctcctcactgctggatgactcccccgaagccgtggagatcaagcagcggctcgaggagaagaccttcttacccctacagcggagcaacaacaacggcgtaatccccaaccagctccaccaggtggagctggacgagatcatcaagaagcagtccaagtactatccgttcctggcggagaagaaccccgacgagagcgaggaggcccagaagaaggctcccaccaagctcgacgccttactgaccttccgggtgccctactacgtcgggccgatgatcacaaaggaggaacaggaggcgcagaacgggcactcctttgcctggatggtgcgcagggatccccaggaccacgaagccatcaccccctggaacttcgagaaaaaggtcgacaagatggccagcgctacccagtttatcaaacggatgaccacgaaagacacctacctgctcggcgaggacgtgctgcccgcgtcctcgctgaagtaccagctgttcactgtgctcaacgaactgaacaaccttcgggtcaacggcaagaagctgacctccgacgagaaggagcaggtcattgagggcctgttcaagaagcagaaaacggtcaaggccgacaagttcgtgaagtactggcaagccaaacacatcggggccgacatcaaggtgaagggcctcagcgacccgagcaagttcaattcaaccatgagcacctacattgacttcaagaagatcttcggcgaccagctgaacgacgtcaaccgccagaacgactttgagaagatcatcgagtattccaccatcttcgaggaccgaaagatcctcgaggacaagctccgcgccgacttcgcgtggcttagcgaggagcagatcaagcagttatgtcggttacgcctgcaagggtggggcaggctgagcgacaagctcctgacgcgcctgacagacgccgatgggcagaacgtcctcgagagactatggaacagcaacgacaatttcgtgcagatcgtgtccgaccctaacatcaaggccaagatcgagcaggagaaccagaagctgctccgcgacagccagtctgacaacgccgtcgagtccatcctggatgacgcatataccagcccccagaacaagaaggcgatccgccaggtgatgcgggtggtccatgacatcgtgaaggcctgcgacggcaacgtgccggccaagttcgccatcgagttcgcccggtctcaggaggacgacccgaagcgaacaacggcccgtgtcaaccagatgcagaagatatacgaccagatctccgacgaggtggtgagccagggggtcaaggaacagctgtccggaatgaagtccctcaaagaccggtactacctgtacttcatgcagggcggtcgcgacgcatacaccggcgcaaaattgaacatcgaccggctgtccgactacgacgtggaccacatcatgccccagtcattcgtgaaagacgattccctggacaaccgcgtcctggtggcccgggccgtgaacaatcagaagtcggacaaggtccccgccctcctgttcgggaacaaggtggtggccgacctgggcatcaccgtccgcgagatgtgggataagtggcagaaactcgggatgatcagcaaacggaagctgtccaacttactcaccgatcccgacgccctgaccgagtacagagcccagggcttcatccggcgccagctggtggagacgagccaggtgatcaagctcacagcgaccatcctgcagtccgagtttccggatagcaagatcatcgaggtccccgcaaagtacaactcgatcgtgcggaagcagttcgatctgtacaagagccgcgaggtgaacgacttccaccacgcgatcgacgcctacctctccaccatcgttggcaactacctgtaccaggtgtaccccaatctgcggcgcatgttcgtgtacggggagttcaagaagttcagctccaatgccgaagagagcgcgcatgacgtcgcccggcgcgtgaagagtatgaacttcctcgacgaccttctccggggtacgcacggggacaacatctactgcaggagcacgggcgagatcgtattcaaccgtaacgacatcatatctaagctcaagcaggcctacagtttcaagcagatgctggtcacccaggaggtgttcacccgcaagtccgccctgttcgaccagactgtgtacccgagccccgagcgcgactccaagaaacggagcggcctcatcccccgcaagaaaggtatggacccggagatctacggcgggtacgcgcacaaccaggactcctacttcgtcctggccaagatcgagaaggtgaagggctacaccctgcagatcgtgggggtcccgatccggtcgctcgagataatcaacaaggccgaggacttcagcaccgccttgctggacatcattaagtccaaagtgatgtacaacgagaagaccggccagccaaagcgcggcatcaagaacgtggagatcctcgtgaataagctaccctaccgtcagcccatcctggaaaaggacgtaagttacatgctcgggtccagcgcctacaagtataatatgaagcagatcacgctgtcccgccagagcatgaagtacatcctagattacatcgacgacccaaacttcaccaaacacgagatgaccatgatcgacgagcagaacgaacgggagtgcctccttagcgtctacgacgagatcctggagaaggtggacaagtacctccccctattcgacggcaacaagttccgcgagaagctgcacagcgcgcgtaaggagttcgtctccctcagcgtcgatgacgaggcctccgccatcgagaaaattctgcgcgggttacacgccaactcagagatgccctcccttgagaacctgaaaatcaagcccgccctgggcttcttccagatgaagaatggaatcaccttaagcaacgacgcagtgctgctgtaccagtccccgacgggcctcttcgaacggcgagtgaaagtctctgacctgctgaagtga

SEQ ID NO: 7960 - RNA, 4263 nt, synthetic construct
  misc_feature 1..4263: note = Cas9 variant
  source 1..4263: mol_type = other RNA
atggccaagcctaaggactacaccatcggccttgacatcgggaccaacagcgtgggctgggtcgtgacggacgaccagaacaatatcttgcgcattaaggggaagaaggccattggcgcgcggctgttcaccgaggggaaggtggccgccaagagacgttccttccgcaccacccggcgccggctgagccgccggcgctggcggattaagctcctggaagaactgtttgacgaggagatcgccaaggtcgacccgtccttcttcgcaaggctccacgagagctggatttcccctaaggataaacggaagcgctacagcgcaatcgtgttcccctcccccgaggaggacaaaaagttccacgagtcgtacccgacaatataccacctccgggacaagctgatgaaggacgaccagaaacacgacatccgcgagatctacatcgccgtgcaccagatgatcaaggcccggggcaatttcctccacgacgagtccgtcgaaacctaccgcagcggaatgtccagcctcggcgggcggtccgagagaaccatcctaagcgtgcaaaccctagaggagctgaacgacctgttcgccgagaacgaagggacggaggaggtggagctaaacgtcgcgtccgccgagcagatcaacgacatcttgacagggggacacctgaacgctgatagccagaaagaaatctccaacctcctgttgcccagctccttccccagcttcgacgacaaagccaaggagaagcaggtcaagaagctgatcaacaacgtggccaccaacatcagcaaggcgtggctgggatataaggccgacttctccaccatcttgaaccttgccaaggtggacaaggaccagaagaagatcttcgcttttgccctgcagggcgaggacgaggaggataaggtgcaggagctggaaagcctcctggagcagtcccagacagacatcgtggaccggctgattgagatccgccacgcgatcgtgcttagcgagatcgtccctgtggggatgaccctgtccgaggctatgatcgacaagtacgaccagcataaggaggacctgatcaccctcaaggccgtcatccgcaacaccaaggataaaaagaaagcagccaagctgcaggcgatctacgacctgtacgtaaagaaccgccacgccgacctcgctaaggccatgaagctgaccggcatcaaaaagcgcagcgagctgttggacccggaggagctgaagaaggggatctccagcctgcttgacgactcccccgaggccgtggagatcaagcagcggatcgaggagaagaccttcctgcccctacagcgcagcaataacaacggcgtcatccccaaccagctccatcaggtggagctggacgagatcattaagaagcagtccaagtactacccgttcttggcggagaagaaccccgacgagagcgaggaagcccagaagaaagcccccaccaagttggacgcactgctcaccttccgggttccctactacgttggcccgatgatcacgaaggaggagcaggaggcgcagaacggacactccttcgcctggatggtgcgccgggacccacaggaccacgaggccatcaccccctggaacttcgaaaagaaggtcgacaagatggcgagcgccacccagttcatcaagcgcatgaccactaaagacacctatctgctcggcgaggacgtgctgcccgcgtccagcctgaagtaccagctgttcaccgtcctgaacgagctgaacaacctccgtgtcaacgggaagaaactgacgtccgacgagaaagagcaggtcatagagggcctgttcaagaaacagaagacggtgaaggccgacaagttcgtgaagtactggcaggccaagcacatcggggccgacatcaaggtgaagggcctgtccgacccgtccaagttcaactctaccatgagtacctatattgacttcaagaagatcttcggagaccagctgaacgacgtgaaccgccagaacgacttcgagaagatcattgagtactccactatcttcgaggatcgtaagatcctggaggacaagctccgcgtagactttgcctggctgagcgaggagcagataaagcagctgtgccgactccgcctgcaggggtggggccggctgtccgataagctactgacgcgcctgaccgacgcggatggtcagaacgtactcgaacggctgtggaatagcaacgataacttcgtgcagatcgtctctgatccaaacatcaaggctaagatcgagcaggagaaccagaagctgctgcgcgacagccaatccgacaacgccgttgaaagcatcctggacgatgcctacaccagcccccagaacaagaaggccatccgccaggtgatgcgggtcgtgcatgacatcgtgaaggcgtgcgacggaaacgtccccgccaaattcgccattgagttcgccaggagccaggaggatgacccgaagcggaccacggcgagagtgaaccagatgcagaaaatctacgaccagatctccgacgaggtagtcagccagggggtgaaggagcagctgtccggcatgaagtcactcaaggaccggtactacctgtacttcatgcaagggggaagggatgcctacacgggcgccaagctgaacatcgatcggctctccgactacgacgtggaccacatcatgccccagagcttcgttaaggacgacagtctagataaccgcgtgctcgtggcacgggcggtaaacaaccagaagtccgacaaagtgcccgcgctcctgtttgggaacaaggtcgtcgccgacttaggcatcaccgtgcgcgagatgtgggacaagtggcagaagctcgggatgatcagcaagcggaagctaagcaacctgctcaccgaccccgacgccctgacagagtaccgcgcccagggattcatccgtcgccagctggtggagacgagccaggtcatcaagctcaccgccaccatcctacagtccgagttcccggactcgaagatcatcgaggtacccgctaagtataactccatcgtgcgtaagcagttcgacctgtacaagtctagggaggtcaacgacttccaccacgccatcgacgcatacctcagtaccatcgtgggcaattacctgtaccaggtgtaccccaatctgcggcgcatgttcgtctacggggagttcaagaaattcagctccaacgccgaagaaagcgcccacgacgtggcgcgccgtgtgaagtccatgaacttcctggacgacctgctaagaggcacgcatggggacaacatctactgcagaagcaccggcgaaatcgtcttcaaccggaacgacatcatttccaaactcaagcaggcctacagcttcaagcagatgctggtgacccaggaggtgtttaccaagaagtccgccctgttcaatcaaacggtctacccgagccccaagcgcgacggctcaaagcgcagcgggctcattccccggaagcgcggcatggatcccgaaatatacgggggctacgcccacaaccaggactcccacttcgtgctggcgaagatcgagaaggtgaaggggtataccctgcagatcgtcggcgtgccgatccggagcctcgagatcatcaacaaggccgaggacttcagcaccgccctgctggacattatcaagtccaaggtaatgtacaacgagaagaccggccagcccaagcgcggcatcaagaacgtagagatattagtaaacaagctgccctatcgtcagcccatcctggagaaggatgtcagctacatgcttggctccagcgcctataagtacaacatcaaacagatcacactatcccgccaaagcatgaagtacatcctggactatatcgacgacccgaacttcaccaagcacgagatgaccatgatcgacgagcagaacgagcgggagtgcctcctgtccgtgtacgacgagatcctggagaaggtggacaagtacctccccctgttcgacgggaacaagttccgcgaaaagctgcacagcgcccggaaagagttcgtctccttaagcgtggacgacgaggcgtcggccatcgagaagatcctgcggggcttgcacgccaatagcgagatgccctccctcgagaacctgaagatcaagcccgcactcgggttcttccagatgaagaacgggatcaccctcagcaacgacgccgtcctgctgtaccagtccccgacgggcctcttcgagcggcgcgtcaaggtgagcgatctgctgaagtga

SEQ ID NO: 7961 - RNA, 4263 nt, synthetic construct; identical to SEQ ID NO: 2161
  misc_feature 1..4263: note = Cas9 variant
  source 1..4263: mol_type = other RNA

SEQ ID NO: 7962 - RNA, 4263 nt, synthetic construct; identical to SEQ ID NO: 2162
  misc_feature 1..4263: note = Cas9 variant
  source 1..4263: mol_type = other RNA

SEQ ID NO: 7963 - RNA, 4263 nt, synthetic construct; identical to SEQ ID NO: 2163
  misc_feature 1..4263: note = Cas9 variant
  source 1..4263: mol_type = other RNA

SEQ ID NO: 7964 - RNA, 4263 nt, synthetic construct; identical to SEQ ID NO: 2164
  misc_feature 1..4263: note = Cas9 variant
  source 1..4263: mol_type = other RNA

SEQ ID NO: 7965 - RNA, 4263 nt, synthetic construct
  misc_feature 1..4263: note = Cas9 variant
  source 1..4263: mol_type = other RNA
atgagtcgcaagaactacgtggatgactacgccatttccttggacatcggcaatgcctccgtcgggtggtccgcgtttacacccaactaccggttggtacgcgcgaagggacacgagctcatcggggtgcggctgttcgacccggccgatactgcagagtctcgcagaatggctcgcacgacgcggcgcagatattcccgccggcgatggcggctccgcctgcttgacgccctctttgaccaagccctgagcgaaatcgatccaagtttcctagcacggcgcaagtacagctgggtgcaccccgacgacgagaacaacgccgactgttggtacggctccgtgctgttcgacagcaacgagcaggacaagcggttctacgagaaatatcccaccatatatcacctcaggaaggcgctgatggaagacgactcgcagcacgacattcgtgaaatctacctcgcgatacaccacatggtcaagtaccgaggtaatttcctggtcgaaggcaccctagagagcagtaacgccttcaaggaagacgagctcctgaagctgctcggccggataacgcggtacgagatgtctgagggggaacagaactccgacatcgaacaggacgacgaaaataaactggtagccccggcgaacggccagctggcagacgctctctgcgccactagagggagccgctccatgcgcgtggacaacgcgctagaggccctaagcgcagtgaacgacctctcccgagagcagagagccatcgtgaaggccatattcgccgggctggaggggaacaagctggacctggccaaaatcttcgtgagcaaggagtttagcagtgagaacaagaagatcctgggaatctacttcaacaaaagtgactacgaggagaagtgcgtccagatcgtagactcaggcctgctcgacgacgaggagcgggagtttctcgaccgcatgcaggggcagtacaacgcgattgccctcaagcagctcctggggaggagcacttctgtgagcgattccaagtgcgccagctacgacgcccaccgcgccaactggaatctgattaaactccaattacgcaccaaggagaacgagaaggacataaatgagaactacgggatcctggtcgggtggaagatcgatagcggccagcgtaaatcagtgcgcggggagtccgcgtacgagaacatgcggaagaaggccaacgtgttctttaagaagatgatagagacgagcgatctctcggagacggacaagaataggctgatccacgacatagaggaggataaactgtttcccatccaacgcgacagcgacaatggagtcattccccaccagctccatcagaatgagctgaagcagatcatcaagaaacaggggaaatactaccccttcctcctcgacgcgttcgaaaaagacggcaagcagatcaacaaaatcgagggactgctgactttccgggtgccgtacttcgttggacccctcgtagtgcccgaggaccttcagaaaagtgacaactcagagaaccactggatggtgcgtaagaaaaagggggagatcacgccatggaacttcgatgagatggtcgacaaggacgcttccgggcgaaagtttatcgagcgtctggtgggcacggactcttacctgctcggcgagccgacactaccaaagaactccttactctaccaagagtacgaggttctgaatgaattgaacaacgtgcgactaagcgtgcgcaccggcaaccactggaacgacaagcgccggatgcgcttggggagggaggagaaaaccctgctctgccagcggctgttcatgaaaggccagaccgtgaccaagcggaccgcggaaaaccttctcaggaaggagtacggccgaacctacgagctgagcgggttgtccgacgagagcaagttcacgtccagtctctcgacctatggcaaaatgtgtcgcatttttggagagaagtacgtcaacgagcaccgggacctgatggagaagatcgtggagctgcagaccgtcttcgaggacaaggagaccttactgcaccaactgcgtcagctagaggggatcagcgaggccgactgcgcccttctggtgaacacacactacacggggtggggacggctctctcgcaagttactgaccacaaaggccggcgagtgtaagataagcgatgatttcgcgccccggaagcattccatcatcgaaattatgcgcgcggaggaccgaaacctcatggagatcatcacggacaaacaactaggtttcagcgactggattgaacaggaaaacctgggggccgagaacggtagcagcctcatggaggtggtcgacgacctgcgcgtgtcccccaaggtgaagagaggcatcatccagagcatccgcctgatcgatgatatctccaaggcggtcggcaaacggccgagccgcatctttctcgagctggcagatgacatccagccctcggggcggaccatcagccgcaaaagccgcctacaggacctctaccgaaacgccaaccttggcaaggagtttaagggtatagcggacgagctgaacgcctgctccgataaggacctccaagatgaccgcctgttcctgtactatacccagctcggcaaggacatgtacaccggggaggagctcgacctggaccggctttccagtgcctacgacatcgatcacatcatccctcaggcggtgacgcagaacgacagcatcgacaaccgcgtgttagtcgcccgggcggaaaatgcccgcaagaccgactcgttcacctacatgccccaaatcgcggaccgcatgcggaatttctggcagatcctcttggacaacggcctgatcagccgggtaaagttcgagcgcctcacccggcagaacgagttctccgagcgcgagaaagagcggttcgtgcaacgcagtctcgtcgagacgcggcaaatcatgaagaacgtggccaccctgatgcgccagcgttatggcaattccgcggcggtaatcgggctgaacgccgagctcactaaggagatgcaccgctacctggggttcagccacaagaaccgggacataaacgactaccaccacgctcaagacgcactgtgcgtcgggatcgctggccagttcgccgccaaccgagggttcttcgccgacggcgaggtctccgacggcgcgcaaaacagctacaaccagtacctccgcgactatctacgggggtacagggagaagctgtccgccgaagaccgcaagcaaggccgcgcctttggcttcatagtagggagcatgcggtcccaggacgaacaaaagagggtcaacccgcggactggcgaagtggtgtggagcgaggaagacaaggactacctccggaaggttatgaattatagaaagatgttagtgacccagaaggtcggcgacgacttcggcgccctgtatgatgaaacgcgctacgccgcaaccgaccccaagggcatcaagggaatacccttcgacggcgctaaacaggacacatccctctacggcggctttagctccgcaaagccagcatacgccgtcctgatcgagtccaagggcaagaccaggctggtgaacgtgaccatgcaggagtacagcctcctcggcgaccgcccatccgacgacgaactgcgcaaggtcctggctaagaagaagtccgagtacgccaaggctaatatcctcctgcgccacgtgcccaaaatgcagctcatcaggtacgggggcggactgatggtgatcaaaagtgctggcgagctgaacaacgcccagcaactctggctgccctacgaggagtactgttatttcgatgatctgagccagggtaaggggtccctcgaaaaggacgacctaaagaagctgttagacagtatccttggctccgtacagtgcctgtatccctggcaccgcttcaccgaggaggagttagcggatttacatgtggccttcgacaagctgcctgaggacgagaagaaaaatgtcatcaccgggatcgtttccgctctccacgccgacgcaaaaaccgcgaacctttccatcgtaggcatgacggggagctggcggaggatgaacaacaagtccggctacaccttcagcgacgaagacgagtttatcttccaatcaccctcgggcttattcgagaaaagagtgacagttggggagttgaagcgcaaggctaagaaggaggtaaactccaagtaccgcacgaatgagaagaggctgcccacgttatcaggcgccagtcagccatga

SEQ ID NO: 7966 - RNA, 4263 nt, synthetic construct
  misc_feature 1..4263: note = Cas9 variant
  source 1..4263: mol_type = other RNA
atggccaagcccaaggactacaccatcggcctggacatcgggacgaatagcgtcggctgggtcgtgacggacgaccagaacaacatcttacgcatcaagggcaagaaagccatcggcgcgcgacttttcgccgaggggaaggtggccgccgagcgccggtccttccgcaccacccgacgacggatcagcaggcggcgttggcggattaaacttctcgaggagctgttcgacgaggaaatcgccaaggtcgacccgtccttcttcgcgcgcctgcacgagagctggatctcccccaaggacaagcggaagcgctactccgccatcgtgttcccctcccccgaggaagacaagaagttccacgaaagctacccgaccatctaccacttgcgggacaagctgatgaaggatgaccagaagcacgacatccgcgaaatctacatcgccgtgcaccagatgatcaaagttcggggcaacttcctgcacgacgagagtgtggagacgtaccgcagcggcatgtccagcctagggggccggtccgagcgcaccatcttaagcgtgcagaccttagaggagctcaatgacctgtttgccgagaacgaggggaccgaggaggtcgagctgaacgtggcgtccgccgagcagatcaacgacatcctcacgggcgaccacctgaacgccgacagccagaaggagatctctaatctgctcctgcccagttcctttcccagcttcgacgacaaggccaaggagaagcaggtcaagaagctgatcaacaatgtggccactaatatcagtaaagcgtggctcggttacaaggccgacttcagcaccatcttgaacctggccaaagtggacaaagaccagaagaagatcttcgcattcgcccttcagggaggtgacgaggaggacaaggtgcaggagctggagagcctgttagagcagtcacagaccgacatcgtcgaccggctgatcgagatccgccacgcgattgtgctgagcgaaatcgttcccgttgggatgactctctccgaggccatgatcgacaagtatgaccagcacaaagaagatctgatcaccctgaaggccgttattcgtaacaccaaagacaagaagaaggccgccaagctccaggcgatctatgacctgtacgttaacaatcggcacgccgacctggccaaggccatgaaactcaccggcatcaagaagcgcagcgagctgctggacccggaggagctcaagaaggccatctccagcctgctggacgactcccccgaggcgggagagatcaagcagcggctcgagggaaagactttcctgcctctgcagcgcagcaacaacaacggcgtcatccccaaccaactccaccaggtggagctggacgagatcatcaagaaacagtccaagtactacccattcctggccgagaagaaccccgacgagagcgaggaggcccaaaagaaggcccccacaaagctcgacgcgctgctcaccttcagggtgccctactacgtcgggccgatgatcaccaaagaggagcaggaggcacaagacggccactccttcgcctggatggtccgccgggacccccaagaccacgaggccatcacgccctggaacttcgagaaaaaggtcgacaagatggcgagtgctacccagtttataaagcgcatgaccactaaggacacgtacctgctcggggaggacgtgctgcccgccagtagcctgaagtaccaactgttcaccgtgctcaacgagctgaacaacctccgagttaacggcaagaaactgacctccgacgagaaagagcaggtcatcgaggggttgttcaagaagcagaagaccgtgaaggcagacaagttcgtgaaatactggcaggccatccacataggcgccgacatcaaagtgaagggcctcagcgacccgagtaagttcaacagcacgatgagcacctacatcgacttcaagaagatcttcggggaccagctgaacgacgcgaaccgacagaacgacttcgagaaaatcatcgagtactccaccatcttcgaggaccggaagatcctggaggacaagctccgcgccgacttcgcctggctgagcgaagaacagataaagcagctgtgccggctccgcctgcagggctggggacggctctccgacaagttactgactcgtctgacggacgccgacggccagaacgttctcgagcggctgtggaacagcaacgacaacttcgtacagattgtatccgaccccaacataaaggccaagatcgagcaggagaaccagaaactgctccgcgacgggcagagcgacgacgcggtcgagtccatcctggacgacgcttataccagcccccagaacaagaaggccatccggcaggtaatgcgcgtcgtgcacgacatcgtcaaggcttgcgatggcaacgtgcccgcgaagttcgccatcgagttcgcgcgctcccaggaggacgacccaaagcggaccaccgcccgcgtgaaccaaatgcagaagatctacgaccagatcagcgacgaggtcgtgtcccagggcgtgaaggagcagctgagcgggatgaagtccctcaaggatcggtactacctgtacttcatgcagggagggcgcgatgcatacacgggcgcgaagctgaacatcgaccggctctcagattacgacatcgaccacataatgccccagtccttcgtcaaggacgacagcctcgacaaccgcgttctggtggcccgggccgtaaacaatcagaagtccgacaaggttcccgcgttcctcttcgggaacaaagtcgtcgccgacctgggcatcaccgtgcgagagatgtgggacaagtggcagaagctgggaatgatcagcaagcgcaaactgagtaacttactgaccgaccccgacgcgctcaccgagtaccgcgcgcaggggttcatcaggcgccagctggtggagacctcccaggtcataaagctgacggccactatactccaaagcgagttcccggactctaagatcatcgaggtccccgcaaagtacaactccatcgtgcggaagcagttcgatctgtacaagtcacgcgaagtcaacgactttcaccatgccatcgatgcgtacctgtcgaccatcgtgggtaactacctctaccaggtgtacccgaacctgcggcgcatgttcgtctacggggagttcaagaaattcagttcaaacgcagaggagtccgcccatgacatggcccgccgcgtcaagagcatgaactttctggacgacctcctgcggggcacccacggcgacaatatctactgccgctccacgggggagatcgtgttcaaccggaacgacatcatcagcaagctgaagcaggcgtactcctttaagcagatgctcgtgactcaggaggtgttcacccgcaagagcgcgctgttcgaccagaccgtgtacccgtcacccgagcgtgatagcaaaaagcggtctggcctgattccccgcaagaaggggatggacacggaaatctacggcgggtacagcggcaacaaggacgcctacttcgtgttggctgaggccgtgaaggaaaagggccacaccctacaaatcgtgggcgtccccatccgggctcttaacaccctcaagaactccgccaactacagcgagaagctgctggagattatcaagccccaggtgatgttcaacaagaagaacggcaagccgaagaagggggtgaacgacgtacgcatcctcatggacaacatcccgtaccggcagcccgtgctcgagggcggtgccctgtacatgctaggcagctccacctacaagtacagcctgaagcagatcacgctgtcccaggagagcatgaagtacattctagactacatagacgacccctcctttaacaagcacatcatggttaacatcgaccaccaggatgaaaagaagtgcctgctcagcgtctatgacgagatcctcgacaagatggacaagtacctacctctgttcgatatcaacggcttccgcaagaagctccacgacgggcgggagaagttcgtgaagctgcccgtagagaagcaggctgaggtggtgaaggacatcctgcgcggtctccacgcgaactccgagatgacaaagcccagcgacctggggctgaccaccgcgctcggcttcatgcaggccccggacgggatcaagatctcggacgacgccgtcttcatctaccagagccccacgggcctgttcgagcggcgcgttaaggtttccgacctgctcaagtga

SEQ ID NO: 7967 - RNA, 4266 nt, synthetic construct; identical to SEQ ID NO: 2167
  misc_feature 1..4266: note = Cas9 variant
  source 1..4266: mol_type = other RNA

SEQ ID NO: 7968 - RNA, 4266 nt, synthetic construct; identical to SEQ ID NO: 2168
  misc_feature 1..4266: note = Cas9 variant
  source 1..4266: mol_type = other RNA

SEQ ID NO: 7969 - RNA, 4266 nt, synthetic construct
  misc_feature 1..4266: note = Cas9 variant
  source 1..4266: mol_type = other RNA
atgaaggacatcctgggcctcgacctggggaccaacagcattggctgggccgtggtcaaggaggcccagaacgacaacgagcagtccgagatcgtggacgtaggggtccgtgtgaaccccctgaccacggacgagaaaaccaacttcgagaagggcaagccgatcagcaccaacgcggaccggaccttaaagcgctctgcccggcgcaacctgcagcggtacaagctgcgccggaaggagctaatagagctgctgaaggagcaccagctcatctctacggacaccatcctgaccgagaacgggaagggcaccactttccagaccctggagctccgcgccaagtccgccaaagagaagatcagcctggaggagctggcccgggtgttcctcaccatcaataagaagcgcggctacaagtccagccggaaggcgaagaacgaggacgaggggcagcttatagacggcatggagatcgcaaagcgcctgtacgaggagaacctcaccacagggcagctgtccctgcagctccttaaggagggcaagaagtccctgcccgactactaccggtccgacctccagttcgagctggacaaggtctggaacttccagaaacagttccacagccacatcctgaccgacgagttctacgcccagctcaaggggaagggccagcgcgccacctccgcgctgttcctggccaagtaccagatctacaccgccgaaaacaagggcagccgggaggacaagaaacttcaggcctaccagtggcgcgtcgacgccctgtccaaggagctgacgcgggagcagctcgcgttcgtgatcaccgagatcaacaacaacctgaacaacagctccgggtacctgggcgccatcagcgaccgctccaaggagctctacttcaacaacgagaccgtcggggagtacttatggaagcagatcgccgccaacccgcatacaagcctgaagaaccaggtgttctaccggcaggactacctcgacgagttcgagcagatctggaaaacgcagagcgccttctaccccgagattctgaccgagtccctgaagaaggagctccgcgacgtggtcatcttctaccagcggaagctcaagagccagaagtccctggtgtccttctgcgagttcgagaacaaggaaatcgagatcaagaaggaggacggcacctccaccaagaaggtgatcggcctcaaggtcgcgcccaagagcagccccctgttccaggagttcaagatttggcagaacctgaacaacgtgctcatccgcaagaaggggagcaagacgaagaaggccgctaagaaccagcaggccgtgctgttcgaagaggagaagactatctccgagctggacctggaggccaagcaggccctgttcaacgagctgaacctgaaaggcaacctcaaggccgactactgcctggagatcctggggtactcgccaaaggagtgggagatgaactactccgttctggagggcaatcgcaccaacaaggccctgtacgaggcctacctgaagatcaccgacctcgaggggtacgacgccaagaaccacctgaaggtgaagctgaacaaagacgaggtcgagcttgatgacctgaaggtccccgcgagcgagatcaaggacatggtgcaggccatcttcaaggaagccggcatcaacacggacatcctgcacttcaacgccgagctcgacggcaaggacttcgagaaccaggcgtcctaccagctgtggcacctcctctacagctacgagggggacgactccaagagcggcaacgagctgctgtacaagctcctggagaccaagttcgggttcaagaaggagtacgcccagatccttgccaacgtgtccctcagcgacgactacggctccctgagcactaaggccatgcggaagatccacccctatatcaaggagaacaagttcagcaccgcctgcgagctggcggggtaccgccactccaagcacagcctcacgaaggaggagaacgacaaccgggtcctgcgcgactccctggaggtgctcaagaagaatagcctgcggcagcccgtcgtggagaagatcctgaaccagatgatcaacctcgtgaacgccctgctgaagaagtaccgcaccgagaaccccaacttcaagttcgacgagatccggatcgagctggcccgcgagctgaagaagaacgccgaggagagggccaacatgaccgcgaacatcaacaaagccaagaccgagcacgagaagatcatcaagatcctgaagaacgagttcggcctccccaacccgacgcgcaacgacatcatccggtaccgcctgtacgaggagctgaaggccaacggctacaaggacctctacaccaacatcaagatcccccaggagaagttattcaccaaggagatcgacatcgagcatatcatccccaagtcccgggtctttgacgacagtttctccaacaagaccctgagcttccgcaagaccaacctcgacaagggggagcggacggccttcgactacatggagtccaagttcggcgccgacaagctggaggagtatgtggcgcgcgtggaggacctgtacaagaacaacatcatcagcaaggccaagtaccagaagctcctgaagaaagagtccgagattggggacggcttcgtcgagcgggacctgagggagacccagtacatcgccaagaaggccaaggagatcctcctgcaaatcacccccaacgtgctgagcacctccgggggcatcacggaccggctccgcgaggactgggacctgatcaacgtgatgaaggagctgaacctcccgaagtaccgcgcgctgggcctgaccgagatggaggaccggaagtacgggcagcaggtcgaggtaatcatcgactggactaagcgcaacgaccaccggcaccacgccatggacgccctcaccgtggccttcacgaagcacaaccacatccagtacctgaactacctgaacgcgcgcaagaacgagaagcacaaggagcacagcaacatcatgggcatccagcagctcgagaccatcaaggtcaccgacaagaacggaaacgagaagcgggtgttcaaggcccccatgcccaacttccgccaggtgaccaaggccttcctggagaacatcctgatctcccacaaggccaagaacaaggtcgtgacgaagaacaagaacaaggtggccggcagcaacaaggtccaggaggtgctcaccccgaggggccagctgcacaaggagaccgtgtacgggaagtaccagtactacgtccagaaggaggagaagatcggcgggaagttcgacctggagaccatcaagaaggtggccaaccctctctaccagtccctgctgaagaagcgcctcgaggagaacggcggggaccccaagaaggcgttcacgggcaagaacagcctggccaagaaccccatatacctggacgacgcccagaccgagcagctccccgagaaggtgaagctggtctggctggagaacagcttcagtatccggaaggacatcaccccggagaacttcaaggacgagaagctcatcgacaagatcctggacgagggcgtgaagagaatcctgaaggagcggctccagagcttcgggaacgacgccaagaaggccttctccgacctggagaagaaccccatctggctgaataaggagaagggcatcaccatcaagcgcgtgacgatcagcggggtcgcgaacgccgagcccctccacaccaagaaggaccacctgggcaaggagatcctggacaaggaggggaagcccatcccggtggacttcatcagtaccggcagcaaccaccacgtggccgtctaccgggacgagaagggcaacctccaggagaaggtggtgtccgtcttcgaggccgtggtgcgcgcgaaccaggggctgcccatcatcgacaagacctacaaccagcacctgggctgggagttcctcttcacgatgaagcagaatgagatgttcgtcttccccaacgagagcaccgggttcaacccgaacgacatcgacctgctggacccgaagaacaagcggatcatctcccccaacctcttccgcgtgcagaagctggccaccggcgactactggttcaggcaccatctggagaccacggtggagaccaagagcgccacgaaggatatgacctacaagcgcctgtccctgaaccacatcaagaacatcatcaaggtccggatcagccacctgggggacatcgtgtccgtgggcgagtactga

SEQ ID NO: 7970 - RNA, 4275 nt, synthetic construct
  misc_feature 1..4275: note = Cas9 variant
  source 1..4275: mol_type = other RNA
atgaagaggatcctgggcctcgatctggggaccaacagcatcggctgggccctggtgaacgaggctgagaccgatgaggaggtctccagcatcatccggctcggggtgcgcgtgaaccccctgacggtcgacgagacccagaacttcgagaagggcaaaagtatcaccaccaacgctgagcggactctgaagcgcagcatgcggcgcaacctccagcggtacaagctgcgccgggacgccctggtggagttcctgaaggagctggggttcatcacagacgagaccatcctgtccgagcagggcaaccgcaccacgttcgagacctgcaggctccgcgccaaagcagccgaggaggagatcagcctggaggagctgtcccgggtgctcctgatgatcaacaagaagagaggctacaaaagcagccggaaggtcaagaaggaggaggacggggtgctgatcgacggcatggagatcgccaagaaactctacgaggaggacttaacgccggggcagctgtgcagccagttactggagtccggcaagaaggtgttacccgacttctaccgcagcgacctccaggaggagctggaccggatctggtccgttcaaaagcaattccaccccgatgtgttctgcgacgccgccaaggaggagatcaaggggaagaaccgcagccagacctgggccatcctggcgaactatttcgtgtggaaggaggaggtcgtgggctggaacgaccgggaggccaagaacgagacgatcgagaaagaatgcaagctcgtaggcctgaagcgcaccaccaagggttacgagctgaagaaggagaactatcggtggcgggcccaggccctcaccgagcagctgggcctggaggagatcgcggtcgtgctccaggagatcaatgggcagatcaacgcgtccagcggctacctgggcgcgatctccgacaggagcaaggtgctgtattttaaccaccagacggtcgggcagtaccagatggccgagctcgataagaacccccacgcctccctgcggaacatggtgttttaccgtcaggactacctggacgagtttgaccggatatgggagaagcaggccgagttccacaaggaactcactgcggagctgaagaaggagatccgcgacatgatcatcttctaccagcggcgcctcaagagccagaagggactcatcagcttctgcgagttcgagcggctggaaatcgtggtcgagaaggacggaaagaagcagaccaaggtgataggctgcaaggtgatcccgcgctcccaccccctgttccaggagttcaaggtctggcaaaccctcaacgatatcaaggtgctggggcgggagaagaagaggaacgccctgagcgcctccgagagccgggccctttaccccgaggagaaggagatcttggcccgcgagctggcgatcaaggagaacatgaagaaggccgatgtcctgaagctcctgttcgagaacccccaggagctggacctcaacttcaagcagatagacggcaaccgtacgggcttctccctgttcagcgcctactccaagatgatcgagaagtacgggtacgagcccctggacttcaagaagcccgccgacgagatcatcggccagctccgcaccatcttcaccgacctggggtggaacaccaacctgttcactatagacctcaccaaggagggcaaggagctggagatgcagccctacttccggctgtggcacctcctgtatagcttcgagggggacaacacctccactggcaacggcaagctgatcgagaagatcatgcagttgtgcggggtggagaaagagtacgccgtggagctggcgtcactgtccttccaggacgactacggctctctctccgccaaggccatcaagcgcatcttaccctacctgaaggaggggaacctctacgacgtcgcctgcgagtacgccggatacagacactcgaagtccagcctgaccaaagaagagatcgagaacaaggtgctgaaggggaagctcgaggtgctgccgaaaaattccctgcgcaaccccgttgtggagaagatcctcagccagatggtgaacgtcatcaataccatcatcgacacctacggcaaacccgacgagatccgggtggagctggcccgcgagctgaagaagtccgccaaggagcgcgaggagctcaccaaggccatagccaagtccacgcgggagcacgaggagatccgcaagctgctgcaggacgagttcggcatgatgaacgttagccggaacgacatcattcgctacaagctctacgaggagctgaaggacaacggttataagaccctgtactccaaccagtacatccctaaggagaagatctttagcaaggagatcgacatcgagcatatcatcccgcaatccaggctgttcgatgacagcctgtccaacaagaccctcgagtacaaggcgataaacatagagaagggcaacaagaccgcctacgacttcgtcaaggagaagtatggggaggagggcctccagcaatatatcaaccgctgcgagagcctattcaacgacaagaaagccaagctgcggaagctcaagatggagcagaaggacattcccgacgggtttatcgaccgtgacctgaggaacacgcagtacatcgccaagaaggcactggcgatgctcaacgagatctgccgccgggtggtggccaccaccgggtccatcaccgaccaactgcgcgaggactggcagctggtcgacgtgatgaaggagctcaacctgcccaagtacgaggccctgggcttcgtcgagacctacgaggacaaggacggccggaagatcaagcgcatcaaggactggacgaagcggaacgaccaccgccatcacgccatggacgccttgaccgtcgcgttcaccaaggacgccttcatccagtatttcaataacaagaacgccgcccaggatagcggcaaccggaaccacacgaacatcatcgggatcaagacgcgctacttcgacaagggccgggcgctgcccccgattccactggagcagttccgcattgaggccaagcagcacctcgagaagctgctggtctccatcaaggccaagaacaaggtcgtaaccgtaaacgtgaaccggaccaagaaacgcaagggcgagaacaccaagatccagcagacgccccgcgggcagctccacctggagaccgtctacggcagccacaagcagtacgtgacgaagatcgaaaaggtgaacgcctccttcgacgccgcgaagatcgccaccgtctcgaagcgggcctaccgcaacgccctgctgaagcggctggagacgttcgggaacgaccccaagaaggccttcaccggcaagaacgctctggagaagaacccgctctacgccgacaagtaccagaccatccgcgtgcccgagaaggtgcagaccgtcgagttcgaaacgatctacaccatccggaagcccgtggacccagccctgaacgtggacaaggtcgtggacgtgaaagtccgcgctatcctggagcggcgcctaaaggagtacggcggggaccctaagaaagcattcgtgaacttctgggagaatcccatctggctgaacaaggagaaggggatctccatcaagcgggtgagcatccgggggatcaacaacgcacagtccattcacgttaagaaggacaagaacggcaatcccatctgggacgagaacgggaagcagataccggttgacttcgtgaacaccggcaacaaccaccacgtcgccatctaccggaaacccgtcctggacaagaagggccaggtgaccttcgacgaggacggaaacctcatgtacgagctagatgaggtcgtggtgcccttcttcgaggccgttacgcgcgccaacctaggcctccccatcatcgacaaggactaccgcaagagcgaggggtggcagttcctgttctccatgaagcagaacgaatacttcgtgtttccgaacgagaagaccggcttcaaccccaaggaggtggacctgctcaaccccgacaactacgcaatgatcagccccaatctgttccgggtgcagaccatgagcaaagtgatgtacgggaacaacgtcgttcgggactacaagttccgccaccacctagagaccacggtgaaggacatgaaggaactcaaagacatcgcctacaaacagtacaagaccctgtccttcggtaacagcgtcgtgaagatacggatcaaccacatcgggcagatcgtgtccgtaggcgagtactga

SEQ ID NO: 7971 - RNA, 4275 nt, synthetic construct
  misc_feature 1..4275: note = Cas9 variant
  source 1..4275: mol_type = other RNA
atgaagcgcatcctggggctcgacctggggaccaacagcatcggctgggccctggtaaacgaggccgagaccgacgaggaggtcagtagcatcatccggctcggggtacgcgtgaaccccctgacagtcgacgagacccagaacttcgagaagggtaagtccatcaccaccaacgcggagcggacactgaagcgcagcatgaggcgcaacctccagcggtacaagctgcgcagagatgccctggtggagttcctcaaggagctgggtttcatcaccgatgagaccatcctgtccgagcagggcaaccgaaccacgttcgagacttgccggctccgcgccaaggccgccgaggaggagatcagcctggaggagctgagcagagtgctcctgatgatcaacaagaagcgtggctacaagagctcccggaaggtcaagaaggaagaggacggggtgctgatcgacggcatggagatcgcaaagaagctctacgaggaggacctgacaccagggcagctgtgcagccagctcctcgaatccggcaagaaggtgctgcccgacttctaccacagcgacctccaggaggagctggaccgcatctggtccgttcagaagcagttccatcccgacgtgttctgcgacgccgccaaggaggagatcaaggggaagaaccggagccagacctgggccatcctggcgaactacttcgtgtggaaggaagaggtcgtgggctggaacgaccgcgaggccaaaaacgagacgatcgagaaagagtgcaagctcgtgggcttaaagcggaccaccaaggggtacgagctgaaaaaggagaactaccgctggcgggcccaggcgctcaccgagcaactgggcctggaagaaatcgccgtcgtgctccaggagatcaacgggcagatcaacgcgtccagcggctacctaggcgcgatctccgaccggagcaaggtgttatacttcaaccaccagacggtcgggcaataccagatggccgaactcgataagaacccccacgcctccttacgcaacatggtgttctaccggcaggactacctggacgagttcgaccgcatctgggagaagcaggccgagttccacaaggagctcaccgcggagctgaagaaagagatccgggacatgatcatcttctaccagcgccggctcaagagccagaagggcctgatcagcttctgcgagttcgagcggctggagatcgtggtcgagaaggacgggaagaaacagaccaaggtgatcggctgcaaggtgataccccggtcccaccccctgttccaggagttcaaggtctggcagaccctcaacgacatcaaagtgctggggcgcgagaaaaagcgcaacgccctgagcgcatccgagagcagagccctataccccgaggagaaggagatccttgcccgggagctggcaatcaaggagaacatgaagaaggccgacgtcctgaagctcttattcgagaacccccaggagcttgacctcaacttcaaacagatcgacggcaaccgcaccggattctccctgttcagcgcctattccaagatgatcgagaagtacgggtacgaaccgctggacttcaagaagcccgccgacgagatcatcggccagctccggaccatcttcaccgacctgggttggaacaccaacctgttcactatcgacctcaccaaggagggcaaggagctggagatgcagccctacttccgcctgtggcacttactgtacagcttcgagggggacaacacctccaccggcaacggcaagctgatcgagaagatcatgcagctctgcggagtggagaaggaatacgccgttgagctggcgagcctgtccttccaggacgactacggcagcctctccgccaaggccatcaagcggattctgccatacctgaaggaggggaacctctacgacgtcgcctgcgagtacgcgggctaccggcacagcaagtccagcttaacgaaggaagagatcgagaacaaggtgctgaaggggaagctcgaggtgcttcccaagaacagtctgcggaacccggtcgtggagaaaatcctcagccagatggtgaacgtcatcaacaccatcatcgacacctatggcaagcccgacgagattcgcgtggagctggcccgggagctgaagaagtccgccaaggagcgcgaggagctcaccaaggccatcgccaagagcacgcgcgaacacgaggagatccggaagctgctgcaggacgaatttggcatgatgaacgtgagccgcaacgacatcatccggtacaagctctacgaggagctgaaggacaacgggtacaagacactgtactcgaaccagtacatccccaaggagaagatcttcagcaaggaaatagacatcgagcatatcatcccgcagtcccgcctcttcgacgacagcctgtccaacaaaaccctggagtacaaggcaatcaatatcgagaagggcaacaagaccgcctacgacttcgtcaaggagaagtacggggaggagggcctacagcagtacatcaatcggtgcgagagcctgttcaacgataagaaggccaagctgcgcaagctcaagatggagcaaaaggatatccccgacggcttcatcgaccgggacctgcgcaacacgcaatacatcgccaaaaaggccctggcgatgctcaacgagatctgccggcgcgtggtggccaccactgggtccatcaccgaccagctgcgggaggactggcagctggtcgatgttatgaaggagctcaacctgcccaagtacgaggccctgggcttcgtggagacctacgaggataaagacgggcgcaagatcaagcggatcaaggactggacgaagcgcaacgatcaccggcaccacgccatggacgcgctcaccgtcgcgttcaccaaggacgccttcatccagtacttcaacaacaagaacgctgcccaggacagcggtaaccgcaatcacaccaacatcatcggaatcaaaacacggtacttcgacaagggccgcgcgttgccaccgatccccctggagcagttccggatcgaggccaaacagcacctcgagaagttgctggtgtccatcaaggccaagaacaaggtggtcaccgttaacgtgaaccgcaccaagaagcggaagggcgagaacacgaagatacagcagacgccccgcgggcaactccacttggagaccgtctacggcagccacaagcagtacgtgaccaagatcgagaaggtgaacgcctccttcgacgccgcgaagatcgccaccgtctcaaagcgggcctaccggaacgccctgctcaagcgcctagagacgttcgggaatgaccccaagaaggcgttcaccggcaagaacgcgcttgagaagaacccgctctacgccgacaagtaccagaccattcgcgtccccgagaaggtgcagaccgtcgagttcgagactatctacactatccgcaagccagtggaccccgccctgaacgtggacaaggtcgtggacgtgaaggtccgagccatcctggagcggcgcttaaaggagtacggcggggacccgaagaaggccttcgtgaacttctgggagaacccgatctggctgaacaaggagaaggggatctccatcaaacgcgtgagcatccgggggatcaacaacgcgcagtccatccacgtcaagaaggacaagaacggcaaccccatctgggacgagaatgggaagcagatcccggtggatttcgtgaacaccggcaacaaccaccacgtcgccatctaccggaagcccgtactggacaagaagggccaggtgacctttgacgaggatgggaacctcatgtacgagctggacgaagtcgtggtccccttcttcgaggctgtcacgcgggccaacctgggcctccccataatcgacaaagactacagaaagagcgaggggtggcagttcctgttctccatgaagcagaacgaatacttcgtgttcccgaacgagaaaaccggcttcaaccccaaggaggtggacctgttgaaccccgacaactacgcgatgatcagccccaacctgttccgggtccaaaccatgagcaaggtgatgtacgggaacaacgtcgtgcgcgactacaagttccggcaccacctggagaccacggtgaaggatatgaaggagctcaaggacatcgcctacaagcagtacaagaccctgtccttcggcaacagcgtcgtgaagatccgcatcaaccacattgggcagatcgtgtccgtcggcgagtactga

SEQ ID NO: 7972 - RNA, 4278 nt, synthetic construct
  misc_feature 1..4278: note = Cas9 variant
  source 1..4278: mol_type = other RNA
atgcgccggaacatcctgggcctcgacctggggaccaccagcatcggcttcgccaaggtgatcgaggacgaggactaccaaaattccgccgtcgagctgataggggtgcgcgtgaaccccctcacgaccgatgagcagaccaacttcgagaagggccggccggtctctgtgaacgcggaccgcaccctgaagcgggggatgcgccggaacctggaccgctaccagctccggcgccaccacctgatcgaggtgctgaaggccaaccacatcatcacggtcgacaccaagctcgccgaggacggcaagaacaccacccatgccacgtacgccgtgcgggcgctggccgccacagccgagatccccctggaggcgttcgcccgcgtgctcctggccatcaacaagaagcggggctacaagtccagccgcaaggccaagaacgaggacgaggggcagctaatcgacggcatggccgtcgcgaagcggctctacgaggagaacctgacccccggacagctgtcctacctcctgctgaaagagggcaagaagtacctccccgacttctaccgcagcgacctgaacgccgagctggacaaggtgtggtccttccagaagcagttctacccggagatcttaaccgaggagttcaagaagcacctggaagggaagggccagcgggccacgagcgccgccttctggggccagtacgggttcaacaccgcagagaacaagggctcccgcgaggagaagaagctgaaggcctaccagtggcggagcgaggcagtggatcagcagctcaccaaggaggaggtcgcctacgtgattacagagatcaataacgacctgaacaagtccagcgggtacctgggcgccatctccgaccgcagcaaggagctgttcttcaacaagcagacggtgggccagtacctgtaccagcagctgaagcagaacccccacacccggctcaaggggcaggtcttctaccgccaggactacctggacgagttcgagaccatctgggagacacaggccaagttccaccccgagctgacggccgccctcaaggaggagatccgcgacgtgatcatcttctaccagcggaagctgaagtcccagaagggcctgatcagcttctgcgagttcgagtccaaagagatcgaagtcgagaagaacgggctcaagatcaagaagcgcatcggccttcgggtcgcccccaagagctccccgctgttccaagagttcaagatctggcaggtcctcaacaacttggagttccgcaacaagagcagcaaggaggtgtttgtgcccgacatgaccgcaaagcagcagctgttcgacgagctcaacatcaaggggaacctgctggcgtccgaggccatcaagatcctcggctacaagaccaaggactgggaggccaactaccacaccctggagggcaaccggacgaacaagagcctgtacgacgcctacctgaagatcctcgagctggaggggtatgacgaggatctgctcaagctgtccggcagcgacgacatcgacgtgtccaagattgagaagtccgcgagcgagatcaagcagatggtgcacgccgtcttcgaggtgctggggatcaacagcaccatcctcgacttcgacgccgaggccgacggcaaggccttcgagcagcagactgcgtaccgcctgtggcatctcctctactccgccgaggacgacaacaagaagtacctgcaggaggacatcttcatctacgggcatgacaacatcggcctgaagaagaaactttgcgagcggttcggcttccgccccgagcacaccaagatcctggtcaacgtggccttcagcggggactacggctcgctcagctccaaggccatgcggaagatctacccctttatcaaggagctcacgtacgacaaggcctgccgcgaggcgggataccggcacagcgccagcagcctgtccaaggaagagatcgccacccgcccgctgcagaagcggctcggcctgctgaagaagaacgagttgcgcagccccgtggtcgagaagatcctgaaccagatggtgaacgtggtcaacgccctgatcgacgacgagaacaagcggcgcaaggcccgggggctctccgacgactttcacttcgacgagatccgcatcgagctggcgcgggagctgaagaagaacgccaaggagcgcgccgaaatgaccaccaacatcaacgccgcgaagcagctccacgagaagatcatcaagatcctgcagacgcagttcggcgtgagcaaccccagccgcaacgacatcatccggtacaagctgtacgaggagctcaagaacaacggctacaaggacctgtacaccaacacctacatctccccggacatcttattcagcaagcagatcgacatagaccacattatcccgcagatgtctctcttcgacgacagcttctccaacaaaacagtggtcttccgcaaggacaaccaggacaaggggaacaagacggcctacgactacatcctgggcaagtacggggagctggccctcgaagagtacatcagccggatcacctccctgttcgagctgggcaaaaagaacaaggaggagggcatcaacaaggccaagttccagaagctgcagaagcgcctgatcgacatcggggacggcttcatcgagaaggacctgcgggagagccaatacatcgccaagaaggcgaagaacatgctctacgccatctgccgctccgtggtggccaccagcggggagatcaccgcccggctgcgcgaggactgggacctggtcaacgtgatgcaggagatcaacctccccaagttccgtgccctgggcctgaccgagatggtggagaagaaggacggaggccagaaggagcgcatcatagactggacgaagcggaacgaccaccgccaccacgcgatggacgccctcaccatcgcgttcacccggcattcccacatccagtacctgaaccacctgaacgcccgcaaggacgaggccagcaagtggcaccccgtcgtgtccaagatcgaggagaaggagaccgacctcgtgtacgacgacctgggcaaccggaagcgccggttcaaggcgcccatgccgaacttccgcgaggtcgtgaaggagcacctggagaacgtgctcatcagccacaaggccaagaacaaggtcgtgacgaagaacaagaacaagatcaagaccgccaagggggagaagatcaagaccgagttaacgccccggggccagctgcacaaggagaccatctacgggcgctaccggtactacgagtccaaggaggagaaggtgggccccaagttcgacgccgagaccatcgggatggtcgttaacccccagtaccgcaagctcctgctggagcgcctcaccaccaacggcaacgacccgaagaaggcgttcggcgggaagaacacgcttagcaagaaccccctgtacatcgacgaggccaagcaggagctcttacccgagaagatcctgctccggtggctgaacgatgattactccatccgcaaggacgtgacccccgagaacctgaaggacgtaaagaccatcgagaaagtgctcgacgagggcatcaaaaagatcctgctgaagcggctcgtggatttcggaaacgacccgaagaaggccttcagcgacctggacaagaacccaatctggctgaacgaggccaagggcatcaccatcaagcgcgtcacgatcagcggggtgaagaacgccgaggcgctccactacaagaaggaccacttcggcaacgccatcctgaacgagaacggcaagctgatcccttccagcttcgtgtccaccgggaataaccaccacgtggccatctaccgggacgccgagggcaacctccaggagcgtgtggtgtccctgttcgacgccgtccaactggtgaacgcgggggaggccgtgatcgaccgggagtacaacaagggcatcgggtggcaattcctcttcaccatgaagcagaacgagatgttcgtcttcccgaacgagaagacaggcttcgaccccaaggagatcgacctgctgaacacggacaaccgcaagctcatctcccctaacctgttccgggtgcagaagatagccagcaagaactacttcttccgccaccacctggagaccaacgtggaggagcgcaaggagctcaaggacatcgtctacaagccccagctgggactgaacgccatcaaggacgtggtgaaggttcgcatcaaccacctcgggaagatcatctccgtgggcgagtactga

SEQ ID NO: 7973 - RNA, 4281 nt, synthetic construct
  misc_feature 1..4281: note = Cas9 variant
  source 1..4281: mol_type = other RNA
atgccccgcaagaacatcctgggtctcgacctgggcaccaccagtataggcttcgccaagattatcgaggacgacgactaccagtgctccagcgtggaactgatcggcgtccgggtgaacccactcactaccgatgagcaaaccaacttcgagaagggcaagcccgtgtccgtaaacgccgatcgcacccttaagcggggtatgcgccggaacctggaccgatatcagctccgtcgcgactaccttatcgagatcctgcggacgcatcacatcatcaccgcggatactaagctcgccgaggacggcaaaaacaccacgcataccacctacgccttacgggctctggcagcgaccgccgagatccccctcgaggccttcgttagggtcctgctggccatcaacaaaaagcgcggctacaagagcagccgcaaggcgaagaacgaagacgaggggcagctcatcgacggtatggccattgcgcgccggctctacgaggagtccctgacccctgggcagttctcctaccagctcctgaaagagggcaagaagtacctgccggacttctacagatctgacctcaacactgagctaaataaggtatggaatttccagaagcagttctaccccgagatattaacagacgagttcaagcgccatctagaggggaagggccaacgcgcaaccgccgttgcattctggggccaacatggtttctccatggcggaaaacaagggaagccgggaggaaaagaagctacacgcctacaagtggcgcagcgaggccgcccacaagcagttgacgaaggaagaggtcgcgttcgtcatcacggagatcaacaacgacctaaataaaagctccgggtacctgggtgccatcagcgacagatcaaaggagttattctttaacaagcagactgtgggccagtatctacaccaacagttaaaggagaacccccacaccaggctgaagggccaggtgttctaccgccaggactacttagacgagttcgagacaatctgggagatgcaagccaaattttacagcgctctgacactggagctcaaggaggaggtccgtgatgtggtgatcttctaccagcgcaagctaaagtcccagatggggttgataagcctctgcgaatttgagagcaaggagatcgagatcgagaagaatggggaaaaggcgaagaagcgaatcggcctgcgcgtggcgccaaagtcaagcccgctgttccaggagttcaagatctggcaggttctcaataacctggagttccgcaacaagaagacaaaagaggtctttgtgcccgagatggctgctaaacagcagcttttcgacgaactcaacatcaaggggaacctgctggcgtccgaagccatcaaaatcttaggctacaagaccaaggactgggaggcgaactaccacacattagagggaaaccgcacaaacaagagcctgtacgacgcatggttaaagatcctagagctggagggttatgacgagaacctgttgaagctatctggcagcgacgacattgacgtgtccaagatcgagaagcccgcacttgagatccggcagatggtgctcgccgtcttcgaggttctggggatcagtggcgcgatcctggacttcgatgctgaggccgacgggaaggccttcgaacagcagccagcctatcagctctggcacctcctttactccgctgaagacgacggcaagaaatacagccaggaggacatcttcacctacggccacgataatatcgggcttaagaagaagctatgcgagaagttcggattccgtccggaacacaccaagattctggtgaacgtcgttttctccgacgactatgggaacctaagctccaaggccatgcggcgcatctaccccttcataaaggagctgacgtacgacaaggcttgcgccgaagcaggctaccggcacagcgcggcctccctgaccaaggaggaaatcgccgcccgcccactccagaaccggctggacctgctcaaaaagaacgagctgcggagtcccgtcgtcgagaagatcctaaaccaaatggtgaacgtagtcaacaccctcgtggacgacgaaaaccagaaccggaaggcccgcgggctgagtgaggacttccatttcgacgaaatccggatcgagctggcgcgcgaactcaaaaagaacgccaaggagagagcagagatgaccacgaacataaataccgccaagcagagccacgagaagatcatccgcatcctgcagaccgagttcggtgtcccgaacccctcccgcaacgacatcgttcggtacaagctatacgaagaattaaagaacaacggctacaaagatctgtataccaacacgtacatcagcagagacatcctgttctccaagcagatagacgtggaccacatcatcccccagatgagcctcttcgatgacagcttctccaacaaaaccgtagtcttccggaaggataatcaggataaggggaacaagacggcctatgactacatacttggcaaatacggggaacaggccctggaggagtacatcagccgcataacctccctcttcgagctgggtaagaagaacaaggaagagggaatcgggaaggccaagttccagaagctacagaagcgcttggtggacatcggcgacgggttcatcgagcgtgacctacgggagagccaatatatcgccaagaaggccaacaatatgctgtacgcgatctgccgttccgtcgtgagcacctcaggcgagatcacggcgcggctccgagaggattgggacctggtgaacgtcatgcaagagatcaacctaccgaaattcagggccctcgggctaacggagatggtcgagaagaaggatggcgcccagaaggagcgcatcaccgactggaccaaacggaacgatcaccgccaccacgcaatggacgcgttagcaatcgccttcacgcggcacagccatatccagtacctcaaccacctgaatgcccgcaaggacgaagcgaacaagtggcacccggttgtctcaaagatagaggagaaagagactgtgttgatctatgacgacctcggaaacagaaagcgcaagttcaaggcgccaatgcccaacttccgggaggtggtcaaagagcatctcgagaacgttctgatcagccacaaggccaaaaataaggtggtgactaagaacaaaaacaagatcaagactgttcgcggggagaaggtgaagacggagctcacgccccggggccagctgcacaaggagaccatctacgggcgctaccgctactacgagtccaaggaagagaagatcggcccgaagttcgatgcggagatgatcgggatggtcaccaacccacagtacaaaaagctgctcctggagcggctggccgcgaacggcaacgatcccaagaaggccttttggggcaagaatgctctcaacaagaaccccctgtatgtggacgaggcccgccaggaactgctcccggagaagattctgctgcgttggctcaacgacgactacagcattcgcaaggacgtaaccccagagaacctgaaagacatcaaaaccatcgagaagattctggacaaaggggttaaaaagatcttactgaagcggctggccgacttcgggaatgaccccaaaaaggcttttagcgatctcgacaaaaaccccatttggcagaacgaggccaaacgcatcgccatcaagagggtgaccatcagcggtatcaagaacgccgcgcccctgcaccacaagaaagatcacctgggcaacgacatcttggacgaaaaggggaagcaaatccccagtagcttcgtctccaccggcaacaaccaccacgttgcgatataccgcgacgccgagggcaatctgcaggagcgggtggtgtccctgttcgacgcagtccagctcgttaacggcggagagcccgtgatcgacaaagagtacaacaaggggatcggatggcagttcctgtttacaatgaagcagaacgagatgttcgtcttccctgacgagaagaccggcttcaaccctagagaggtggatttactcagtagtggcaaccgtaagctgatcagcccaaaccttttccgcgtacagaaactcgcatccaagaactacttctttcggcaccacctggagactagcgtggaggaaaagaaggagttaaagaacatcgcgtataagccccagctcggcctgaacgcgctctccaacatcgtgaaggtacgcatcaaccacatcggagagatcgtttctgtgggggagtactga

SEQ ID NO: 7974 - RNA, 4281 nt, synthetic construct; identical to SEQ ID NO: 2174
  misc_feature 1..4281: note = Cas9 variant
  source 1..4281: mol_type = other RNA

SEQ ID NO: 7975 - RNA, 4281 nt, synthetic construct
  misc_feature 1..4281: note = Cas9 variant
  source 1..4281: mol_type = other RNA
atgaagcacatcctgggcctcgaccttgggaccaacagtatcggctgggccctgatcaagcaggacttcgagaacaagcagggggagatcctcggcatgggttcgcgaatcatccccatgagccaggatatactgggtgactttggcaaggggaactccgtgagccagaccgccgagaggacgaagtaccgatccgtccggcgcctgcgggagcgatttctcctgcggcgcgagcggctgcacaggatcctcaacgttttgggcttcctgcccgagcactacgcgagtcagatagacttcaccaagcggttcgggaagttcaaagaggagactgagcccaagctcgtgtacagtaatgagggcttcatattcaaaaagagcttcgaggagatgctgagcgacttcaagactcaccagccacagctgctcgaggacaacaagaagatcccatacgactggacgatctactacctccgcaagaaggccctgagccgcaagatcgagaaggaggagctcgcctggatcctgctgaacttcaaccaaaagagagggtactaccagctacggggcgaggaggaggaggagaacccaaacaagctgatcgagttctactcactgaagatcgtcgacgtgctcgccgacgagcctcagaaaggcaagagcgacatctggtattcccttatcctggaaaacgggtggatctacagacggagctccaaaacgcccctcttcgactggaaggagaagacccgagacttcatagtgaccatcgacctgaacgacgacggctcagtcaaaaccgacaaggaggggaacgaaaagcggtcctttcgcgctcccggcgagaacgactggaccctggtgaagaagaagaccgagcaggagatcgacagctcccggaagacagtgggcacttacatctacgagacgctcctgaaaaacccgaagcagaagatcaaggggaagctggtacgcaccatcgagcgcaaattctacaagaccgagctcaagcaaatcctggagaagcagaaggagttccaccccgagctgcggcaggacgacctctatagcgactgcgtgcgcgagttatacaagaacaacgaagcgcaccagctgacgctcagcaaaaaggacttcgtgcatctgttcatggaggacatcatcttctaccagcggcccctgggatcccagaagtccagcatcagcaactgcacgctagagttccgcaaatataaggacgagaacggaaccgagcacacccagtacctgaaggccatcccaaagagtaacccgtactaccaggagttccgtatctggcagtggatgtacaacctgaacatctacaagaaagaggatgacacgaacgtaaccaaggacttcttaaacaccaaggccgattttgagagcctgtttgagttcctgaacaatcgcaaggaggtggaccagaaggccctcctgaagcacttcaagctgaacgacaagacccaccggtggaactacgtagaggacaagaagtacccctgcaacgaaactaagacaatgatcctttcccgcctagacaaagtagagaacatctcagatgacttcctgacccgggagatggagcagaagatctggcatatcatctactccgtgaacgataaggtggagtacgagaaggcgctcaagagcttcgccggcaagaacaacctcgaggacaactccttcttcgaggcgttcaagaagttcccgccctttaagagcgagtacggggctttcagcgagaaggccatcaaaaagctgctgcccctcatgcgcatgggcaagttctggaactacaataacataagcgagcagtccaaatcgcggatccaaaagatcatcaccggcgagtacgacgagaacatcaaggacaaggtacgcgagaaggcgatccacctgacgaccgagaccgacttccaggggctgcagctctggctggtgcaatacattgtgtacggtcggcactccgaggccgccatgctggggaagtggaactcagcagacgacctcgaggagttcctgaaggagttcaagcagcactccctgcgcaaccccatcgtcgaacaggtaatcaccgagaccctccgggtggtgaaggacatctggcagaaatatggcaacggagccaaggacttcttccgcgagatccacatcgagctaggcagagagatgaagctgcccgcggaggaacgcgagcggctcacccgccagatcagcgagaacgagaacacaaacttccgcatcaaggccctgctggccgagatgatggatgacaacagcgttgagaacgtccggccattctccccaatgcagcaggagatcttgaagatctacgaggagggcgtgctgaacagcgacattgagattgaagacgacatcctgaagatctccaaaaccgcccagcccagctcctccgacctcaaacgctacaagctgtggctggagcagaagtacaaatccccctacacggggcagatcatccccctaaacaagctgttcaccccggagtacgagatcgagcacatcatccctcagagccggtactttgacgatagtttcaccaacaagatcatctgcgagagcgccgtgaacaagctgaaggacaactatatcggcctcgagttcattaaaaagctcggcgggtccatcgtcgagtgtgggaacggcaagagcgtggccattctgaagcacgacgcctacgaggacttcataaagaagcactatgccaacaaccgctcaaagagaaataaacttctgctggaggacatccccgagaagatgattgagcgccagatgaacgacacacggtacatcagcaagtacatctccggtgtgctcagcaatatagtcagagtggaggacgggaccgacgagggcgtcaactccaagaacatcgtccccgggaacggcaagatcacgacccagctgaagcaggactggggcctgaacgacgtgtggaatgacttaatcctgccccggttcgagcgcatgaaccacctgacaaacagcaccgacttcacggcctggaacgaaaaccaccagaagttcctccccaccgtgcccgtcgagttcagcaagggtttttccaagaagcgaatcgaccaccgccaccacgccctggacgcgctggtgatcgcctgcgccacaaaggaccacgtgaacttactgaacaaccagagcgccaagtctgacaccaagcggtacgatctgaagaagaaacttatgaagttcgagaaggtcgcttacaaccaccctcaaacgggcgagcgcatcgagcgggaggcccccaagcagttcctgaagccctgggaaaccttcaccatcgatgcaaagaaccacctcgagaccatcatcgtgagctttaagcagaacttacgagtgataaataaggccacgaactactacgagaagtacgtcgagaaggaggggaccaaggtgaaggaacgagtggaacagaagggcaccaattgggccatccgtaagcccatgcacaaggagacagtctccggaaagatcgacctgccgcggatcaaggtgcccaagggcaagattctgactgcaacccgcaagtccttggacacctctttcaacttaaagaccatcgggagcatcacggacaccgggatccagaagatcctgaagaactacctccaatacaaggacaacaaccctgagcttgccttttcccccgagggcatcgaggacatgaacaagaacatcgagaagttcaacaacgggaaggcccatcagagcatctccaaggtccgggtcttcgagctgggcagcaagttcccgctcgggcagtccggtaacaagaaagagaagtacgtggaggcggccaaaggcaccaacctgttcttcgcaatctaccaggacaaaaacgggaagcgctcctatgagaccatccccctgaatgaggtgatcgagcgccagaagcagggcctctccgtcgtggacctgaagggagtggatgacttttacctgtcacccaacgacctcgtctacgtgccctccgaagacgagctggaaaacatcagcatgatcgatttcaacaagatgtccagcgagcggatctacaaggtggttagcttcacgggcaaccagatcttcttcgtgagacaggacatcgccacttcggtggtcaacaaggccgagttcagcaccctgaacaagatggagcgggcaatcgacgggaccatgattaaggagacgtgcgttaagctccagatagaccgcctgggcaacatctccaagatctga

SEQ ID NO: 7976 - RNA, 4281 nt, synthetic construct; identical to SEQ ID NO: 2176
  misc_feature 1..4281: note = Cas9 variant
  source 1..4281: mol_type = other RNA

SEQ ID NO: 7977 - RNA, 4281 nt, synthetic construct
  misc_feature 1..4281: note = Cas9 variant
  source 1..4281: mol_type = other RNA
atgaagaacatcctgggcctcgacctagggaccaccagcataggcttcgcccacatcgtggaagacgagaacaaggagaagtccgagatcaaggagctgggggtccgcatcgtgagcctcacgaccgacgagcagtccgacttcgagaaaggcaagagcatcaccaccaacgccaaccggacgctgaagcacggggcgcgcctgaacctcgaccggtaccagcagcgccggaagtacctgatcgacctgctacagaaggccaacctgatcaccccctccagcatcctggccgagaacggcaaaaacaccacccactccacgtggcagctccgcgccaaagccgtgaccgagcggatcgagaaggaggagtttgcgcgcatcctgctggccatcaacaagaagcggggctacaagagctcccgcaaggccaagaccgaggacgaggggcaggccatcgacggcatggcgatcgccaagcggctctacgacgagaacctgaccccggggcagctgagcctccagctgctgcagcagaataagaagctcctgcccgacttctaccgctccgacctgcagaaggagttcgacctcgtctggaacttccagaagcagttctaccccgacatcctgacggacattttctacaaggagctgcagggcaaggggaaggacgccaccagcaaggccttctccaagcggtaccacttcgacaccaccgagaacaagggcagcaaggagtccgtgcgcctccaggcctaccagtggcgggcggaggccatcagcaagcagctttccaaagaggaggtggcctacgtcctgacggagatcaacaacaaccttaacaacgccagcggctacctgggggccatctccgaccgcagcaaggagctgtacttcaaccgacagaccgtgggccagtacctctacgctaagctgcaggagaaccgccacaatagcctgaagaacaaggtgttctaccggcaggactacctcgacgagttcgagcgcatctgggagacccaggcctccttccacaaggagctgaccgacgagctgaagaagcagatccgggacgtcgtgatcttctatcagcgcaagcccaagagccagaaggggctcatctctttctgcgagttcgagagcaaggagatcgagatcgagaaggacggcaagacgatcaccaagaacatcggcgcccgcgtggtcccgaagtccagcccactgttccaggagttcaagatctggcagatcctgaacaacgtgatctgcaagcggaaggggatccgcaagaagaagatctccgccaagactacccagctcgacctgctgaacgagagctcccagacgatcttcagcctcgacatggagtgcaagcagctactgtttgacgagctcaacctgaagggcgacttgaagtccgacaaggtgctgaagctgctggggtacagccctcaggagtgggagatcaactacaaccagctggagggcaaccggacccagaaggccctctacgaggcgtacctgaagatcgtggagatggaggctcacgacgtgaaggacatcctgcagatcaagtccgccaaggacgactggagcctcgacgagagccctctgtccgcctccgagatccgcgagaaggtgaaagccatcttccagaccctgggtatctgcaccaagatcttatacttcgacccgctgctgcccgtcaaggagttcgaggagcaggacagctatcagctctggcacctcctgtactcctacgagagcgacgacagcacgtccggcaacgagaccctctaccggatcctggagaagaagtacgcgttcaagcgcgagcacgcccggatcctggccaacgtggccctccaggatgactacggcagcctgtccaccaaggcgatccgcaagatctaccccaacatcaaggagaaccagtacagcaccgcctgcgagaaggccgggtacaagcactccaaactgagcctcacgaccgaggaactggaggcccgggagctgaaaaacatcatccccctcctgaagaagaacgccctgcgcaacccggtggtcgagaagatcctcaaccagatgatcaacgtggtgaacgccctgatcgagaagaactccgagcgggacgcagagggtaagatcaccaagtacttccatttcgatgagatccgcatcgagctggcccgggagctcaagaagaacgcccagaagcgctacgagatgacccaaaacatcaacaaggccaagctggagcaccagaagatcagcgagatcctgcagaaggagttcgggatcaagaaccccacgaagtccgacatcatccggtaccgcctctaccaggagctggagcacaacggctacaaggaactgtacaccaacgcgcccatcgcgcgtgacatgctgttcagcaagaacatcgagatcgagcacatcgtccccaaggcccgcgtgttcgacgactccttcagcaacaagaccctgaccttccaccggatcaacagtgacaagggggagtacaccgccttcgactacatcacgtcactgaactccgaggaggagctcaaccagtatctgacccgcgtcgagaacgcctacaagaccaagagcatctccccgaccaagtacaagaacctgctcaagaaggcgagcgagatcggcgacgacttcatcaaccgcgacctgcgggacacgcagtacatcgccaagaaggccaaagagatactgttccaggtgactaagaacgtgctcagcacctccggcagcatcaccgaccgcctgcgggaggactgggggctggtggacgtgatgaaggaactcaacatgccgaagtaccagagcctgggcctgacggaggtggaggagcgcaaggacgggaacaaggtaaccgtgatcaagaactggaccaagcgcaacgaccaccgtcaccacgccatggatgcgctcaccgttgccttcacgaagcccagctacatacaatacctgaatcacctgaacgcccggaaggacgagaacaacaagaactacagtgtcatcctcgccattgaggagaaggagaccatcaaggtgcccaccaacaacggcaagaacaagcgcgtgttcatcgagccgatcccaaacttccggcaggtcgcgaagaagcacctggaggagatcttcatcagccacaaggcgaagaacaaggtggtgaccaagaacacgaacaagcccgccgggaccgacaagcagcaaatcaccctgacgccccgcggccagctccacaaggagaccatctacggcaagtaccagtactacatcaacaaggaggaaaagatcggggtcaagttcgacgagcggaccatcgccaaggtatccaacccggtgtatcgcgaggccctgctgaagcggctccaggccaatgacaacgaccccaagaaggcgttcgccggcaagaacgccctcagcaagaaccccatctacctggacgagtccaagaccaagaccctccccgagaaggtcaacctgacgtacctggaggaggacttcagcatccgcaaggacatctccccggacaacttcaaggacctcaagagcatcgagaaggtgatcgaccaaggggtgaagcggatcctgatcaaacgcttgcaggcctacgacaacgaccccaagaaggcgttcgtcgacctcgagaagaaccccatctggctgaacaaggagaagggcatcgcgatcaaacgggtgaccatctccggcgtgaacaacgcccagccgctgcacatcgggaaggaccacctcggcaagaccaccctgaacaaggaggggaaggagatccccgtcgactacgtgagcacgggcaacaaccaccacgtggccatctaccgcgacaaggaggggaacctgcaggagcagatcgtctccttcttcgacgccgtggtgcgggcgcagcagggcatccccatcatcgacaagacctacaagcaggcggagggctggcagttcctcttcacaatgaagcagaacgagatgttcgtcttccccaacgccaccacggggttcaacccggctgagatcgacctgctcgaccccaaaaacaagaagctcatcagccccaacctattccgcgtgcagaagatcgccaccaaggactacttcttccggcaccacctggagaccaacgtggagaccgacaacattctcaagaacgtcacgtggaagcgcgaaggcctgtctgggctgaaggacatcgtgaaggtgcgcatcaaccacctcggcgacatcgtaagcatcggggagtactga

SEQ ID NO: 7978 - RNA, 4281 nt, synthetic construct
  misc_feature 1..4281: note = Cas9 variant
  source 1..4281: mol_type = other RNA
atgaagaacatcctgggcctcgatctggggaccaccagcatcggcttcacgcacatcgtggaggacgagaacaaagagaagtccgagatcaaggagctgggggtccgcatcgtgagcctcaccaccgacgagcagtccgacttcgagaaaggcaagagcatctccaccaacgccaaccggacgctgaagcacggggctcgcctgaacctcgatcggtaccagcagcgccggaagttcctgatcgacctgctccagaaggcgaacctgatcaccagctccagcatcctggccgagaacggaaagaacaccacccactccacgtggcagctccgcgccaaggccgtaaccgagcggatcgagaaggaggagttcgcccgcgtcctcctggcgatcaacaagaagcgaggctacaagagctcccgcaaggccaagaccgaggatgaggggcaggccatcgacggcatggccattgcgaagcggctctacgacgagaacctgacccccgggcagctgagcctccaactgctgcagcagaacaagaagctcctgccggacttctatcgctccgacctgcagaaggagttcgatctcgtgtggaacttccagaagcagttctaccccgacatcctgacggacagcttctacaaggagctgcagggcaaggggaaagacgccaccagcaaggccttcagcaagcggtaccacttcgacaccgccgagaacaagggatcccgcgagagtgtgcggctccaggcctaccagtggcgcgcggaagccatctccaagcaactgagcaaggaggaggtcgcctacgtgttaaccgagatcaacaacaacctcaacaacgccagcggctacctgggggccatctccgaccggagcaaggagctgtacttcaaccgccagacggttggccagtacctctacgcccagctgcaggagaacaagcacaactccctgaagaacaaggtcttctaccggcaggactacctcgacgagttcgagcgcatctgggagacccaggccagcttccacaaggagctgaccgaggagctgaagaagcagatccgggacgtcgtgatcttctaccagcgcaagctcaagtcccagaaggggctgatcagcttctgcgagttcgagtccaaggagatcgagatcgagaaggacggcaagaccatcacgaagtccatcggcgcccgcgtcgtgcccaagtccagccccctgttccaggagttcaagatctggcagatcctcaacaacgtaacctgtaagcggaaggggatccgcaagaagaagtccagcgccaagtccaccgagctggacctgttcaacgagccgagccagaccatcttctccctcgacatggagtgcaagcaactgctgttcgaggagctcaaccttaagggcgacctcaagtccgacaaggtcctgaagctcctggggtacagcccccaggagtgggagatcaactacaaccagctggagggcaaccggacgcagaaggccctctacgaagcgtacctgaagatcgtggagatggaggcccacgacgttaaggacatcctgcagatcaagagcaccaaggacgactgggccctcgaggagagccccctgagcgccagcgaaatccgcgaacgggtcaaggcgatcttccagaccctggggatctgcaccaagatcctctacttcgaccccctgctgccggtgaaggagttcgaggagcaggactcctaccagctctggcatctcctgtacagctacgagtccgacgatagcacgtctggcaacgagaccctgtatcgcatcctagagaagaagtacgcgttcaagcgggagcacgccaccatcctggccaacgtgaccctccaggacgactacggcagcctgtccacgaaggccatccgcaagatctacccctatatcaaggagaaccagtacagcaccgcgtgcgagaaggccgggtacaagcactccaagttgagcctcaccaccgaggaactggaggcccgtgagctgaagaacatcatccccctcctgaagaagaacgccctgcgcaaccccgtcgtggagaagatccttaaccagatgataaacgtggtcaacgcgctaatcgagaaaaactccgagcgggacgcggagggcaagatcacgaagtacttccacttcgatgagatccgcatcgagctggcccgggagctcaagaagaacgcccaggagcgctacgagatgacccagaacatcaacaaggccaagctggaacaccagaagatcagcgggatcctgcagaaggagttcggcatcaagaacccgaccaagtccgacatcacccggtaccgcctctaccaggagctggcccacaacgggtacaacgacctgtacaccaacacgtacatccccaaggagctcctgttcagcaagaacatcgacatcgagcacatcgtgtccaaggcgcgggtcttcgacgacagcttctccaacaagaccctggccttccgcgagttcaacatcaagaagggcgagagcacggcgttcgactacatcaccagcctcaacaacgaggaggagttgaatcagtacctgaaccgggtggagaacgcctacaagacgaagaacatctcccccgcaaagtacaagaacctcctgaagaaagcgagcgagatcggcgacgggtttatcaaccgcgacctgcgcgacacccagtacatcgccaagaaggccaaggagatcctcttccaggtgaccaagaacgtcctgtccaccagcggctccatcacggaccggctgcgcgaggactgggggctcgtggacgtgatgaaggagctgaacatgcccaagtatcagagcctgggcctcaccgaggtcgaggagcggaaggaggggaacaaggtgaccgtgatcaagaactggaccaagcgcaacgatcaccggcaccacgccatggacgcgctgacggtcgcattcaccaagccgtcctacatccagtacctgaaccacctcaacgcccgcaaggacaagaacaacaagaactacagcgtgatcctggccatcgaggagaaggagaccatcaaggtgccaaccaacaatggcaagaacaagcgggtcttcatcgagcccatccccaacttccgccaggtggccaagaagcacctggaggagatcttcatctcccacaaagcgaagaacaaggtggtcacgaagaacaccaacaagccggccggcaccgacaagcagcagatcaccctcacgccccgggggcagctgcacaaagagaccgtgtacggcaagtaccagtactacgtgaacaaagaggagaagatcggggttaagttcgacaaggagaccatcgccaaggtgagtaaccccgtgtaccgcgaggccctgctcaagcggctgcaggcgaacgacaacgaccccaagaaggcgttcgccggcaagaacgccctgtccaagaacccgatctacctcgacgaggccaagaccaagacgctgacggagaaggtcaacctgacctacctcgaggaggacttcagcatccgcaaggacatctcccccgacaacttcaaggacctcaagagcatcgagaaagtgatcgaccagggcgtaaaacggatcctgatcaagcgcctgcaggactacgacaacgaccccaagaaggccttcgtcgacctggagaagaaccccatctggctaaacaaggagaaggggatcgccatcaagcgggttaccatctccggtgtgaacaacgcccagccgctccacatcgggaaggaccacctgggcaagacgaccctgaacaaggaagggaaggagatccccgtcgactacgtgagcaccggcaacaaccaccacgtggccatctaccgcgacaaggagggcaacctccaggagcagatcgtctccttcttcgaggccgtggtgggggcgcagcagggcctgcccatcgtcgacaagacctacaagcaggccgagggatggcagttcctgttcacgatgaagcagaatgagatgtttgtgttcccgaacgaggccaccggcttcaaccccgccgagatcgacctcctggaccctaagaataagaagcagatctctcccaacctgttccgggtgcagaagatcgccaccaaggactacttcttccgccaccacctcgaaaccaacgtcgacacggacaacgtgctgaaaaacaccacctggaagcgggaggggttatccggcctcaaagacattgtgaaggtccgcatcaaccacctgggcgatatcgtgagcatcggggagtactga

SEQ ID NO: 7979 - RNA, 4284 nt, synthetic construct
  misc_feature 1..4284: note = Cas9 variant
  source 1..4284: mol_type = other RNA
atgaaaaagatcctgggcctcgaccttgggaccagcagtatcggctgggcccttgtgaacgaggccgagacgagcgaggaaaaatccagcatcatcaagctcggggttagagtgaaccccctgacggtggacgaactgcagaacttcgagaagggaaagtcaatcaccaccaacgcggatcggaccgccgggcgctctatgcggcgcaacctccagcggtacaagctgcgccgggagaacctgatcgaagtcctcaaggagtataacttcatcactgacgagatgatactgtccgagaacgggaaccgcaccaccttcgagacctaccggctgcgcgccaaggctgccgtggaggagatcagccttgagcagttcgcgcgggtgctgctgatgataaataagaagcgcggctacaaatccagccggaaggccaagggcgccgagaacggcacgctcattgacgggatggaagtcgccaagaagatgtacgacgaaggcatcacaccaggtgagctgtgcctgcagctcctgaccgcggggaagcgctacttccccgatttctaccgttccgacctgcaggctgagttcgaccgaatctggaacttccagaagcagttttaccccgacagcctcatcgacaaggtaaaggatgaggtgcggggcaagaacaagtcccagacatgggcaatcctggctaagtactttgtctggaaagaggtggagaacagctggaacgaagaggaggcccagacgagacgggtggaaaaggaataccgcctggtcgggatcaagcggggcgtgaagcgcgaggagctcaagttagagaacttccagtggcgcgtgaaagcactgtccgaacggatgaaccccgaggagctcgcaatcgtcctacaggagatcaatgagcagattagcaactcaagcgggtacctgggggccatctccgaccgcagcaaggagctctacttcaaccggcagaccgtgggccagtatcagatggccgtgctggacaacaatccgaacatcgggttgcgcaacatggtcttctaccggcaggactacttagacgagttcaacaccatctgggagaagcaggccgagttccacaaggagctaacagaggacctgaagaaggagatacgcgacatcgtgattttctaccagcggcgcctcaagagccaaaagggcctgatcaacatctgcgagttcgagcggcgccagatcgaggtcgagatcgatgggaagaagaaaatcaagacgatcggctcccgggtcatcccccgtagcagccccctgttccaggagttcaagatctggcagactctgaacgacatcgaggtgtccgtgctgggcgtaaagaataagcggaagaaacaggacgacaactccactaccctgctcgacagcgcggagaatatcgactctctgaagctgaacgtcagccgccccctcgacgcggacgaaaagtccctgctggccaaggagctgttcatacgagacaaacttaccaagtcagacgtgcttaagctcttattcaacaacccgcaaaacctgaacctaaacttcaaaaacatagacggcaacagaacaggcagtgccttgtatcaggctttctcgaagatcctcgagatctccggacacgagagcattaacttcaagaaatccgcggacgagatcgtggagcaggtcaagaccatcttcagcgccctcggctggaacaccgaggtgctctgcttcgactcagagaaggagttagacaagcagccctacttcaagctgtggcatctactttacagcttcgaaggggactccacgcccaccggcgacgggaatctcatccagaagatcgccgatctctgcggcttcgagaaggattacgccagcatcctggccaacatcacctttcaggaggactacggctccctgtccaccaaggcgatccggaaaatcctcccccatctgaaggacgggaaccagtacgacgtcgcctgcgagtatgcgggatacaagcatagcaaatccagcctgaagaaggaggaaatcaagaacaaggtgctgaaggacaagctggagctgctcccaaagaactccctgcgcaaccctgtcgtggagaagatcctgaaccagatggtgaacgtcatcaacgccatcatcacgacctatgggaagccagacgaaatccggatcgagctcgcacgcgagctgaagaagaacgccaaggagcgcgaggaactgaccaagagcatcgtagacaccacgaagacccacgagggaatccgggccatcctccagaacgacttcgggatgtcccacgtgtctcgcaacgccatcatccgatacaagctgtacgaggagctgaaggacaacgggtataagacactctactccaacacctacatccctaaggagaagctgttcagcaaggatttcgacatcgagcacattatcccgcaggccaggttgttcgacgactccttcagcaacaagacattggaggtcaagtccatcaacattgagaagggcagcaagaccgcgtacgacttcgtggaggagaaatacggggagcagggcctgcaggagtacctcaaccggtgcgaggttctcttccgcgacaaaaagaccaagctgcgaaagctgaaaatgcaggagagtgagatccccgaggggttcatcgatcgagacctccggaacacccagtacatcgccaagaaggccctgagcatgctgaacgagatctgtcgccgggtggtggctaccacgggcgccatcaccgatgagctccgcgaggactggcagctggtggacgtaatgaaggagctgaactgggagaagtacaaggtgctgggcctggtggagtacttcgaggacaacgacggacggctgatcggccgcatcaaggactggaccaaacgcaacgatcaccgccaccacgcgatggacgcccttaccgtcgcctttacgaaggacgtgttcatccagtacttcaacaacaagaatgcctccctgaagccggacaccaacgaggccgcgattcgcaacaagtacttccagaacgggaaggccataccacccatgagcctggacgagttccgcgcggaggcgaagaagcacctcaacgacaccctgatcagcatcaagaccaagaataaggtggtcacgatcaacctgaaccggactaagaaaaagaacggcataaacaagaaacagcagcagacgccacgcgggcagctccacctggagaccgtgtatggctcccacaagcagtacgtagtcaaggaggagaaagtgaatgcgagcttcgacgccgcgaagatcgctacggtgaacaagcctgcctacagggacgcgctgctccgccgcctgcaagagaacggcaacgactctaagaaggccttcaccggcaagaacagcctggacaagcagccggtctggctcgacgccaagcagaacgagtgcgtcccggagaaggtgaagaccgtcatgctagagaccgtgtacacggtgcggaagcccatcgacgagaaacttaacgtcgacaaggtagtggacgcgcgaatccggaagttactgcaggaccgcatcaaggagtacggcaacgccaagtccgcgttcgccaacctggacgagaatcccatatggctcaacaaggagaaggggatcaccatcaagcgggtcagcgtgtcagggatcagcaaggcccagtccctgcacgaaaagaaggacaaggatgggaacttcatcctggacaaggactcccgccggatccccgtggacttcgtcaacaccggcaacaaccaccacgtcgccatctacaggaagcccgtgctcgacaagaagggccaggccgtgttcgacgagaacggggagctgaagttcgagctggaggaagtggtggtctcctttttcgacgcagttacgcgggtgaacctctcccagcccatcatcgacaaggactacaagcgatccgagggatggaagttcctgttcagcatgaagcagaacgagtactttgtcttccccaacgagaagacggggttcgacccgaaagagatcgacctgttaaaccccgagaactacgccttgatctcccccaacctgttccgggtgcagaagatcgccagcaaggactacgtcttccgccaccacctcgagaccgtggtggcggacaggaaggagctgcaagagatcacctggaaacgcatatccagcctgtccattttaaaccgtatcatcaaggtccgcgtgaaccacatcggacagatcgtgatgatcggggagtactga

SEQ ID NO: 7980 - RNA, 4284 nt, synthetic construct
  misc_feature 1..4284: note = Cas9 variant
  source 1..4284: mol_type = other RNA
atggccaagcccaaggactacaccatagggctggacatagggaccaacagcgtgggctgggtcgtgacggacgaccagaacaacatcctccgcatcaaggggaaaaaggccatcggagcgcggctgttcgccgaggggaaggtggctgccgagcgccggtccttccgcaccacccggcgccggctgagccgcagacgctggcggatcaagctcctggaggaactcttcgacaaggagatcgccaaggtcgacccgtccttcttcgcgcgcctccatgagagctggatctcccccaaggacaagaggaagcgctacagcgccatcgtgttcccctcccccgaggaggacaagaagttccacgagtcctacccgaccatctaccacttacgagacaagctgatgaaggacgaccaaaagcacgacatacgcgagatctacatcgccgtgcaccagatgatcaaggcgcggggcaatttcctccatgacgagtccgtcgagacatatcgctcaggcatgtccagcctcgggggccggtccgagcgcaccatcctgagcgtgcagacactggaggagctgaacgacttgttcgctgagaacgaggggaccgaggaggccaagctcaacgtggcctcagccgagcagatcaacgacatcctgaccggtgggcacctgaacgccgatagccagaaggagatcggcaacctcctgctgccatccagcttcccctccttcgacgacaaggcgaaggaaaagcaggtcaagaagctcatcaagaacgtggccaccaacatcagcaaggcctggctaggctacaaggccgacttcagcaccatcctgaacctcgccaacgtggataaggaccaaaagaaaatctttgcctttgccctgcagggcggggacgaggaggacaaagtccaggagctggagtccctcctggagcagagccagaccgacatcgtggaccggctgatcgagatccgacacgcgatcgtgctcagtgagatcgtccccgtggggatgacgctgagcgaagccatgatcgacaaatacgaccaacataaggaggaccttatcaccctcaaggccgtgatccgcaataccaaggacaagaagaaggcggccaagctgcaagccatctacgacctgtacgtcaataaccggcacgccgatctcgcgaaggcgatgaaattgaccggcatcaagaagcgctccgaactgctcgacccggaagaactgaagaaggccatcagctccttactcgacgactcacccgaggccgtggagatcaagcagatgctagaggagaagacgttcctgcccctccagcggtccaataacaacggcgtgatccccaaccagctgcaccaggtcgagctagacgagatcataaagaagcagagcaagtactacccgttcctcgccgagaagaaccccgacgagtccgaggaagcgcagaagaaggcccccaccaagctggatgccctgttaaccttccgcgtgccttactacgtggggccgatgatcaccaaagaggagcaggaggcccaggacggccacagcttcgcctggatggtacggcgcgacccccaggaccatgaggcgatcacgccctggaacttcgagaagaaggtggacaaaatggccagtgccacgcaattcatcaagcggatgaccaccaaggacacgtacctcctgggggaggacgtcctgcccgccagctccctcaagtaccagctgttcaccgtactgaacgagctcaataacctgcgagtaaacggcaagaagctgacctcggacgagaaggaacaggtcatcgaggggctgttcaagaagcagaagaccgtcaaggccgacaagttcgtgaagtactggcaggcgaagcacatcggcgccgacatcaaggtcaagggtctgtccgacccgagtaagttcaattccacgatgagcacctacattgatttcaagaagatcttcggggatcagctgaacgatgtgaatagacagaacgacttcgagaagatcatcgagtacagcaccatcttcgaggaccgcaagatcctcgaggacaagctgcgggccgacttcgcctggttgtccgaggagcagatcaagcagttgtgccgcctgcggctgcaaggctgggggagactcagcgacaagctgctgacccggctcacggacgccgacggccagaatgtattagaacgcctgtggaactccaatgacaacttcgtgcagatcgtgagcgatcccaacatcaaagcgaagatcgaacaggagaatcagaagctcctgcgggatgggcagtccgacgacgcagtggagagcatcctggacgacgcgtacaccagcccccagaacaaaaaggccatccgccaggtcatgcgggtggtgcacgacatcgtcaaagcgtgcgacggaaacgtgcccgccaagttcgccattgagttcgcccgcagccaagaagacgacccgaagcgcaccaccgcccgggtgaaccagatgcagaaaatctacgatcaaatttccgacgaagtcgtgagccagggcgtgaaggagcagcttagcgggatgaagtccctgaaggaccgctactacctgtacttcatgcagggcgggcgggacgcttacacgggcgccaagctcaacatagaccgactgtccgactacgacatcgaccatatcatgccccagagttttgtcaaggacgattccctggacaaccgtgtgctcgtggcccgcgccgtcaataatcagaagtccgacaaagtgcccgccttgctgttcgggaacaaggtggtcgcagacctcggcatcacggtgcgggagatgtgggacaagtggcagaagctggggatgatcagcaagcgcaagctcagcaatctcctgaccgaccccgacgccctgaccgagtaccgggcccaggggttcatccgccggcagctcgtggagaccagtcaggtcataaagctgacggccacgatcctgcagtccgagttcccggattctaagatcatcgaggtgcccgccaaatacaactccatcgtgcgcaagcagttcgacctctacaaaagccgggaggtcaacgactaccaccacgcgatcgacgcctacttatccaccattgtgggcaactacctgtaccaggtgtaccctaacctccgccggatgttcgtctacggagagttcaagaagttcagctccaacgccgaggaaagcgcctacgacgttgtgagacgggtcaagtcgatgaatttccttgacgacctgcttcgcgggacccacggcgacaacatctactgcaggagcacgggggagatcgtgtttaaccgcaatgacataatctccaagttgaagcaggcttacagcttcaagcagatgctggtgacccaggaggtcttcaccaaaaagtccgccctctttgaccagaccgtgtacccgtctcccgagcgggattccaagaagcgtagcggtctgatcccgcgcaagaaggggatggacacggaaatttacggcgggtactccggcaacaaggatgcctacttcgtgctggccgaggccgtaaaggagaagggccacaccctccaaatcgtgggggtgcccatccgggcgctgaacaccctgaagaacagcgccaactactccgaaaaattactggagataatcaaaccccaagtcatgttcaataaggacaccggcaagcccatcaaagggattaaagacgttaagatcctgatggacaagatcccctgcagacagcccgtgctcgagggcgagagctactacatgctggctagctcgaagtaccgctatagcctgaagcaaatctcactaagccagatgtcaatgaagtacatcctggactacatcgacgacccgaacttcaacaagcatgagatgatcaacatcgaccaacaagacgagaaggagtgcttactcagcgtctacgacgagatcctggagaagatggataagtacttaccactcttcgacatccgctccttccggaagaagctgcacgacgggcgtgacgccttcatcgccctacccgtcgcgtcggaagagaagaagcccggtaaggtcgacgtgatccggaaggtgctcaagggcctgcacgccaacgcagacataaccaacctagctgagctcgggttcggcacggcagctttgggggccttagtctccaccggtgggatcaagatcagtgacgacgccgtcttcatctaccagtccccgaccgggttattcgagcgccgggtgaaggtcagcgacctactgaagtga

SEQ ID NO: 7981 - RNA, 4287 nt, synthetic construct
  misc_feature 1..4287: note = Cas9 variant
  source 1..4287: mol_type = other RNA
atgaagaaaatactgggcctcgacctggggaccactagcatcggctccgcctacgtgctggaggccgagaaatccgcggagcagacgaaaatcgtctacttggggacccgcattatcctgtccagcgccgacgcggagaacttctccaagggcctgagctgctcaccaaccaccgaccggactttcaagcgcagcatgcggcgccggctccagcgctacaagcagcggcgctcatcgctgatccagcagttcaagaagatcgggatcatcaccaacaccgagcagatcatccgggagccgatctccgagacccacgaactgctccgcatccggagcaaagccgtttccgagcgggtgtcgctggaggagttcgcccggatcctgcttacgatcaataagcgccggggctacaagtccaaccgcaagaccagcaagtccaccgaggaggacggcaagctggtcgacgctatggccgtgaccaaggagctgatcaagctcaagaagacgcccgggcagtacatgttcgagcggttcaagcgcggcaagtacgccgagatcgacttctaccccttcgacctgatcaacgagctgaagcaaatttgggaggtacaggggcagaagtaccccgatgtcctcaccgaggacctgctcagctccctcctgaagcagaagaccggcaaggccaaggagctgatctactcgaagtccgacctcaatccggcggaggtgccgatcgactaccagaaggggaaaaagctgcggaagaccatcctgaacaagtacttcgcctacgagtcccgaagcctcgccgccacgaacatcatccccgtggaacaagttatcaccgccatcgtggcgatctgcaagcagatcaataactccagcggctacctaggcgcaatcggggaccggtcccgcgtgctgtatgccaataaccagaccatcggccagtacctctacgagcgcatcaaggccaacccccatgaccggatccgcggggaggtcttctaccggcaagactacctggacgagttcgaccgcatctgggagtgccagcagaattactacccggccatcctgaccaacgaccggaagcagttcatccgcaaccggatcatcttctaccagcgcccgctcaagagcaaaaagtccgagctggcattctgtgagttcgagagccgggaggtggagcataacggcaaaaagtatacggagggcctgcacgtggcccccaagtccagccccgtcttccaacacttccgcctctggcagcggctggggcagatcgaggtgtccccgctgcgcaagtggaacaagcagagcaacgagctgttcgagcagcagaacgacaccgatcaggagcggatcctgaacaccgaggctaagcagaagctgttctcatacctcaacttactggaccacctcaccgataacgagatcctgaacatcttaggctacagccccgacaagtggaagatcaacttccgcgaaatcatcgggaaccggaccaacaactccatgatgaaggccttcttcaacatgaaggagatgaccgacggcgagcagatcaactgggaaaagaacctcaccaagattaccaacgggcagtcactgatctctcccgagcagatcgttgacctgatccgccagttcttcgagcgggagggcataacgaccagcctgctctatttcgaccccaccaccgacaacttccgcgagcagtcccactacagcctgtggcacctcctttacagctacgaggacgacaactccccgacgggcacgaccagcctgtgcaagaccctggccaagcggtacgggatcccccatgagctctgccccctgctggcgtccctcacgtttgagccccagtacggcagtctgtccaccaaggccatgaggaagatactgcccttcatgcaggagaacgggtacgacaaggcctgcgagctcgccggctatcgccacagcgcctggaccaccaaggaggagaacaccgaacggacgctgaagaactccctgcccctactgcgcaaggggagccttcggaaccccgtcgtggagaagatcctcaaccagatgacccacgtaatcaacacccacatctcagagtacggcaaccccgacgaaatccgcatcgagatggctcgggacatgcaggccaacagcaagcagcgcaaggccatgaccacggccatcgcggaggccaccaagcggaacacccaattcatcgaggagatccagaaggagttcggcttcaatccgtccaagaacgacctgataaagtacaagctgtggaaggagctcgcgcccctggggagcaagaccctgtattccaacacgtacatccccaaggaggaactgttcaccgccaagttcgagatcgagcacatcatcccccgcgccctgttctacgacgacagcttctccaacaagaccctggagctcaactcagtcaacaaactgaagggcaacaagaccgcactggactacatggatacgctctcccaggagcaggccaacgactacatcatccgggtggaggaactgaagaagatcggggccatcacccaggccaagtacaagaagctactcatccgcgagaaggacctgggcgacgattttactaaccgggacctgacgaatacgcgctacatcatcaggcacgccgcggacatgctcctacaggtgaccccgagcatcgtccacaccaacgggagcatcaccgccatcctgcgccgggactgggagctcctggacatcctgaaggagctcaacctgcccacgtatgagtccatcgaccgcaagatcagcgatcccaaggagaagctgaccgagtccgtggagcggaaggacggccaggccattaagatgatcaaggactggagcaagcgcgacgaccaccggcaccatgccatggacgccctcatcaccgcgctgaccacgcgcaagcacgtccaatacttaaacggcaaccgcggggccgaggagaccgacaaggtgcaaaagctccagcagctgaaggccctgcggaagcagctcatcggctccgacgggcacttcatcccgcccatgcatgacatccgcgtgcaggccaaggaggcgctgtcccgggtcatcatctccaccaaggccaagggcaaggtgacaacgccgaacaccaacatcatctgcagccgcgacaagacgaccggccggaagatctacgtgaagcagacgaccctgacgccccgcggggccctccacaaggagatgcagtacggctgcaaccactactacctggagaaacagatcccgatcgggtccaagctgacagaggaggagatccggctcgtcagctcgcccaaaatccgcagcatgctgtccgagcggcttcaggcctacaacaacgaccccaagagcgccttcaccggccgcaactccatggacaagaagccactcgaggacaagaacaagaaactggtgtacaccgacaagaaggtgaagcagactattctggcgaaccggttcgtcaaacgagaccgggtcaacagcaagctggacttagacaaggtgatcgacaccgggatcaagcgcatcctggaacggcgcttaaagcagtacggcggcaagtacgagaccgccttctccgacctggagaacaacccaatctggctgaacgaggagaaggggattgcaatcaagagcgtccggatccgcggcaagaacaacaccatcaccatccggcaaaccaacacgtgccgcatcaagtacgtggccaacgacaacaaccaccacctcgccgtgtacgcgctgcccgacggttccatcgaggacgacatcgtcagcttcttcgacgccgtggagcggagtcgcaagggcttgcccataatcgacaagcacaagaaccagtccctcgggtggaagtttttattcagcgtgaagcaaaacgagtacttcctgctcccccaacagggcgagaagatagacatcgacaccggcgagatctccatgcagaccacatttagcccgaaggacctgtcccccgagtacatcatgaaccccgacaactacgccgagctggcgccccacatcttccgcgtccagagcatatccaagacaccgcaggggaacagggacgtgcgcatctacctcttcaagcagcagtacataagcggctcccagaaggacagcctgcacctgaaggggatcacgcaccggcagatctccagcgccaaggacctcgccgggctggtgaagatccgggtcaaccacctgggtcggatcgtggccgtgggcgagaagtga

SEQ ID NO: 7982 - RNA, 4287 nt, synthetic construct; identical to SEQ ID NO: 2182
  misc_feature 1..4287: note = Cas9 variant
  source 1..4287: mol_type = other RNA

SEQ ID NO: 7983 - RNA, 4287 nt, synthetic construct
  misc_feature 1..4287: note = Cas9 variant
  source 1..4287: mol_type = other RNA
atgaccaagaaaatactgggcctcgacctggggaccacgagcatcggctgggcctacgtgatcgagtccgacaaccccgacgagagcgagatcaagcagatcggggtacgcgtgaacccgctgaccaccgacgagcagaccaacttcgagaagggcaagcccttctccatcaacaaggagcggacgttgaagcgtggtgcccggcgcaatctggaccggtacaaggaccgccggaacaacctgatcgaggtgctcaagaaggcgaacatactgagccaggactccatcctgaccgaggagggccagcacaccacccaccagacctggcagctccgcgccaaggccgccgtcgacaagatcgagaaggaggagttagcccgggtgctgctcgcgatcaacaagaagcgcggttacaagagctcccggaaggccaagaacgaggacgaggggcaggccatcgacgggatggccgtggcgaagcgcctgtacgacgagcagatcacgtgcgggcagctggtctaccagcttctgcgggagggcaagaagtccatccccgacttctaccgctccgacctgcaggccgagttcgacaaggtgtggaacttccagaagcagttctaccccaagattctcaccgacgagttctacaaggagctgaaggggaagggccagcgggccaccagcgccctgttctacaagacctacaacttcaacaccgccgagaacaagggctcccgcgaggagaagaagatccaggcgtacaagtggcggagcgaggccatctcccagcagctcgagaaggaggaggtggccttcgtcctgaccgagataaacaacaacctgaacaacagctccgggtacctcggcgccataagcgatcgctccaaggagttatacttcaacaagcagaccgtggggcagtacctgtaccagcagctccaggagaaccggcacgcccgcctgaagaaccaggtgttctaccggcaggactacctggacgagttcgaggcgatctggaaggagcaggccaagcaccacacggagctcaccgaggagctgaaggccgagatccgcgacatcatcatcttctaccagcgcaagctcaagagccagaagggcctgatctccttctgcgagttcgagagccgggagatccagatcgacggcaagaagaagaccatcgggctgcgcgtcgcccccaagagcagccccctgttccaagagttcaagatctggcagaacctcaacaacgtgctggtccggaagaagggcagccgaaagcggaacgtcaagcaggagatccaggggtccctgttcgaggaggagaaggagatcttcgtgttcgacctcgagaccaaggagaagttgttcgaggagctgaacctcaagggcaacctgagcgctaacaaggtgatcgagctgctcgggcacaagcccacggagtgggagatcaactactccgcgctggagggcaaccgcaccaaccaggccctgtacaacgcatacctcaagatcctggacatcgagggctacgacgaggacctgctgaagctcagcgacaaggacgacatcaacgtcgccgacctgaagacccccgcctccgagatcaagaacatggtgagggacatcttccaggtgctggggatcagcaccgacatcctcgagttcgacgcggagctggacggcaaggacttcgagcagcaggcctcctaccagctgtggcacctcctgtacagctacgagggggacgattcccagagcggcaacgagaagctgtacgagctcctggagaagaagttcgggttcaagaaggagcactcccaggtcctggccaacgtaacgctcagcgacgactacggcaacctctccagcaaggccatgcgcaagatctacccgttcatcaaggagaacaattactccaccgcgtgcgagctggccggctaccggcacagcaagcactccctcaccaaggaggagatcgagaaccgccccctggacgacaagctggagctccttaagaagaacagcctgcggcagcccgtggtcgagaaaatcctcaaccagatggtgaatgtcgtgaacagcctgctggagaagaaccgcaaggagaaccccgacttccggttcgacgagatccgcatcgaactcgcccgggagctgaagaagaacgccaaggagcgcgccgagatgaccacgaacatcaactccgcgaagaccgagaacgagaagatctttaagctgctccaggctgagttcgggcttaagaacccgacccggaacgacatcatccgctaccggctgtacgaggagctcaagaacaacggctacaaggacctgtacacgaacaagtacattccccgcgagatcctgttcagcaagcaggtcgacatcgagcacatcatcccccagtcccgcctcttcgacgacagcttctccaacaagacgatcgtgtaccgcgagaccaacctggacaagggcaaccagaccgccttcgactacatcgacagcaagtacggcaacgagaaggtggaggagtacatcctgcgcatcgaggccctccacgacgcctggaagaagaacaaggaggaaggaatctccaaggcgaagtaccagaagctgctgaagaaggagaccgagatcggcgacggcttcatcgagcgagacctccgcgagagccagtacatcgccaagaaggccaaggagatgctgttcaagatcacccggtccgtggtctcaacctccgggtccattaccgacaagctgcgcgaggactggggcctcatcaacatcatgaaagagctgaacttgcccaagtaccggtccctcgggttaaccgagatgcaggagcgcaagttcggccagaaagtggaggtgatcaacgactggaccaagcggaacgaccaccgccaccacgccatggacgccctcacggtcgcgttcaccaagcacaaccacatccagtacctcaactacctgaatgcccggaagaacgagaaccacaagctgcacaacaacatcatagccatcgagaacctcgagaccgagaccatgatcgacaacaacggctccaagcgccgggtgttcaaggccccgatgcccaacttccgccaggtggcgaaggagcacctggagaacgtcctgatctcccataaggccaagaacaaggtggtgacgaagaacaagaacaagatcgccgggaaggtcgccgcccaggagaccctcaccccgcggggacagctgcacaaggagaccgtgtacgggaagtaccagtactacgtgaacaaggaagagaagatcggcacgaagttcgacgaggagaccatcaacaaggttagcaatccccagtaccgcaagctgctcttagagcggctgtccgcgaacgggaatgacccgaagaaggccttcagcggcaagaacgccctcagcaagaaccccatctacctgaacgagaccaagaccgagacggtgcccgaggtggtcaagctgacctggctcgaggaggactactccatccgcaaggacatcacccccgacaacttcaaggacgagaaatccatcgacaagatcctggacgagggcgtgaagcggatcctgaagaagcgcctgcggaagaacgacaacgacccgaagaaggccttctcggacctggacaagaaccccatctggctgaacgaggagaagggcataagcatcaagcgcgtgaccatctccggcgtcaacaacgccgagcccctccactacaagaaggaccacttcgggaacgatatcctggacgagaagggcgacaagatccctgtggacttcgtgagcacggggaacaaccaccacgtcgcggtgtaccgcgacgagaagggcaatctgcaggagaacatcgtgtcattcttcgaggccgtcatccgagtgaatcagggcctcccgatcatcgacaaggcctacaaccagcacctggggtggcagttcctgttcaccatgaagcagaacgagatgttcgtgttccccaacgagaagtccggcttcaacccccaggagatcgacctcctggacccgagcaacaagaagaagattagccccaacctgttccgcgtccagaagatgtccaaggtgatctacgggaacagccccgtgcgggagtacgtcttccgccaccacctcgagaccaacgtggacgagaagaaggagctgaaggacataaccttcaagaacatcaagtccctcggctatttcgaggacatcgtgaaggtccggatcaaccacctcggggacatcgtgagcgtaggcgagtactga

SEQ ID NO: 7984 - RNA, 4293 nt, synthetic construct
  misc_feature 1..4293: note = Cas9 variant
  source 1..4293: mol_type = other RNA
atgaagcacattctgggcctcgacctggggaccaactccatcggatgggctgtggtcaaggaggcccagaatgacaacgaacagtccgagatcgtggacgtgggggtcagggtaaacccactgactacggacgagaagacgaacttcgagaagggcaagccgatcagcaccaacgcggaccggaccctcaagcgctccgcccggcgcaacctccaacggtacaagttacgccggaaggagctcatcgagctgctgaaggagcaccagctcatctcgacggacaccatactgaccgagaacgggaagggcaccacgttccagaccttggaactccgcgccaagtccgccaaggagaagatcagcctggaggagctggcccgggtgttcctcaccattaacaagaagcgcggctacaagagtagccggaaggcgaagaacgaggacgaagggcagctgatcgacggcatggaaatcgccaagcgcctgtacgaggaaaacctcacgacagggcagttatccctgcaactcttgaaagagggcaagaaatccctgcccgactactaccgcagcgatctccagttcgaactggacaaggtctggaacttccagaagcagttccactcagacatcctgaccgacgagttctacgcccagctcaagggtaagggccagcgcgccacctcggcgctgttcctagccaagtaccagatctacaccgccgaaaacaaaggatctagagaggacaagaagctccaggcctaccagtggcgcgtcgacgctctgtcgaaggagctgacgcgggagcaactcgcgttcgtgataaccgagatcaataacaatctgaacaacagctccgggtacctgggcgctatcagcgatcgctccaaggagctatacttcaataacgagaccgtcggggagtacctgtggaagcagatcgccgccaacccccacaccagcctgaagaaccaggttttctaccggcaggactaccttgacgagtttgagcagatctggaagacccagagcgctttctatccagagatcctgaccgacgagctgaagaaggagctccgcgatgtggtcatcttttaccagcggaagctgaagtcccagaagtccctggtgagcttctgcgagttcgagaacaaggagatcgagatcaagaaggaggacggcaccagcaccaagaaggtgatcggcctcaaggtggcgccgaagtcctctccgttattccaagagttcaagatctggcaaaatctgaacaacgtgctcatccgcaagaaggggtcaaagacgaagaaggtcgccaagaaccagcaggccgtgctgtttgaagaggagaagaccatcagcgagctggacctggaggcaaagcaggccctattcaacgagctgaacctgaagggcaacctcaaagcggactactgcctagagatcctggggtattcccccaaggagtgggagatgaactatagtgtgttagagggcaaccgcaccaacaaggcactgtacgaggcctacctgaagatcaccgacctcgaggggtacgacgccaagaatcacctgaaggtgaagctgaacaaggacgaggtcgagctcgacgaccttaaggtgcccgcctccgagatcaaggacatggtgcaggcgatcttcaaggaggccggcataaacacggatatcctgcacttcaacgccgagctcgacggcaaggacttcgagaatcaggcctcctaccagctgtggcacctcctgtactcctacgagggggacgacagcaaatccggcaacgagctgctgtacaagctcctggaaaccaagttcggtttcaagaaggagtacgcacagatcttagccaatgtcagcctctccgacgactacggcagcctgtccaccaaggcaatgcgaaaaatccatccgtacatcaaggagaacaagttcagcaccgcctgcgagctggccgggtaccggcacagcaagcactccctcacgaaggaggagaacgacaacagggtactgaaggactctctggaggtcctcaagaaaaattccctgcgccaacccgttgtggagaagatcttgaatcagatgatcaacctcgtcaacgcgctgctcaagaaataccggaccgagaaccccaacttcaagttcgacgaaatccgcattgagctcgcccgggaactgaaaaagaacgccgaggagcgcgccaacatgaccgccaacatcaacaaagcgaaaaccgagcacgagaagatcatcaagatcttgaaaaacgagttcggcctccccaaccccacgcggaatgacatcatacgctaccggctctacgaggagctgaaggccaacgggtacaaggacctctacaccaacatcaagatcccccaggagaaactgttcacaaaagagatcgacatcgagcacatcatccccaagagcagggtattcgatgactctttctctaacaaaaccctctccttcagaaagaccaacctcgacaaaggtgagaggacggccttcgactacatggagagcaagttcggggccgacaagctggaagagtacgtggctcgggtcgaggacctgtacaagaacaacatcatctccaaggcgaagtaccagaagctcctgaagaaggagagcgagatcggcgacggcttcgtggaacgcgatctgcgggagacccagtacatcgccaagaaggccaaggagatcctcctgcagatcacacccaacgtactgtcaaccagcgggggcatcacggaccgcctcagagaggactgggatctgatcaacgtcatgaaggagctgaatttaccgaagtacagagctctgggtctgacccaaatggaggaccgcaaatacgggcaacaggtggaagtgatcaccgactggaccaagcggaacgaccaccgccaccacgcaatggacgccctgacggtggctttcaccaaacataatcacatacagtacctgaactacctgaacgcccggaagaatgagaagcataaggagcacagtaacatcatgggcatccagcagctcgagaccatcaaggtgaccgacaagaacggcaacgagaaacgcgtgttcaaagccccaatgcccaacttccggcaggtcacgaaggcgttcctggaaaacattctgatcagccacaaggccaagaacaaggtggtgaccaagaacaagaacaaggtcgcaggctccaacaaggtgcaggaggtgctcacgccccgcggccagctgcacaaagagactgtctacgggaagtaccagtattacgtgcagaaggaagagaagattggcgccaagttcgacttagagaccatcaagaaagtcgccaacccgctctatcagagcctgctgaagaagcggctcgaggagaacgggggcgaccccaagaaggctttcaccgggaagaactccctggccaagaaccccatctacctggacgacacccagaccgagcaactccccgagaaagtcaagctggtgtggctggagaacagcttctcaatccgcaaggacatcactccggagaacttcaaggacgagaaactcatcgacaagatcctggatgagggcgtgaagcgaatcctgaaggagcggctccagtcatttggcaacgacgccaagaaggccttcagcgacctggacaagaaccccatctggctgaacaaggaaaaggggatcaccataaaacgtgtcaccatctccggcgtggccaacgcggagcccctccacaccaagaaggaccacctggggaaggagatcctggataaggaggggaagcccatcccggtggatttcatcagcacaggttccaaccaccacgtggcggtgtaccgcgacgagaaaggcaacctccaggaaaaagtggtcagcgtgttcgaggccgtggtgcgggccaaccaggggctgcccatcatagataaaacctacaaccagcacctcggctgggagttcctctttaccatgaagcagaacgagatgttcgtgtttcccaacgagtccaccggtttcaaccccaacgacatcgacctgctggaccccaagaacaaacgcatcatctcacccaacctcttccgggtgcagaagttctctaagctgcagtacggaaacagcttcgtccgcgagttcgtgttccggcaccatctagagaccaccgtggaggaccgtaaggagctgcaggggataacttacaagcaaatgaagaactccaccttctttaacgacattattaaggtccggatcaaccacctcggggacatcgtaagcatcggcgagtactga

SEQ ID NO: 7985 - RNA, 4293 nt, synthetic construct
  misc_feature 1..4293: note = Cas9 variant
  source 1..4293: mol_type = other RNA
atgaagcacatcctaggcctggacctggggaccaacagcatcggctgggccgtggtcaaggaggcccagaacgacaacgaacagtccgagatcgtggacgtcggggtccgcgtgaaccccctgaccacggacgagaagaccaacttcgagaagggcaagccgatcagcaccaacgcggaccggactctcaagcgctccgcccggcgcaacctgcagcggtacaagctgcgccggaaggagctcatcgagctgctgaaggagcaccagctcatcagcacggataccatcctgacggagaacgggaagggcaccacgttccagaccctggagctccgcgccaagtccgccaaggagaagatcagcctggaggagctggcccgggtgttcctcaccatcaacaagaagcgcggctacaagtccagccggaaggcgaagaacgaggacgaggggcagctgatcgacggcatggagatcgccaagcgcctgtacgaggaaaacctcaccacggggcagctgtccctgcagctcctgaaggagggcaagaagtccctgcccgactactaccggagcgatctccagttcgagctggacaaggtctggaacttccagaagcagttccacagccacatcctgaccgacgagttctacgcccagctcaaggggaaaggccagcgcgccacctccgcgctgttcctggccaagtaccagatctacaccgccgagaacaagggcagcagggaggacaagaagctccaggcctaccagtggcgcgtcgacgccctgtccaaggagctgacgcgggagcagctcgctttcgtgatcaccgagatcaacaacaacctgaacaacagctccgggtacctgggcgccatcagcgaccgcagtaaggagctctacttcaacaacgagaccgtcggggagtacctgtggaagcagatcgccgccaacccgcacaccagcctgaagaaccaggtcttctatcggcaggactacctcgacgagttcgagcagatatggaagacccagagcgccttctaccccgagatcctgaccgacgagctgaagaaggagctccgcgacgtggtcatcttctaccagcggaaactgaagtcccagaagtccctggtgagcttctgcgagttcgagaacaaagagatcgagatcaagaaggaggacggcaccagcaccaagaaggtgatcggcctcaaggtcgctccgaagtccagccccctgttccaggagttcaagatctggcagaacctgaacaacgtgctcatccgcaagaagggatccaagacgaaaaaggtggacaagaaccagcaggccgtcctgttcgaggaggagaagaccatcttcgagctggacctcgaggccaagcaggccctcttcaacgagctgaacctgaagggcaacctcaaggcctactactgcctggagatcctggggtacagccccaaggagtgggagatgaactactccgtgctcgagggcaaccgcaccaacaaggcgctgtacgaggcatacctgaagatcactgacctcgaggggtacgacgccaagaaccacctgaaggtgaagctgaacaaggatgaggtcgagctcgacgaccttaaggtgcccgccagcgagatcaaggacatggtgcaggccatcttcaaggaggcgggcatcaacacggacatcctgcacttcaacgccgagctcgacggcaaggacttcgaaaatcaggccagctaccagctgtggcacctcctgtacagctacgagggggacgactccaagtctggcaacgagctgctgtacaagctcctggagaccaagttcgggttcaagaaggagtacgcccaaatcctggcgaacgtctccctcagcgacgactacggctccctgagcacgaaggccatgcggaagatccacccgtacatcaaggagaacaagttttccaccgcctgcgagctcgccgggtaccgccacagcaagcatagcctcacgaaggaggagaacgacaaccgggtgctgaaggactccctggaagtcctcaagaagaacagcttacgccagcccgtcgtggagaagatcctgaaccagatgatcaacctcgtcaacgccctgctgaagaagtaccggaccgagaaccccaactttaagttcgacgagatccgcatcgagctcgcacgggagctgaagaagaacgccgaggagcgcgcgaacatgaccgtgaacatcaacaaggccaagaccgagcacgagaagatcatcaagatcctgaagaacgagttcggcctccccaacccgacgcgtaacgacatcatccgctaccggctgtacgaggagctgaaggccaacggctacaaggacctctacaccaatgagtacatcgagaagcaggaccttttcaccaagaacatcgacatcgagcacatcatccccaagtcccgcgtgttcgacgacagcttctccaacaagaccctgagcttccggaagaccaacctcgacaagggggagcgcacggcgttcgactacatcgagtccaagttcggggccgacaagctggaggagtacgtcgcccgggtggaggacctttacaagaacaacatcatcagcaaggccaagtaccagaagctactgaagaaggagtccgagatcggggacggcttcgtggagcgcgacctgcgggagacccagtacatcgccaagaaggctaaggagatcctcctgcagatcacccccaacgtcctgtcgacctccgggggcataacggaccgactccgggaggactgggacctgatcaacgtgatgaaggagctgaacctgcccaagtaccgcgccctgggcctgacgcagatggaggaccgcaagtacgggcagcaggtcgaggtgatcatcgactggaccaagcggaacgaccaccgccaccacgccatggacgccctcaccgtggcgttcacgaagcacaaccacatccagtacctgaactacctgaacgcccggaagaacgagaagcaccgcgagcacagcaacatcatgggcatccagcagctcgagaccatcaaggtgacagacaagaacgggaacgaaaagcgggtcttcaaggctccgatgcccaacttccgccaggtgaccaaggcgtttcttgagaacgtgctgatctcccacaaggccaagaacaaggtcgtgacgaagaacaagaacaaggtcgcgggcagcaacaaggtccaggaggtgctcacgccccggggccagctgcacaaggagaccgtgtacgggaagtaccagtactacgtccagaaagaggagaagatcggcgggaagttcgacctggagaccatcaagaaggtggccaaccccctctaccagtccctgttgaagaagcgcctcgaggagaacggcggggacccgaagaaggccttcaccggcaagaacagcttggccaagaaccccatctacctggacgacgcccagaccgagcagctccccgagaaggtgaagctggtctggctggagaactccttcagcatccggaaggacatcacccccgagaacttcaaggacgagaagctcatcgacaagatcctggacgagggcgtgaagaggatcctgaaggagaggctccagagcttcgggaacgacgcgaagaaggccttctccgacctggacaagaacccgatctggctgaacaaggagaagggcatcgccatcaagcgcgtagccatcagcggggtcgccaacgcggagcccctccacaccaagaaggaccacctgggcaaggagatcctggacaaggaggggaagtccatccccgtggacttcatcagcacgggcaacaaccaccacgtggccgtctaccgcgacgagaagggcaacctccaagagaaggtggtgtccgtcttcgaggccgtggtgcgcgccaaccaggggctccccatcatcgacaagacctacaaccagcacctcggctgggagttcctcttcaccatgaagcagaacgagatgttcgtcttcagcaacgagtccaccgggttcaacccgaacgacatcgacctgctcgaccccaagaacaagaagatcatcagccccaacctcttccgggtgcagaagttctccaagctgcagtacggcaacagcttcgtgcgcgagttcgtcttccggcaccacttggagacgaccgtggaggaccgcaaggaactgcaggggatcacctacaagcagatgaagaactccgcgttcttcaacgacatcatcaaggtgcggatcaaccacctcggcggcatcgtcagcgtgggggagtactga

SEQ ID NO: 7986 - RNA, 4293 nt, synthetic construct; identical to SEQ ID NO: 2186
  misc_feature 1..4293: note = Cas9 variant
  source 1..4293: mol_type = other RNA

SEQ ID NO: 7987 - RNA, 4293 nt, synthetic construct
  misc_feature 1..4293: note = Cas9 variant
  source 1..4293: mol_type = other RNA
atgaagcacatcctgggcctcgacctggggaccaacagcatcggctgggcctacgtgaaggaggccgagaacgacaccgagacatccgaaatcgtcgacctgggggtgcgcgtgaatcccctcaccaccgacgagaagaccaacttcgagaagggcaagccgatcagcacgaacgcggatcggaccctgaagcgctccgccagacgcaacctgcagcggtacaagctccgccggaaggagctgatcgagctgctcaaggagcaccagctgatctctgaaaacaccatcctgaccgagaacgggaagggcacgaccttccagaccctcgagctgcgcgccaagtccgccaaggagaagatcagcctgggcgagctcgcccgggtcttcctgaccattaacaagaagcgcgggtacaagtccagccggaaggcgaagaacgaggacgagggccagctgatcgacgggatggaaatcgccaagcgcctctacgaggagaacctgacgaccgggcagctgtccctccagctgttaaaggaggggaagaagtccctccccgactactaccggtccgacctgcagttcgagttagacaaggtgtggaacttccagaagcagttccacagcgacatcctcaccgacgagttctacgcccaactgaagggcaagggccagcgcgccacctccgcgctgttcctcgccaagtaccagatctacacggccgagaacaaggggagccgggaggacaagaaacttcaggcctaccagtggagggttgacgccctgtccaaggaattgacccgggagcagttggcgttcgtcatcaccgagatcaacaacaacctgaacaacagctccggctacctcggggccatcagcgaccgctccaaggagctgtacttcaacaacgagaccgtgggcgagtacctgtggaagcagattgccgccaacccccacacgagcctcaagaaccaggtgttctaccggcaggactacctggacgagttcgagcagatctggaacactcaggcccagttctacccccagatcctgaccgacgagctcaagaaggagctgcgcgacgtcgtgatcttctaccagcggaagctgaagtcccagaagtccctcgtcagcttctgcgagttcgagaacaaggagatcgagatcaagaaggaggacggcacctccacgaagaaggtcatcgggctgaaggtggcgcccaagagcagccccctgttccaggagttcaagatctggcaaaacctcaacaacgtgctgatccgcaagaagggcagcaagaccaagaaggccgccaaaaaccagcaggccgtcctgttcgaggaggagaagaccatctccgagctggacctcgaggccaagcaagcgctgttcaacgagctgaacctcaaggggaacctgaaggccgactactgcctggagatcctcggctacagccccaaggagtgggagatgaactactccgtgctggaggggaaccgcaccaataaggccctgtacgaggcctacctcaagatcacggacctggagggctacgacgccaagaaccacctgaaggtgaagctcaacaaggacgaggtcgagctggacgacctgaaggttcccgcgagtgagatcaaggagatggtgcaggccatctttaaggaggccggcatcaacaccgacatcctccacttcaacgctgagctggacgggaaggactttgagaaccaggcatcctaccagctgtggcacctcctgtacagctatgagggcgacgactcaaagagcgggaacgagctgctctacaagctgctggagaccaagttcggcttcaagaaggagtacgcgcagatcctcgccaatgtctccctgagcgacgactacgggaacctgtccaccaaagccatgcggaagatctacccgtacatcaaggagaacaagttcagcacggcctgcgagctcgcgggctaccgccactccaagcacagcctgaccaaggaagagaacgacaaccgggtgctcaaggacagcctcgaggtgctgaagaagaactccctgcgccagcccgtcgtggagaagatcctcaaccagatgatcaacctggtcaacgccctgctcaagaagtaccggaccgagaaccccaacttcaagttcgacgagatccgcatcgaactggcccgggaactgaagaagaacgctgaggagcgcgccaacatgaccgcgaatattaacaaagccaagacggagcatgagaaaatcatcaagatcctcaaaaacgagttcggcctgcccaacccaacccggaacgacatcatccgctaccggctgtacgaggagctcaaggccaacgggtacaaagacctgtacaccaacatcaagatcccccaggagaagctgttcaccaaggagatcgacatcgagcacatcatccccaagagccgcgtgttcgatgactccttcagcaacaagaccctctccttccggaagacgaacctggacaagggcgagcgcaccgccttcgactacatggagagcaagttcggggccgacaagttagaggagtacgtggcgcgggtcgaggacctctacaagaacaacataatctccaaggccaagtaccagaagctgctgaagaaagagagcgagatcggcgacgggttcgtggagcgcgacctccgggagacccagtacatcgccaagaaggccaaggagatcctgctgcagatcacccgcaacgtgctgtccacaagcggcggcatcaccgaccggctgcgcgaggattgggacctggtcaacgttatgaaggagctcaacctgcccaagtaccgcgcgctggggctcaccgagatggaggaccggaaatatggccagcaggtcgaggtgatcatcgactggaccaagcgcaacgaccaccggcaccacgccatggacgccctgacggtggccttcaccaagcacaaccacatccagtacctgaactacctcaacgcccgcaagaatgagaagcaccgggagcactccaacatcatggggatccagcagctggagaccattaaggtaaccgacaagaacggcaacgagaaacgcgtcttcaaggcgccgatgcccaacttccgccaggtcacgaaggccttcctggagaacgtgctcatcagccacaaggccaagaacaaggtcgtgaccaagaacaagaacaaggtggccggctccaacaaggtccaggaggtgctgaccccgcgggggcagctgcacaaggagaccgtgtacggcaagtaccagtactacgtccagaaggaggagaagatcggcgggaagttcgacctcgagacgatcaagaaggtcgccaaccccctttaccagagcctgcttaagaagcggctggaggagaatggcggggacccgaagaaggcgttcactgggaagaactccctggcgaagaaccccatctacctcgacgacgcacagaccgagcagctgcccgagaaggtgaagctggtctggctcgagaacagcttctccatccgcaaggacattacccccgagaacttcaaggacgagaagctgatcgacaagatcctggacgagggggtgaagcggatcctcaaggagcgcctgcagagcttcggcaacgacgccaagaaggcctttagcgacctggacaagaacccgatctggctcaacaaggagaaggggatcaccatcaagcgggtgaccatctccggcgtcgcgaacgccgagcccttacacaccaagaaggaccacctggggaaagagatcctcgacaaggagggcaagcccatccccgtggacttcatctctaccggctccaaccaccacgtggccgtctaccgcgacgagaaggggaacctgcaggagaaggtggtgagcgtcttcgaagctgtggtgcgggcgaaccaaggcctgccgataatcgacaagacgtacaacgagcacctcgggtgggaatttctgttcaccatgaagcaaaacgagatgtttgtcttccccaacgagtccacgggctttaaccccaacgacatcgacctgcttgacccgaagaacaagcgcatcatcagccccaatctgttccgggtgcagaccatctccgtggtcaagtacgggaacgccatcgtgcgcgacttcaagttccggcaccacctggagacgaccgtggaggacaagaaggagctgcagggcaagacgtaccagcagatcaagagcctcagccccctgaacgacatcatcaaagtccgcatcaaccacctgggcgacatcgtgagcgtgggggagtactga

SEQ ID NO: 7988 - RNA, 4293 nt, synthetic construct
  misc_feature 1..4293: note = Cas9 variant
  source 1..4293: mol_type = other RNA
atggcgcagaagtacattctgggcctcgacctggggaccaacagcatcggctgggccgtagtcaaggaggccgagaacgacaacgagcagtccgagatcgtggacgtgggggtccgcgtaaaccccctgaccacggacgagaagaccaacttcgagaagggcaagccgatcagcaccaacgccgaccggaccctcaagcgcggggcccggagaaacctccagcggtacaagctgagacggaaggagctcattaagatcctgaaggagcaccagttgatctccgacgatacgatcctggccgagaacggcaagggcaccacctaccagaccttgaagctgagagccaagagctctaaggagaagatcagcctcgaggagctggcgcgcgtgttcctgacgattaacaagaagcgcgggtacaagtccagccggaagaccaagaacgaggacgagggccagctcatcgacgggatggagatcgccaagcgcctgtacgaggagaacctgaccaccggccagctctccctgcagctgctcaaggaagggaagaagtccctgcccgactactaccggagcgacctggagctagagctggacaaggtctggaacttccagaagcaattccacagcgacatcctgacggacgagttctacacccaactaaaaggcaagggccagagggccacctccgccctgttcctggagaagtaccagatctacaccgtggagaacaaaggtaatcgggaggagaagaacctccaggcgtaccagtggcgcgtggacgccctgagcaaggagctgacgcgggaggagctcgccttcgtcatcacggagatcaacaacaacctgaataactcctcaggctacctgggggccatcagtgaccgcagcaaggagctctactttaacaacgagaccgtgggcgagtacctgtggaagcagatcgccgcgaacccgcacacctccctgaagaaccaggtgttctaccggcaggactacctcgacgagttcgagcgcatctggaacacgcaggctcagttctacccccagatcctgaccgagagccttaaaaaggagctccgggacgtagtgatcttctaccagcgcaagctgaaaagccagaagtccctggtgagcttctgcgagttcgagaacaaggagatcgagatcaaaaatgaggacggcaccaccacgaagaaggtcatcgggctcaaggtggccccgaaatccagccccctgttccaggagttcaagatctggcagaacctgaacaacgttctcatccgcaagaagggttccaagaccgagaaggtcgccaagaatcaacaggtcgtgctgttcgaggaggagaagaccatcagcgagctggacctggaggccaagcaggcgctattcaacgagctgaacctgaagggaaacctcaaagcagactactgcctggagatcctgggttattccagcaaggagtgggagatgaactactccgtgctcgaagggaaccggaccaacaaggccctgtatgaggcctacctgaagattacggacctcgagggatacgacgccaagaattacctgaaggtcaagagtaacaaggacgaggtggagctggacgacctcaaggtgccagcgtccgagatcaaggagatggtgcaggccatattcaaggaggccggaatcaacaccgacatcctacactttgacgccgagctggacgggaaggactttgagaaccagggcagctacaagctctggcacctcctgtactcctacgagggggacgacagcaagtccggcaacgaactgctgtacaagctgctcgagaccaaatttgggctgaagaaggagtacgcccagatccttgcgaacatcagcctcagcgacgactatggcaacctgtccaccaaggccatgcgcaagatccacccctatattaaggagaacaagttctccacggcctgcgagctggccggctaccggcatagcaagcacagcttaaccaaggaggagaacgagaaacgcgtcctgaaggacgggctggaggtcctcaagaagaactccctgcggcagccggtggtcgagaagatcctgaaccagatgattaacctcgtgaacgcgctgctgaagaagtaccgcaccgagaaccccaactttaagttcgacgagatccggatcgaactggcacgcgagctgaagaaaaatgccgaggaacgggccaacatgaccgcgaacatcaacaaggcgaagacggagcacgagaagatcgacaagatcttgaaaagcgagttcggcctgcccaaccccacacgcaacgacatcatacggtaccgcttatacgaggagctgaaggccaacgggtacaaggacctctacaccaaccggtatatctccagcgaaaagctgttctccaaagagatcgacatcgagcacatcatccccaagtctcgcgtgttcgacgactccttcagcaataaaaccatcgtatatcggaccgacaacctggataagggcgagcagacggcctacgactacatcgagtccaagttcggggccgagaagctgaaggagtacatgacccgcgtgaaggacctgtaccagaagaagatcatcagcaaggccaagtaccagaagctgctcaagaaagagtcagagatcggcgatggcttcgtggagcgggatctgcgcgagacccagtacatcgcgaagaaggccaaggaaatcctgctccagatcacccacaacgtcctgagcacatccgggggcatcaccgaccgactgcgcaaggactgggggctcgtgaacgtgatgaaggaactgaacctgccgaagtaccgcgccctcgggctgaccaagatggaggaccggaaatacggccagcaggtcgaggtgatcaccgactggacgaagcgcaacgacctgcggcaccacgccatggacgccttgaccgtggcgttcaccaaacataaccacatccagtacctgaattatctgaacgcccgcaagaacgagaagcataaggagcacaacaacatcatggccatacagcagctcgagaccatcaaggtcaccgacgagaacgggaacgagaagcggatctttaaggcccctatgcccaacttccgccaggtggcaaagaccttcctggagaacgtcctgatcagccacaaggccaagaacaaggtcgtgaccaagaacaagaacaagatctccggctctaacaaggtgcaggaggtcctcacgccccgggggcagctgcacaaggagaccgtttacggcaagtaccagtactacgtgcagaaggaggagaagatcggcgccaaattcgactccgagaccatcgagaaggtcgccaatcccctgtaccagtcactcctgaagaagcgccttgaggagaacggcggcgaccccaagaaggccttcaccggcaagaactcattagcgaagaaccccatctacctggacgacacccagacagagcagctgccggagaaggtgaagctcgtgtggctcgagaactccttctccatccggaaggacatcacccccgagaacttcaaggacgagaagctgatcgacaagatcctcgacgagggcgtcaagcgcatcctgaaggagcggctgcagtccttcgggaacgacgccaagaaggcgttctccgacctcgagaaaaatcctatctggctgaacaaggagaagggcatcgccatcaagcgcgtgaccatctccggagtggccaacgcggagcccctgcacaccaagaaggaccatctcggcaaggagatcctagacaaggaaggcaagccgatccccgtcgactttatcagcacggggaacaaccaccacgtggccgtgtaccgggacgagaagggcaacctgcaggagaaggtcctctccgtgttcgaagccgtggtccgggccaaccaggggttacccatcatcgagaaaacctacaatcagcacctgggatgggagttcctcttcagcatgaagcagaacgaaatgttcgtgttccccaacgagtctaccgggttcaacccgaacgacatcgacctgctggaccccaaaaataagcggattatcagccccaacctcttcaaggtgcagaagctggccaccaagaactacatgttcactcaccacctcgagactaagtccatcgacggggacatgctgaagaacaaaaaggagctctcaggcatcctgtacaattttatccagacaccgcagaagctgtatgggataatcaaggtccgcattaaccacctcggcgacatcgtttccgtgggggagtactga

SEQ ID NO: 7989 - RNA, 4296 nt, synthetic construct
  misc_feature 1..4296: note = Cas9 variant
  source 1..4296: mol_type = other RNA
atgaagcgcattctgggcctcgacctagggagctccagtatcggctgggccctggtgaacgaggccgagtccaagaacgagcggagctccatcgtgaagctcggggtgcgcgtgaaccccctgacggtcgacgagagcataaacttcgagaagggcaagtccatcactacgaacgcggaccggaccctgaagcgcagcatgaggcgcaacctccaccggtacaagctgcgccgggaggccctgatcgaggtgctcaaggagtgcaagttcatcactgaggacaccatcctgtccgagaacgggaaccgcacgaccttcgagacctaccggctgcgcgtgaaggccctcaccgaggagatcagcctggaggagttcgctcgggtcttaataatgatcaacaagaagcgcggctataagtccagccggaaggccggcggggcggaggaggacacgctcatcgatggcatggacatcgcccgcaaactgtacgacgccaacctgaccccgggggagctctgcctgcagctgctctccgccggcaagaaggtgctgccggacttctaccggagcgacctgcagaatgagctcgaccgcatctgggagaagcagaaggagtactaccccgggatcctgaccgcggccctgaaggaggagctccggggcaagaagcgcgacgccgtgtgggccatctgcgccaacgcgttcgtctggaaggagacatacacggagtggaataacgaggagtccaagaacgagcagatcgagaaggagcacaagctggagggcatctactccaagcggaagcgcgacgaggccaagaaggagaacctgcagtggcgtgtgtccgggctcaaggagaaactgagcctggagcagctcgtgatcatcctgcaggagatcaacacccagatcaacaactccagcggctacctggggaccattagcgacaggtccaaggagctctacttcaacaagcagaccgtcggccagtacctgatggacatcctggacaacaaccccaacgccagcctccgcaacatcgtgttctaccggcaggactacctggacgagttcaacgtgctgtgggagaagcaggccgagttccacaaggagctcacgggcgagctgaagaaggagatccgagacatcatcatcttctaccaacggagactgaagtcccagaaggggctcatcagcttctgcgagttcgagtcccggcagatcgaggtaaagatagatggcaagcgcaagatccggaccgtggggaaccgcgtgatcccgcggagcagccccctgttccaggagttcaagatctggcagatcctgaacaacatagaagtcaccgcagtaggtaataagaacaagcagcgcatgcagaacgggtccaacgagcccgacgacaccgagcagctcgagctgaacggccggcgctacctgtaccaggaggagaaggagctgctcgcgaaagagctgttcgtgcgggacaagatgacgaagctggacgtcctccgcctgctgttcgacaaccccgaggagctcgacctgaacttcaagaccatcgacggcaacaagaccgggtacctgttcttccaggcctactccaagatgatcgagatgagcggccacgagccggtggatttcaagaagcccatcgagaagatcgtggagcaggtcaagtccgtgttcgtcctcttaaactggaacaccgacatcctgagcttcgactccaacaaggaactcgacaagcagagctactacaagctgtggcacctcctctactcattcgagggggacaacacgcccaccggtaacggttgcctggtgcagaagatcatggactcttacggcctgggcaaggagttcgccaagatcctcgcaaacatcaccttccaggaggactacgggtccctgagcgccaaggcgatccacaagatcctgccccacctcaaggagggcaaccagtacgacgtggcctgcgagtacgccgggtacagacactccaagagcagcctgaccaaggaggagatcgccaacaaggtcctgaaggacaagctcgaggttctgccccgcaactccctgcggaaccccgtggtagagaagatcctcaaccagatggtgaacgtgatcaacgccatcatcgaggcgtacggccgccccgacgagatccgcgtcgagctggcccgggagctgaagaagaacgccaaggagcgcgagaagctcaccaagagcatcgccgagaccaccaagacccacgaggcgcacaagaagctgctacaggaggagttcgggctcaagaacgtgggccggtccgacatcctgcgctacaagctgtacaaagagctcgagagccggggctacaagacgctgtactccaacacctacatcccccgcgagaagctgttcagcaaggagttcgacatcgaacacatcatcccgcaggcccggctgttcgacgactcctttagcaacaagaccctggaggccaggaacgttaacatcgagaaggggaaccggaccgcctacgacttcgtgaaggagaagttcggcgagtccgggacggacaatagcctggactgctacctcaacaacatcgaggtgctgttcgtgtccggcaagatcagcaagaccaagtacaccaagctcaagatgaccgagcaggacatccccggcgggttcatcgagcgcgacctccggaacacccagtacatcgccaagaaggcgctgtccatgctgaacgagatcagccgctgcgtcgtggccacgtccggcagcatcaccgacaagctccgggaggactggcagctggtggacgtcatgaaggagctgaactgggagaagtacaaggccctcgggctggtggagtacttcgaggacaaggacggcaagcagatcgggcgcattaaggactggtccaaacggaacgaccaccgccaccacgctatggacgccctgaccgtggcgttcaccaaggaggtcttcatccagtacttcaacaacaaaaatgccagcctcaaccccaacacgaacgagtacgccatcaagaacaagtatttccagaacggccgggccatcgcccccatcccgctgaacgagttccgcgcggaagccaagaagcacctggagaacaccctaatcagtatcaaggccaagaacaaggtgattaccaacaacatcaacaagaccaagaagagaggcggggtgaatacgaagaagcagcagacgccccgcggccagctgcacctggagaccatctacggttgctgccggcagtacctcaccaaggaggagaaggtcaacgcctccttcgacgtgagcaagatcgcgacggtgtccagctccgtctaccgcgacgccctgctaaagcgcctccaggagcaccacaacgaccccaagaaggccttcgccggccggaacagcctggacaagaagcccgtgtggctggacaaggagcagatccgcaaggtgccggagaaggtcaagaccgtgaccttcgagaccatctacacgatccggaaggagatctcccccgacctccgcgtggacaagatcatcgacagcggggtccggaagatgctgaccggccgcctgaaggagtacggcaacgacgccaagaaggcgttctccaacctcgacgagaagcccatctggctgaacaaggagaaggggatccccatcaagcgggtgaccatcagcggcatctccaacgcccagagcctgcacgtgaagaaggacaaggacgggaagccggtcctcgacggcaacgggcgcaacatacccgtggacttcgttaacacaggcaacaaccaccacgtcgccgtgtaccggcgccccgtgatcgacaagaacggccagatggtcatcgacgagaacggaaacctgaagtacgagctagaggaggtggtggtcaccttcttcgacgccgtgacccgggtgaacctcggccagccgatcatcgataaggactacaaggcctccgaggggtggcagttcctgttcagcatgaagcagaacgagtacttcgtcttccccaacaagaagaccggcttcaaccccaaggagatcgacctgctcgacgcggacaactacgggttaatctcccccaacctgttccgcgtgcagaagttcacccacaagaactacgtgttccggcaccatctcgagacaacaatcaaggacaccagctccatcctgcgcggcatcacctggatcgacttccggagctctaagggcctggacagcatagtcaaggtgcgcgtcaaccacatcgggcagatcgtgagcgtgggcgagtactga

SEQ ID NO: 7990 - RNA, 4299 nt, synthetic construct
  misc_feature 1..4299: note = Cas9 variant
  source 1..4299: mol_type = other RNA
atgaagaagatcctgggcttagatctggggtccaattcgatcggctgggccctggtgaacgaggcagagaaccgcgacgaggcgagctctatcatcaaactcggtgtccgagtgaaccccctgaccgtggacgagatgcagaacttcgagaagggcaagagcattaccacgaacgccgacagaaccttaaaacgctccatgcgccggaacctccaacgctataagctgcggcgcgacgccctgatcaagctcctgaagaaggtggggttcatcgccgacggcacaatcctgagcgagcagggcaaccggtccaccttcgagacgtaccgcctccgggccaaggcgcctgacgaggagataagcctgcaggagctggcccgggtgctcctgatgatcaacaagaagcgggggtacaaatccagccgcaagatcaaggagaaggaagccgggacccttatcgacgggatgaaggtggctaagaagctctacgatgaggacttaaccccgggccagctgtgcctccagctgctggaatcagggaagaagtccctccccgacttctactcaagcgacttacaagaagagttcgaccggatctggaatttccagaagcagttcaaccccaaggcgttttgcgacaccgccaaggaggagattaagggcaagaacaagtcccagacgtgggccatcctggccaagtacttcatctggacggacgagatggtcgtgtggaacgaaaaggagtccaagaccgaacgcgtggagaaggagtgcaagctcgtcggccttaaacggaccgtgaagaaggaggagcagcgtaaagagaactacaggtggcgcgtgcaggccttaacagagcagctcgatctggggaaggtcgccgtggtgctgcaggagatcaacggccagatctccacctcctctgggtacctcggcgccatcagcgacaggagcaaggtactgtatttcaaccgccagaccgtgggccagtaccagatggccgagctagagaagaaccccaacacctctctccgcaacatggtgttctaccggcaggactacctggacgagttcgacaagatctgggagaagcaagccgagttccacaaggagctgactgtcgagctcaagaaggagatccgcgacatcatcatattttaccagcggcgcctcaaaagccagaaggggctaatcggattctgcgagttcgagaatcgggagatcatggtggagaagaacgggaaaatgcaagccaaggtggtcggatgcaaggtgatcccacgctcccaccccctcttccaggagttcaaaatctggcagaccctgaacaatgtggaggtcttcgcgggggagaaaaagtgcaagcgaaagcgcacagacgccttccccggcctgttcgacggcaccgaagacacgctcatggtggaggggtggcggtacctgtaccaggaggagaaggagattttagccaaggagctgagcgtcaagaagagtctgaagaaggagtacatcctgaagctgctgttcgacaacccgcaagacctggacatgaatttcgagcagatcgagggcaacgacaccgggaacgtgctgttcagcgcctactccaagatgatcgagaagtatggctacgagcccctcgactttggcaagtcgaccgacgagatcatcgagcgcctccaggtgattttcaccgacctggggtggaacacggacctgctgttcgtcgacctgaacaaggagggcaaggacctcgagaagcagccctatttcaagctgtggcacctcctctactccttcgagggggataacacccccaccggcaacgggaaacttgtggaaaagctgatggagctctgccatgtgggcaaggagtgcgccctggagcttgtcaacatcagcttccaaaacgactacgggagtctctcagcgaaagccatcaagaagatcctgccgtacctgaaggagggcaacagatacgacgttgcctgcggctacgccgggtatcggcactccaagagctccctcacgaaggaggagatcgaaaacaaggtactgaaggacaagttagacatccttcccaagaacagcctgcgcaaccccgtcatcgagaagatactgaaccagatggtaaacgtgataaacgcaatcatcgacacgtacggcaagcctgacgagatccgagtcgagctcgctcgggagctgaagaagtccgccaaggagagagacgagctgaccaaggccatcgccaagagcacccgggagcacgaagaaatccgcaaagtgctccaagaggagttcgggatgatcaacgtgtcccggaacgacatcatccgctacaaactgtacgaagaactgaaggacaacggctacaagaccctttacagcaatcagtacatcccgaaggagaaggtcttcagcaaggagatcgacatcgagcacatcatcccccaggcccgcctgttcgatgactccctgagcaacaagactctcgagtacaaagccatcaatatcgagaaaggcaacaagaccgcatacgactttgtgaaagaaaagtacggggagaagggcctacaacagtacctgaaccgatgcgagtccttgttcaagggtcaccgcaccaagctgcggaagctgaaaatgggccaagagaacatcccggaggggttcatcgaccgagacctcagaaacacccagtacatcgcgaagaaagccctggcgatgctgaacgagatctgccgtcgggtggtcgctacgaccgggagcataaccgaccgcctccgggaggactggcagctggtggacgtgttaaaggagctcaacctccccaagtacgagaccctgggcctcgttgaggtttacgaggacaaggacggccgcaagatcaagcggatcaaggactggaccaagcgcaacgaccatcggcatcacgccatggacgcactgacggtggccttcacgaaggacgtcttcatccagtacttcaacaacaagaatgcggcctggcaggccgattgcaaggagcactccgacatcatcggtatcaagacccgctacttcgagaacgggcgggccctgccgcccatgcccctcgtgcgcttccgggccgaggccaagagccacctggagaccctactcgtgtccatcaaggcgaagaacaaggtggtgacgaacaacgtgaactgcaccaagcgcaagggtggggagaacaagaaacttcaacagacgcccagaggccagctgcacctcgagaccatctacggcagccaccgccagtatgtcatgaaggaggaaaaggtgaacgcctccttcgacagctccaagattgccaccgtgtgcaagcaggcgtaccggaacgctctgctggaaagactcgccgcattcgggaacgacccgaagaaggctttcaccgggaagaacagcctagagaagaatcctgtctacctggacagagaacagactgcgcgggtgcccgagcgcgtgcggaccgtggaacttgagacggtgtacacgattcgcaagcccgtggacccgaatctgtccgtcgacaaggtggtggacgccaaggtccggagcatcctggagcagaggctccgggagtatgatggcgaggccaagcgcgcattcgtgaaccttgacgagaaccccatctggctgaacgaggaaaagggcatcgccatcaagcgggtaaccatacgcggtatcaacaaggtccagtctctccacggcaaaaaggacaagaacggcaacctgatcttagacgagaccgggaagaagatccccgtggacttcgtgaacacgggcaacaaccaccacgtcgctatttaccggaagccggttctcgacaagaccgggcaggagatgttggacaacgagggcaaccccgtttacgagctggacgaggtcgtggtcagcttcttcgaggcggtgaccagggtcaacctggggctgcctgtcatcgataagaactacaacaagtccgagggctggcagttcatgttcactatgaagcagaacgagtacttcgtgtttcccaacgagaagacgggatttgacccgaaagaggtggacctgctcaatcccgagaactacgccgtcatcagccccaacctgttccgggtgcagaaaattaccgagaaggactatatgttccgccaccacctggagaccaaggtggtcgacgacaaattcctcaaagagatcacttggaagcggatcctgacgcccaacaagctggaagggatcgtgaaggttcgagtgaaccacattgggcagatcgtgagcgtgggggagtactga

SEQ ID NO: 7991 - RNA, 4299 nt, synthetic construct
  misc_feature 1..4299: note = Cas9 variant
  source 1..4299: mol_type = other RNA
atgaagaaaatcctgggccttgacctggggagcaactccatcggctgggccctggttaacgaggccgagaacagcgacgaggtctccagcatcatcaaactcggagttcgcgtgaatcccctgaccgtcgacgagatgcagaacttcgagaagggcaagtccatcaccacgaacgcggaccggaccctgaagcgctccatgagacgcaatttgcagcggtacaaactacgccgggacgccctgatcaagctcctgaagaaggtggggttcatcaccgatggcacaatcctgagtgaacagggcaacagaacgaccttcgagacctaccgtctccgcgctaaggcccccgacgaggagatcagcctccaggagctggcccgagtgctcttgatgataaacaagaagagggggtacaagtccagccggaagatcaaagagaaggaggcgggcacgctgatcgacgggatggaggtcgctaagaagctgtacgacgaggacctgacgccgggccagctgtgcctccagctgctggagtccgggaagaagtccctccccgatttctacagcagcgacctgcaggaggagttcgatcgcatctggaacttccagaaacagttcaaccccaaagcgttctgcgacaccgccaaggaggagatcaagggcaagaacaaatcccagacctgggcgatcctggccaagtacttcatctggaccgatgagatggtggtgtggaacgagaaggagagcaagactgagcgggtcgagaaggagtgcaagctcgtgggcctgaagcgcaccgtgaagaaggaggagcagcggaaggagaactactgctggcgcgtgcaggccctgaccgaacagctcgacctggagaaggtagccgtggtcctgcaggagatcaacgggcagatttccaccagcagtggctaccttggggccatcagcgaccgtagcaaggtgctgtacttcaaccgccagacggtgggccagtaccagatggcggagctggagaagaacccgaacaccagcctacggaacatggtcttctaccgccaggactatctggacgagttcgacaagatctgggagaagcaggcggagttccataaggagctgaccgtggagctcaaaaaggagatccgcgacatcattatcttctaccagcgacgcctcaagagccagaagggcctgatcgggttctgcgagttcgaaaaccgcgagatcatggtcgaaaagaacggaaagatgcaggccaaggtcgtggggtgcaaagtgatcccacgctcccatcccctcttccaggagttcaagatctggcagaccctgaataacgtagaggtgttcgctggtgaaaagaagtgtaagcgtaaacgcaccgacgccttccccggcctgttcgatgggaccgaggataccctcatggtcgagggctggcggtatctgtaccaggaggagaaggagatactggcgaaggagctcagcgtgaagaagtccctgaagaaggaatacatcctgaagttattatttgacaatccgcaggacctggacatgaacttcgagcagatcgagggtaacgacaccggcaacgtgctgttcagcgcctactcgaagatgatcgagaagtacggatacgagccattggacttcggcaagcccacggacaagatcatcgagcagcttcaggtgatcttcgcagacctgggttggaacaccgacctcctgttcgtggacctgaacaaggagggcaaggacctagagaagcagccctacttcaagctgtggcacctcctgtacagcttcgagggcgacaacaccccgaccggtaatggcaagctggtcgaaaagctgatggagctctgccacgtcgggaaggagtgcgcccttgagctggtgaacatctcgtttcagaacgactacgggagcctctccgccaaggcgatcaagaagatccttccctacctgaaggaggggaaccgctacgacgtggcctgcggctacgcgggctacagacacagcaagtccagcctcacgaaggaggagatcgagaacaaggtactaaaagacaagctggacatcctccccaaaaattccctccgcaaccccgtggtggagaagatcttgaatcagatggtcaacgtaatcaacgccataatcgacacctacgggaagccggatgaaatccgcgtggagctcgctcgcgagctgaaaaagtccgcgaaggagcgggaggagcttaccaaggccatcgccaagagtacccgtgagcacgaagagatccggaaagttctgcaggaggagttcggcatgatcaacgtgagccgcaacgacatcatccggtacaagctgtatgaggaactgaaggataacggatacaagacgctctactccaaccagtacatacccaaggagaaagtgttctccaaggagatcgacatcgagcacatcatcccccaggcccgcctgttcgacgactcactgagcaacaagactctcgagtacaaggcgatcaacatcgagaagggcaacaagaccgcctatgacttcgtcaaggagaagtacggggagaaagggctgcaacaatacctgaaccggtgcgagagcctcttcaaaggccagagaaccaagctgaggaagctaaagatggggcaggaaaatatcccagagggcttcatcgaccgggacctccgcaacacgcagtacatcgccaagaaggcgctggcgatgctgaacgagatctgccggcgcgtggttgcgaccaccgggtccatcaccgaccggctccgcgaggactggcagctggttgacgtgctgaaggagctcaacctgccgaagtacgagaccctggggctcgtggaggtctacgaggacaaggacggacggaagattaagcgcatcaaggactggacgaagcggaatgaccaccgccaccacgccatggacgcactgaccgtggccttcaccaaggacgtgttcatacaatacttcaacaacaaaaacgccgcgtggcaggccgactgcaaggagcacagcgacatcatagggatcaagacccggtatttcgagaacggccgctccctgccgcccatgcccctcgttcggttccgcgccgaggccaagagccacctggagacgctgctcgtgtccataaaggccaagaacaaggttgtaaccaacaatgtgaactgcaccaaaagaaagggcggggagaacaagaaactgcaacagagcccccgcggacagctgcacctcgagaccatctacggctcccaccggcagtatgtcacgaaggaagagaaggtcaatgcttcgttcgactccagcaagatcgccaccgtgtgcaagcaggcctatcgcaacgcgcttctggagcggctcgctgccttcggcaacgaccccaagaaggccttcaccgggaagaactccctggagaagaaccccgtgtacctgaaccgcgagcagaccgcccgggtccccgagcgcgtacgcaccgtggagctagagaccgtctacaccatccggaagccggtggacccaaatcttagtgtggacaaggtcgtggacgccaaggtgcgctccatccttgagcaacggctacgcgagtatgacggcgaggcgaagcgggccttcgtcaacctggacgagaaccccatctggctgaacgaggagaaggggatcgccatcaagcgtgtgacaatccggggcattaacaaggttcagagcctccatggcaaaaaggacaagaacggcaacctgatcctggacgagacgggcaagaagatccccgtcgatttcgtgaacaccgggaacaaccatcacgtggccatctaccgcaagcccgtcctcaacaagacaggccaggaaatgctggacaacgaggggaaccccgtgtacgagctggacgaggtcgtggtgtccttcttcgaggccgtcacccgggtgaacctcggcctgcccgtgatcgacaagaactataacaagagcgaggggtggcagttcatgttcacgatgaagcagaacgagtatttcgtcttccccaacgagaagacccgcttcgacccaaaggaggtggacctgctcaaccctgaaaactacgcggttatcagccccaacctgttccgcgtgcagaagatcaccgagaaagactatatgttccgccaccacctggaaaccaaggtggtggacgacaagttcctcaaggagatcacgtggaagcggatcctgacaccgaacaagttagagggcatagtcaaagtgcgagtgaaccacatcggccagattgtctccgtgggtgaatactga

SEQ ID NO: 7992 - RNA, 4299 nt, synthetic construct
  misc_feature 1..4299: note = Cas9 variant
  source 1..4299: mol_type = other RNA
atgaagaacatcctgggcctcgacctggggaccaccagcatcggcttcgcccacatcgtggaggacgagaacaaggagaagtccgagattaaggagctgggggtccgcatcgtgagcctcacaaccgacgagcaatccgacttcgagaagggcaagagcatcaccaccaacgccaaccggacgctgaagcacggggcgaggctgaacctcgaccggtaccagcagcgccggaagtacctgatcgacctgctccacaaggccaacctgatcaccccctccagcatcctggccgagaacggcaagaacaccacccactccacgtggcagctccgcgccaaggccgtgaccgagcggatcgagaaggaggagttcgcgcgcatcctgctggccattaacaagaagcggggctacaagagctcccgcaaggccaagaccgaggacgaggggcaggccatcgacggcatggcgatcgctaagcgtctctacgacgagaacctgaccccggggcagctgagcttacagctgctgcagcagaacaagaagctcctgcccgatttctaccgctccgatctccagaaggagttcgacctcgtctggaacttccaaaaacaattctaccccgacatcctgacggacatcttctacaaggagctgcagggcaaggggaaggacgccaccagcaaggccttctccaagcggtaccacttcgacaccgccgagaacaagggcagcaaggagtccgtgcgcctccaggcgtaccagtggcgggccgaggcggtgagcaagcagctgtccaaggaggaagtcgcctatgtgctgaccgagatcaacaacaacctcaacaacgccagcggctacctgggcgcgatctccgaccgctctaaggagctgtacttcaaccggcagacggtcggccagtacctctacgcccagctgcaggagaaccgccacaacagcctgaagaacaaggtcttctaccggcaggactacctcgacgagttcgagcgcatctgggagacccaggccctgttccacaaggagctgaccgacgagctcaaaaagcagatccgggacgtggtgatcttctaccagcgtaagcccaagagccagaaggggctgatcagcttctgcgagttcgagtccaaggagatcgagatcgagaaggacggtaagaccatcacgaagaacatcggggcccgcgtcgtccccaagagctccccgctgttccaggagttcaagatctggcagatcctcaacaacgttatctgcaagcggaaggggatccgcaagaagaagatcagcgccaagaccacccagctggacctgcttaacgagtccagccagaccatcttctccctggatatggagtgcaagcaactgctgttcgacgagctgaacctgaagggcgacctcaagagcgacaaggtcctcaagctgctggggtactctccccaggagtgggagatcaactacaaccagctcgagggcaaccggacgcagaaggcgctgtacgaggcctacctgaagatcgtggagatggaggcccacgacgtgaaggacatcctccaaatcaaaagcaccaaagacgactggtccctggacgagagcccactgtccgccagcgagatccgcgagtccgtcaaggccatattccaggcgctcgggatctgcaccaagatcctgtacttcgacccgctgctccccgtgaaggacttcgaggagcaggacagctaccagctgtggcacctcctctactcctacgagagcgacgacagcacctccggcaacgagacgctgtaccggatcttggagaagaagtacgccttcaagcgcgagcacgcccggatcctcgccaacgtggcgctgcaggacgactacggcagcctgtccaccaaggccatccgcaagatctaccccaacatcaaggagaaccagtacagcaccgcctgcgagatggcagggtacaagcactcgaagctcagcctgactacggaggagctggaggcccgcgagctcaagaacatcatccccctgctgaagaagaacgcgctccgcaacccggtagtggagaagatcctgaaccagatgattaacgtggtcaacgccctgatcgagaaaaactcagagcgggacgccgagggcaagatcaccaagtacttccacttcgacgagatccgcatcgagctcgcccgggagctgaagaagaacgcccagaagagatatgagatgacccagaacatcaataaggcgaagtcggagcaccagaagatctccgagatcctgcagaaggagttcgggatcaaaaaccccaccaagagcgacattatccggtaccgcctctacaaggagctggagcacaacggctacaaggagctgtacacgaacacctacatcgcccctgacgtgctgttctccaaaaacatcgacatcgagcacatcgtccccaaggcccgggtgttcgacgacagcttctccaacaagaccctggccttcaaggacttcaacatcaagaagggggagagcaccgccttcgactacatcacctcactgaagaacgaggagaagctcaaccagtacctggcgcgcgtggagaacgcatacaagacgaagaacatcagccccgccaagtacaagaacctgttgaagaaggcctccgagatcggcgacggcttcataaaccgggacctgcgcgacacccagtacatcgccaagaaggccaaggagatcctgttccaggtcaccaagaacgtgctcagcacctccgggtccatcacggaccgcctgagagaggactggagcctggtggacgtcatgaaggagttaaacatgcccaagtaccagtccctgggcctgaccgaggtggaggagcgcaaggacgggaacaaggtgaccgtcatcaaggactggaccaagcggaacgaccaccgccaccacgccatggacgccctcacggtggcctttactaagcccagctacatccagtacctgaaccacctgaacgcgcggaaggacgagaacaataagaactactccgtgatactcgctatcgagaagaaggagaccatcaaggtccccaccaacaacggcaagaacaagcgcgtgttcatcgagccgatccccaacttccgccaggtggccaagaagcacctggaggagatcttcataagccacaaagccaagaacaaggtcgtcacgaagaacaccaacaagcccgccggaaccaacaagcagcagatcaccctgacgccccggggccagctccacaaggagaccatctacggcaagtaccagtactacgtgaacaaggaggagaaggtcggggtgaagttcgacaaggagaccatcgcgaaggtgtccaaccccctgtaccgggaggccctgctcaagcgcctgcaggccaacgacaacgaccccaagaaggccttcaccggcaagaacgccctgagcaaaaaccccatctacctggacgaggcgaagacgaagaccctgccagagaaggtcaacctgacctacctcgaagaggacttttccgtgcggaagaagatcgtgccgaagaaccccaccagcaaggagttcgtccccaacctgaagtccatcgagaaggtcgtggacgagggggtccgcaacatcctgatcgagcggctacgcgtgtacaacaacgacccggagaaggccttcgtggacctggagaagaaccccatctggctgaacaaggagaagggcatcgccatcaagcgggtcacgatcagcggcgtgaacaacgcccagcccctccacatcgggaaggaccacctgggcaagaccaccctgaacaaagaggggaaggagatccccgtggactacgtctccaccggcaacaaccaccacgtggcgatctaccgcgacaaggaggggaacctccaagagcagatcgtgagcttcttcgaggccgtcgtgagaacgcagcagggcctgccgatcatcgacaagacctacaagcaggaggagggctggcagttcctgttcaccatgaaacagaacgagatgttcgtattccccaatgaggccaccgggtttaaccccgccgagatcgacctcctggaccccaagaacaagaagcagatctccccgaacctgttccgcgtccagaagatcgccacgaaggactacttcttccgccaccacctcgagaccaacgtggagaccgacaacgtgctgaagaacaccacgtggaagcgcgagggcttaagcgggctcaaggacatcgtcaaggtgcggatcaaccacctgggcgacatcgtgtccatcggcgaatactga

SEQ ID NO: 7993 - RNA, 4302 nt, synthetic construct
  misc_feature 1..4302: note = Cas9 variant
  source 1..4302: mol_type = other RNA
atgaagaagatcctgggcctggacctggggaccactagcatagggtatgcccaggtgaacgagtccgaggacttcaaggacagctccatcgagcgcatcggggtccgggtgaaccccctgagcgtggacgagcagacgaacttcgagaagggcaagccgatatccataaacgccgaccgcaccctcaagagcggggcgcggcgcaccctggaccggtatcaggaccgccggagcaacctgatcgacgccctcgtcaagagcgtgatcatcaccgaggacacggtgctggccgaggacggcaagaacaccacccactccaccttcgccctccgcgccaagagcgcgtccgagaaggtcgagaaagccgagttcgcccggatcctcctggccatcaacaagaaacgcggctacaagagctcccggaaaacgaacaacaacgacgacgaagggcaggcgatcgacggcatggccatcgccaagaagctgtacgacgagaacctcacgcccgggcagctggcctaccagctgctcaaggagggcaagaagtacctgcccgacttctaccgcagcgaccttcaggccgagttcgacaagatctggaccttccagaagcagttttaccccgagatcctcaccgacgagctgcagaaggagctggcggggaagggccagcgggccacgtccgcgatcttctggaagaagtacgacttcaacaccgccgagaataagggcacccgcgaggagaaaaagctcaaggcctacgagtggcggagcacctcggtggacaagaagctgcagaaggaagaggtggcgtacgtcatcacggagatcaacaacaacctgaccaactcttccgggtacttaggcgccatcagcgaccgcagcaaggagctgtacttcaacaagcagaccgtggggcagtacctgttcaagcagatccagaagaatccgcacaccaagctcaagaaccaggtgttctaccggcaggactacttcgacgagttcgagatcatctgggagacgcaggccaagttccaccccgagctgaccgaggagctgaaaaacaagatccgcgacatcatcatcttctaccagcggaagctcaagtcccagaagggcctgatcagcttctgcgagttcgagcgcaaggaggtcgagatcgagaagggcgggcggcgcatgaagaagaccatcggactgaaggtagcccccaagtccagccccctcttccaggagttcaagatctggcaggtcttgaacaacgtgctgatccgcaagaaggggtccaagaagcggcgcgtgaaggagccggaccagctcaacctggtggagcaggagcaggaggtcatgttcttcgacatgcagaccaagcagacgctgttcgacgagctcaacgtgaagggcaacctgaaggccaagcggatcatcgagctgatcgggcaggacgcgaacgactgggagatcaactacagcgagatcgagggcaaccgcaccaacaaggccctctacgacgcctacctgaagatcctggacctcgagggctacgacaccaaggccctgctggacgtgaagacctccaaggacgaggtcgagctcgacgacatcaacatcagcgggcccgaggtgaaggacctggtgaagcgtatcttcgagtccctggagatcgacacgcagatcctggagttcgacgccgaactcgacggcgaggtcttcgagaagcagagctcctacctgctgtggcacctcctgtacagctacgaaggggacgactcccccagcggcaacgagaagctgtacaagctcctgaagcagaagttcgggttcaagaaggagcacgcgcagatcctggcctccatcaccctctcagacgactacggctccctgagcgccaaggccatgcgcaagatctacccctacatcagggagcagaccttcgacaaggcggcctccctggccggctaccgccacagcgccagctccctcaccaaggaggagattgccaaccggccgctgaaggacaagctggagctcatcaagaaaaacagcctgcgcaaccccgtggtcgagaagatcctgaaccaggtggtaaatatcgtcaacagtttgatcgaggcgaacagcgagaaggactccgacgggaacatcatcagctacttcaagttcgacgagatccggatcgagctggcccgcgacctgaagaagaacgccaaggagcgggccgagatgacgctcaacatcaacgccgcgaagatcgtgcacgaaaagatcttcaagctgctgcaggccgagttcggcgtgaagaaccccacccgcaacgacatcatccggtacaagctctacgaggagctgaagaacaacggctacaaggacctgtacaccaacatatacatcccccgcgagatcctcttctccaagcagatcgacatcgagcacatcatcccgcagagcaagatgttcgacgactccttcagcaacaagaccatcgtcttccggaaggacaacctggacaagggcaactccaccgccttcgactacatcgacagccgcttcgggaaggacaagctgaccgacttcgagcagcggatcgagttcctcttcgagcagggcaagaaaaacaaggaagagggcatctccaaggccaagtaccagaagctgctgaagcgcgaggccgacatcggggacggcttcatcgagcgcgatctccgggacacccagtacatcgcgaagaaggcccgcaacctgctgtacgagatctgccgcatcgtgacccccaccacggggagcatcaccgaccgcctccgggaggactgggacctggtgaacatcatgcaggagctgaacctcgacaagttcaagaagttgggcctgaccgagatggtcgagaagaaggatggctccttcaaggagcgcatcgtggactggagcaaacggaacgaccaccgccaccacgccatggacgccctcaccatcgcgttcacgaagcactcccacatccagtacctgaactacctgaacgcccggaagaacgagaaccacaagcagcatcacaacatcatcgggatcgagcgcaaggagaccgagttcgtgatcgacgacctcggcaacaagaagcggaaattccacctccccctgcccaacttccgcgaggaagccaagaagcacctggagaacgtcctggtgagcttcaaggccaagaacaaggtggtcaccaagaacaagaacaagaccgccagctccaagggggagaagatcaaggtggagctgacaccgcggggccagctccataaggagaccgtgtacgggaagtacaagttctacgtcagcaaggaggagcgcatcggcggcaagttcgaccagcgaaccatcgagcgcgtggcgaactccacccacaagcggctgctgctccagcgcctgctggagaacgataacgacgccaagaaggccttcacggggaagaacgccctcgccaagaaccccatctacctggacgacaccaagaccctcaccctccccgagatcgtgaagctgacgtggctggaggaggactacagcatccggaaggacatcacccccgagaacttcaaggacatcaaggtcatcgataagatcctcgacgagggcgtgaagcgcatactgaaggagcggctggcgaagcacaacaacaacccgaaggaagccttctccgacttagagaagaaccccatctggcttaacgagaagaagtcgatcagcatcaagaaggtgaagatcagcgggatcaacaacgctgaggccctgcactataagaagaaccatctcggcatcgagatcctggatgacgagaagaagcgcatccccgtcgacttcgtgtccacagggaacaaccaccatgtggccatctaccgcgacgagaagggcaacctgcaggaggacgtcgtgagcttcttcgaggcggtggcccgggtcaaccagaacctccccatcatcgacaagaccctgaaggcctacctgggctggacgttcctcttcaccatgaagcagaacgagtacttcattttcccgaacaagcagaccgggttcaaccccaccgagatcgacctgctggactccatgaacaacaagctcatcagccccaacctgttccgcgtgcagaaattcacggtgaaggactacttcttccggcaccacctggagaccaacgtcgaagacgactccaagctcaagaacaccacctggaagcgcgagggcctcgggggcattgggaacatcgtgaaggtgcggatcaaccacatcggccagatagtcaagatcggcgagtactga

SEQ ID NO: 7994 - RNA, 4305 nt, synthetic construct
  misc_feature 1..4305: note = Cas9 variant
  source 1..4305: mol_type = other RNA
atgaagaacatcctgggcctggacctggggaccaacagcatcggctgggcctacgttaagcaggcccagaacgactccgagaagtccgagatcgcggaactgggggtccgcgtaaaccccctcaccgtggacgagaaaacgaatttcgagaagggcaagccgatcagcaccaacgccgaccgcactctgaagcgcggggcccggagaaacctgcagcggtacaagctccgccggcaggagctcatagagctgctcaaggactaccaagtcatcagcgacaagaccatcctggccgaggacggcaaggagactaccttcgagacactgcgcctccgggtgaagtccgccaaggagcaggtcagcctggaggagctggcgcgcatcctcctgatgatcaacaaaaagcggggatacaagtccagccgcaaggccaagaacgaagacgaggggcagctgatcgacggcatggagatcgcccggcgcctctatgacgaaaacctgaccacggggcagctgtcgctccagctgctgaaggagggcaagaagtccctccccgactactatcggagcgacctgcagcacgagctagacaaggtgtggaacttccagaagcagttccaccccgacatcctcaccgacgagttctacaccagcatccaggggaagggccagaaggccacccgcgagtccttctcctccaagtacggcattgacacggcggagaacaagggtagccgggaggagaaaaagctgcaggcctaccagtggcgcgccgacgccacccacaaggagctgaccaaggaggaactcgccttcgtgatcaccgagatcaacaacaacatcaacaactccagcggctacctaggggcgatctccgaccggagcaaggagctgatcttcgccaacgagacggtgggcgagtacctctggaagcagatccaaaacgacccccacaccagcctgaagaaccaggtcttctaccgccaggactacttcgacgagttcgagcggatctgggagacccagtccggcttctacccgcagatcctgaccgagagcctcaagaacgagctgcgcgacatcctgatcttctaccagcgcaagctcaagtcccagaaggccctggtgagcatctgcgagttcgagtccaaggagatccccctgaaggacaagcaggggaaccccatcagcaagaacggcatccccgtgacgaagctcgtcgggccgaaggtggcccccaagtccagccccctgttccaggagttcaagatctggcagaacctcaacaacgtgctcgtccggcccaagggctcccgcaagcggaaggtgaccaccaaccagcagagcaccctgctggaggggcaggagccggtgttcgagctcaacctggagcagaaggagcttctgttcgaggagctcaacctgaagggcaacctgaagacggactactgcttggagctgatcggctactccgccaaggagtgggagatgaactaccccaccctggaggggaacaagaccaacaaggcgctctatgaggcctaccttaagattatcgacagcgagggctacgacgccaagaagctgctcaaggtcaagaccgacaaggacgacatcaacctggacgacatcaaggtatccgccagcgagatcaagaccatgatctcggacatcttcaacgagctgggcatcaacaccaagatcctcgacttcgacgcggagctggagcgcaagcagttcgaggcgcaggccagctaccggctgtggcacctcctgtactcctacgagggcgacgacagcaagtccgggaacgagctgctctaccgcctgctggaggacaagttcggcttcaaacgggagcacagcaagaccctcgccaacgtgagcctgctgtccgactacggcaacctcagcaccaaggccatccgcacgatctacccctacatcaaagagaacaagttctccaccgcctgcgagctggcggggtaccggcacagcaagctctccatcagcaaggaggagaacgaaaaccgtaccctcaaggacacccttgacgtcctgaagaagaactccctccggcagcccgtcgtggaaaagatcctgaaccagatgatcaacctgatcaacgagctcatcgagaagcacagcgagaaggacgagaagggtaacatcgtcaagtacttcaagttcgatgagatccacatcgagctggcccgcgagctgaagaaaaacgccgaggagcggcgcgagctcgactccaaggtgcgggaggggaaggaccgcaacgagaagatcatcacgatcctcaagagcgagttcggcctgccgtacccgaccaagaacgacatcacccggtaccgcctctacgaggagctgaaggacaacgggtacaaggacctgtacaccaacacctacatcccccgggagaagctgttctccaaggagatcgacatcgaacacatcatccccaagagccgcctgttcaacgactccttcagcaacaagaccatctgctaccgccaggacaacctgaacaagggcgagcggaccgcctacgactacatcgagggcctcgggaagacccagctggacgagtacctgaaccgcgtcgaaaacctctacaccaacaagttcatcacgaaggcgaagtaccggaacctgctgaagaaggagtccgaaatcggcgatgggttcatcgagcgcgatctccgggagacccaatacatcgccaagaaggccaaggagatgctgctgcagatcacccgccacgtggtgagcaccacgggctccatcaccgaccggctccgcgacgattgggagctggtcaacgtgatgcgggagctgaacctccccaagtacaaggtgctgggcctgaccgagatccaggagcgcaagaacgggcagaccgtcgaggtgatcacggactggaccaagcggaacgaccaccgccaccacgccatggatgccctcaccgtggcgttcaccaagcacagccacatccagtacctgaacttcctgaacgccaggaaggacgagaagcacaaggagtacagcaacattatgggcatccagcagctcgagacggagaagaccaccgacaaggacgggaaggaccgccgggtcttcaagacccccatccccaacttccgccaggtggccaaggagcacctggagtccatcctgatcagccacaagacgaagaacaaggtggtcacacgggccaccaacaagatcgccggctccaagaagcagcaggagaccctgagcccccgcgggcagctgcacaaggagacggtgtacggcaagtaccggcgctacgtgcagaaggaggagaagatcggctccaagttcgacctgcaaaccatcgagcgtgtcgcgaacccgctctacaagcgcctgctgaccaagcgcctcgaggagaacggaggcgaccccaagaaggccttcaccgggaagaacgcactggccaagagccccatctacctggacgagacgcagacccagcagctccctgagaaggtgaagttggtgtggctggagaccgacttctccatccggaaggacatcaccccggacaacttcaaagacgagaagtccatcgacaaggtcctcgacgagggcatcaagcgcatcctgaaggaccggctcaagagcttcgacggggacgccaagcgcgcgttcacggacctggagcagaaccccatctggctgaacaaggagaagggcatcgccatcaaacgggtgaccatcagcggcgtgtccaacgccgagcccctgcacaccaagaaggaccacctcgggaacgagatcttcgacgacaccggcaagccgatccccgtcgactacgtaagcacggggaacaaccaccacatcgccatctaccgcgacgagaacggcaacctgcaggagaaggcggtgtccttcttcgaggccgtcacccgggccaaccaggggctgccaaccgtggacaagacctacaaccagcacctcgggtggcagttcctcttcaccatgaagcaaaacgagatgttcgtgttccccaacaaggagacgggcttcgacccgcaggagatcgacctgctcgaccccaagaacaagaagctgatcagccccaatctgttccgcgtccagaaaatctccaccaagaactacttcttccggcaccacctcgagacgagcgtggagacccacaacgccctgaacggggtgacgtacaagtcccagctgggactgaacgggatcaccgacatcatcaaggtccgcatcaaccacctaggcgacatcgtgcacataggggagtactga

SEQ ID NO: 7995 - RNA, 4308 nt, synthetic construct
  misc_feature 1..4308: note = Cas9 variant
  source 1..4308: mol_type = other RNA
atgctgggctgcgaacgcaagcggaagcggcgggagaaagagaaaatggcaaagcccaaggactacaccataggtctcgacatcggcaccaacagcgttgggtgggtggttactgacgaccaaaacaacatattgcgcatcaagggcaaaaaggccatcggggcgcggctgttcaccgaggggaaggtagccgccgagcgccggtccttccgcactacccggcgccggctcagccgccggcgctggcggatcaagatgttagaggagttgttcgatgaggaaatcgccaaggtcgatccgtcattcttcgcccgcctccacgagagctggatctcccccaaggacaagcggaagcgctactcagcgatcgtgttcccctcccctgaggaggacaaaaagttccatgaaagctacccgacgatctaccatttaagggacaaactgatgaaggacgaccagaagcacgatattcgcgagatctacatcgctgtgcaccagatgatcaaggccaggggcaacttcctgcacgacgagtccgtcgagacctaccgcagcgggatgtcaagccttggcggtcgctccgaacggaatatcttaagcgtccagacactcgaggagctgaatgatctgttcgccgaaaacgaaggcaccgaggaggtagagctcaacgtcgcgtccgccgaacagattaacgacatcctgaccgggggtcacctgaacgcggacagccagaaggaaatctccaacctcctgctgcccagctccttcccctcgtttgatgacaaggccaaggagaagcaggtcaagaagctcatcaacaacgtagccacgaatatcagcaaggcttggctgggctacaaggccgacttctccacgatcctgaacctcgccaaggtggataaggaccagaagaagatcttcgccttcgccctgcagggtggggacgaagaggacaaggtccaggagctggagagcctcttagagcaatcccagacagatatagtggatcgccttatcgagatcagacacgcgatcgtcctcagcgaaatcgttcccgtggggatgacgctgtctgaggccatgatcgataagtacgaccagcacaaggaagacctgatcaccctcaaggccgttatccgcaacactaaagacaagaagaaggcagccaagctccaggcgatctacgacttgtacgtcaagaaccggcacgcagacctcgctaaggccatgaagctgaccggcataaagaagaggtcggagctgcttgaccccgaagagttaaagaagggcatctcctctctgctagacgactcccccgaggcagtggagatcaaacaacggttggaggagaagacgttcctgcccctccagcgcagcaataacaacggagtcatccctaaccagctgcaccaggtggagttagacgagatcatcaagaagcagtccaagtactatccgttcctcgctgagaagaaccccgacgagagcgaggaggcccagaagaaggcccctaccaagctggacgcgcttctaaccttccgggtcccctactacgtcggcccaatgataaccaaggaggagcaggaagcgcagaacggacactccttcgcttggatggttcgccgggacccccaggaccacgaggctatcacgccttggaacttcgagaagaaggtcgacaagatggccagcgcgacccagttcatcaaaagaatgaccaccaaggacacgtacctcctgggggaagatgtcctgcccgcgagtagcctcaagtatcaactgtttaccgtgctgaacgagctcaacaacctgcgggtcaacgggaagaagctgacgagcgacgaaaaggagcaggtcatcgagggcctcttcaagaagcagaaaaccgtgaaggccgacaagttcgtaaagtattggcaggccaagcatataggcgccgacatcaaggtgaaggggctcagcgacccgtccaaattcaacagcacaatgagcacgtacatcgacttcaagaagatctttggcgaccaactgaacgacgtgaaccgccagaacgactttgagaaaataatcgagtattccacgatcttcgaggacaggaagatcctcgaggacaagctgcgcgtcgacttcgcttggctgagcgaggagcaaatcaagcagctctgtcgcctgagactgcagggatggggccggctatccgacaagctgctgacacgcctcacggatgccgacggccagaacgtcctggagcgcctgtggaacagcaacgacaacttcgtgcagatcgtttccgacccgaacattaaggccaagatcgagcaggagaaccagaagttactgcgggatagccagtccgataacgccgtcgagagcatcctagacgatgcctacaccagcccgcagaacaagaaggcaatccgccaggtcatgcgggttgtacacgacattgtgaaggcgtgcgacggcaacgtccccgcgaagtttgctatcgagttcgcacgctcccaagaagatgacccgaagagaaccactgcgagggtaaatcagatgcagaagatctacgaccagatctctgacgaggtggttagccagggtgttaaggagcagctctccggtatgaagtcgctgaaagaccggtactacctgtacttcatgcagggcgggcgagatgcctatacgggcgccaagctcaacatcgaccggctctccgactacgacgtggaccacataatgccgcagagcttcgtaaaggacgactccttagacaaccgagtgctcgtggcccgggccgtcaacaaccaaaagtcggataaggtgcccgcgctgctgttcgggaacaaggtggtcgccgatctcggcatcaccgtgcgagagatgtgggataagtggcagaagctgggcatgattagcaagcgcaaacttagcaacctcctgaccgacagcgacgccctgaccgagtaccgcgcccaggggttcattcgacgccagctcgtcgagacctctcaggtcattaagctgacggcaaccatcctgcaatcagagttccctgactccaagataatcgaggtccccgcgaagtacaacagcatcgtgaggaagcagttcgatctctacaagtcccgcgaggttaacgactttcaccacgccatcgacgcatacctgtccaccatcgtcggtaactacctgtaccaggtgtaccctaaccttcggaggatgttcgtctatggggagttcaagaaattctcctccaatgcggaggagtccgcccacgacgtagcgcggcgcgtaaaaagcatgaacttcctggacgatctcctccgaggcacccacggcgataacatctattgccggtccacgggggagatcgtgttcaaccgcaacgacatcatcagcaagctgaagcaggcctactccttcaagcagatgctggtgacccaggaggtgttcaccaagaagtccgccctctttaaccagaccgtctaccccagcccgaaacgggacggcagcaagcgctccgggctgatccccaggaaaagaggcatggaccccgagatatacgggggctacgcccacaaccaagatagctactttgtactcgctaagatcgagaaagtgaagggctacacgctccagatcgttggagtgcctatccggagcttagagatcatcaacaaggccgaggacttcagcaccgccttactggacatcatcaaaagcaaggtgatgtacaacgagaagactggccagccgaagagagggatcaagaacgtcgaaatcctggtgaataaactgccctaccgtcagcctatactcgagaaggacgtctcctacatgctaggctcctccgcctacaagtacaacatcaagcagatcaccctgagcagacagtccatgaagtacatcctcgactacatagacgaccccaacttcacgaagcatgagatgaccatgatcgacgagcagaacgaacgggagtgcctgctgagcgtttatgacgaaatcctcgagaaagtcgacaagtacctgcccctcttcgacgggaacaaattccgcgaaaagctccactccgcccgaaaggagtttgtcagcttatccgtggacgacgaggcgagcgccatcgaaaagatccttcgcggcctccacgccaactccgagatgccgagcctggagaacctaaagatcaaacccgccctcggcttcttccagatgaagaacgggatcaccctatccaatgatgccgttctactctaccaaagccccaccgggctgttcgaacggcgcgtcaaggtgagtgacctgctcaagtga

SEQ ID NO: 7996 - RNA, 4308 nt, synthetic construct
  misc_feature 1..4308: note = Cas9 variant
  source 1..4308: mol_type = other RNA
atgaagaatatcctgggcctcgatctggggacaacatccatcggcttcgcccatatagtagaggacgagaacaaagagaagtctgaaatcaaggagctgggggtccgcatcgtgcccctcacgaccgacgagcaaagtgacttcgagaagggcaagtccatcaccaccaacgccaaccgcacgctgaagcacggggcgcgcctgaacctcgaccggtaccagcagcgccggaagtacctgatcgatctgctccaaaaagccaatctgataacctcgtccagcatcctagccgagaatggtaagaataccacccactccacttggcagctccgcgccaaggccgtgaccgagcggatcgagaaggaggagttcgcccgcgtcctgctggccatcaacaagaagcgaggctacaagagctcccgcaaggctaagaccgaggacgaggggcaggccatcgatggcatggcgatagccaagcgactctacgacgagaacctgacgacggggcagctgagcctccagctgctgcagcagaacaagaagctcctgccggacttctaccgctccgatctgcagaaagagtttgacctcgtgtggaacttccaaaaacagttctaccccgatattctgaccgactcgttctacaaggagctgcagggcaaggggaaggacgccaccagcaaggccttctcaaagcggtaccactttgacaccgccgagaacaagggctccaaggagagcgtgcgcctccaggcgtaccagtggcgggtcgaggccatctccaaacagctgagcaaagaagaagtggcctacgtgcttacggagatcaacaacaacctcaacaacgcgagcggctacctgggggccatcagcgaccgcagcaaggagctatacttcaaccggcagaccgtcggccagtacctctacgcgcaactgcaggagaaccgccacaactccctgaaaaacaaggtgttctatcggcaggactacctcgacgagttcgaacgcatatgggagacccaggccagcttccacaaggagctaacggaggagctgaagaagcagatccgggacgttgtaatcttctaccaacgcaagcccaagagccagaaggggctcatcagcttctgtgagttcgaatccaaggaaatcgagatagagaaggacgggaagacgatcacaaagaccatcggcgcccgcgtggtgcccaagagcagccccctgttccaggagttcaagatatggcagatcctgaacaacgtgatctgcaagcggaaggggatccgcaaaaagaaagtgtccgccaagactacgcagctcgacctgctgaatgagtcctcccagaccatattctccctcgacatggagtgcaagcaactgctgtttgaggagctcaacctgaagggcgatctgaagtccgacaaggtgctgaagctgctgggatacagcccccaagagtgggagatcaactacaaccaactcgagggcaatcggacccagaaggccctctacgaggcgtacctgaagatcgtcgagatggaggcccacgacgtgaaggacatcctccagatcaagagcgccaaggacgattggtccctcgatgagagccctctgtccgcctctgagatccgcgagtccgtgaaggccatcttccaggcgctggggatctgcacgaaaatcttatatttcgaccccctgctgccggtcaaggagttcgagaagcaggacagctaccagctctggcacctcctgtacagctacgagagtgatgacagcacgtccggcaacgagaccctatatcggatactggagaagaagtacgcctttaaacgcgagcatgtgcggatcctggccaacgtggccctccaggatgactacggcagtctgtccaccaaggcgatccgcaagatctaccccaacatcaaggagaaccagtacagcatagcatgcgagatggccgggtacaagcactcgaagctgagcctgaccacggaggagctggaggcccgcgagctgaagaacatcatccctctcctgaagaagaacgccctgcgcaaccccgtcgtggagaagatcctcaaccagatgatcaacgtcgtgaacgcgctgatagagaagaactcggagcgtgacgcagagggcaagatcaccaagtactttcacttcgacgagatccgcatcgaactggcccgggagctcaaaaagaacgcccagaagcgttacgagatgacccagaacatcaacaaggccaagctggagcaccagaagatcagcgagatcctgcagaagcaattcgggatcaagaatccaaccaagtccgacatcatccggtatcgcctatatcaggagctggagcacaacggctacaaggagctgtacacgaacgcgtacatcgctcccgacgtgttattcagcaagaacatcgacatcgaacacatcgtccccaaggcccgtgtgttcgacgactccttcagtaacaagaccctagccttccgggagttcaacatcaagaagggtgagtcgaccgccttcgattacatcacctctctgaactccgaggaggagctcaaccagtacctgacccgggtggagaacgcgtataagaccaagtcgatctcgcccaccaagtacaaaaacctgctcaagaaggcatccgagatcggcgatgacttcatcaacagagacctgcgcgacacccagtacatcgcgaagaaggctaaggagatcctgttccaggtaaccaaaaacgtcctgagcacgtccggcagcatcaccgaccgactgcgtgaggactgggggctggtggacgtaatgaaggagctcaacatgccgaagtatcagtccctcggcctgaccgaggtggaggagcggaaggacgggaacaaggtgacggtcatcaagaactggacgaagcgcaacgaccaccggcaccacgcaatggacgccctcaccgtagccttcaccaaacccagctacatacagtacctgaatcacctgaacgcccgcaaggacgagaacaacaagaactactccgtgatcctcgccatcgaggagaaggagacgatcaaggtccggacgaacaacggcaagaacaagcgcgtgttcatcgagcccatacccaacttccgccaggttgcgaagaagcacctggaggagatcttcatcagccacaagaccaagaacaaggtcgtgaccaagaacgtcaacaaaccggccgggaccgacaagcagcagatcaccctgacgccccggggacagctccacaaggagaccatatacggtaagtaccagtattacgtcaacaaggaggagaagatcggtgtgaagttcgacaaggagacaatcgccaaagtgtccaacccgctgtaccgggaggctctactcaagagactccaggccaacgataacgaccccaagaaagcgttcacgggcaagaacgccctgagcaagaagccgatctacctcgacgagtccaagaccaagaccctacccgaaaaagtcaacctgacatacctcgaggaggacttcagcatccggaaagacatctcccccgacaacttcaaggacctaaagagcatcgagaaggtgatcgaccaaggggtgaagcgcatcttgatcaagcggttacaagcatacgacaacgaccccaaaaaggcgttcgtcgacctagagaagaacccgatctggctgaacaaagagaagggcatcgccatcaagagagttacgatctccggcgtgaacaatgcgcagcccctccacattggtaaggaccacctgggcaagaccaccctgaacaaggaggggaaggagatcccggtcgactatgtgagcaccggaaacaaccaccacgtggccatctaccgggacaaggaggggaacctccaggagcagatcgtctccttcttcgatgcagtggtacgagcccagcagggcctgccgattatcgacaagacgtacaagcaggcggagggctggcaattcatgtttaccatgaagcagaatgaaatgttcgtcttcccgaatgaaactaccggtttcaaccccgcagaaatcgacctgctcgaccccaagaacaagaaactgatcagcccgaacctgttccgggtgcagacgatctccgtggtcaagtacggcaacagcgtggtgcgcgacttcaagttccggcaccacctagagaccaccttgcaggacgacaagatcctgcaggggatcaccttccagcagataaaaagtctcgagcccttacgcaacatcgtcaaggtgcgcatcaaccacctgggcgacatcgtgtccatcggcgagtactga

SEQ ID NO: 7997 - RNA, 4308 nt, synthetic construct
  misc_feature 1..4308: note = Cas9 variant
  source 1..4308: mol_type = other RNA
atgaagaacatactgggcctcgacctggggaccaccagcatcggcttcgcccacatcgtggaggacgagaacaaggagaagtccgagatcaaggagctgggggtacgcatcgtgagcctcgccacggacgagcagagcgacttcgagaagggtaagagcatctccaccaacgctaaccggacactgaaacacggggcccgcctgaacctcgaccggtaccagcagcggcggaagttcctgatcgacctgctacagaaggccaacctgatcaccagcgcctccatcctggccgagaatggcaagaacacgacccacagcacctggcagctccgcgcgaaggcagtgaccgaacgcatcgagaaggaggagttcgcccgcgtgctgctggcgatcaacaagaagcggggctataagaactcccgcaagacgaagaccgaggacgaggggcaggcgatcgacggcatggccatcgctaagtgcctatacgacgagaacctcacccccgggcagctgagcctccagctgctgcaacagaacaagaagctcctgccggacttctaccggtccgacctgcagaaggagtttgatctggtgtggaacctgcagaagcaattttaccccgacatcctgaccgacagcttctacaaggagctccagggcaaggggaaggacgcgacgtcaaaggccttcagcaagcgctaccacttcgacaccgctgagaataagggctccaaggagagcgtgcgcctgcaggcctaccagtggcgcgccgaggccatctctaagcagctgagcaaggaggaggtcgcctacgtgctcaccgagatcaacaataacctgaacaactcctcgggttacctgggggcgatcagcgaccggtccaaagagctctacttcaatcgccagaccgtgggccagtacctgtacgcccaactgcaggagaacaggcacaacagcctcaagaacaaggttttctaccgccaggactacctggacgagttcgaacggatctgggagactcaggcctccttccacaaggagttaaccgacgaactaaagaagcagatccgagacgtggttatcttctaccagcggaagctaaagagccagaaggggctggtctccttctgcgagttcgagagcaaggagatcgagatcgagaaggatggcaaggccataaccaagtccattggtgcccgcgtggtgcccaagagcagccccctcttccaggagttcaagatctggcagatcctgaacaacgtcacgtgcaagcgaaaggggatccggaagaagaagtcctccgccaagtcgacggagctggacctcttcaacgagccgtcccagagcatcttttccctggacatggagtgcaagcagctcctgttcgacgagctgaacctgaagggcgacctcaagagcgacaaggtgctgaagctgctggggtacagcccacaggagtgggagataaactacaaccagctcgagggcaaccgcacccagaagtccctgtacgaggcgtacctgaagatcatcgagatcgagggctacgaggtgaaggacatcctccagatcaaatctaccaaggacgactggagcctggacgagagccccctgtccgccagcgagatccgggagagagtcaaggtgattttccagaccctgggcatctgcacgaagatcctgtacttcgatcctctgctcccggtgaaggagttcgagcagcagtactcctaccaactgtggcacctcctgtacagctacgagtccgacgacagcacctcgggcaacgagaccctgtaccggatcctggaaaagaagtacgccttcaagcgcgagcacgccaccatcttagcgaacgtggccctgcaggacgactacgggagcctgtccacgaaggccatcagaaagatctacccctacatcaaggagaaccagtatagcaccgcctgcgagctcgcgggctacaagcactccaagctgtcgctgaccaccgaggagctcgaggcccgcgagctgaagaacatcatccccctgctcaagaagaacgccttacggaaccccgtggtggagaagatcctgaaccaaatgatcaacgtcgtgaacgccctcatcgagaaaaattccgagcgcgacgccgagggcaagatcacgaagtacttccactttgacgagatccggatcgagctggcgcgcgagctgaagaaaaacgcccaggagcgatacgagatgacccagaacatcaacaaggccaagctcgagcaccagaagatcagcgaaaagctgcagaagcagttcggcatcaagaatccgactaagtccgacatcatccgctaccggttataccaggagctcgagcacaatggatataaggagctgtacaccaacacgtacatcgcccccgacgtcctattcagcaagaacatcgacatcgagcacatcgtgccgaaggcacgtgtgttcgacgactccttcagcaataagaccctcgcgttcaaggagttcaacatcaagaagggcgagagcaccgccttcgactatatcacctcgctgaactgcgagggcgagttgaaccagtacctcacccgggtcgagaacgcctacaagaccaagagcatctccctgaccaagtacaagaatctgctcaagaaagccagcgagatcggggacggcttcatcaaccgcgatctgcgggacacccagtacatcgccaagaaggctaaggagatcctgttccaggtgaccaagaacgtgctctccacgagtgggtccatcacagaccgtctgcgcgaggactggggcctggtcgacgtcatgaaggagctcaacatgcccaagtaccagagcctggggctgaccgaggtggaggagcggaaggacgggaacaaggtcaccgtgatcaaagactggacgaagaggaacgaccaccggcaccatgccatggacgccctcaccgtggccttcaccaaaccgtcctacatccagtacctgaaccacctgaacgcgcgcaaggacgagaacaacaagaactacagcgtcatcctcgccatcgagaagaaggagaccatcaaggtccccattaacaacggcaagaacaagcgggtgttcatcgagcccatcctgaacttccgccaggtcgctaagaagcacctggaagagatcttcatcagccacaaggccaagaataaggtggtgacaaagaacataaataagcccgccgggaccgacaaacagcagatcaccctcaccccgcggggccagctacacaaggagacgatctacgggaagtaccagtactacgtcaacaaggaggagaaggtgggcgtgaagttcgacgagcgcactatcaccaaggtcagcaacccactgtaccgggaggcgctcctgaagagactgcaggccaacgacaacgaccccaagaaggccttcgccggcaaaaacgccctctccaagaaccccatctacctggacgaggcgaagaccaaaacgctcccggagaaggtgaacctaacctacctggaggaagacttttcaatccgcaaggatatctcccccgacaacttcaaggatctcaagagcatagagaaggtaatagaccagggggtcaagcgcatcctgatcaagcggctgcaggcctacgacaacgaccccaagaaagccttcgtggacttagaaaagaaccccatctggctcaacaaggagaagggtatcgccattaagcgcgtgaccatctccggggttagcaacgcccagccgctgcacatcggcaaagaccacttagggaagaccacgctcaacaaggagggcaaggaggttcccgtggactatgtctcaaccggcaacaaccaccacgtggcgatctaccgggacaaggaggggaacttacaggagcaaatcgtgagcttcttcgaggccgtcgtgcgcgcccagcagggcctgcccatcatcgacaagaattacaagcaggccgaggggtggcaattcatgttcacgatgaagcaaaacgagatgttcgtattcccgaacgaggcgacagggttcaaccccgccgagatcgacctcctggatcctaagaataagaagctgataagccctaacctcttccgggtccagacgatctccatcgtgaagtacgggaacagcgtggtccgcgacttcaagttccggcaccacctggagaccaccctgcaggacgacaagatcctccagggcatcaccttccagcagatcaagtctctggagccgctgcgcaacatcgtgaaggtgcggatcaaccacctcggcgacatcgtcaacatcggggagtactga

SEQ ID NO: 7998 - RNA, 4311 nt, synthetic construct; identical to SEQ ID NO: 2198
  misc_feature 1..4311: note = Cas9 variant
  source 1..4311: mol_type = other RNA

SEQ ID NO: 7999 - RNA, 4311 nt, synthetic construct; identical to SEQ ID NO: 2199
  misc_feature 1..4311: note = Cas9 variant
  source 1..4311: mol_type = other RNA

SEQ ID NO: 8000 - RNA, 4311 nt, synthetic construct
  misc_feature 1..4311: note = Cas9 variant
  source 1..4311: mol_type = other RNA
atgaagcgcatcctgggcctcgacctcggtaccaacagcatcggctgggccctggtgaacgaggccgagaacaaggacgagcggtccagcatcgtcaagctcggggttcgcgtgaaccccctgaccgtcgacgagctgacgaacttcgagaagggcaagtccataaccaccaacgcggacaggaccctcaagcgcgggatgcggcgcaatctgcagcggtacaagctgcgccgggagacgctcaccgaggtgcttaaggagcacaagctgatcaccgaggataccatcctcagcgagaacggcaaccgcacaaccttcgagacctaccggctacgcgccaaggccgtgaccgaggagatctccctggaggagttcgcccgggtcctcctgatgatcaacaagaagcgcggctacaagagctcccggaaggccaagggggtggaagagggcacgctgatcgacgggatggacatcgcgcgcgagctctacaacaacaacctgacgccgggcgagctgtgcctccagctgctggacgccgggaaaaagttcctccccgacttctaccggagcgacctgcagaacgagctggaccgcatctgggagaagcagaaggagtactaccccgagatcctcaccgatgtgctgaaggaggaactgcggggtaagaagcgcgacgccgtctgggccatctgcgcgaagtacttcgtgtggaaggagaactacaccgagtggaacaaagagaagggcaagacggagcagcaggagcgggagcacaagctcgaggggatctactccaagcgcaagcgggacgaggccaagcgagagaacctgcagtggagagtgaacggcctgaaggagaagctcagcctggagcagctggtcatcgtgttccaggagatgaacacccagatcaacaactccagcgggtacctcggcgctatctccgaccggagcaaggagctgtacttcaacaagcagacggtcggccagtaccagatggagatgctggataagaaccccaacgcctccctccgcaacatggtcttctaccggcaggactacctggacgagttcaacatgctgtgggagaagcaggccgtgtaccacaaggagctcaccgaggagctgaagaaggagatccgcgacatcatcatcttctaccagcggcgcctcaagagccaaaagggtctgatcggcttctgcgagttcgagtcccggcagatcgaggtggacatcgacgggaagaagaagatcaagacggtcggcaaccgcgtgatcagccggtccagcccgctgttccaggagttcaagatctggcagatactgaacaacatcgaggtgaccgtcgtggggaagaagcgcaagcggcgcaagctcaaggagaactacagcgctctgttcgaggagctgaacgacgccgagcagctggaactcaacggctcccggcgcctgtgccaggaggagaaggagctgctcgcccaggagctgttcatccgggacaagatgaccaagagcgaggtgctgaagctcctgttcgacaatccccaggagctggacctcaacttcaagaccatcgacggcaacaagacggggtacgctctgttccaggcctactccaagatgatcgagatgagcggccacgagcccgtcgatttcaagaagcccgtggaaaaggtcgtggagtacatcaaggcggtgttcgacctgctcaactggaacaccgacatcctggggttcaactccaacgaggagctggacaaccagtcatactacaagctctggcacctcctgtactccttcgagggcgacaacaccccgactgggaacggccgcctgatccagaagatgacggagctgtatggcttcgagaaggagtacgccaccatcctggcgaacgtcagcttccaggacgactacgggtccctctcagccaaggccatacacaagatcctgccccacctgaaggagggcaaccggtacgacgtggcgtgcgtttacgccgggtaccgccactccgagagctccctgacccgcgaggagatcgccaacaaggtcctcaaggaccggctgatgctcctgcccaagaacagcctgcacaaccccgtggtcgagaagatcctaaaccagatggtcaacgtgatcaacgtgatcatcgacatatacggcaagccggacgagatccgcgtcgagctggcccgggagctgaagaagaacgccaaggagagagaggagctcaccaagtccatcgcgcagacgaccaaggcccacgaggagtacaagaccctgctgcagaccgagttcgggctcacgaacgtgagccggaccgacatcctgcgctacaaactgtacaaggagctcgagtcctgcggctacaaaacactgtatagcaacacctacatctcccgggagaagctgttcagcaaggagttcgacatcgagcacatcatcccccaggccaggctctttgacgatagcttctccaacaagaccctggaggcacggagcgtgaacatcgagaagggcaacaagacggcgtatgacttcgtcaaggagaagttcggggagtcaggcgccgacaacagcctggagcactatctcaataacatcgaggatctgttcaagtccgggaagatcagcaagaccaagtacaacaagctgaagatggccgagcaggacatccccgacggcttcatcgagcgcgacctccggaacacccagtacatcgccaagaaggccctgtccatgctgaacgagatcagccaccgcgtggtcgcgacctccggcagcgtcacggacaaactccgggaggactggcagttgatcgatgtgatgaaggagctgaactgggagaagtacaaggccctcggcctggtggagtacttcgaggaccgcgacggcaggcagatcgggcgaatcaaggactggaccaagcggaacgaccaccgccaccacgccatggacgccctgaccgtcgccttcactaaggacgtgttcatccagtacttcaataacaaaaacgcgtccctcgaccccaacgccaatgagcacgccatcaagaacaagtacttccagaacggccgggccatcgcccctatgcccctgcgcgagttccgggcggaagccaagaagcacctggagaacacgctcatcagcatcaaggccaagaacaaggtgatcaccgggaacatcaacaagacccgcaagaagggcggcgtcaacaaaaacatgcagcagacgccccgcgggcaactgcacctggagaccatctacggctccgggaaacagtatctcaccaaggaggagaaggtgaacgccagcttcgacatgcggaagatcggcaccgtgtccaagctggcgtaccgcgatgccctgctcaagcggctgtacgagaacgataacgaccccaagaaggccttcgccggcaagaacagcctggacaagcagccgatctggctcgacaaggagcagatgcgcaaggtccccgagaaggtgaagatcgtgaccctggaggccatctacacgattcggaaggagatcagtcccgacctgaaggtggacaaggtgatcgacgtgggcgtccgcaagatcctcatcgaccggctgaacgagtacggtaacgacgcgaagaaggccttcagcaaccttgacgaaaaccccatctggctcaacaaggagaaggggataagcatcaaacgcgtgaccatctccggcatcagcaacgcccagtccctgcacgtgaagaaggacaaggacgggaagccgatcctggacgagaacggccgtaacatccccgtcgactttgtgaacaccgggaacaaccaccacgtggccgtctactaccgccccgtgatcgacaagcggggccagctcgtggtcgacgaggccggcaaccccaagtacgagctggaggaggtggttgtcagcttcttcgaggcggtgacccgcgccaatctggggcagccgatcatcgacaaggactacaagacgaccgagggctggcaattcctcttctccatgaagcagaacgagtacttcgtgttccccaacgagaagaccgggttcaaccccaaggagatcgacctgctggatgtcgagaactacggcctcatcagcccgaacctgttccgggtgcagaagttttccctgaagaactacgtgttccgccaccacctcgagaccacgatcaaagacaccagctccatcctgcgggggatcacttggatagactttcggtcttccaagggcctggacaccatcgtcaaggtgcgcgttaaccacattggccagatcgtgagcgtgggcgagtactga

SEQ ID NO: 8001 - RNA, 4311 nt, synthetic construct
  misc_feature 1..4311: note = Cas9 variant
  source 1..4311: mol_type = other RNA
atgaagcgcatcctgggcttggatctggggacaaacagtatcggctgggccctggtgaacgaggccgagaacaaggacgagcggtcgagcatcgtcaagctcggggtgcgcgtgaaccccctgaccgtggacgaactgacgaacttcgagaagggcaaatccattaccaccaacgcggaccggaccctcaagcgcgggatgcggcgtaacctgcagcggtacaagctgcgccgggagacgctcactgaggtactgaaggagcacaagctgatcacggaggatacgatcctcagcgagaacggcaaccgcacgacctttgaaacctaccggcttcgcgccaaggccgtgaccgaggagatctccctggaggagttcgcccgggtcctcctgatgatcaataagaagcgcggatacaagagctcccggaaggccaagggggtggaggagggcacgctgatcgacgggatggacatagcgcgcgagctctacaacaacaacctgacccctggcgagctgtgcctccagctgctggacgccgggaagaagttcctccccgacttctaccgctccgacttgcagaacgaactggaccgcatctgggaaaagcagaaggagtactatcccgagatcctaaccgacgtgttgaaggaggagctgcggggcaagaagcgcgacgccgtctgggccatctgcgcgaagtacttcgtgtggaaggagacctacacggagtggaacaaggagaagggcaagaccgagcagcaggagcgggagcacaagctcgaggggatctactccaagcgcaagcgcgacgaggccaagcgggagaacctgcagtggcgggtgaacggcctgaaggaaaaactttccctggagcagctggtcatcgtgttccaggagatgaacacccagatcaacaactccagcgggtacctcggcgccatctccgaccggagcaaggagctgtacttcaacaagcagaccgtgggccagtaccagatggagatgctggacaagaaccccaacgcctccctccgcaacatggtgttctaccggcaggactacctggacgagttcaacatgctgtgggagaagcaggccgtttatcacaaggagctcacggaggaactgaagaaggagattcgcgacatcatcatattttaccagcggcgcctaaagagccagaaggggctcatcggattctgcgagttcgagtcccgccagatcgaggtggacatcgacgggaagaagaagatcaagaccgtcggaaatcgcgtgatcagccggtccagcccgctgttccaggagttcaagatctggcagatcctgaacaacatcgaggtgaccgtcgtggggaagaaacgcaagcggcgcaagctcaaggagaattacagcgcgatcttcgaggagctgaacgacgcagagcagctggagctgaacggcagcagacgcctctgccaggaggagaaggagctgctggcacaagaactgttcgtgcgggacaagatgaccaagagcgaggtcctgaaactcctgttcgacaacccgcaggagctggacctgaacttcaagaccatcgacggcaacaagaccgggtacgccctcttccaggcctattccaagatgatcgagatgagcggacacgagcccgtggacttcaagaagcccgtcgagaaggtggtggagtacatcaaggcggtcttcgacctgcttaactggaacaccgacatcctcgggttcaactcgaacgaagaactagacaaccagagctactacaagctgtggcacctcctgtactcattcgagggcgacaacaccccgacggggaacggccgcctgatccagaagatgaccgagctctacggcttcgagaaggagtatgccaccatactggccaacgtgtcgttccaggacgactacggatccctgagcgccaaggccatccacaagatcctcccccatctgaaagagggcaaccggtacgacgtggcgtgcgtctacgccgggtaccgccactccgagagctccctgaccagggaggagatcgccaacaaagtgctcaaggaccggctgatgctgctccccaagaacagcctgcacaaccccgtggtcgagaagatcctgaaccagatggtgaacgtgatcaacgtcatcatcgacatctacggcaagccggacgagatccgcgtggagctcgccagagagctgaagaaaaacgccaaggagcgcgaggagctgacgaaatccatcgcgcagaccaccaaggccaacgaggagtacaagaccctcctgcagacggagttcgggctcaccaacgtgagccggacggacatcctccgctacaagctgtacaaggagctggagtcctgcggctacaagaccttgtacagcaacacctacatctcccgggagaagctgttcagcaaggagttcgatatcgagcacatcatcccccaggcacgcctgttcgacgacagcttctccaacaaaacgctcgaggcccggagcgtcaacatcgaaaagggcaacaagactgcgtacgacttcgtgaaggagaagtttggggagtccggcgccgacaacagcctggagcactacctgaacaacatcgaggacctattcaagtccgggaagatcagcaagaccaagtacaataagctgaagatggccaagcaggacatccccgacggctttatcgagcgcgacctgcggaacactcagtacatcgccaagaaggccctctccatgctgaacgagatcagccaccgcgtggtcgcgacgtccggcagcgtgaccgacaagctgagggaagactggcagctcatcgacgtgatgaaggagctgaactgggagaaatacaaggccctggggctcgtcgagtacttcgaagaccgcgacggccggcagatcgggcgcatcaaggactggaccaagcggaacgaccaccgccaccacgctatggacgccctgacggtggccttcacgaaggacgtgttcatccagtacttcaacaacaaaaacgcctccctggaccccaacgccaacgagcacgccatcaaaaacaagtacttccaaaatggcagggccattgccccgatgcccctccgagagttccgggcggaagcaaagaagcacctggagaacaccctcatcagcatcaaggcgaagaataaggtcataaccgggaacatcaacaagacacggaagaagggcggggtgaacaagaacatgcagcagacgccccgagggcagctccacctggagaccatctacggctccgggaagcagtacctgaccaaggaggagcgggtgaacgcgtcattcgacatgcgcaaaatcgaaactgtctccaagagcgcttaccgggacgccctcctgaagcgcctgtacgagaacgacaacgacccaaagaaggccttcgccggcaagaactccctcgacaaacagccgatatggcttgacaaggagcagaagcggaaggtgcccgagaaggtgaaaatcgtcacgctggaggccatctacaccatccgcaaggagatcagccccgacctcaaggtggacaaggtgatcgacgtcggggtgcggaagatcctgatcgaccgcctaaacgagtacgggaacgacgcgaagaaggccttcagcaatctcgacgagaaccccatctggctgaacaaagagaaggggatctccatcaagcgagtgacgatcagcgggatatccaacgcccagagcctgcacgtcaagaaggacaaggacggcaagccgatcctcgacgagaacgggcgcaacatccccgtggacttcgtgaacaccggcaacaaccaccacgtcgccgtgtactacaggccagtgatcgacaagcgcgggcagctggtcgtggacgaggccggcaaccccaagtacgagctggaggaagtggtcgtgtccttcttcgaggcggtgacccgggccaacctcggccagccgatcatcgataaggactacaagaccacagaggggtggcagttcctgttctcaatgaagcagaacgagtatttcgtcttccctaacgagaagaccggcttcaaccccaaggagatcgacctgttggacgtggagaactacgggctgattagcccgaacctgttcagagtgcagaagttctcgttaaagaactatgtcttccggcaccacctggagacgaccatcaaggatacctcctcgatcctgcgcggaatcacctggatcgacttcagatccagcaaggggctcgacacgatcgtgaaggtccgcgtgaaccacatcggccagatcgtgtccgttggcgagtactga

SEQ ID NO: 8002 - RNA, 4311 nt, synthetic construct
  misc_feature 1..4311: note = Cas9 variant
  source 1..4311: mol_type = other RNA
atgaagcgcatcctgggcctcgatctggggaccaacagcatcggctgggccctggtgaacgaggcagagaacaaagacgagcggtccagcatcgtcaagctcggggtgcgcgtgaacccccttaccgtcgacgagctgactaatttcgagaagggcaagtcgatcaccaccaacgcggaccggaccctaaagcgcgggatgcggcgcaacctgcagcggtacaagctgcgccgggagacgctcaccgaggtactgaaagagcacaagctgatcaccgaggacaccatcctcagcgagaatggaaaccgcacgaccttcgagacataccggctgcgtgccaaggccgttaccgaggagatctccttagaggagttcgcgcgggtcctcctgatgatcaacaagaaacgcggctacaaaagctcccggaaggccaagggggtggaggagggcacactgatcgacgggatggacatcgcgcgcgagctctacaacaacaacctgaccccgggcgagctgtgcctccagctgctggacgccgggaagaagttcctccccgacttctaccggagcgatctgcagaacgagctggacaggatctgggagaagcagaaggagtactaccccgaaatcctcaccgacgtgctgaaggaggagctgcggggcaagaagcgcgacgccgtctgggcgatctgcgccaagtacttcgtgtggaaggagacatacacggagtggaacaaggagaaagggaagaccgagcagcaggagaaggagcacaagctcgaggggatctactccaagcggaagcgcgacgaggccaagcgcgagaacctgcagtggcgggtgaacggcctgaaggagaagctcagccttgagcagctggtcatcgtcttccaggagatgaacacgcagatcaacaactccagcggctacctcggcgccatctccgaccgcagcaaggagctgtactttaacaagcagaccgtgggccaataccagatggagatgctggacaagaaccccaacgcctccctccggaacatggtcttttaccgccaggactacctggacgagttcaacatgctgtgggagaagcaggccgtgtaccacaaggagctcacggaggagctgaagaaagagatcagagacatcataattttctaccagcgccggctcaaaagccaaaaggggctcatcggcttctgcgagttcgagtcccgccagatcgaggtggacatcgacgggaaaaagaagatcaagaccgtcggcaacagggtgatcagcagatccagcccgctgtttcaggagttcaaaatctggcagattctgaacaacatcgaggtgaccgtcgtggggaagaagcgcaagcgccgaaagctcaaggagaactattcagcgcttttcgaggagctgaacgacgccgagcagctggagctaaacggctcccgccggctgtgccaggaggagaaagagctgctcgcccaggagctgttcatccgtgacaagatgactaagagcgaggtgctgaagctcctgttcgacaacccccaggaactggacctcaacttcaagacgatcgacggcaacaagaccgggtacgcactgttccaggcctactccaagatgatagagatgagcggccacgagcccgtagacttcaagaaacccgtggagaaggtcgtggagtacatcaaagcggtgttcgacctgctcaactggaacaccgacatcctggggttcaatagcaacgaggaactggacaaccagagctactacaagctctggcacctcctgtactccttcgagggcgacaacaccccgacggggaacggtcggctgatccagaagatgaccgagctatacggcttcgagaaggagtacgccaccattctggccaacgtcagcttccaggacgactacgggtctctcagcgccaaggccatccacaagatcctgccacacctgaaggagggcaaccgctacgacgtggcttgcgtgtacgcaggctaccggcactccgagagctccctcacccgcgaggagatcgccaacaaagtcctgaaggaccgcctgatgctcctgcccaagaacagcctgcacaaccccgtggtggagaagatcctcaaccagatggtcaacgtgatcaacgtgatcatcgacatttacggcaagccggacgaaatccgggtcgagctggcccgcgagctgaagaagaacgccaaggagcgggaggagctcacgaagtccatcgcgcagaccaccaaggcccacgaggagtacaagaccctgctgcagacggagttcgggctcaccaacgtgagccgcaccgacatcttacggtacaagctgtacaaggagctcgagtcctgcggatataagaccctgtacagcaatacctacatcagtagagagaagctattcagcaaggagttcgatatagagcacatcatcccccaggcccggctgttcgacgacagcttctccaataagacactggaagcacgcagcgtgaacatcgagaaaggcaacaaaaccgcgtacgatttcgtcaaggagaagttcggggagtccggcgccgacaacagcctggagcattacctcaacaacatcgaggacctgttcaagtccgggaagatcagcaagaccaagtacaacaagctgaagatggccgagcaggacatccccgacggcttcatcgagcgggacctacgcaacacccaatacattgccaagaaagccctgtccatgctgaacgagatctcgcaccgggtggtggcgacgtccggcagcgtcaccgacaagctccgcgaagactggcagctgatcgacgtgatgaaggagctgaactgggagaagtacaaggccctggggctggtggagtacttcgaggaccgggatggccgccagatcgggcggatcaaggattggactaaacgcaacgaccaccggcaccacgccatggacgccctgacggtcgcctttacgaaggacgtgttcatccagtacttcaacaacaagaacgcgtccttggaccccaacgccaacgagcacgccataaagaacaagtactttcagaacggcagagccatagccccgatgcccctccgggagttccgcgcggaggccaagaagcacctggagaacaccctcatcagtatcaaggctaagaacaaggtgatcaccgggaacatcaacaagacccggaagaagggcggcgtcaacaagaacatgcagcagacgcccagagggcagctgcacctggagaccatctacggctccgggaaacagtacctcaccaaggaggagaaggtgaacgccagcttcgatatgcgcaagatcggcaccgtctccaagctggcgtacagggacgccctgctcaagcgcctgtacgagaacgataacgaccccaagaaggccttcgccgggaagaactcactggacaagcagccgatctggctcgacaaggagcagatgcggaaggttcccgagaaggtgaaaatcgtgacgctggaagccatctacaccatccgcaaggagatctcacccgacctgaaggtcgacaaagtgatcgacgtgggcgtccggaagatcctcatcgaccgcctaaacgagtacggcaacgacgcgaagaaggccttcagcaacctggacgagaaccccatctggctcaacaaggaaaaggggatcagcatcaagcgagtgaccatctccggcatcagcaacgcccagtccctgcacgttaagaaggacaaggacgggaagccgatcctggacgagaacgggcgaaacatccccgtcgacttcgtgaacaccgggaacaaccaccacgtggccgtctattaccggcccgtgatcgacaagcgcggccagttagtggtcgacgaggcaggcaatccaaagtacgagctggaggaggtggtggtcagcttcttcgaggcggtgacgagagccaacctggggcagccgatcatcgacaaggactacaagaccaccgaaggctggcagttcctcttctccatgaagcagaacgagtacttcgtgttccccaacgagaagaccgggttcaatcccaaggagatcgacctgctggacgtcgagaactacggcctcatcagcccgaacctattcagggtgcagaagttcagcctgaaaaactacgtgttccggcaccacctcgagacgaccatcaaggatactagctctatcctgcgcggaatcacctggatcgacttccggagctccaagggcctggacacgatcgtgaaggtgcgcgtcaaccacatcggccagatcgtgagcgtaggtgagtactga

SEQ ID NO: 8003 - RNA, 4311 nt, synthetic construct
  misc_feature 1..4311: note = Cas9 variant
  source 1..4311: mol_type = other RNA
atgaagcgcatcctgggcctcgacctggggaccaacagcataggctgggccctggtgaacgaggccgagaacaaggacgagcggtccagcatcgtcaagctcggggttcgcgtgaaccccctgaccgtagacgagctgacgaacttcgagaagggcaagtccatcaccaccaacgcggaccggaccctcaagcgcgggatgcggcgcaacctgcaacggtacaagctgcgccgggagacgctcaccgaggtgctgaaggagcacaagctgatcaccgaggacaccatcctcagcgagaatggcaaccgcacgaccttcgagacctaccggctgcgcgccaaggccgtgaccgaggagatctccctggaggagttcgcccgggtcctcctgatgatcaacaagaagcgcggctacaagagctcccggaaggccaagggggtggaggagggcacgctgatcgacgggatggacatcgctcgcgagctctacaacaacaacctgacccctggcgagctgtgtctccagctgctggacgccgggaagaagttcctccccgacttctaccggagcgacctgcagaacgagctggaccgcatctgggagaagcagaaggagtattatcccgagatcttaaccgacgtgttgaaggaggagctgcggggcaagaagcgcgacgccgtgtgggccatctgcgcgaagtacttcgtgtggaaggagaactacaccgagtggaacaaggagaagggcaagacggagcagcaggagagagagcacaagctcgaggggatctactccaagcgcaagcgcgacgaggccaagcgggagaacctgcagtggcgcgtgaacggcctgaaggagaagctcagcctggagcagctggtcatcgtgttccaggaaatgaacacccagatcaacaactccagcgggtacctcggcgccatctccgaccggagcaaggagctgtacttcaacaagcagaccgtgggccagtaccagatggagatgttagacaagaaccccaacgcctccctccgcaacatggtcttctacaggcaggactacctggacgagtttaacatgctgtgggagaagcaggccgtgtaccacaaggagctcaccgaggagctgaagaaggagatccgcgacatcatcatcttctaccagaggcgcctcaagagccaaaaggggctgatcggcttctgcgagttcgagtcccggcagatcgaggtggacatcgacgggaagaagaaaatcaagacggtcggcaaccgggtgatcagccgttccagcccgctgttccaggagttcaagatctggcagatcctgaacaacatagaggtgaccgtcgtgggtaagaagcgcaagcggcgcaaacttaaggagaactactccgcgctgttcgaggagctgaacgacgccgagcagctggagctcaacgggtcccggcgcctgtgccaggaggaaaaggagctgctcgcccaagagctgttcatcagagataagatgaccaagagcgaggtgctgaagctcctgttcgacaacccccaggagctggacctcaacttcaagaccatcgacggcaacaagacggggtacgccctgttccaggcctactctaagatgatcgagatgtcgggccacgagcccgtcgacttcaagaagcccgtggagaaggtcgtggagtacatcaaggcggtgttcgacctgctcaactggaataccgacatcctgggcttcaactccaacgaggagctggacaaccagccatactacaagctctggcacctcctgtacagcttcgagggcgacaacacacccaccgggaacggccgcctgatccagaagatgacggagctgtacggcttcgagaaggagtacgccaccatcctggccaacgtctccttccaggacgactacggaagcctctccgccaaggccatccacaaaatcctgccacacctgaaggagggcaaccggtacgacgtggcgtgcgtgtacgccgggtaccgccacagcgagtccagcctcacccgcgaggagatcgccaacaaagtcctgaaggacaggctgatgctcctgcccaagaactccctgcacaacccggtggtggaaaagatcctcaaccagatggtcaatgtcatcaacgtgatcatcgacatctacggcaagcccgacgagatccgcgtcgagctggcccgggagctgaagaagaacgccaaggagcgcgaggagctcaccaagagcatcgcacagacgaccaaggcccacgaggagtacaagaccctgctgcagaccgagttcgggctcacgaacgtgtcccggaccgacatcctgcgctacaagctgtacaaggagctcgagagctgcggctacaagaccctgtactccaacacctacatcagccgggagaagctgttctccaaagagttcgacatcgagcacatcatcccccaggcccgcctcttcgacgacagctttagcaacaagaccctggaggcccggtccgtgaacatcgagaagggcaacaagacggcgtacgacttcgtcaaggagaagttcggggagagcggcgccgacaactccctggagcactacctcaacaacatcgaggacctgttcaagagcgggaagatctccaagaccaagtacaacaagctgaagatggccgaacaggacatccccgacggcttcatcgagagggacctccggaacacccagtacatcgccaagaaggccctgagcatgctgaacgagatctcccatcgcgtggtggcgaccagcggctccgtcacggacaagctccgggaggactggcagctgatcgacgtgatgaaggagctgaactgggagaagtacaaggcgctcgggctggtggagtacttcgaggaccgcgacggccggcagatcgggcgcatcaaagactggactaagcggaacgaccaccgccaccacgccatggacgccctgaccgtcgccttcaccaaggacgtgttcattcagtacttcaacaataagaacgcgagcctcgacccgaacgccaacgagcacgccatcaagaacaagtacttccagaacggccgggccatcgcccctatgcccctgcgcgagttccgggcggaggccaagaagcacctggagaacacgctcatctccatcaaggccaagaacaaggtgatcaccgggaacatcaacaagacccgcaagaaagggggcgtcaacaagaacatgcagcagacgccccgtgggcagctgcacttggagaccatctacggctcagggaagcagtacctcaccaaggaggagaaggtgaacgcctccttcgacatgcggaagatcggcaccgtgagcaagtccgcgtaccgcgacgccctgctgaagaggctctacgagaacgacaacgacccgaagaaggcattcgccgggaagaacagcttggacaagcagcccatctggctggacaaggagcagatgcgcaaggtccccgagaaggtgaagatcgtgaccctcgaggccatctacacgatccggaaggagatctcctcggacctgaaggtcgacaaggtgatcgacgtgggcgtccgcaagatcctgatcgaccggctcaacgagtacggcaacgacgcgaagaaggccttctcaaacctggacaagaaccccatttggctgaacaaggagaaggggatctccatcaagcgcgtgaccatcagcgggatctccaacgcacagagcctccacgtgaagaaggacaaggacgggaagccgatcctggacgagaacggccggaacatccccgtcgacttcgtgaacacagggaacaaccaccacgtggccgtctactaccgccccgtgatcgacaagcggggccagctggtggtcgacgaggccgggaaccccaagtacgagctcgaggaagtggtggtatccttcttcgaggcggtgacccgcgccaacctggggctgccgatcatcgacaaggactacaagacgaccgagggctggcagttcctcttcagcatgaagcagaacgagtacttcgtgttccccaacgagaagaccgggttcaaccccaaggaaatcgacctgctggacgtcgagaactacggcctcatctccccgaacctgttccgggtgcagaagttcagcctgaagaactacgtgttccgccaccacctcgagaccacgatcaaggacacctccagcatcctgcgggggatcacctggatcgacttccgctccagcaagggcctggataccatagtcaaggtgcgggtcaaccacatcggccagatcgtgagcgtgggggagtactga

SEQ ID NO: 8004 - RNA, 4311 nt, synthetic construct
  misc_feature 1..4311: note = Cas9 variant
  source 1..4311: mol_type = other RNA
atgaagcgcatcctgggcctcgatctggggaccaacagcatcggctgggccctggtgaacgaggccgagaacaaggatgagcggtccagcatcgtcaagctcggggtgcgggtgaacccactgaccgtcgacgagctgacgaacttcgagaagggcaagtccatcaccaccaacgcggaccggaccctcaagcgcgggatgcggcgcaacctgcagcggtataagctgagacgggagacgctcaccgaggtgctgaaagagcacaagctgatcaccgaggacaccatcctcagcgagaacggcaaccgcacgaccttcgagacctaccggctgcgcgccaaggccgtaaccgaggagatctccctcgaggagttcgcccgggtcctcctgatgatcaacaagaagcgcggctacaagagctcccggaaggccaagggggtggaggagggcacgctgatcgacgggatggacatcgcgcgcgagctctataacaacaacctgaccccgggcgagctgtgcctccagctgctggacgccgggaagaagttcctaccagacttctaccggagcgacctgcagaacgagctggaccgcatctgggagaagcagaaggagtactaccccgagatcctcaccgacgtgctgaaggaggaactgcggggcaagaagcgcgacgccgtctgggccatctgcgcgaagtacttcgtgtggaaggagaactacaccgagtggaacaaggagaagggcaagacggagcagcaggagcgggaacacaagctcgaggggatctactccaagcgcaagcgcgacgaggccaagcgggagaacctgcaatggcgcgtgaacggcctgaaagagaagctcagcctggagcagctggtcatcgtgttccaggagatgaacacccagatcaacaactccagcgggtacctcggcgccatctccgaccggagcaaggagctgtacttcaacaagcaaaccgtgggccagtgccagatggagatgctggacaagaaccccaacgcctccctccgcaacatggtcttctaccggcaggactatctggacgagttcaacatgctgtgggagaagcaggccgtgtaccacaaggagctcaccgaggagctgaagaaggagattcgcgacatcatcatcttctaccagcggcgcctcaagagccagaaggggctgatcgggttctgcgagttcgagtcccggcagatcgaggtggacattgacgggaagaagaagatcaagacggtcggcaaccgcgtgatctcgcggtcctcgccactgttccaggagttcaagatctggcaaatactgaacaacatagaggtgaccgtcgtggggaagaagcgcaagcggcgtaagctgaaggagaactacagcgcgctgttcgaggagctgaacgacgccgagcagctggagcttaacggctccagacgcctgtgccaggaggagaaggagctgctcgcccaggagctgttcatccgggacaagatgaccaagagcgaggtgctgaagctgctgttcgacaacccccaagagctggacctcaacttcaagaccatcgacggcaacaagacgggctacgccctgttccaggcctactccaaaatgatcgagatgagcggccacgagcccgtcgacttcaagaaacccgtggagaaggtcgtggagtatatcaaggccgtgttcgatctgctcaactggaacaccgacatcctggggttcaactccaacgaggagctggacaaccagccgtactacaagctgtggcacctcctgtacagctttgaaggcgacaacacccccaccgggaacggccgcctgatccagaagatgacggagctgtacggcttcgaaaaggagtacgccaccatcctggccaacgtctccttccaagacgactacggatctctctccgccaaggccatccacaagattctgcctcacctgaaggagggcaaccggtacgacgtggcttgcgtgtatgccgggtaccgccactcggagtccagcctcacccgcgaggagatcgccaacaaggtcctgaaggaccggctgatgctcctgcccaagaactccctgcacaacccggtggtggagaagatcctcaatcagatggtcaacgtgatcaacgtgatcatcgacatctacggcaagcccgacgagatccgcgtcgagctggcccgggagctgaagaagaacgccaaggagcgcgaggagctcaccaagagcatcgcgcagacgaccaaggcccacgaggagtacaagacactcctgcagaccgagttcgggctcacgaacgtgtcccggaccgacatcctgcgctacaagctgtacaaggagctcgagagctgcggctacaagaccctgtactccaacacctacatcagccgggagaagctgttctcaaaggagttcgacatcgagcacatcatcccccaggcccgcctcttcgacgacagcttcagcaacaagaccctggaggcccggtccgtgaacatcgagaagggcaataagacggcgtacgactttgtcaaggagaagttcggggagagcggcgccgataactccctggagcactacctaaacaacatcgaggacctgttcaagagcgggaagatctccaagaccaagtacaacaagctgaagatggccgagcaggacatacccgacggcttcatcgagcgcgacctccggaatacccagtacatcgccaagaaggccctgagcatgctgaatgagatctcccaccgcgtggtggcgaccagcggctccgttacggacaaacttcgggaggactggcaactgattgacgtgatgaaggagctgaactgggagaagtacaaggccctcgggctggtggagtacttcgaggaccgcgacggccggcaaatcgggcgcatcaaggactggaccaagcggaacgaccaccgccaccacgccatggacgccctgaccgtcgccttcaccaaggacgtgttcatccagtacttcaacaacaagaatgcgagcctcgacccgaacgccaacgagcacgccatcaagaataagtacttccagaatggccgggctatcgcgcccatgcccctgcgcgagttccgggcggaggccaagaagcacctcgagaacacgctcatctccatcaaggccaagaacaaggtgatcactgggaacatcaacaagacccgcaagaagggcggcgtcaacaagaacatgcagcagacgccgcgcgggcagctgcacctggagaccatctacggcagcgggaagcagtacctcaccaaggaggagaaggtgaatgcctccttcgacatgcggaagatcggcaccgtgagcaagtccgcgtaccgcgacgccctgctgaagcggctctacgagaacgacaacgacccgaagaaagccttcgcaggtaagaacagccttgacaagcagcccatctggctggacaaggagcagatgcgcaaggtcccggagaaggtgaagatcgtgaccctcgaggccatctacacgatccggaaggaaatctcccccgacctgaaggtcgacaaggtgatcgacgtgggcgtccgcaagatcctgatcgaccggttgaacgagtacggcaacgacgcgaagaaggccttcagcaacctggacaagaacccgatctggctaaacaaggagaaggggatcagcatcaagcgcgtgaccatctccggcatctcgaacgcccagtccctccacgtgaagaaggacaaggacgggaagcctatcctggacgagaacggccggaacatccccgtcgacttcgtgaacaccgggaacaaccaccacgtggccgtctactaccgacccgttatcgacaagcggggacagcttgtggtcgacgaggccggcaacccgaagtacgagctcgaggaggtggtggtcagcttcttcgaagcggtgacccgcgccaacctggggttacccatcatcgacaaggactacaagacgaccgagggctggcagttcctcttctccatgaagcagaacgagtacttcgtgttccccaacgagaagaccgggttcaacccgaaggagatcgacctgctggacgtcgagaactacggcctcatcagccccaacctgttccgggtgcagaagttctccctgaagaactacgtgttccgccaccatctcgagaccacgatcaaggacaccagctccatcctgcgggggatcacctggatcgacttccgcagctccaagggcctggacaccatcgtcaaggtgcgggtcaaccacatcggccaaatcgtaagcgtgggggagtactga

SEQ ID NO: 8005 - RNA, 4311 nt, synthetic construct
  misc_feature 1..4311: note = Cas9 variant
  source 1..4311: mol_type = other RNA
atgaagcgcatcctggggctcgatctcgggaccaatagcatcggctgggccctggtgaacgaggccgagaacaaggacgagcggtccagcatcgtcaagctcggggtgcgcgtgaacccactgactgtagacgagctcacgaacttcgagaagggcaagtcaatcaccaccaacgccgatcggaccctcaagcgcgggatgcggcgcaacctgcagcggtacaaactgcgcagagagacgctgacagaggtgctgaaggaacacaagctgatcaccgaggacactatcctaagcgagaacggcaaccgcacgacgtttgagacctatcggctgagagccaaagccgtgaccgaggagatttccctagaggagttcgcccgggtcttactgatgatcaataagaagcgcggctacaagagctcccggaaggccaagggggtggaggagggcacgctgatcgatggcatggacattgcgcgcgagctctacaacaacaatctgacgccgggcgagctgtgcctccagctcctggacgccgggaagaagttcctccccgacttctaccgcagcgatctgcaaaatgagctggaccgcatctgggaaaagcagaaggagtactaccctgagatcctaaccgacgtactgaaggaggagttacggggcaagaagcgcgacgccgtctgggcaatatgcgcgaagtacttcgtgtggaaggagacctacacggagtggaacaaggagaagggcaagaccgagcaacaagagcgggagcacaagctcgaggggatctactccaagcgtaagcgcgacgaagccaaaagagagaacctgcagtggcgcgtaaacggtctgaaggagaagctcagtctggagcagctcgtcatcgtcttccaggaaatgaacacccagatcaacaactccagcgggtacctcggcgccatttccgatcggtctaaggagctgtacttcaacaagcagaccgtgggccaataccaaatggagatgctggataagaaccccaacgcctctctccgcaacatggtcttctaccggcaggactacctggatgagttcaacatgctgtgggagaagcaggccgtgtaccacaaggaactcacggaggagctgaagaaagagattcgcgacatcataatcttctaccagcgccgcctcaagtcgcagaagggcttgatcggcttctgcgagttcgagtcccggcagatcgaggtggacatcgacgggaagaagaagattaagaccgtcggcaacagggtgataagccgctccagcccgctgtttcaggagttcaagatctggcagatcctgaacaacatcgaggtgaccgtcgtggggaagaagcgcaagcggcgcaaactcaaggagaactacagcgcgatcttcgaggagctgaacgacgcggagcagctggagctgaacggctcccggcgcctctgccaggaggagaaggagctgcttgcccaagagctgtttgttcgggacaagatgaccaagagcgaagtcctaaagctcctgttcgacaatccccaagaactggacctaaattttaagacgatcgacggcaacaagaccgggtacgcactcttccaggcctacagtaagatgatcgaaatgagcgggcacgagccggtcgactttaagaagcccgtcgagaaggtggtcgagtacataaaggcggtcttcgacctgctgaactggaacaccgacatccttgggttcaactccaatgaggagctggacaaccagagctactacaagctgtggcacctcctgtactccttcgagggcgacaacaccccgacagggaacggccgcctgatccagaagatgaccgagctctacggcttcgaaaaggagtacgccaccatcctggccaacgtcagcttccaggacgactacgggtccttaagcgcgaaggccatccacaagatcctcccgcacctgaaggagggcaatcggtacgatgtggcgtgcgtctacgctgggtatcgccactccgagagctccctgaccagggaggagatcgccaacaaggtgcttaaggacaggctcatgttactccccaagaacagcctgcacaaccccgtggtcgagaaaatactgaaccagatggtgaacgtgatcaacgtcatcatcgacatctatggaaagccggacgagatccgcgtggagctcgcccgggagctgaagaagaacgctaaggagcgcgaggagctgacgaaatccatcgcgcagactaccaaggccaatgaggaatacaagacactcctgcagacggagttcgggcttaccaacgtcagccggaccgacatcctccgctataagctgtacaaagagctggagtcgtgcgggtacaaaaccctctattcgaacacctacatcagccgggagaagctgttcagcaaggagtttgacatcgagcacatcatcccccaggcccggctgttcgacgacagcttctccaacaagacgctcgaggcccggagcgtcaacatcgaaaagggcaacaagaccgcgtacgacttcgtgaaggagaagttcggggagtccggcgcagataactcgctggagcactacctgaacaacatcgaggacctcttcaaatccgggaagatcagcaagaccaagtacaacaagctgaagatggccgaacaggacatccccgacggctttatcgagagagacctgcggaatacgcagtatatcgcaaagaaggctctctctatgctgaacgagatcagccacagagtggtcgcgacgtccggcagcgtgactgacaagctgcgggaggactggcagctcatcgatgtaatgaaagagctgaactgggagaagtataaggcgctggggctcgtagagtacttcgaggatcgcgacggccggcagatcgggcgcatcaaggactggacgaagcggaacgaccatcgccaccacgccatggacgccctgaccgtggccttcacgaaggacgtgtttatccagtacttcaacaacaagaacgcgagcctggaccccaacgccaacgagcacgccattaagaataagtacttccagaacggacgtgccatcgccccgatgcccctccgcgagttccgggcggaggccaagaagcacctggaaaacaccctgatcagcatcaaagccaagaacaaggtcatcacgggaaacatcaacaagacgaggaagaagggcggcgtgaacaagaacatgcagcagacgccgcgcgggcagctccacctggaaaccatctacggctctgggaaacagtacctaaccaaagaggagaaggttaacgccagcttcgacatgcgtaagatcgagaccgtctccaagtcggcgtaccgcgacgccttactgaagcggctgtacgagaacgacaacgaccccaagaaggctttcgccggcaagaactccctggacaagcagcctatctggctggacaaagagcagatgcgtaaggtgcccgagaaggtgaagatcgtcacgctggaggcgatctacaccatcaggaaggagattagccccgacctcaaggtggacaaggtgatcgacgtcggggtacgcaagatcctgatcgaccggctgaacgagtacggcaatgacgcgaagaaggcatttagcaacctcgacaagaaccccatctggctgaacaaggagaagggcatctctatcaagcgcgtgaccatcagcgggatctccaacgcccagagcctgcatgtcaagaaggacaaggacggcaagccgatcctggacgagaacggccggaacatccccgtggacttcgtcaacaccggtaacaaccaccacgtcgcagtgtactaccgccccgtgatcgacaagcgggggcagctggtggtagatgaggccgggaaccccaagtatgagctggaggaggtggtcgtgtccttcttcgaagcggtgactagagccaacctcggcctgcctattatagacaaggactacaagaccaccgaggggtggcagttcctgttcagcatgaaacagaacgagtacttcgtcttcccaaacgagaagatcgggtttaaccccaaggaaatcgatctgctggacgtggagaactacggactgatttccccgaacctcttccgggttcagaagttcagcctgaagaactacgtcttcaggcaccacctggagaccacgatcaaagacacctccagcatcctcaggggcataacctggatcgacttcagatccagcaaggggctggacaccatcgtcaaagtccgggtgaaccacatcggtcagatagtgtccgtcggcgaatactga

SEQ ID NO: 8006 - RNA, 4311 nt, synthetic construct
  misc_feature 1..4311: note = Cas9 variant
  source 1..4311: mol_type = other RNA
atgaagcgcatcctgggcctcgacctggggaccaacagcatcggctgggccctggtggacgaggccgagaacaaggacgagcggtccagcatcgtcaagctcggggtgcgcgtgaaccccctgaccgtcgacgagctgacgaacttcgagaagggcaagtccatcaccaccaacgcggacaggaccctcaagcgcgggatgcggcgcaacctgcagcggtacaaactgcgccgggagacgctcatggaggtactgaaggagcacaagctgatcaccgaggacaccatcctcagcgagaacggaaaccgcaccacgttcgagacctaccggctgcgcgccaaggcggctaccgagaagatctccctggaggagttcgcccgggttctactgatgatcaacaagaagcgcggctacaagagctgccggaaggcgaagggggccgaggagggcaccctgatcgacgggatggacatcgcccgcgagctctacaacaacaacctgacgccgggcgagctgtgcctccagctgctggacgccgggaagaagtacctccccgacttctaccgatccgacctgcagaacgagctggaccgcatttgggagaagcagaaagagtactaccccgagatcctcaccgaggtcctgaaagaggagctgcggggcaagaagcgagacgcggtgtgggccatctgcgccaagagcttcgtgtgggaggagtactacaccgagtggaacaaggagaagggcaaaaccgagcagcaggagcgggagcacaagctcgaggggatctactccaagcgcaagcgcgacgaggccaagagagagaacctgcagtggcgcgtcaacggcctgaaggagaagctcagcctggagcagctggtgatcgtgctccaggagatgaacatccagatcaacaactccagcgggtacctgggcgccatctccgaccggagcaaggaactgtacttcaacaagcagacggttggccagtaccagatggagatgctcgacaagaaccccaacgcgtccctgcgcaacatggtgttctaccggcaggactatctagacgagttcaacaccctctgggaaaagcaggccgagtaccacaaggagctgaccggggagctgaagaaggagatccgcgacatcgtgatcttctaccagcggcggttaaagagccagaagggcttggtgggtttctgcgagttcgagtcccggcagatcgaggtggagatcgacggcaagaagaagatcaagaccgtagggaaccgcgtcatcccgcggagcagccccctgttccaggagttcaagatctggcagatcctgaacaacatcgaggtgacggtggtcggcaagaagggcaagcgccggaagcagaaggataactcccccaccctgttcgacgggctggacgacaccgagcagctggagctcaacggcagccgctacctgtaccaggaggagaaggagctgctcgcccaggagctgttcgtgcgggacaagatgaccaagtccgacgtgctgaagctcttgttcgacaacccccaggagctggacctcaacttcaagacgatcgacgggaacaagaccggctacaccctgttccaggcctacagcaagatgatcgagatgtctgggcacgagccggtcgacttcaagaagacggtggagaaggtcgtggagcacgtgaaggccgtcttcgacctgctcaactggaatacggacattctgggcttcaacagcaacgaggagctggacaaccagtcctactacaagctctggcaccttctctacagcttcgagggcgacaacacccccaccgggaacgcgcgcctggtccagaagattaccgagctgtacgggttcgagaaagagtacgccatcatcctggccaacgtgacgttccaggacgactacggatccctcagcgccaaggccatccacaagatactgccccacctgaaggagggcaaccggtacgacgtcgcgtgcgcctacgccgggtataagcactcagagagcagcctcaccaaggaggagatcgccaacaaggccttaaaggaccgcctgaccctcctacccaagaacaacttacggaacccggtggtggaaaagatcctcaaccagatggtcaacgtgatcaacgcgatcatcgacacctacggcaagcccgacgagatccgcgtggagctggcccgcgagctgaagaagaacgccaaggagcgtgaggagctcacaaagttcatcgccgagaccacccgcaagcacgaggagttcaagatactgctccagagcgagttcggcctcaccaacgtctcccggaccgacatcctgagatacaagctgtacaaggagctcgaaagctgcgggtacaagacactgtactccaacacctacatcccccgggagaagctgttcagcaaggagttcgacatcgagcacatcatcccccaggcgcgcctcttcgacgactccttcagcaacaagaccctggaggcccggtccatcaacctggagaagggcaataagactgcctacgacttcgtgaaggagaagttcggggagagcggcgccgacaacagcctcgaccactacctgaacaacatcgaggacctgttcaagtccggcaagatcagcaagacgaagtacaacaagctcaagatggccgagcaggacatcccggacgggttcatcaatcgggacctgcggaacacccaatacatcgcgaagaaggccctgtctatgctcaacgaaatcagccgccgggtggtcgccacctccggcaccatcacggacaagctgcgccaggactggcaactggtggacgtgatgaaggagctcaactgggagaagtacaaggccctggggctggttgagtacttcgaggacaaggacggccggcagatcgggcgcatcaaggactggaccaagcggaacgaccaccgccaccacgccatggacgcgctcaccgtggccttcaccaaggacatcttcatccagtacttcaacaacaagaacgccagcctgaacagcaacacgaacgagtacgccatcaagaacaagtacttccagaacggccgggccatcgcgcccatccccctgcgcgagttccgggtggaggccaagaagcacctcgagaacaccctgatcagcatcaaggccaagaacaaggtcgtgaccggcaacatcaacaagaccaagaagcgcgggggcgtgaacaagtacctgcaacagacgccacgggggcagttacacctggagacgatctacggctccgggaagcagtacctgaccaaggaggagaaggtcaacgcgagcttcgacatgaagaagatcgccaccgtaagcaagagcgcctaccgcgacgtgctcctgaagcgcctgcacgagaacgacaacgacccgaagaaggccttcacgggcaagaactccctcgacaagcagcccatctggctggacaaggagcagacccggaaggtccccgagaaggtgaagaccgtgaccctggagacgatctacaccgtccgcaaggagatcagccccgacctcaaggtggacaaggtgatcgacgccggcgtccggaagatcctgaccgggcgcctgaacgagtacggcaacgacgccaagaaggcgttctccaacctcgacgagaacccgatctggctgaacaaggagaaggggatcagcatcaagagagtgaccatctccggcattagcaacgcccagagcttacacgtgaagaaggacaaggacgggaagcccatcctcgacgaggattcccgcaacatccccgttgacttcgtgaacacgggcaacaaccaccacgtggccgtctaccggcgccccgtgatcgacaagcggggtcaactggtgatcgacgaagccgggaacccgaagtacgagctggaggaagtcgtggtgagcttcttcgaggccgtcacccgcgctaacctcggccagcccatcatcgacaaggactacaagacctccgaggggtggcagttcctgttcagcatgaagcagaatgagtatttcgtgttccccaacgagaagaccggcttcaacccgaaggagatcgacctgctcgacgccgagaactacggggtgatctcccccaacctgttccgggtccagaagttcgcccacaagaactacgtgttccgccaccacctggagacgaccatcaaggacaccagctccatcctcaagggcatcacctggatcgacttccggagctcaaagggcctggacgccatcgtcaaggtccgcgtgaaccacatcggtcagatcgtcagcgtgggcgagtactga

SEQ ID NO: 8007 - RNA, 4311 nt, synthetic construct; identical to SEQ ID NO: 2207
  misc_feature 1..4311: note = Cas9 variant
  source 1..4311: mol_type = other RNA

SEQ ID NO: 8008 - RNA, 4314 nt, synthetic construct
  misc_feature 1..4314: note = Cas9 variant
  source 1..4314: mol_type = other RNA
atgaagtacatcaagtacatcctgggcctcgacatcggcagcaactccatcggctgggccctaattcaactggacctcctgcagaagaccaagcgcatcatcgccacggggagccggatcattcccatggaccagaaggtgctgtccgacttcggcaaggggatcacgatcagccctaccgcgcagcgcacgtcctaccggaatgcgcgccattgccgggagcgccacctactgcggcgcgagcggctgcaccgcgtcctccacatcttaggcttcctgcccacccactacgacaagcagatcgacttcagcaagcggtacggcaagtttgttgacaacacggagcccaaaatcgcctacaacgagcgcaagttcctgttcatggatagtttccaggagatgctggccgacttcaagatccaccagcccgacctgttctacacgaagaagaacggggaggagagtaagatcccgtacgactggaccatctactacctccggaagaaggccctgtcccgcaagatcagcaaagaggagctggcgtggatcatcctcaacttcaaccagaagcggggctactaccaactgcgcgaagaggaggaggagaacaaggagaatgacttcgagatcatctccagcaagatcatctccgtgatcaagaaggacaaagacaagaagtacaacaagtattggtacgacatcatcctggagaacgggctcgtctaccaggccgcgttctacaatgacttcgtgtacaattggatcaaccaggaccgggagttcataatcgagcgaattagcctgaagaacggcaccgagaaggtgaagctgtcctacctccccacgtttgacgagatcgacaaaatggacaagaaggagcaggacaagtactacaagaagatcaagatcaagaccgagaactctatcgggaacaagaccgtcggctgctacatttacgaccacatcctgcagaaccccaacgagaagattaagggcaagctggtgcggacgatcgagcgcaagtactacaaggaggagctgaaggccatcctggagaagcaggttgcgctgcagcccgagctgttcacggaccaactgttcgccgactgcatccgggagctgtattccaagaacgaggcccagcaacgcaacctcgccgcccgcgacttcgtgcatctattcgtggaggacatcatcttctaccagcggagcctgcgccggcagaagtccaccctcgcgaactgcagcctggagtcccgctcctacatcgacaaggacagccatactcggaaggaggccccgctgaaagtgtgtcccaagtccaacccctactaccaggagttccgcgtcctccagtggctgcagaacctgaagatctacgagatcgacacagaccaggaggtgacgcacgagttcatcaagaccctcgaggacaagcagcagttcttcgacttcctgatgaaccagaaggagatagactgtgaggagctgctcaagtacttcctgaaccagacctaccccaacgcccgggagaaggccctcaagagcgagctcaagaaatggaaagatacctaccgctggaactacgtgtacgacatcggggagaagtccagcaagaagtacccgatgaacgagacgcggtacgagctgaagcgccacctggagaaggtagccaacctgcccgacgacttcctctccagcgaggtggagtacctgctgtggcacctcatctactccgtcaaggacaaggtcgcgtacgagaagggcctgaagacctttgcacagaagcaccatctggacaaggacagcttcgtggagtccttcaagaaattcaagccctatcccagcgagtacgggtccttcagcgagaaggccatccggaagctcctgccgctgatgcgcttcggctcctactgggacttcaaccacatcgacaagaacacccagaagcggatcgaggacctcatcaccggcgtggagaacgaagaaatccgcacgatcctgcgggagaaggccgagaagtaccaattagagaaggagaccgacttccaggacctccccctgtggctggcccagtacatcgtttacaacaggcacgcggaggccagctccctcgagaagtggaccagcgtgaacgacctggagacctacctgaacgagttcaagcagtactccctccggaaccccattgtcgagcaggtcgtgatggagactctgcgcgtagttcgggacatctggcagcagtacgggcagggacaagccagcttcttcgacgagatccacatcgagctggggcgcgagctcaagaagaccgccaaggagcgcgagaaactgagcaagcagaaccagaaaaacgaagacatcaacctgtccatcaaggagaagctcaaggagctggagaagtacaacacccgggcctatagcatcacgcaccaggagaagtacaagctgtggctcgagcagaaacacatctccccctacacgggccagatcatcagcccggagaacctgtttaccgacaactacgagatcgaacatataattccccagtcccgcttcttcgacgacagcctgtccaacaaggtggtctgcgagagcatcgtgaacaaggcgccctacaaggaccggcagctcgggctggagttcatcaagaaccagggcggccgcatcgtgaaggaactgagtaccgagaacaagacaatcaagatcttcacggaggagcagtaccgcaccttcatcaaggagcactacagcaacaaccccgagaagaccaagaagctcctgctggaggagatcccggagaagatggtcgcccgccagatgaacgacacgtgctacatatctaagtttatcagcgagatcctgtccaagatcgtgcggagcgacgagcaggacgagggggtgcactccaagaacgtcatcctgtgcaccggcaagatcaccagcgccctgaaacaggactggggcgtgaacgacgtgtggaacgacctcatcctgccccgcttcgagcggatgaacgacctgacccagtccaccctcttcaccacgtacaacgagaagtaccagaagtacctgcccaccgtccccatggagtacagcaacgggttccagaaaaagcgcatcgaccaccggcaccacgccatggacgcgatcattatcgcctgcgccacccgagagcacatcaactacatcaacaaccagcacgccctggagaagggtaaggacaagaaagagaaacagaaggagcacgacaaacttcgggagaagctgtgcatcaagaaggacaacaagggcagcgaggagaactactcctggatcttcaagaagccgtgggacaccttcacgcaggaggtgcaggccgcgctggaaggcatcgtggtgagcttcaagcagaacctccgcgtaatcaacaaggctaccaactactacgaacggtgggtggaggaaaacggcaagtatataaagaagatggtcaagcaggagggcacgaattgggccatccgcaagcccctgcatgaggagacaatctccgggaagatctacctggaccgggaggagatcacgaagaacgacattctcacagccacccgcaagactgtggacagctccttcgacgagaagcgaatcaagaagatcacggacaccggcatccagaagatcctgctgaactacctgaagtataaggggagccccgagatcgccttctccccggagggactggaggagcttaacaagaacctcagcatatacaacgacggcaagccccacaagcccatctacaaggtgcgcatctatgagaagggctccggccggttcgcgctgggagagaagggccgcaagtacaagaagtacgtccaaggcgcccccaacttatactttgggatctaccagggcgccaacaagcgtagcttcgccaccataccactcaacgaggtgattgagcggcaaaagcaggggcgcccctccatccccgagtacaacgagaaaggcgaccccctactgttcagcctatccccgaacgacctggtgtacgtccctgtggagggggagatcatagaggacattgacttccagaacctgagcaaggaacagaaggagcggatctacaacgtaaacgacttctccagcacgtgctacttcacccccaaccgcatcgccaaggcgatcttccccaaagaggtcgacctccaacggaagggcgacaagctgccgggctcctacgacaccaagaccgccagcctggagggaatccagatcaaggaggtgtgcatcaagctcaagatcgaccgcctggggaacatctccaaggcctga

SEQ ID NO: 8009 - RNA, 4317 nt, synthetic construct
  misc_feature 1..4317: note = Cas9 variant
  source 1..4317: mol_type = other RNA
atgaagaccatcctgggccttgacctggggaccaacagcatcggctgggccctgatcaagcagaacttcgagaacaagtacggggagatcctcggtatggggtcccgcatcatccccatgagccaggacatcctgggtgagttcggcaaggggaactccgtgagccagacggccgcgcggaccgactaccgcgccacccggaggctgcgggagcgcttcctccttcggcgcgagcggctgcaccgcgtccttaacgtgctgaacttcctgccggagcactacgcctcccagatcgacttcgacaagcggttcggcaaattcaaggtggagaccgagcccaagctcgcctggaagaacatcgacgggaagttcagcttcctgttccagacgagtttcaacgagatgctggaggacttcaaggcccacggccaggacctcaaggtcccctacgactggaccatctactacctgcgcaagaaggcgttaagccagaagatcgagaaggaggagttagtgtggatcctgctgaacttcaaccagaagcgggggtactaccagctacgcggcgaggaggaggaggagaaccccaacaagctgatcgagttttactccctaaagatcatcgacgtgctcgccgacgagccacagaaaggcaagagcgacatctggtactccctcgtcctggagaacgggtggatctaccggcgcagctccaagaccagcctcctggactggaaggacaagatccgggactttatcgtgaccacggacctgaacgacgacggctccgtgaagaccgacaaggaggggaacgagaagcgcagcttccgggcccccggcgagaacgactggaccctcgtcaagaccaagacggagcaggagatcgaccgctcccggaagaccgtgggcaactacatctacgagaccctgctgcagaaccccaagcagaagatcaaggggaagctcgtgcggaccatcgagcgcaagttctacaaggaggagctgaagcggatcctcgagaagcagaaggagttccatcgcgagctcgagagcaatgacctgtacaacgactgcatccgggagctgtaccgcaacaacgaggcccaccagctcacgctgtccaagaaggacttcgtccacctgttcatggaggacatcatattctaccagcggcccctcaagagccagaagtccagcatcagcaactgcaccctggagttccgcaagtacaaggacgagaacggcatcgagcacacccagttcctgaaggcgatcccgaagagtaatccctactaccaggagttccggatctggcagtggatcttcaacctcaacatctacaagaaggacaacgacgacaacgtaacgaaggagttcctgaacacgacccgcgacttcgagaacctgttcgagttcctcaacaaccggaaggagatcgagcagaagcccctgctgaaattcctgctcgagcagaaggagttcaaggggaaactgctgaacgccgagaccgagaagttccgctggaactacgtggaggacaagaagtacccctgcaacgagacccggacgatgatcagcgagcgcctcaagaaggtcgagaacatctccgacgacttcctaacccgggagatggagcagaagatctggcacatcatctacagcgtgaacgacaagaccgagtacgagaaggccctgaagtcctttgccgagaagaacaacctcgacgagaacagcctgttcgaggccttcaagaagctgccgcccttcaagtccgagtacggcagcttctccgagaaggcgatcaagaagctcctacccctgatgcgcctcgggaagtactggagctacgccaagatcgacctgtactccaagaaccggatccagaagatcatcaccggcgagttcgacgagaacatcaaggaccgcgtgcgggagaaggccatccgcctgacggcagagaacgacttccagggcctccagctgtggctggcccagtacatcgtctacgggcggcacagcgaggcgtccatgatcggcaagtggaacagcgccgacgacctcgaggagttcctgaaggagttcaagcagcactccctgcgcaaccccatcgtggagcaggtcatcaccgagaccctccgcatcgttaaggacatctggctgaaatacgggaacggcgccaaggacttcttcaacgagatccacatcgagctgggacgggagatgaagcagaccaaggacgagcgcgccaacgccacgaaaaccatcaccgagaatgagaacaccaacctccggatcaaggcgctgctggccgagatgatgaacgaccacagcgtggagaacgtgaggccgtactcccccatgcagcaggagatcctcaagatatacgaggacggcatcctcaagagcgatatcgagatcgacgacgatatcctcaagataagcaagacggcccagccctccagctccgacttgaagcggtacaagctgtggctggagcagaagtacaagagcccctacaccggccagatcatcccgctcaacaagctgttcacccctgagtacgagatcgagcacatcatcccccagtcccgctacttcgacgacagcttctccaacaagatcatctgcgagagcgccgtcaacaagctgaaggataactacatcgggctcggcttcatcaagcagttcgggggcaccatcatcgagtgcgggttcggcaagcgggtaaaggtcttcgaggtcggcgaatacgaggagttcgtgaagaagcactacgccaacaacagggggaagcggaacaagctgctgctcgaggagatccccgagaagatgatcgagagacagatgaacgacacccggcacatctccaagtacatcagcggcatcctgtctcacatcgtccgcgtggaggacgggacggacgagggcgtgaacagcaagaacgtcatcccggggaacgggaaaatcaccacgcagctgagacaggactggggactcaacgacgtgtggaacgagctgatcctgccccgcttcgagcggatgaatcaactcaccaactccaccgacttcaccagctggaacgagaaccaccagaagtatctacccaccgtgcccgtcgagttctccaaggggttcagcaagaagcgcatcgaccaccggcaccacgcgttagacgccctcgtgatcgcctgcgccaccaaggaccacgtgaacctgctgaacaaccagtccgccaagagcgcgacgaagcgctacgacctcaagaagaagctgatgaagttcgagaagaccgtctataaggacccgcagaccgagaagcggatcgagcgcgaagtgcccaagcacttcctgaagccctgggagaccttcacggtggacgccaagaaccggctcgagaccatcatcgtcagcttcaagcagaacctgcgcgtgatcaacaaggccaccaactactacgagaagtatgtggagaaggacggggtcatgatgaaggagcgcgtggagcaaaccgggacgaactgggccatccggaagccgatgcacaaggagaccgtctccggcaagatcgacctgccctgggtcaaggtgcccaagggcaagatcctcaccgcgacccgcaaaagcctggacacgtccttcgacctgaaggccatcgccagcatcaccgacaccggtatccagaagatcctcaagaactacctggagttcaaagagtcccctgagctggccttcagcccggagggcatcgaggacatgaacaagaacattgagaagtacaatgggggacggccccaccagcccatctccaaggtgcgcgtctttgagctcgggagcaagttccaggtcgggcagaccggcaacaagaaggacaagtacgtggaagccgcgaaggggacgaacctgttcttcgctatctacgaggacaagaagggcaagaggtcctacgagaccatccccctgaacgaggtcatcgagcgccagaagcaagggctcagcgtggtggacctgaagaacgtcaacgacttcttcctgtgtccgaacgacctcgtgtacatcccctcgggcgacgagttcgagaaccgggggagcatcgagatcgaaaacatcaccaaggagaagtccgaacgcttctacaaggtggtcagcttctccggtagccagatcttcttcgtgcggcacgacattgccgtgtccatcgttaacaagggcgagttctcgaccctgaacaagatggaaagagccatcgacgggtccatggtgaaagagatctgcatcaagctgaagatcgaccggctcggcgacgtgctgaaggcctga

SEQ ID NO: 8010 - RNA, 4317 nt, synthetic construct
  misc_feature 1..4317: note = Cas9 variant
  source 1..4317: mol_type = other RNA
atggtgaagaagggctacaccatcgggctggacatcggcaccacgagcgtggggtgggccgtgaccgacgacgacttcgagctcgtgaacaagaagatgtccatcaaggacaagagcggctccaccatcaagcgcgtccggaagaacctgtggggcgtgcgcctgttcgacgaggccaagaccgcggagaacacgcggcgcacacgcggggtgaggcgcaggatccgaagacggaaggagcgcctcaactacctgcagggcatcttcagctccgagatggccaagatggacgagaacttcttcatgcggctggaggagagcttcttcaagctctccgacaagagcgagcagaacaagttcccctacgccctgttcaagaacgagatcgaggagaaggcttactacaggcagtttccgaccatctaccacctccggaagcacctcatggagcacgaggagtccgacctgcgcaagatttacctggggctccaccacatactgaagtaccggggccacttcgttcaagaggggcagaagatggacgtggccaacatcgacatccaaggcaacctgaaggagctgttcaacgcgcttaacgagaacttctcaaacaaggaggacgacttcgagcaggagcgcatgaaggacggtgtgaagcgggccaaggtcctgttcgacaccgagaagctcgccgccgtggaggagatcctgaaggagaagatctccaagtcctggaaggtgaacaagatctccaagggcattctggctgagaagaaggacctccccatcttcaaggccatcgtcggcaacaagatcgatctggccgggatattcgactgccccgactacgccgagaaagtgaacgagagcatcaaggagctgaaggacaaggtgtacttcaacaaggaggatttcgaggaaacattcgagaaactctcccagcttctgaaggaggaggagctcgagatattaatcctggcccgcaagtgctacgaggcggtccttttagccgacatcatgcagggcgagcagagcctgtccgacgccatggtggccaagtacaacgaccacaagaaagacttggtgatctttaagaagttcgtcatcgactattttagcgaggacgtttactttgacctgttcaagaacacccagctagccgggaactaccactcctacgtgaagggcgagcggaagggcaacaagttcaaccacgcgagcctcgacgacttctacaagttcgtcaaaaaggaactggacaagaaggccgaggagctaagcgagcaccccgtatacaagcagatcctccagaagatcgagctggagaccttcctgccgaaacagcgcatgttcaagaacggggccatcccctaccaggtccacctccacgaactgcgcgccatcatcaagaagcaggaaaagcggttcccgttcctggccgagaagatcatcatcaaagacaaccagaaggacatctccgagtataagatcgagacgctcatgaagttccgcatcccctactatgtcggcccgctgatcgaggcgcgggagggggagctgggcaagaagcgcacgaactacagccggttcgcctggatgcagaagtcccccgagagccagaatatcgggataaccccctggaacttccactctgtggtcgataaggacgctagtgcttccgagttcatcgaacgcatgaccggcttctgcagctatttccccgaggagcccgtgctccccaagaactccctgatctaccagcagttcaccgtgttccaggaactgagcatagtgggctactacgacgagcagaatcggaagcactacctggacggggagacacgccggcgcatcttcgaggacctcttcaagaagaaccggaccgtgtccgccggcctgctgcgcaagtggctcgtgtgcaaccagcggaccagccaggaggagaaagaaatcagactattcgggctggacctcaaaaagaacggcctggggtccggcaacttcaacaccaaatacacgacctacctggacctcaaggacgcgggcatcaccgagaagcagctgaagcagcacaaggacttcttcgagaagatcgtcaagtaccagaccatattcgaagacaagaagatcctgaagcggcgcatcatactcctgaacgaggagcagcccctgctctcagaggagcaaataaagaacctggccaagaagcactacacggggtggggcaacctgtccctcaagctgatcgacgggatccaggacaagggcaagacgattctggactacctcgagacccaggactacaaccagaatctgatgcagctgatgaacgacgagaacaagagcttcgagatgcaaatcgagcaggcccgggccgggaaggtgcagttcggcaagatcgattactccttcgtggagcagctcgcgggcagccccgccataaagcgggggatctggcagtccctgcagatcgtcgaggaactggtggccttcctcggcaaggagaacatcaagaagattgtgatcgagatggcccgggagaaccagagctcaaagcgcaccaagtcccgccagaaacagatcgaggccctgtatcagaaggtcacgggggacctgaagaacgagcaggagaagatcgacgtgatgcagaatttcgataacgagcgggtgttcctctactacctgcagaacggcaagtgtatgcacagcggcgagaaactagagctctcccagctgagcgagtacgagatcgaccacatcatcccacagacctacatcaaagacgactccttcgacaacaaggtgcttgtgaccagaaacgccaaccagcagaagggcggggacgtgcccagctacgacgtaatcgacaagatgaagtcctactgggagaagctcaaggagaacaacctgatcagcgaaaagaagttcgccaacctgaccaaggggaagttcgacgaccagcagctctccggcttcatcaaccggcagctggtggagacgcgccagatcaccaagaacgtggccatcatcctagacaagatttacaacgacgaggccaagaacgagaaggaagtcgccatcatcaccctcaagagcgcgctgacctcccagtatcggcaggggatcatctacgtgcccaacgacgacttcgacgagctgaagctcgtgagcaagacgaactcccgcctgaaggaggtcaagctacacgacggcttctacaaggtgagggagatcaacgactatcaccatgcccacgacgcctacctcaacaatgtggtcgccacctacctgtacgaggccatgcccgacctgcgccccctcttcgtgtacggggagcacagtcgggagatccacaagcgcttcctggggaagtacgcgaccaccagaaagggccagttcaagcagctgttagtggacatgcaggacgagtactggatgcgcaaggacaaagaggggaacttcatcgacggcgagatcctgtggcggcgcgatgaggtcctgcagatcgtgaagaaggttctagactaccggaacatccagatcacgaagaagctggagatgatggtcaccgggggtgaggagaagtcgttctaccaggacagccgctgccgaaaggacaaaacggccatcccgtataagaccaactgggacccctccaagtacggcgggttcaagtcaccccggaccgcatacgccatcccggtgatcaagaagaacaaacccaaactggagcccgtgctcctcgtcaaccggagcaaagtggagacggacggccagttcgactgcgagaagttcaaggagttaaaccccaccctcaagatcctggggcagccgatctggaagtaccagtccttcgagatgtttgacggcaccaagcgctacatcgcgagcgcgagtgagatccacaaggggaaccagatcaagttctcccaagagcacatgaagttcatctcctgctgccagaaatacgacgaggtgaagaacaaactggccttcgacttcgtcaacgagagcaagcacctcttccaggagatcctgaccgccatcaaggacaacatccaccggtaccgcctgatcgcggagggcatcgaggtgcaccgcaagttctccaacatgctagagaacatcgagaagctgagcacgcaggagctggtggacaacctcctggacgcgatcaacatcacctccgtcggcaccaccaacaacgccttcgggcgggtgcgctacaaaggcagctacctgaacgaaatctggtccgccacgctcatccaccagagcgtgaccggtctgtacgagacccgggagaagctgatctga

SEQ ID NO: 8011 - RNA, 4323 nt, synthetic construct
  misc_feature 1..4323: note = Cas9 variant
  source 1..4323: mol_type = other RNA
atgaagaccatcctgggcctcgacctggggacgaacagcataggctgggccctggtagaacaggacttcgagaacaagcaggggctaatcctgggcatggggtcccgcatcatcccgatggacgccggcatcatcggcaaatttgcggaggggagcagtatcagccagactgccgagcggacgggataccgctccatccggcgcctgcgggagcgccaccttctgcggcgcgagcggctgcaccgcgtcctcaatatcctaaagttccttccggagcactacgccgccgaaatcgactttgagaagcggttcgggcagttcctcgccgagaccgaacccaagctggcgtggaagaagtcagccgagggcaagtttgagttcctgttccagcgcagcttcgacgagatggtggccgactttaaggccaacgggcaggacatcaagatcccatacgactggaccatctactatctccggaaaaaggcgctgacgcaaaagatcagcccccaggagcttgcgtggatcatactcaactttaaccagaagcgcggttactaccagctgcggggcgaggaggaagaggagaacccgaataagaaggtggagttctactccctaaagatcgttgacgtggtggccgacgagcaacccaacaagaagggggacacctggtactccctccatctggagaacggctgggtctaccgcaggtctagcaagatccccctgtacgactggaaggacaaggttcgcgacttcatcgtgaccaccgacatcaacgaggacgggtccgagaagctcgacaaggacggcgaggtcaagcggagcttccgcgcccccaaggaggacgactggacgcttataaagaagaagaccgagcaggagatcgagcagttcaaccagacggtgggctcctacatctacgaggctctgcttgacaacccgacccagaagatccggggcaagctggtccgcacgatcgagcgcaagttctacaagagcgaactgaagaagatcctcgagaaacagatcgagctgcagcccgagctgttcaccgaggacctctacaacgcgtgcgcccgggagctgtacaggtccaacgtcgcacaccagcagcagctgagctcccgggacttcgtgtacctcttcctgaacgacatcatcttctatcaacgcccgctgcggagccagaagtccttaatcagcaactgcagcctggaatttcgcaccatcaaggacaaggacggcaacggccagatcatctacctgaaggccatccctaagtccaacccatactatcaggagttccgggtgtggcaatggctctacaacctgaagatcttcaccaaggaggacgacaaggacgtcacgaaccaattcatcaacaaggtggaggacctggaggcactcttcgagttcctgatgaaccagaaggaggtgaaccacactgacatcctgacatacctcattgagcccatagtcaagagcaagtaccccaacgcgaaaggcaaggccttcaaagacgagctgaagaaggagctgaagaagtaccgctggaactacgtgtacgacgccgacaaggacgagtccaagtcctaccccatgaacgagacccggtacgagctgcgcaagcggttagacaaggtggagaacgtcccggccgacttcatgacgcgtaagatcgaacagcacctctggcacataatatactccgtgaccgacaagatcgagttcgagaaggccctcaagtcattcgcgaacaagtacgacctgcaccaggagtccttcgtggagaacttcaagcggttcaagcccttcgacagcgactacgggacatactccgagaaggccatcaaaaagctgctgcccctcatgcgcgtcggcaagtactggagctgggagggcatcgataacaacacaaagaagcgaatcgggaagattatcacgggcgagtacgacgaaaccataaagaaccgcgtgcgggaaaaggccatcgacctgaccgaggagaaccacttccagggtctgcaactctggctggcccagtacatcgtctacgaccgccactccgaggccgacatcgcgggcaagtggaacagcgtggcggacctggagcagtacctcagcgagttcaagcagcacagcctgcggaacccaatcgtagagcaggtcatcaccgagacgctgcgcgtggtgcgcgacatctggaagcaatacgggaagggcgccaaggactacttcgacgagatccacatcgagctcggccgggagatgaaaaacaccgccgaggagcgcaagcgtctgtcctcgatcatctccgagaacgagaccaccaacctgagaatccgggcaattctcgaggagctgatgtacgacgagaacatggagaatgtccgcccgtacagccccatgcaacaggaggcactgaagatctacgaggacggggtgctctcctcgagcgtggagattcccgaggacatcgagaagatcagcaagaagtccgagcccaccaagagcgagatccagcggtacaagttatggctggagcagaagtaccggagcccgtacacgggccggcccatccccctctccaaactgttcacccccgcctaccagatcgagcacatcatcccgcaggcccgcttcttcgacgacgggttcagcaacaaggtcatttgcgagtccgaggttaacgccctgaaggacaagatgctcggcctggagttcatacagaactactacgggcagaaggtgaccacgagcttcggcgaggtcaccatcctgaccgaggacgcgtacaaggccttcgtaaaggagcactacgacaagaaccggtccaagcgcaacaagctcctgctagaggagatccccgagaagatgatcgaccggcagatgaacgacacacgctacatctctaagtacatctccaaggtgctctcaaacctggtccggggcgagaaggacgacgagggggtgaactccaagaacattatccccggcaacgggaagatcagcggcaccctgaaacaggactggggcctcaacgacgtgtggaacgacctgatcctgccgcgcttcgagcggatgaaccagctcactaactccaccgacttcaccgcctggaacgagaaacaccagaagttcctgcccactatccccctggagctcagcaaggggttccagaagaagcgcatcgaccaccggcaccatgccctggacgccctgattatcgcgtgcgccacgcgcgaccacgtcaacttactgaacaacaagcacgccaagagccggaacgagcgctacgacctgcagcacaagctccgccacaccacaccgtggcaggacaaggaaggcaaggtgcggaccaagttcacagagttcaagaagccgtgggaaaccttcacccaagacaccaagaaggagctggagaagatcgtggtctccttcaagcagaacctgcgcgtaatcaacaaggccacgaactactacgagaagatcgtggacgggaagaaggtcatgttcaagcaggagggcgtgaactgggccatccggaagccaatgcacaaggagaccgtgagcgggaagatcgatctcccccgcgtcaaggtgtccaagggcaaaatcttaaccgctacccgcaaaagcctggacacatccttcaacgccaagaccatcctcagcatcaccgacaccggcatacagaagatcctgctgaactacctcaaggctaaggggaaccccgagctggccttctccccggaggggatcgaggagatgaaccagaacatcagcctgtacaacgacggaaagcctcaccagcccatcctcaaggtgcgggtcttcgaacagggctccaagtttccactgggggagacgggaaacaagaccaccaagtacgtggaggcggctaagggcaccaacctgttcttcggggtgtacgagaacaaccagggcaagcggagctacaacacaatcccgctcaacctggtcatcgagcgccaaaagcaggggcttaattccgtgcccgagaccaacgagaagggccaccggctcctattcagcctgtcccccaacgacctcgtgtatgtccccatagagggggaggtgttcgacaagaccaacccggacgtgaaccgcatctacaagatcgtcagcttctccggtagccagatgttctgcgtacgtcaggacgtggccacctccatcgtctacaagctggagttcagctccctgaacaagatggagcggacgatcgacggaatcatgatcaaggagatctgcatcaagctcaaggtggaccggctggggaacatcagcaaggcctga

SEQ ID NO: 8012 - RNA, 4323 nt, synthetic construct
  misc_feature 1..4323: note = Cas9 variant
  source 1..4323: mol_type = other RNA
atgaagaccatcctgggtctcgacctgggaaccaatagcatcggctgggccctggtggagcaggacttcgagaacaagcaggggctcatcctggggatggggagtcgaatcatccccatggacgccggcatcatcggcaagtttgcggaggggagctcgattagccagacggccgagcggaccggctaccgctccatccggcgcttgcgagaaaggcacctcctacgacgagagcggctgcaccgcgtcttgaacatccttaagttcctgccggaacactacgccgccgagatagactttgagaagcggttcgggcagttcctcgccgagaccgagcccaagctggcgtggaagaaaaacgccgagggcaaattcgagtttctgttccagcgcagcttcgacgagatggtggccgatttcaaggccaacggtcaggacataaagatcccctatgactggaccatatactacctccggaagaaggcgctgacgcagaagataagcccccaggagctggcctggatcatcctcaacttcaaccagaagcgcggctactaccagctgagaggcgaggaggaagaggaaaacccgaacaagaaggtagagttctacagcctcaaaatcgtggacgtggtggccgacgagcagcccaataagaagggggacacttggtactcgctccacctggagaacggctgggtttaccgccggagctccaagatccctctgtacgactggaaggacaaggtgcgcgacttcatcgtgactaccgacatcaacgaggacgggtcagagaagttggataaggatggcgaggtcaaacggagtttcagagcccccaaggaggacgattggacgctgatcaagaagaaaacggagcaggagatcgagcagttcaaccagaccgtgggcagctacatctatgaggccctgctcgacaacccgacccagaagatccgagggaagctagtgcgcacgatcgaacgcaagttctacaagtccgagctgaagaagatcctcgagaagcaaatcgagctgcagccggagctgttcaccgaggacctctacaacgcgtgcgcccgtgagctctaccgccggaacgtcgcccaccagcagcagctcagctcacgcgacttcgtgtacctcttcttgaacgacataatcttttaccagcggcccctgcgctcccagaagtccctcatcagcaactgcagcctggagttccggaccatcaaggacaaggacggcaacgggcagatcatctacctgaaggccatcccaaagagcaacccgtactaccaggagttccgagtgtggcagtggctctacaacctgaagatcttcacaaaggaggacgacaaggacgtcacgaaccagttcatcaacaaggtggaggacctggaggccctcttcgagtttttaatgaaccagaaggaagtgaaccacaccgacatcctgacctacctcatcgagcccatcgtcaaaagcaagtaccccaacgcgaagggcaaggccttcaaggacgagctgaagaaggagttgaagaagtaccggtggaactacgtgtacgacgccgataaggacgagtccaagagctaccccatgaacgagacccgctacgaactgcggaagcgcctcgacaaggtcgaaaatgtcccggccgacttcatgacgcggaagatcgagcagcacctgtggcacatcatctactccgtgaccgacaagatcgagtttgaaaaggcactcaagagcttcgcgaacaagtacgacctccaccaggagtcctttgtggagaacttcaaacgcttcaagccatttgacagcgactacgggacctactccgagaaggccatcaagaaactgctgcccctaatgcgggtcggcaaatactggagctgggacatcatcgacgacaagaccaagacccgcataggcaagataataaccggggagtacgatgagaccatcaaaaaccgggtgcgcgaaaaggccattgacctgaccgaggagaaccacttccagggcttacagctctggctggcccagtacatcgtctacgatcggcactccgaggccgatatcgcagggaaatggaacagcgtggccgacctggagcagtatctctccgagttcaaacagcatagcctgcgcaaccccatcgtggagcaggtcatcacggagaccctgcgagtggtgagggatatctggaagcagtacggcaagggggccaaggactacttcgatgagatccacatcgagctcggccgcgagatgaagaacacagccgaggaacggaagcgcctgagtagcatcatctccgagaatgagaccacgaacctgcggatacgcgcgatcctcgaggagcttatgtacgacgagaacatggagaacgtccggccttactctcccatgcagcaggaggcactgaagatctacgaagacggcgtgctctccagcagcgtagagatccccgaggacatcgagaaaatctccaaaaagagcgagccaaccaagtccgagatccagcgctacaagctgtggctggagcagaagtaccggagcccctacaccgggcgccccatccccctctccaagctgttcacccccgcctaccagatcgagcacatcatcccgcaggcccggtttttcgacgacggcttctctaacaaggtaatctgcgagtccgaagtcaacgcccttaaagacaagatgctcgggctggagttcattcagaactactacggccagaaggtgacgaccagcttcggggaggttacaatcctgaccgaggacgcgtacaaggccttcgtgaaggagcactacgacaagaaccgctcaaagcggaacaagctcctgctggaagagatccccgagaagatgatcgaccgccagatgaacgacaccagatacatcagcaagtacatctccaaggtactcagcaatctggttcgcggcgagaaggacgacgagggtgtgaactccaagaacataatccccgggaatggcaagatcactgggatcctgaagcaggactggggtctcaatgacgtgtggaacgacctcatcctgccgcggttcgagcgaatgaaccagctcaccaacagcaccgacttcaccgcctggaacgagaagcaccagaagttcctgccatccgtccccctagaattgagcaagggattccagaagaagcggatcgatcaccgccaccacgccctggacgccctgatcatcgcgtgcgccacgcgggaccatgtgaacctccttaacaacaagcacgccaagtccagaaacgagcgctacgacctgcagcacaagctccggcacaccaccccatggcaggacaaggaagggaaggtgcgcacgaagttcacggagttcaagaagccgtgggagaccttcacccaggataccaagaaagagctggagaagatcgtcgtgaatttcaaacagaacctgcgggtgatcaacaaggccacgaactactacgaaaagatagtcgacggcaaaaaggtgatgttcaagcaggagggggtgaactgggccatccgcaagcccatgcacaaggagaccgtcagcggcaagatagacctcccgcgggtgaaagtgagcaaagggaagatcctgaccgcgactcgcaagtctctggacacgagcttcaacgcaaagacaatcctctccataaccgacaccggtatccagaagatcctactaaactacctcaaggccaagggcaaccccgagctggccttcagtccggaggggatcgaggagatgaaccagaacatctccctgtacaacgatggcaagcctcaccagcccatcctaaaggtccgagtgttcgagcaggggagcaagttccccctgggcgagacagggaacaagactaccaagtacgtggaggccgccaagggcaccaacctgtttttcggcgtctacgaggataaccaagggaagcgcagctacgacacgatcccgctcaacatcgtgatcgaacggcagaagcagggcctgaacagcgtgccggaaaccaacgagaaggggcaccgcctgctgttctccctgagccccaacgacctggtctatgtgcccattgagggcgaggtcttcgacgagaccaacccagacgtcaaccggatctataaggtggtgtccttcagcgggtcccagatgttctgcgtcaggcaggacgtggccaccagcatcgtgtacaagctcgagttttccagcctgaacaagatggagcggacgattgacggcatcatgattaaggaaatctgcatcaagctgaaggtcgatcgcctcggcaacatctccaaggcctga

SEQ ID NO: 8013 - RNA, 4332 nt, synthetic construct
  misc_feature 1..4332: note = Cas9 variant
  source 1..4332: mol_type = other RNA
atgatcaagctgctctacctggagaagctgaagcagtacaccatgaagaagatcctcggcctagacctggggaccagttccatcggctgggccctcgtgaacgaggccgagaacagcgacgaggtctccagcatcatcaagctgggggtgcgcgttaaccccctgacggtcgacgagatgcagaatttcgagaagggcaagtccatcaccacaaacgcggaccgtaccctcaagcgcagcatgcggcgcaacctgcagcggtacaagctgcgccgggacgccctcatcgagctgctgaaaaaggtggggttcatcacggacaagaccatcctctccgagcagggcaaccgcaccaccttcgagacgtaccggctgcgcgccaaggcggccgaggaggagatcagcctgaaggagctcgcgcgggtgctcctgatgatcaacaagaagcgcggctacaagtcctcacggaaggccaagggggaggaggagggcgccctcatcgacgggatggagatcgccaagaagctgtacgacgaggacctgaccccgggccagctctgcctgcagctgctcgagtccgggaagaagttctttcccgacttctaccgcagcgacctgcaggaggagttcaacaagatctgggacttccagaagcagttcaacctgttctccttctgcgacgtcgcgaaggaggaggttaagggcaagaacaagagccagacctgggccatcctcgccaagtacttcgtggagactaagaaggtcaacgtgtggaacgagcacgaggcccagacggagaaccgggaggaggtgtacaagctggtcggcctgaagcgcaccgtgaagggggaggagctcaagaaggagaactaccggtggcgcgtgcaggccctgaccgaacagctggacctcgagaagatcgcggtcgtgctacaggagatcaacggccagatctccgccagctccgggtacctgggcgccatcagcgaccggtccaaggtgctctacttcaaccgccagaccgtcggccagtatcagatggccgagctgaacaagaaccccaacatgagcctgagaaacatggtgttctaccgtcaggactacctcgacgagttcaacgtgatctgggagaagcaggccgagttccacaaggagctgacgcccgagctgaagaaggagatccgcgacattatcatcttctaccagcggcgcctcaagagccagaaggggctgatctcattctgcgagttcgaaaaccgggaggtcgtggtggagaaagagggcaagaagcagaccaagatcatcgggtgcaaggtcatcccgcgcagccaccctctgttccaggagttcaagatctggcagaccctcaataacatcgaggtgttcgtcggcgagaagaaggggaagcggaagaaatccaacgtgagctcagacctgttcggcgacaccgaggacgcgctgatcacggagggccgccggttcctgtatcaggaggagaagaagatcctcgccaaggagctgtcgatcaagaaggggctgaccaaggccgagatcctccgcttactgttcgagaacccccaggagctcgacatcaacttcaagcagatcgacggcaaccaaaccgggttcgccctgttctccgcctacagcaacatgatcgagaagtacggctacgaacctctggacttcaagaagccggcggaggacctcatctcccagctgaagaccgtgttcacggacctggggtggaacaccgacctcctgttcatagacctggacaaggagaataaagagtgggagaagcaaccctacttccggctctggcacctcctgtactctttcgagggcgacaacacccccaccggcaacggcaagctcatcgagaagatcatgcagctgtgtggcatcgagaaagagtacgccatcgagctggccaacgtctccctccaggacgactacgggagcctgtccgccaaggccataaagaagatcctgctctacctgaaggagggcaatcagtacgacatggcgtgcgaatacgcggggtaccgccacagcaaatccagcctgacgaaggaggagattgagaacaaggtgctcaaagacaagctggagatcctgcccaagaactccctccggaacccggtggtcgagaagatcctgaaccagatggtcaacgtgatcaataccgtcatggaggtttacggccgccccgacgagatccgggtggagctggccagagagctcaagaagtccgccaaggagcgggaggagctgaccaaggcggtcgccaagaacacccgtgagcacgaggagatccggaaggtgcttcagagcgagttcggcatgatcaacgtgagccgcaacgacatcatccggtacaagctctacgaggagctgaaggacaacgggtacaagacgctgtacagcaaccagtacatcccccgcgagaagctgttctccaaggagatcgacatcgagcacatcatcccacagagtcgcctgttcgacgactccctgagcaacaagaccctcgagtacaagtccatcaacatcgagaagggcaacaagaccgcttacgacttcgtcaaggagaagtacggggaggagggcctgcagcagtacctgaaccggtgcgagaacctctgcaaggacaagaaggccaagctgcgcaagctgaagatggagctcaacgagatccccgacggcttcatcgaccgggacctgcgcaacacccagtacatcgccaagaaggcgctgagcatgctcacggagatttgccggcgcgtggtggccaccaccgggtccatcaccgacaagttacgggaggactggcagctggtcgacgtgatgaaggagctcaacctgcccaagtacgaggccctgggcctcgtggaggtatacgaggacaaggacgggcgcaagatcaagcggatcaaggactggaccaagcgcaacgaccaccggcaccacgccatggacgccctcacggtggcgttcaccaaggacgtgttcatccagtacttcaacaacaagaacgccgcctgggagagcgactccaaggagcataccaacatcgtcggcatcaagacccgctacttcgaaagcgggaaggccgtgccgccgatccccctgggccagttccgggttgaggccaagtgccacctcgagaacctgctggtctccatcaaggcgaagaacaaggtggtgacgaccaacgtcaactgcatcaagaagaagggcgggacctacaagaacacccagcagacgccccgcggccagctccaccttgagaccatctacgggtcgcataaccagtacgtgaccaagatcgagaaggtgaacgcctccttcgacgccgtcaagatcgccaccgtgagcaagcaggactaccggaacgcgctgctcaagcgcctggaggtgttcggcaacgatcccaagaaggccttcacggggaagaactccctggagaagaaccctatctacctcgaccgggcccagaccatccaggtcccggacaaggtgcagaccgtggagctggagacggcctacacgatccgcaaacccgtcgaccccaccctgaacgtggacaaggtggtcgacaagaagatccggctcatcctggagcagcgccttaaggagtacggcggcgacgccaaaaaggcgttcgtgaacctcgatgagaaccccatctggctgaacgaggaaaaggggatctcgatcaagcgggtgaccatccgcggcatctccaaggcccaagccctgcacgacaagaaggacaaggacgggaacttcatcctcgatgagaccggcaagcgcatccccgtcgacttcgtgaacacggggaacaaccaccacgtggccatctaccggaagcccgtcctggacaagaagggccaggttatcttcgacgatgagggcaaccccatgtacgagctggacgaggacgtggtcccgttcttcgaggccgtgacacgcgcgaacctcgggatccccatcatcgacaaggactacaagaaatccgagggctggcagttcctgttcagcatgaagcagaacgagtacttcgtcttccccaacgagaagaccgggttcaaccccaaggaggtggacctgttagacccggataactacgccatgatcagccccaacctgttccgggtgcagaagatcggcctgaacgactacacttttcgccaccacctcgagacgaccatccagaacgacctgaagttcatcacttggatccggtgcggcaagagcgggatcaaggacatcgtcaaggtgcgcatcaaccacatcggccagatcgtgtccgtcggggagtactga

SEQ ID NO: 8014 - RNA, 4332 nt, synthetic construct; identical to SEQ ID NO: 2214
  misc_feature 1..4332: note = Cas9 variant
  source 1..4332: mol_type = other RNA

SEQ ID NO: 8015 - RNA, 4341 nt, synthetic construct
  misc_feature 1..4341: note = Cas9 variant
  source 1..4341: mol_type = other RNA
atggtgaaaaacatcctgggcctcgacctggggaccaatagcgtcggctgggccctgatcaaacaggacttcgagaacaaacagggggacatactcggcatgggctcccgcatcatccccatgagccaggacgtgctgggcgacttcggcaaggggaactccatcagccagaccgccgagcgaacgaagtaccgctccgtgcggcgcctgcgggagcgcttcctcctgcggcgagagcggctgcaccgcgtcctcaacgtactggacttcctgccggagcactacgcgagccagatcgacttcaacaagcggttcggcaagttcaaggaggagactgagcccaagctcgcctactccaacgacgggttcatcttcaagaagtccttcgaggaaatgatcagcgacttcaagacccaccagcccgagttactggagaacaacaagaaggtgccctacgactggacgatctactacctccgcaacaaggcgctgagccacaagatcgagaaggaggagctggcctggatcctccttaacttcaaccagaagcggggctactaccagctgcgcggggaggaggaggaggagaacccgaacaagctcatcgagttctactccctgaagatcgttgacgtgctggccgacgagccccagaagggcaagagcgacatctggtactccctcatcctggagaacggctggatctaccggcgcagctccaagatccccctgctcgactggaaggggaagacgcgggacttcatcgtgacaaccgacctgaacgacgacggcagcgtcaagaccgacaaggaggggaacgagaaacgctccttccgggcgcccggggagaacgattggacgctggtgaagaagaagaccgagcaggagatcgacaattctgacaagaccgtgggcgcctacatctacgaggccctcctgcagaacccgaagcagaagatcaaggggaagctggtccgcaccatcgagcggaagttctacaaggccgagctcaagcagatcctggagaagcagatggagttccaccccgaactgcgccaggacgacctctactccgactgcgtgcgtgagctgtacaagaacaacgaggcgcaccagctgacgctcagcaagaaggacttcgtgcacctgttcatggaggacatcatcttctaccagcgtcccctgcgcagccagaagtccagcatctccaattgcacactagagttccggaagtacaaggacgagaacggcaccgagcacatccagtacctgaaggccctgcccaagtctaacccgtactaccaggagttccgcatctggcagtggatgtacaacctcaacatctacaagaaggaggacgacaccaacgtcacgaaggagtttttaaactccaaggccgacttcgagagcttattcgagttcctcaacaacaagaaggaggtggaccagaaagccctgctgaagcacttcaagatcaacgacaagacccatcggtggaagtacgtggaggacaagaagtacccctgcaatgagactaagaccatgatctccgagcgcctgaagaaggtcgagaacatcagcgacgacttcctcacgcgggagatggagcagaagatctggcacatcatctactccgtgaacgacaaggtgaagtacgagaaggccctcaagagcttcgcggagaaaaacaatctggacgagtcctccttcttcgaggccttcaagaagttcccgcccttcaagtccgagtacggggccttcagcgagaaggccattaaaaagctcctgcccctaatgcgcctcggcaagtactgggacgacgacgagatcctgaagtactccgacatctacttcaagaacatcgaatacctgctcggggtcctgaagcagaaggacaagaacatcagcgacgacaaccggcagaactggaacaagtccatcaacaacaagctgcgcgaggagctcgagatcttccagaacgccgaaatcgagagcttccagggcctgcggctgcacatcgcgcagtacatcctctacggccgccactccgaggccgccatgctggggaagtggaactccgccgacgacctggaggagttcctcaaggagttcaagcagcacagcttacgtaaccccatcgtggagcaggtcatcaccgagaccctgcgcgtggtgaaggacatctgggtcaagtacggcaacggggccaaagacttcttcaacgagatccacatagagctcggccgggaaatgaagctgcccgcagaggaccgcaagaagatcaccaaccaaatcagtgagaacgagaacacgaacctgcggatcaaggccctcttagcggagatgatggtggactcttccgtggagaacgtccgccccttcagcccgatgcagcaggagatcctcaagatctacgaggacggggtgctcaactccgacatcgagatcgaggacgacatcctgaagatctcgaagaccgcccagccctcccccagcgacctgaagcggtacaagctctggctggagcagaagtacaagtccccctacaccggccagatcatcccgctgaacaagctgttcacccccgagtacgagatcgagcacatcatcccccagagtcgatacttcgacgactccttcagcaataaggtgatctgcgaggccgcggtcaacaagctgaaggacaacttcatcggcctggggttcatcaagcagttcggcgggacgatcgtggagtgcggcaacgggaagtccgtgaccgtcctcaaggaggaccagtacgaggacttcgtgaagaagcactacgccaacaaccgctcaaagcggaacaagctgctgctcgaggacatccccgagaagatgatagaacggcagatgaacgacacccggtacatctccaagtacatcagcggcgtgctgtccaacatcgtccgcaccgaggacggcacggacgacggggtgaacagcaagaacatcgtgccgggcaatggaaagatcaccaacaccctgaagcaggactggggcctcaacgacatctggaacgacctgatcctgccccggttcgagcgcatgaaccagctcaccaacagcacggacttcaccgcctggaacgagaaccaccagaagttcctgcccaccgtcccggtggagttctccaagggcttcagcaagaagcggatcgaccaccgccaccacgccctggacgcgctcgtgatcgcctgcgccaccaaggaccacgtcaacctgctgaacaaccagtccgccaaaagcgacaccaagcggcacgacctcaagcgcaagctgatgaagttcgagaaggtggcctacaaccacccccagacgggggagcggatcgagcgcgaggtgcccaagcagttcctgaagccctgggagaccttcaccgtcgaggcgaagaacggcctcgagaccatcatcgtgtccttcaagcagaacctgcgggtgatcaacaaggccacgaaccactacgagaagtacgtcgagaaggacggggccaaagtgaagggccgcgtggagcaggccgggactaactgggccatccggaagccgatgcacaaggagactgtcagcggcaagatcgacctgccccgcatcaaggtgcccaagggcaagatcctcaccgcgacgcggaagaacctggacacctccttcgacctgaagaccatcgggagcatcaccgacacgggcatccagaagatcctcaaaaactacttgcagtacaaggacaacaaccccgagctggccttctccccagaggggatcgaggacatgaacaagaacatcgagaagttcaacgacggcaaggtgcaccagcccatcatcaaggtccgcatctttgagctcgggtctaagttccccctgggccagtccggcaacaagaaggacaagtacgtagaggccgccaaggggaccaacctgttcttcgccgtgtacgaggacaaaaacggcaagcggagctacgagaccatccccctcaacgaggtcatcgagcgccagaagcaggggctgacagtggtggatctgaagggcgtcaacgacttctacctctccccgaacgacctggtgtacgtgcccagcgaggacgagctggagaacgtctccatgatcgactacaataagttgagcaacgagaaggtgtacaaggtggtctccttcacggggaaccagatcttcttcgtgcggcaggacgtggcgaccagcatcgtcaacaaggccgagttctccagcctgaacaagatggaacgcgccatcggcggcaccatgatcaaggaggtgttcgtgaagatcaagatcgaccgccttgggaacatcagcaaagtctga

SEQ ID NO: 8016 - RNA, 4347 nt, synthetic construct
  misc_feature 1..4347: note = Cas9 variant
  source 1..4347: mol_type = other RNA
atgaagcacatcctgggcctcgacctggggaccaatagcatcggctgggccgtggtcaaggaggcccagaacgacaacgagcagtccgagatcgtggacgtgggggtgcgcgtgaaccccctgacaacggacgagaagaccaacttcgaaaagggcaagccgatcagcaccaacgcggaccggacgctcaagcgctccgcccggaggaacctgcagcggtacaagctgcgccgtaaggagctcatcgagctgctgaaggagcaccagctgattagcgagaacacgatactaaccgagaacgggaaaggaacaaccttccagactctggagctccgcgctaagtctgccaaggagaagatctccctgggcgagctggcccgcgtgttcctcaccattaacaagaagcgcgggtacaagtccagccggaaggcgaagaacggcgacgaggggcagctgatcgacggcatggagatcgccaagcgcctgtacgaggagaacctcaccaccgggcagctgtccctgcagctcctgaaggagggcaagaagtccctgccagactactaccggagcgatctccagtttgaactggacaaggtctggaacttccagaaacagagccactccgacatcctgacagacgagttctacgcccagctcaagggtaaggggcagcgcgccaccagcgcgctgttcctcgccaagtatcagatctacactgctgagaacaagggctcccgggaggacaagaagctccaggcctatcagtggcgcgtggatgccctgagcaaggagctaacccgggaggagctcgcgttcgtgatcacggagatcaacaacaacctgaacaactccagcggctacctgggcgccatcagcgaccgcagtaaagagctgtacttcaacaatgagaccgtcggcgagtacctatggaagcagatcgccgccaacccccacaacagcctgaagaaccaggtgttctaccggcaggattacctcgacgagtttgagcagatctggaagacccagtccgccttctaccccgagatcctgaccgacgagctaaagaaagagctccgcgacgtggtcatattctaccagcggaagttaaaaagccagaagagtcttgtgagcttctgcgagttcgagaacaaggagatcgagatcaaaaacgaggacgggacgaccaccaaaaaggtgatcggcttgaaggtcgcgccgaagtccagccccctgttccaggagttcaagatctggcagaatcttaacaacgtgctcatacgcaagaaggggtcgaagaccaaaaaggttgctaagaatcagcaggccgtcctgttcgaggaggagaagaccatcagcgagctggatctggaggcgaagcaggccctcttcaacgagctgaacctgaagggcaacctcaaggcggactactgcctggagatcctggggtactcccccaaggagtgggagatgaactacagcatcctggagggcaaccgcaccaacaaggcgctgtacgaggcctacctgaagatcaccgacctcgaggggtacgatgccaagaaccacctgaaggtgaagctgaacaaggacgaggtggagctcgacgacctgaaggtccccgcctctgagatcaaggacatggtgcaggcgatattcaaggaggccggcatcaataccgacatccttcacttcaacgccgagctcgacggtaaggacttcgagaaccaggccagctaccagctgtggcacctcctgtactcctacgagggggatgactctaagtccggcaacgaactgctgtacaagctcctagagacaaagttcgggttcaaaaaggagtacgcgcaaattctggccaacgtgagcctctccgacgattacggcaacctgagcaccaaggccatgcgggaaatcatcacacacctgaagcagggcttcccgttcaccgggcgcaaggaccggcccgacgaaccctccgcctgcgagttcgccggctacaagcacagcaagcacagcctcacgaaggaggagaacgagaagcgagtcctgaaggactccctggaggtgctcaagaagaacagcctgcggcagcccgtcgtggagaaaatcctgaaccagatgatcaatctcgtgaacgcgctgctgaagaagtaccgcaccgagaacccgaacttcaagttcgacgagatccggatcgaactcgcccgcgagcttaagaagaaggccgaggagagagccaacatgacggccaacatcaacaaggcgaagaccgagcacgagaagatcatcaagattctgaagaacgagttcggcctccccaacccgacgcgcaacgatatcatccggtaccgcctgtacgaggaactgaaggacaacggctacaaggacctctataagggggactacatcccacgggagaagctgttctccaaggaaatcgacatagagcacatcatcccgaaggcccgcgtcttcgacgacagcttctccaacaagaccatcacctaccgaaagaccaacctggagaagggcgagcgcaccgcgtacgactacatcgagagcctcggcgagaagcagctggaggagttcctgtcccggattgagaacttatacgaaatcgggaagcccagccgcctgcacaaccggcgcaacccgctgaaaaaggtggaggaaaagggcatctccgacagcaagtacaagaagctcctgaagaaggagtccgagatcggcgacggcttcgtggaacgcgacctgcgggagacgcagtacatcgccaagaaggcgaaggagatcctgctacagatcaccagaagcgtcctgtccaccagcggcgggatcaccgaccggttacgcgaggactgggacctgatcaacgtaatgaaggagctcaacctccccaagtaccgagcgctgggcctgacgaagatggaggaccgcaagtacggccagcaggtcgaggtgatcacagactggaccaagagaaacgacctccgccaccacgctatggacgccctgaccgtggccttcacgaagcacaaccacatccagtacctgaactacctcaacgcgcggaagaacgagaaacacaaggagcataacaacatcatggccatccagcagctggagaccataaaggtgaccgacgagaacggcaacgagaagcgcatctttaaagccccgatgcccaacttccggcaggtcgccaaggccttcctggagaacgtgctcatctcccacaaggcgaaaaacaaggtggtcaccaagaataagaacaagatcagcgggaacaacaaggtgcaggaggtgctcacgccgcgcggccagctgcacaaggagaccatctacggcaagtaccagtactacgtccagaaggaggagaagatcgggggcaagtttgacctcgagaccatcgagaaggtggccaaccccctgtaccagtccctgctcaagaagcggctggaggagaacgggggcgacccgaagaaggccttcaccgggaagaacagcttagccaagaaccccatctacctcgatgaggcccagacggagcagctgcccgagaaggtgaaactggtctggctcgagaacagtttctccatccgcaaggacatcacccccgagaacttcaaggacgagaagctgatcgacaagatcctggatgagggcgtgaagcggatactcaaggagcgcttgcagagcttcggcaacgacgcgaagaaggccttctccgacttggagaagaacccgatctggctcaacaaggagaaggggatcgctatcaagcgggtgactatcagcggcgtcgccaacgccgagcccctgcataccaagaaggaccatctggggaaggagatcctcgacaaggaaggcaagcccataccggtggacttcatctccacggggagcaaccaccacgtggcggtctaccgcgacgagaagggcaacctacaagagaaggtggtgtctgtcttcgaggccgtggtgcgggccaaccagggcctgcccatcatcgacaaaacctacaaccagtacctcgggtgggagttcttatttagcatgaagcagaacgagatgtttgtcttcccgaacgagtccaccggttttaaccccaacgacatcgacctgctggacccgaagaacaagaaaattatcagccccaacctcttccgcgtgcaaaagctggccaccggggactactggttccggcaccacctggagacgaccgtggagaccaaaagcgcgaccaaggacatgacgtacaagcgcctaagcctgaaccacatcaagaatatcatcaaggtacgcatcaatcacctcggcgacatcgtctccgtcggggagtactga

SEQ ID NO: 8017 - RNA, 4353 nt, synthetic construct
  misc_feature 1..4353: note = Cas9 variant
  source 1..4353: mol_type = other RNA
atgaagcacatcctgggcctcgacctggggagcaactccatcggctgggccttcgtgcagcaggacttcgagaacaagcaggggaagatcatcgccaccgggagccgcatcatccccatggaccaagggatcctgggcgacttcgagcggggcaacaccgtctcccagacggcggagcgcacgacctaccggaacacacgccggctccgcgagcggcacctcctgcgccgggagcgcctccaccgggtgctgcacatcctggggttcctcccgccccactacgacagccagatcgacttcaccaagcgctacggcaagttcattgacaacgccgagcccaagatcgcgtacaacaacgggaactttatcttcatgaactctttcaacgagatgatcgaggatttcaagaagtaccaaccccaactattctataagaagtccaacggcgaggagtccaagatcccgtacgactggaccatctactacctgcggaagaaagccctcagccagaagatcacccagcaggagctggcgtggctgatcctacacttcaaccaaaagcgcggttactaccagctgcggggcgaggaggagacagagaaccccaacaaggaggtggcgttccactccctggaggtcgtggacgtggaagccgaggcccctaataagaagggcgagatctggtacacgatcagactcgagaacggttggatataccggcgcaccagcaagatccccctggacgactggaagggcaagacccgggacttcatcgtcaccacggacctgaacgacgacgggaccatcaagctcgacaaagagggcaaagagaagcgctccttcagggccccggacgagaacgactggaacctgctgaagaagaagacggagcacgacatcgacttcagcggcaagaccgtgggcgcgtacatatacgaccaccttctgcagaaccccaaccagaaaatcaagggcaagctggttcgcacgatcgagcgcaagtactacaaggacgagctcaaggccatcctggccaagcagatagccctgcaacccgagctgttcaccgaaaccctgctggctgactgcattcgggagctataccgcaagaacgagacccagcagcagaacttattgtccaaggatttcctccacctgttcgtagaggacatcatcttttaccagcgaccactacgcagcaagaagtcaacgatcgcgaactgcaccctcgagaagcggagctacatcgacaaggagaccaacgagcgcaaggacaccccgatcaaggtgtgcgccaagtccaacccctactaccaggagttccgggtgctacagtggctgcagaacctcaggatctacgagatcgagaccgaccgggaggtcaccgccgagttcatcgagaccgcccaggacaatgaggcactgttcaactttctgatgagccagaaggagatcgacaacgagtccctccttaagtacttcctattcgcgaagaacccccagatcaaggacaaggtggccaagagcgagctcaagaagtggctgacaacgtaccgctggaactacgtgtacgacgccgccgacaacagctccaagaagtaccccatgaacgagaccggatacgagctgcagcagtacctgcagaaggtagagggcctcccggccaacttcctgaccttcgacatcacctaccggttgtggcacttgctgtacagcgtgaaggacaaggtggagttcgagaaggcgctgaagaagttcgcccaggagtaccagctggacgaggcctccttcgtcgacagcttcaaaaacttcaagccctaccccaatgaatacgggtccttcagcgagaaggccattaagaagctgctgcccctcatgcgcttcggcaaccactgggacttcaaccggatcgacgtgtccacgcagaagcgcatcgacgacctgatcaacggcgtggctaatgacgagatccggacaatcatccgcgagaaggcggaaaagtaccagctgaacagcgaaacctgcttccaggggctcccgctgtggctggcccaatacgtcgtctacaatcgccacgccgaggccgcggatatcgagaagtggacctccgtgaacgacctcgaggcctacctggaggacttcaagcagcatagcctccgcaaccccatcgtcgagcaggtcatcacggagaccctccgggtggtgcgcgacatctggcagcgctacggcgggggccaggccaacttcttcgacgagatccacatcgagctggggcgggaactgaagaagaccgctgaagaacgcaagcagctctccaaccgtaaccaggagaacgagaacaccaaccttcgtatcaagaagctgctcgccgaactgaaggaggacgcgagcatccagaacgtgcggccctactcccccgtccagcaggagctgctaaagatctacgaggagggcgtgttctccgccaccgacgaggtggaggaggacatccagaagatcagaaagaaggccgagccgacaacacccgagatccagcggtacaagctgtggctggagcagaagtacaagtccccttacaccggcgaagtcatcagtcttaccaagctgttcacggaggagtacgagatcgagcacatcatcccccagtcccgctactacgacgatagcctcagtaacaaggtgatctgcgagagcgccgtgaacaagctcaagaccaaccagctggggctggagttcatccagaaccaccacggcgagaaggtccgtatcacggccaacaaggaggtgaccatcttcacggaggaacagtacaaggagttcgtgaagaagcactacgcgaacaacagcgccaagcagcagaagctcctgctgaacgagatcccagagaagatggtcgcccgccagctcaacgacacccggtacatctccaagtacattagcgagatcctgtccaagattgtgcgctcagacgagaaagacgaaggggtgaactccaagaacataatcccctgcaccggcaagatcaccacggccctgaaacaggactgggggctcaacgacgtctggaacgagctgatcctgccccggttcgaacgtatgaaccagctcacccagacccagctgttcaccagctacaacgaccgcttccagaagaacctgccgacggtgcccatcgagtattcccagggcttccagaagaagcgcatcgaccaccggcaccacgccatggacgcgctcgtgatcgcctgcgccacccgcgagcacatcaactatatgaacaaccagcacgccctggacaagagcaaggacaaaaaggagaagcagcagtcccggatagacttgcgcaccatcttatgcgagaagaagaacaacaactggcagttcaagaagccctggagcaccttcacgcaggaggcgcaggaggccctggaacacatcgtcgtgtccttcaagcagaacctgcgggtgatcaacaaggccaccaactactacgagaaatgggaggagaaaaacggcgtcctcgtgaaaaagaaggtgaagcaggaggggaccaattgggccatccgcaagcccctgcacaaggagaccgtcagcggcaaaatcgtgctggatcgcaagatcgggaaggacaagatcctcacggccacccggaagtctgtggacatcaccttcaccgaaaagatcatcagctccatcacggacaccggcatccagaagatcctgctgaactacctcaagtacaagggcagcccggaagtggcgttctccgccgaaggactggaggaactgaacaagaacatcgcacagtacaacgacgggaagaagcaccagcccatctacaaggtgaggatcttcgaggaagggagcaagttcccactcggcgagaccggggccaaagccaccaaatacgtggaggcggccaagggcaccaatctgttcttcggcgtctaccaggggaagggcaagcggacctacgccaccatccccctgaacgaggtgatcgagcgtcaaaagcaggggctccctagcgtacccgaacggaacgagaaaggcgagcccttactgttctccctcagccctaacgacctggtctacgtgccgatggagggggagatcgccgagaccatcgacttcaacaacctgtccaaggaacagaaggagcgcatctacaagacggtcagcttcaccggcaaccagtgcttcttcgtacaggaggccgtggcgacccccatcgtgaacaagatcgaatatagccccctcaacaagatggagcgggatatcctgggcaccatgatcaaggaggtctgcatcaagctgaaggtggaccgcctcgggaacatcaccaaggcctga

SEQ ID NO: 8018 - RNA, 4353 nt, synthetic construct
  misc_feature 1..4353: note = Cas9 variant
  source 1..4353: mol_type = other RNA
atgaagcgcatattgggcctcgacttggggagcaactccatcggctgggccttcgtggagcaggacttcgaaaacaagcaggggaaaatcatcgccaccggcagccgaatcatccccatggaccaggggatcctgggcgacttcgagaagggcaacaccgtctcccagacggcggagcgcaccacctaccggagcatgcgcagactccgcgagcggcacctcctgagacgggagaggctccaccgggtgctgcacatcctggggttcctcccgccccactacgacgcccagatcgacttcacgaaacgctacggcaagttcatcgacaacgccgagcccaagatcgcctacaacaacgggaacttcatcttcatgaactccttcaacgagatgatcgaggacttcaagaagtaccagccccaactgttctacaagaagtccaacggcgaagagagcaagatcccgtacgactggacgatatactacttacggaagaaggtgctcagccagaagataacgcagcaggagctggcctggctgattctccacttcaaccaaaagcgcgggtactaccagctgcggggcgaagaggagacggagaaccccaacaaggaagtcgctttccactccctgaaggtggtagacgtcgaggccgaggccccgaacaaaaagggggagatctggtacaccatacgcttagagaacgggtggatctatcggcgcacgagcaagatacccctggacgactggaagggcaagacccgggacttcatcgtgacgaccgacctgaacgacgacgggacgatcaaagtggataaggagggcaaggagaagcgctccttccgggccccggacgagaacgactggaacctcctgaagaagaagaccgagcacgacatcgacttcagcggcaagaccgtcggggcgtacatctacgaccacctcctccagaaccccaaccaaaagatcaagggtaagctggtgcgcaccatcgagcgaaagtactataaggacgagctgaaggccatcctcgccaagcagatcgcactgcagcccgagctgttcacggagaccctcctggccgactgcatccgggagctgtaccgcaagaacgaaacccagcagcagaacctcctgtccaaggacttcctgcacctcttcgtggaggacatcatcttctaccagcggcccctgcgcagcaagaaatccaccatcgcgaactgcaccctggagaagcggagctacatcgacaaggagaccaacgagcgcaaggacaccttcatcaaggtctgcgccaagtccaacccgtattaccaagagttccgggtgctccagtggctgcagaacctgcgcatctacgaaatcgagaccgaccgggaggtgacggccgagttcatcgagaccgcagaggactacgaggccctcttcaacttcctgatgtcgcagaaggagattgacaacgaggggctgctcaaatacttcctgttcgcgaagaacccccagatcaaggacaaggtcgccaagtccgagctgaagaagtggctcaccacctaccgctggaactatgtgtacgacgccgccgacaacagcagcaagaagtaccccatgaacgagacgggctacgacctgcaacggtacctgcagaaggtggaggggctgcccgcaaacttcctcaccttcgacatcacctatcgcctgtggcatctcttatattccgtcaaggacaaggtggagttcgagaaggcgctcaagaagttcgcccaggagtaccagctggacgaggccagcttcgtggactccttcaagaacttcaagccgtaccccaacgagtacggcagcttctccgagaaggcgatcaagaagctcctgcccctgatgagattcggcaaccactgggacttcaaccgcatcgacgtcagcacccagaaacgcatcgacgacctcatcaacggggttgccaacgacgaaatccgcactatcatccgtgagaaggcggagaagtaccagctgaactccgagagctgcttccagggactgcccctctggctggcccagtacgtggtctacaaccgccacgccgaggccaccgacatcgagaagtggacctccgtgagcgatctggagacctacctcgaggacttcaagcagcactccctacggaacccgatcgtcgaacaggtcgtgacggagaccctgcgcgtggtgcgcgacatatggcagcagtacgggggcgggcaggcgaacttcttcgacgagatccacatcgagctcggccgggagctgaagaagaccgccgaggagagaaagcagctgagcaaccggaaccaagaaaacgagaacaccaacctccgcatcaaaaagctgctggccgagcttaaagaggacgcctccatccagaacgtgcggccctacagccccgtccagcaggagctgctgaagatctacgaggagggcgtgttctccagcaccgaccaagtggaggaggacatccagaagatacgcaagaaggccgagccgacgacgcccgagatccagcggtacaagctctggctggagcagaagtacaagtccccctacaccggggaggtcatcagcctgacaaaactgttcacagaggagtacgagatcgagcacatcatcccccagtcccgctactacgacgactccctgagcaataaggtgatctgcgagtcggcggtgaacaagctgaagactaaccagctcggcctggagttcatccagaaccaccacggagagaaagtccggatcaccggaaacaaagaggtcaccattttcacggaggagcagtacaaggagttcgtgaagaagcactacgccaacaacagcgccaagcagcagaaacttttactgaacgagattcccgagaagatggtcgcacgccagctgaacgacacccggtatatctccaagtacatcagcgagatcctctccaagatcgtccgctctgacgagaaggacgagggggtcaactccaagaacgtaatcccgtgcaccggaaagatcaccaccgccctgaagcaggactggggcttaaacgacgtgtggaacgagctcatcctgccccggttcgagcgcatgaaccagctaacccagacccagctgttcaccagctacaacgaccggttccagaagaacctgcccacggtgccgatagagtacagccaggggttccagaagaagcgcatagaccaccggcatcacgcgatggacgccctagtcatcgcatgcgccacccgcgaacacatcaactacatgaacaaccaacacgccctcgacaagaacaaggacaagaaggagaagcagcagagccggatcgacctgcgcacaatcctgtgcgaaaagaagaacaacaactggcagttcaagaagccgtggtccaccttcacgcaggagaccaaggaagcgctcgagcacatcgtggtgtcgttcaagcagaacctccgggtcatcaacaaggccaccaactactatgagaagtgggaggagaagaacggtgtgctggtgaagaagaaggtcaagcaggaggggaccaactgggccatccgcaagcccctccataaggagacagtgtctggcaagatcgtgctggaccgaaagatcggtaaggacaagatcctgaccgccacccggaaggaggtcgacatcaccttcacggagaagatcatctcatccatcaccgacaccgggatccaaaagatcctcctgaactacctgaattacaagggcagccccgaggtggcgttctcagccgaggggctcgaggaactgaacaagaacatcgcccagtacaacgacggcaagaagcaccagccaatctacaaggtgcggatcttcgaggaggggagcaagttccccctgggcgagaccggcgcaaaagcgacgaagttcgtcgaggcggccaaggggaccaacctcttctttggcgtgtaccaggggaaagagaagcggagctacgccacaatcccgctaaacgaggtgatcgagcgccagaagcagggactgccctccgtcccggaacggaacgagaagggtgagcccctcctgttcagcctgagccctaacgacctcgtgtatgtgcccatggagggcgagatcgccgagaccatcgacttcaacaacctgagcaaggagcagaaggaacgcatctacaagacggtctccttcaccggcaaccagtgcttcttcgtgcaggaggccgtggcgaccccgatcgtcaacaagatggagtacagccccctgaacaagatggagcgggacatcctcgggactatgatcaaggaggtgtgcatcaagctgaaggttgatcgacttggcaacatcaccaaggcctga

SEQ ID NO: 8019 - RNA, 4353 nt, synthetic construct
  misc_feature 1..4353: note = Cas9 variant
  source 1..4353: mol_type = other RNA
atgaagcacattcttggcctcgacctggggagcaactccatcgggtgggccttcgtgcagcaggacttcgagaacaagcaaggaaagatcatcgccgcgggcagcaggataatccccatggaccagaagatgctgtccaacttcgaagaggggaccactgtcagccagacggccgagcgtaccacctaccgctccatgaggcgcctccgtgagcgacaccttctgcggcgcgagcggctccacagggtgctgcacatcctaggcttcctcccgccccattacgacgcccaaatcgacttcaccaagcggtacggcaagttcattgacaatgcggaacccaagatcgcatacaacaacgggaacttcatcttcatgaacagctttaacgagatgatcgaagacttcaaagagcaccagccccaactcttctacaagaagtccaatggggaagagagcaagatcccatacgactggacgatctactatctgcgcaagaaagcgctctcgcagaagatcacccaacaggagttggcctggctgattctccacttcaaccagaagcgtgggtactaccagctgcgcggcgaggaggagaccgagaaccccaataaggaggtggccttccacagcctgaaagtcgtggacgtggaggccgaggcgcccaacaaaaagggtgagatctggtacaccatccggctagaaaacggctggatctaccgccggacgtctaaaatcccactggacgactggaagggcaaaacccgcgactttatcgtcaccaccgacctgaacgacgacgggaccatcaagctcgacaaggagggtaaggagaagaggagcttccgcgccccggacgagaacgactggaacctgctaaagaagaagaccgagcacgacatcgacttctccgggaagcccgtgggaacctatatatacgaccacctcctgcagaacccgaaccagaagatcaaggggaagctagtacggaccatcgagcgcaagtactacaaggacgagctcaaggccatcctggccaagcagatcgccctgcagcctgagctgttcactgagaccctgctagcggactgcatccgcgagttataccggaagaacgagacccagcagcagaacctactaagcaaggatttcctccacctgttcgttgaggacataatcttttaccaacggccgcttaggtccaagaagtccacaatcgccaactgcacgctcgagaagcgctcctacatcgataaggagaccaacgagcgaaaggatacccccataaaggtgtgtagcaagtccaacccctactaccaggagttccgcgtgctgcagtggctccagaacctcaggatctacgagatcgagaccgaccgcgaggtaacggccgagttcatcgagaccgcccaggactacgaggcgcttttcaacttcctcatgagccagaaggagatcgacaacgagagcctcctgaagtacttcctgttcgcgaagaacccccagatcaaggacaagaccgccaagatagagctcaagaaatggatcaccacgtaccggtggaactacgtgtacgacgtggccgacaactccagcaaaaagtacccgatgaacgagaccgggtatgacctgcagcgctacatgcagaaggtcgagggcctgcccaccaacttcctgacctttgacacgacataccggctctggcacctcctgtactcagtgaaggacaaggtggagttcgaaaaggccctcaagaagttcgctaagaagaagcagctagacaaaacctccttcgtcgactcctttaagaatttcaagccctaccccaacgaatacgggagcttctccgagaaggcgataaagaaacttttgccgctgatgcggtttggcaaccactgggacttcaaccgtatagacgtgagtacgcaaaaacgtatcgacgatctgataaacggggtggccaacgaggacatacggacgatcattcgcgagaaggccgagaaataccagctcaactccgaaacctgcttccaggacctgcccctgtggctcgcccagtacgtcgtgtacaacaggcacgccgaggcgacagatatcgagaagtggaccagcgtatccgacctggaggcctacctggaggactttaagcaacacagcctccgcaaccccatcgtcgagcaggtcgtgaccgagacgctgcgggtggtgcgcgacatctggcagcagtacggcggcgggcaggccaacttcttcgacgagatccacatcgagttaggccgcgagctcaagaagaccgccgaggagcggaagcagctttcagacaagaaccaggagaacgagaacaccaacctgcgcatcaagaagctcctggcggaactgaaggaggatgccagcatccagaacgtccggccctactccttggtgcaacaggagctgctgaagatctatgaggagggggtgttcagctccaccgacgaaatcgaggaggacatccagaagatcaggaagaaggtcgagccgacgacccccgagatccagcggtacaagctctggctggagcagaagtacaagagcccctacaccggcgaggtgatcagtttaaccaagctgttcacggaggagtacgagatcgagcacatcatcccccagtcccgctactacgatgactctctgtcaaacaaggtgatctgcgaaagcgccgtcaataagctgaagaccaatcagctagggttggagttcatccagaaccaccacggcgagaaggtgcggatcaccgccaacaaggaggtgaccatcttcaccgaggagcagtacaaggagttcgtcaagaagcactatgcgaacaactctgcgaagcagcaaaagctgctcctgaacgagatcccggagaaaatggtggctcgccagctgaacgacacccggtatatcagcaagtacatctccgagatcttgagcaagatcgtgcgctccgacgagaaggacgagggcgtcaacagcaagaacatcatcccatgcacagggaagatcaccacggccctgaagcaggattggggcctgaatgacgtctggaacgagctcatactgcccagatttgagcgcatgaaccagctgacccagacccagctgttcacctcctacaacgaccgtcttcagaagaacctgccgacggtgcccatcgagtacagccaggggttccagaagaagcgcatcgatcaccggcatcacgccatggacgccctcgttatcgcctgtgccacccgcgagcacataaactatatgaacaaccagcacgcactggacaagtccaaagacaagaaggagaagcagcagagccggatcgatttgcgcacgatcctttgcgagaagaagaacaacaactggcagttcaagaaaccctggcggacattcacgcaggaagccaaggaggccctggagcacatagtggtgtcgttcaagcagaacctgcgtgtgatcaacaaggcgacgaactactatgaaaaatgggaggagaagaacggcgtacttgttaagaagaaggtaaagcaggaggggaccaattgggccatccggaagcctctgcacgaggagaccttcagcggcaagatctccctgaaccgggagaaggtgggcaaggggaatatcctcacggccacccgcaaagccgtggacagctccttcgacgtcaagaagatcagcaagatcaccgacaccggcatccagaaaatcctgctcaattacctcaagtacaagggtagcccggaggtggcgttctccgctgaaggcttagaggagctgaacaagaatattgcccagtacaacaatggcaagaagcaccagccaatctacaaggtgcgaatctacgagaaggggagcggccgcttcgtattgggggagaagggcacgaaatccaagaagtacgtgcagggggcccccaacctgtacttcggcgtgtaccagggcaaagagaaacgcacctacgccaccatccccttgaacgaggtcatcgagcgccagaagcagggcctaccgtccgtccccgagcggaacgagaaaggcgagccccttctattctccctcagtcccaatgacctggtgtatgtcccgatggagggcgaggcgaccgaaacgatcaacttcaacaacctgaacaaggagcaaaaggagaggatctacaagaccgtctccttcaccggcaaccagtgcttcttcgtgcaggaggccgtcgcaagccccattgtgaacaagatggagtactctcccctcaataagatggagcggagcatcgtggggataatgatcaaggaagtctgcatcaagctcaaggtggaccgcctgggtaacatcaccaaggcctga

SEQ ID NO: 8020 - RNA, 4362 nt, synthetic construct; identical to SEQ ID NO: 2220
  misc_feature 1..4362: note = Cas9 variant
  source 1..4362: mol_type = other RNA

SEQ ID NO: 8021 - RNA, 4368 nt, synthetic construct; identical to SEQ ID NO: 2221
  misc_feature 1..4368: note = Cas9 variant
  source 1..4368: mol_type = other RNA

SEQ ID NO: 8022 - RNA, 4374 nt, synthetic construct
  misc_feature 1..4374: note = Cas9 variant
  source 1..4374: mol_type = other RNA
atgaagaccatcctgggcttagacctgggtaccaactccatcggctgggccaaagtgtccgtcgacgactacgggaactacctgcacgacattaaactcggcagcagaatcatccccatgtcccaggacgtcctggggaacttcgacagcggcgttacggtctcccagaccgcccagcgcaccgagttccgaagcaagcggcgcctggtgcagcggaacctccagcgtcgggagcgcctgcatcgggtgcttcacgttctcgacttcctgcctgcgcactacgacgccgcaatcggctgggaccgcacagaggccgtgacgtacgggaagttcctgaaccatgccgagcctaagctggcgtgggaggagctgggcaacgggaagcggcgcttcctgttcatggacagtttccacgagatggtggccgactttgcccggtgccagcccgccctcgtcgcggacggaaagaagatccccttagactggaccatctactacctccggaaaaaggccctcactcaggccatcacaaaggaggagctggcctggatcctgttaaacttcaaccagaagagggggtactaccagttacgcggggaggaggaggaggagaaccccacgaagcaggaggaatactacgaactgaaggtggtgagcgtcgaggccaccgactcccggaagggcaacgatacctggtacaacgtgcacttggagaatgggtggatctatcgccggagctccaagatcagcctggacgactgggtgggcaaggtcaagcaatttatcgtgactacggagtacgagaaggacggggcgaccctgaagaccgacaaggaaggctatgtgaagcgctctttccgggcgcccaacgaaaacgactggggcctccgcaagaagagaaccgaaacgctgctggagatgagcgggaagacggtcggcgccttcatctacgatcacctcctgcaggagcccgccgacaaaattcgggggaacttcatccgcaccatcgagcgtcactactacaaggccgagctcgaggcgatcctcgccgagcagtgcaaataccacatcgaattgcgcgacaaggaaatgctggaggcatgcgcccgggagctctatctgaacaacctgccccaccagcgttccctcatgaagaaggacatgacctaccttctgctctacgatctgatcttttatcagcgaccgttaaagagcaaaaaggccctgatcgcgaattgcccctacgagtactacgaatacgtagacaaggagacgggtgagatcaagagacagaacatcaagtgcatcgccaagtccaacccgtacttccaggagttccggctgtggcaattcgtcctgaacctccgcctattcgaccgggtcgaggacaaggaggtgaccgcgaactacctgcccaccgcggacgaccacgccagactgttcacgtacctaaacgaccggaaggagatcaaccaggagacgctgctgaaggactacttcaagctcaagaaagtgaagatcgggaacgagaaggagtacccgatccgctggaattacatcgaggacaaggagaagaagtacccttgtaacgagacccggtacgagctgctgatggcgctcgatagggccggcatagagcacaagtggctggacgataataacctggagtataggctgtggcatctcctgtacagtgtcgaggtgaaatccgaaagcgagaccgccctgcgcaaactgaagaacgacgatgccttcgtcaacagtttcctgaaggtaaaacccttcaagaaggaatacggcgcgtactctgagaaggcgatcaagcggctccttgcggtgatgcgcaaggggttcctgtggaacgagcaggatatatgcgacgagacccgcaagcggatcgagatcatcatcaagggcgacgtggacgaaaaagtgaaggagcgcatggggcatgccgcctactctttcgaccgggttagcgacttccagggactccccgagtggttggcgtgctacgtggtgtacgggcgccacagcgaggccatggacatccagcactgggactccccggagcggctgatggcctacataaacaatttcaagcagtacagcctcagaaaccccattgtggagcagtgcatcctggagaccctgcggacagtccacgacatatggaaggagactggccagatcgacgagatacacgtggagctcggccgcgagatgaagtccaccagcgaggagcgggcccgccggacgcagaacgtgctgaggaacgagaacaccaacctgcggatcaagtccctcctgatcgagctgaaaaacgacaccgacatctgcaacgtccacccctacagccccatgcagcaggagatcttacgcatctacgaagagggggccctgcaggagctgaaccgggaagacgaggacttcgaggagatctccaagataagccagatgtcccagccgagtggaaaggagctcaatcgctacaagctgtggctggagcagaaatatcggtccccctacacagggaaggcgatcagcctcgcaaagctgttcacgcccgcctaccagatcgagcacgtgatcccccagagccgctacttcgacgacagcttcacaaacaaagtgatctgcgaagccgaggtcaacaccctgaagagtaatctcctgggctacgagttcatcaagaagcatgggggcgagatcatccactgcacgaccttgggcgacgtacggattttcagcgaaagcgagtataaggcgttcgtgatggaccactacgcgaacaacaagtccaagaaggacaagctcctgatggaggacatcccgcaggagttcctgtctcgccagatgaacgattcccggtacatcagcaaggtcgtgaagacgctcttgtccaatatcgtgcgcatggccgacgagagcgaggccacctccaagagcgtcatcgtgtgcaccgggggcgtcaccgaccgcctgaagaaggactgggggctcaacgacgtctggaactcaatcgtgtatagccggttcgaacgcctgaatcggctcaccggcaccgaggcgttcggccactgggagaacaaggatgggaaacgcgtgttccagacctccatgcctctcgagctgcagcggggcttccgcaagaagaggatcgatcatcgacaccacgcgatggacgccctggtcatagcctgcgccagccggaacatcgtgaactacctcaacaatgagtcagccaacaatcccaaaaagcgggaggacctgcggcgccagttatgcgataagaaccgagtgattcgcaagccgtgggagaccttcacacaggacgcgtacaacgccctcgagaacgtcgtggtgagcttcaagaactacgtgcgggtgatcaacaaggccaccaaccgctacgagcactacgacgagaacgggaagaaacggttcgtgcagcagaagggctccgagctctgggccatccgcaagccgatgcacaaggagacttactacggtcacgtcaacctacggcgcaaggagctcgtgaccctgcagaaagccctggacgacatcccctccatctgtgacaaaaagctcagggactacatctccgcgctggtggaaaaacacttcaacaagcgacagctgctcgcccactttaagagcacggactactactggcagaagcagtacgtcaacaaggtatatgtgtggacattcagcgacgatatcaaacccctggtggccacccgcaagctgctcgacaccagtttcgacgcgaagcggatcggcacgataaccgacaccggcatccagaagatactgcgcaactacctggaggccaagggagggaacgcgaccctcgccttcacgccagaggggatcgccgagatgaaccagaacatcagcaagtataatgatggcaagccccaccagcccatcttgaaggtaagaataaccgaacccatgggggcgaagtatcgcgtgggccagaccggcaacaagatggcgaagtacgtggaggcccagtccggcaccaatctgtatttcgccatctacgaggatagcgaggggaagagatcctacacgaccgtgccgctggacgaggtggcagagcgcctgaagcagcggctgagccccgtgcccgagaaggacgaaaacgacgtccccctcaagttctacctgtccccgaacgacctggtttacgtccccaccgaggaggagctacagctgcgcgaatgcaagctcaacaaggatcggatctataagatggtaagctccacagggaacgagtgccacttcataccctactacgtggccaacgtgatctacaacaagggcgggttcaacatgcagatgcaccgcccccagagctga

SEQ ID NO: 8023 - RNA, 4374 nt, synthetic construct
  misc_feature 1..4374: note = Cas9 variant
  source 1..4374: mol_type = other RNA
atggccaagatcctgggcctcgacctggggaccaacagcatcggctgggccatcgtggagaagaacaactccgacttcacactgatcgacaagggggtccgcatcttcagcgaaggcgtgaagacggagaaggggattgagcggtcccgcgcggccgagcggaccggctaccggtcagcccggaagatcaagtaccgccgaaagctacgcaagtacgaaaccctgaaggtcctgtccaagaaccggatgtgccccctccagatcgaggacgtcgaggcctggaagaagtccggcttcaaggactacccactgatccccgagttcctgcagtggctccgcaccaacgaccacgagaacgtgaacccctacttcttccgggacaaggcctcccgcgcgaaggtgagcctgtgggagctggggagggccttctaccacatcgcccagcgccgaggcttcctctccaaccgcctggaccagagctctgagggggtcctggaggagcacaacccccagatccagagcctcatcgaggacctggaggagacgtcaaccatcctgaacgaggtacgggactactacatcaacctcggcttactggacggggtgaagggggacttcaagaaggagctcgacgagggagagaagaaacttaagagcctgtacaacaccctgatcgccatcatcaagaagaacgagaacgacgtccagaagtgcaaggacgagatcatcaagcgcctaaacaagaaggaggacctggggaaggtgaagggcaagatcaaggacatctcccaggcgatgctcgacggtaacttcaagaccctgggacagtacttctactcgctgtacaacaagggcaagatccggaaccagtacacgtcccgtgaggagcactacctccaggagttcatcaccatctgcaaggtgcaggggatcaacggcatcaacgacgaggaaatcctgccggagaagaagttcaccgggctggcaaaggacctctacaaggccatcttcttccagcggccgctaaagagccagaagggcctgatcgggaagtgctccttcgagaaaaacaagagccgctgcgccatcagccaccccgacttcgaggagtaccgaatgtggaactacctgaacaccatcaagttcggcacgcagtccgacaagaagctgcggttcctgacccaggaggagaagctgaaactcatccccaagttttaccgcaaaaacgacttcaacttcgaggtcttagccaaggagctcatcgacaaaggcgcgaccttcgggttctacaagagctcccggaagaatgagttcctgtactggttcaactacaagccgaccgacacggtgagcgcctgccagttctccgcaagcctgaagaacgctatcggcgaggactggcagaccaaggtgttcacctacaagaccctgaacagcgagaagaaggaagtcatcaggacggtggactaccgggacctgtggcatctcctgagcgccagtaccagcgacatctacctgtacgagtacgcgaaggagaaacttgggctggaggacaagtccgccaagaccttcagcaagatcaagctcaagaaggacttcgcctccctgagcctgtccgccatcaacaagatcctcccctacatcaaggagggcctgctgtacagccacgccgtgttcatggcaaacatcgagaaggtcgtggacgagcacatctggaaggacgttaaggagcgcaccatcatccaaaacgagatctccaagatcatcaagagcgacgtcttcgagcgggaggtgatcaacatcatcaacgggctcatcaagaactccaagacggagggcgagaactacgccgaggagagcaagaacattttcaagaccgaatttgacaacgccatcgccaagatcttcgagaagaacaacgacatagagttcaaccagccgttcctggacgatacctacctcaagtacgtggaggagctcaagaagttcgataaggcccgcagcttcctgcccgtcccgcgtctggacgagaaagtgatccagttcttgctgggcaacaacaaggacgggatggtctactgctccgacaagaacaagaccaagaagctgtaccatccaagcgatatcgagatcttcaagaagaagatcatcaaggacgagtttggcaacgagaagatggtgctcgggagccccctgacgaccagcatcaaaaaccccatggcgatgcgcgccctgcaccagctccggaaggtgctgaacaccctgatcctcgaggagcagatcgacgagaacacccgcatccacatcgagatggcccgggagctgaacgacgccaacaagcgcaaggggatccaggactaccagaatgaaaacaagaagttccgggaggacgcgatcaaggagatcaagaaactgtacttcgaggaatgcaagaaggaggtcgagcccacggaggaggacgtgctccgctaccagttatggatcgagcaagacaaaaaggagatctacgagcaggggaagtccatccggatcagcgacatcatcggctccaacccggcgtacgacatcgagcacacagtgccccgctcgatctcccaaaacaacagtctaatgaataagaccctctgcacgccccgcttcaatagagagatcaagaagcagaagatgccgatcgagctgtccaactacgaggagatcttgccccgcattgagcactggaagaaggaggccgaagacctcacccggcagattgaaagcatctccaaaagcatcaagtccgcgagcaccaaggaggccaaggacaaaaacatccgcaggaggcactacctgaccctaaagcgggactatctcaagggcaagtacgaccgcttcatctgggaggaacccaaggtcggattcaagaactcccagatccccgacaccgggataatcaccaagtacgcgcaggcctacctcaagagctacttcaagcgggtggagagcgtcaagggcggtatggtcgccgagttcagaaagcagtggggcatccaggagtcctacatcgacgagaacgggttcaagcattacaaggagaaggaccggagcaaacacacgcaccacaccatcgacgccattaccatcgcatgcatgaccaaggacaagtatgacgtgctggcgcaggcatggacctccgaggatgaacaggacaagcagaaggcaaagaccctgatgagcgaggccaagccgtggaagaccttcaaagaggacatcgagaagatcgaggaggagatactggtgtcccacttcaccctggacaatgtcaagaagcagagcaagaagatcgtgagagtgcggggcaagaagcagtacgtagccgagatcgagcgagacgtgaacgggaaggcgatggcgaagaaggacgctaacggcaagatcatttacaagctcaacgagaaaggggagaagatcccacggctgcagcagggcgatacgatccgcgggtccctgcaccaggacagcatctacggggccatcaagaaccccctcaaccaggaggagatcaagtacgtcatacggaaggacctggagtccctgaaggcgaacgacgtcgacaacattgtggacgagaccgtgaagcagaaggtcaaggaggccatcgagaataagatcctcctgctgagctccaacgcccagcagaagaacaagctcgtggacgacgtgtggctgaacaaggagaagcaagtacccatcaagaaggtgcgcatctacgccaacagcgtgaagaacccgctggagatcaaggagcaatccctcctgtccaagtcccggaaggagcacaagcagaaagtctacggccagaacgatgaaaactacgcgatggcgatctacgagctggacgggaagcgcgagttcgagctcataaacaacttcaacctggcaaagctgatcaagcagaaagaaggcttctacccgctcaacaaggagaaagaggtgaaggggaagaaggtgctgtaccccatcgccaagagcaactaccgggacgtagtgctgaagcgcggccaacaggtcgtgttctacgacaaggaggtggagaacccgaaggacatttccgaggtgatcgacttcaaaggcagaatctacatcatcgaggggctctcgatccagcgcatagtccgcccgtccgggaagatcgacgagtacggggtgatcatgttgaagtacttcaaagaggcccggaaggccgacgagatcaagaaggacaactacaaacccgacggcgtgttcaagctgggggagaaccgccccacacggaagatgaaccacagccaattcaccgcgttcgtcgagggcatcgacttcaaagtgctcccgacgggcaagttcgacaagatctga

SEQ ID NO: 8024 - RNA, 4377 nt, synthetic construct; identical to SEQ ID NO: 2224
  misc_feature 1..4377: note = Cas9 variant
  source 1..4377: mol_type = other RNA

SEQ ID NO: 8025 - RNA, 4377 nt, synthetic construct
  misc_feature 1..4377: note = Cas9 variant
  source 1..4377: mol_type = other RNA
atgaagaagatcctgggcctcgacctggggaccaacagcatcggctgggccctgatcgagcaggacttcgagtccaaagccgggaagatcagcggcgcggggtcccgaatcatccccatgagccaggacatcctcggcaccttcgagacgggtcagtcctacagccagaccgccgatcggacccactaccggtccatccggcgcctgtaccagcggaccaagctgcgcagggagcgcttacatcggagcctcaacgtgctggggttcctcccggagcactataagaacgagatcgacttcgagcagcgcaagggccagttctaccccaacaaggagcccaagatcgcctactatccggagcaggttgcctccaaggtgaaataccagttcttgttcaagagctccttcctggagatggtggaggacttcaagcgacgcgggtacaacggcgccatcccgtatgactggacgatctactacctccgcaaaaaggcgctggaaaagaaaatcgagaaggaggagttggcctggctcctgctgaactttaatcagaagagagggtactaccagctccggggcgaggaggaggacaccaacagcaacaagaaggaggagttctacgagctgaaggtctcctctgtggagcagacccacgacacctcccccagcggcacgtggtataacgtgcacctccagaacgggtgggtctatcgccgaaagtccaaggacagcctgaaggactgggagggcctgaacaagaagttcatcgtgaccacccacctgaacgccgacgggtcagagaagctcgacaaggacggcaacgtgagccgcagcttccgggccccaaaagaagacgactggggcctggtcaagaagcgcacagagtccgtgctggaaaagtcagggctccacgtgggcgagtttatatacgagtctctgttggagaaccccgagcagaaaatccgggggagcctcatcaagacgatcgagcgcaagtattacaagaaggagctggaggcgatcctggacaagcagacctccttccatcgcgagctccggaacgacgccctgtacaaggaggcaaccctggagctctacccgaagaacagcgcccatcgctccaacatcaagcagcggggtttcaaatacctgttcatagaggacatcatcttctaccaacgccccctcaagagccagaaacacctgatcgcacattgccagtacgagaaacggacctacaagaacaacgggggcgagacgatcgaggtctccctgcagggtgcgcccaaaagccacccctccttccaggagttccgcatctggcagttcatcagcaacctgcgattctacgacaaggaggagatcgtggagggccaggaggtgtccatcacagagaagctcctcaagagcgactccgacttcgccgagctgtaccactggctgagccatcagcgcgaggtcgaccagaacaagaccctgaaatacttcacccagaagaagctgatccccaagcaaaagaaggacaaccccacgatcagatggaacttccccgaggataagaagtacgagatgggcgagttcaaggcccagttgctgtcccgcctggagaaggtgcggaactgccagcccgacaagttcctcacgcagaagaacgagctcgacctgtggcatatcatttacagcgtgaccgacaagaccgagttcgagaaggccctggtcacgttcgccgagaagcgcgagctcgactccgagagcttcgtggagaacttcaagaagttcccgcccttcaagaacgactacgcgagctactccctgaaggccatcaagaagatcctgcccctcatgcggcgcgggaagtactggaaggccgagaacctgggcccccaaaccttacagcggatcgagaagattgtgaacggggaggccgatgataaaatcagcatccgcgcccggaagctcgcgcttcacctgaacgacaccaaatccttccagggcctccctaccagcctggcctgctacgtagcctacaaccgccactccgagaacgaggagaatcagaagtggcagacccccagcgacatcgacaagtacctgaaggacttcaagcagcactccctccggaaccccattgtggagcaactgatcaccgaggccctgcgagtggttcgggacatatggaagcactatggccaggggcagaaggacttcttcgacgagattcacgtggagctcggccgggagatgaagaatcccgccatcaagcgaaagaagctgagccagaagatccaggagaacgaaaacactaactacagaataaaggaggtcctgcgcaatctcaaggagaacaacatcgacgcgaagccgtacagtcccagccaccaggagatcctgaagatctacgaggagggggtgtaccagtccatcgagaacgtggaggatgagatcgagaaaatccggaagaacaacacccccagctccaaggacatcaaccgctacagactatggctcgagcagggctacatcagcccctacacaggggaggtcatcccgctgtcccaactgttcagcaatcagtacgagatcgagcacataatcccccgctcccggttcttcgacgacagcctcgccaacaaggtgatctgcgagagctccgtgaacgccctgaaggacaacaagaccgcccttgagttcattacaaaccacggcaacgagaaggtagagttcgcgggcaagaccgtggagatcctctcctcggacaagtatacggagcactgcaagcgctacttcaaacggaaccgcaccaagctgaagaacctgctaagctacgacgtgcccgagggcttcatcaaccggcagctgaacgactcccgcttcatcagcaagtacgtccgaaacctgctctccaacatcgtccgcgaggaggaggagcgggaggccatcagcaagcacatccttacgatccctggctccatcaccagccagctgaagcaggactgggggctcaacgagaagtggaacgaggtggtcacacaccgcttcgagcggctgaacaacctgacgggcaccaccgacttcggcttctgggacaataagataaacgcgtttcgcatcaccgtacccaaggagctctccaaggggtttaacaagaagcggatcgaccaccgccaccacacactggacgccctggtgatcgccgcgtgcacaaaggaccacgtcaactacataaccagccttaacaccgagcgcaataaccactccctggtcagcaagctgcggaacacgaagaaggtgctcatcaacggcaaggaacgccggatcgccaaggcatacaagctcccctggtccagcttccccctggacgccaagcaccagttggagaccacagtcatctccttcaagcagaacctgagagtgatcaacaagagttccaacaagacctggcaatggcggaacgtgaacggcgagcagaagaagaagttgatcccgcagaccaagggcgacagctgggccatacgtaaatccatgcacaaggcgaccgtctccgccaaggtggagagcgtggggaagggcaagatcaaaaccaccaataggacgcccctcggcgagatcaagggggaaaaacacgtcgagaagatctacgatgccaggatccgcgaggtgatcatccctaaccacctgaacaagtacctggacgagaagggcaagcccaactacgaagccgcgttctcccagagcgggattaagcagctcaacgagaacatcgaggtgttaaacgagggcaaaccgcacgcgcccatctacaaggtccccctcttcgaggtcgggtccaagttccccgtgagcgaggacgccaagtccccgaagaaccagaagtacgtcgaggccgacaagggcactaacctcttcttcgctgtgtactggaacgaggagaagcagaagcgcaacttcgagacggtgcccttacaccaggtcatcgtgcaccagaagcaagtagcgagcctgcccaccgaacagcggacgtccgtgcccatcaaaccggagctcggcctgttcctgttcagcctctcccccaacgacctggtgtacgtgccgaccgaggaggagatcgaaaacccccacctggtcgacctcaaaaacctgagcaaagaccagaccaaccgcatctacaaaatggtgtccagcaccgggaacgagtgccacttcatcccgcaccacatctcccgcctaatcatgaagtacaacgccaagcaaaaggtgggcgagttcgggagcctcaacaaggccgagaaggccatcacgggcgagaccatcaaagagaaatgcctgaagatccagatcaactccctggggaagctcaagaccgagcgcatcgcctga

SEQ ID NO: 8026 - RNA, 4380 nt, synthetic construct; identical to SEQ ID NO: 2226
  misc_feature 1..4380: note = Cas9 variant
  source 1..4380: mol_type = other RNA

SEQ ID NO: 8027 - RNA, 4383 nt, synthetic construct; identical to SEQ ID NO: 2227
  misc_feature 1..4383: note = Cas9 variant
  source 1..4383: mol_type = other RNA

SEQ ID NO: 8028 - RNA, 4389 nt, synthetic construct
  misc_feature 1..4389: note = Cas9 variant
  source 1..4389: mol_type = other RNA
atgaccaagaacatcctcggcctcgacctggggaccaacagcatcggctgggccctgatcaagcagaacttcgagaacaagcagggagagatcctaggcatggggtcccgcatcatccccatgagccaggacatcctgggcgacttcggcaaggggaactccgtgagccagacggccgagcggaccaagtatcgcagcgtccggcgcctgcgcgagcgcttcctcctgcggcgcgagcggctgcaccgcgtgctcaacctgctgaacttcctcccgcagcactacgcgagccagatcgacttcgagaagcggttcggcaagttcaaggtggagaccgagcccaagctggcctggaagaacatcgacgggcagttctccttcctgttccagaccagcttcaacgagatgctcgaggacttccgcgtcaacggccaggacgtgaagatcccctacgactggacgatctactacctgcggaagaaggccctgtcaaagaagatagagaaggaggagctcgcctggatcctgctgaacttcaaccagaagcgcgggtactaccaactccgcggggaggaggaggaggagaaccccaacaagctggtggagttctacagcctgaaggtcgtggacgtggtcgccgacgagccgcagaagggcaagttcgacatctggtactccctcatcctggagaacgggtgggtgtaccggcggagctccaagatccccctgttcgactggaaggacaagacccgcgacttcatcgtgaccaccgacctcaacgacgacggcagcatcaagaaggacaaggacgggaacgagaaacggtccttccgcgcgcccagcgagaacgactggacgctggtcaagaagaagaccgagcaggagatcgagcagtcccggaagaccgtgggcacctacatctacgaggccctgctcgacaaccccaagcagaagatcaagggcaagctggtgcgcacgatcgagcgcaagttctacaaggaggagctgcggcagatcctcgagaaacagaaggagttccaccaggagctgcagagcgacgacctgtacaacgactgcgtccgcgagctctaccggaacaacgaggcccaccagctgaccctgtccaagaaggacttcgtgcacctcctgatggacgacctgattttctaccagcgcccgctccggagccagaagtccagcgtgagcaactgcacccttgagttccgcaagtacaaggacgagaacggggccgagcacacccagtacctgaaggcgatccccaagtccaacccctactaccaggagttccgtctctggcagtggatctacaacctgaacatctaccgccgggaggacgagcagaaccccatcacgggcgagtttctgagcaccacaaaggagttcgagaacttgttcgagttcctgaacacccggaaggaagtcgaccagaaggccctgctgaagcacttcaagctcaacgacaagacgcacaggtggaacttcgtggaggacaagaagtacccgtgcaacgagaccaagaccatgatatccagccgcctggagaaggtggagaacatctcagacgacttcctgacccgggagatcgagcagaagatctggcacatcatctacagcgtcaacgacaagatcgagtacgaaaaggccctcaagtccttcgccaagaagcaccacctggacgagtcttccttctttgaggccttccgcaagttcccgcccttcaagagcgagtacgggtccttcagcgagaaggcggtcaagaagctgctcccactgatgcggctgggcaagtattggaactatgccgacatcgacaagtccagcaaggagcgcatccagaagatcatctccggggagtacgacgaaaacatcaaggaccgggtgcgcgagaagtccgtccacctcacgaccgagaacgacttccagggcctgcagctgtggctcgcccagtacatcgtgtacggccggcacagcgaggccagcatgatcgggaagtggaacagcgccgacgacctggaggagttcctgaagaacttcaagcagcactccctccgcaatcccatcgtcgagcaggtcatcaccgagaccctgcgcgtggtgaaggacatctggctgaagtacggcaacggggcgaaggacttcttcaacgagatccacatcgagctgggccgggagatgaagctgcccgccaaggaacgcgaggacctgacgcggaagatcaccgagaacgagaacaccaacctccgcatcaaggccctgctggccgagatgatgaacgacagctccgtagagaacgtacggcccttcagccccatgcagcaggagatcctcaagatctacgaggacggggtcctgaactccggcatcgagattgaggacgagtacctgaagatcagcaaaaccgcccagccgtcccccagcgacctcaagcgctacaagctgtggctggagcagaagtacaagtccccctacacgggccagatcatccccctcaacaagctgttcaccccggagtacgagatcgagcatatcatcccccaatctcggtacttcgacgactccttcagcaacaagatcatctgcgagtccgcggtgaacaagctgaaggacaactacattgggttgggcttcatcaagcagttcgggggaaccatcatcgagctgggtttcggcaaaagcgtgaaggtctttgagaccgaggagtacgaggacttcgtgaagaagcactacgccaacaatcgctccaagcggaacaagctgctcctggaggacatccccgagaagatgatcgagcgccagatcaacgacacgcggcacatcagcaagtacatctccggcgtgctgagcaacatcgtccgcatcgacgacgaccaggccaagaagatcatcgaggacgccgagatcctcgcccggaaggagatcgacaaggacaaagcgaatgaaattcgccggaaggccaagagcctggccaccgacgacgggatcaattccaagaacatcgtgcccggcaacgggaagattacgacccagctgaagcaggactggggcctcaacgacgtgtggaacgacctgatcctgccacgcttcgagcggatgaaccagctcaccaacagcaaagacttcacggtctggaacgagaaccaccagaagtacctgcccaccgtgcccatcgagttctccaagggcttcagcaagaagcgcatcgaccaccggcaccacgccctggacgcgctcgtgatcgcctgcgccaccaaggaccacgtcaacctgctgaacaaccagtccgccaagagcgacaccaagcgctacgacctcaagaagaagctgatgaagttcgagaaggtggtgtaccaccacacgcagaccgggaacaagatcgagcgggagatcccgaagcagttcctgaagccctgggagaacttcaccttcgacgccaagtacaatctcgagagcatcatcgtcagcttcaagcagaacctgcgcgtgatcaacaaggcgaccaactactacgagaagtacgtggagaaggacgggacgaagaacaaggggcgcgtcgagcagaccggcaccaactgggccatccggaagccgatgcacaaagacaccgtgtccggtaaggtgaacctgccctgggtcaaggtgccgaagggcaagatcctgacggccacccgcaagatcctggacacctcgttcgacctgaagtccatcggcagcatcaccgacacggggatccagaagatcctccggaactacctggagttcaaaggctcccccgaactggccttcagccccgaggggatcgaggacttaaacaagaacatcgaaaagtacaacgacggcaagccccaccagccgatcaacaaggtgcgcgtctttgagctgggctccaagtttcaggtgggccagaccggcaataagaaggacaagtatgtggaggccgcgaagggaactaacctgttcttcgccgtctacgaggacaagaacggcaagcggtcgtacgagaccatccccctcaacgaggtgatcgagcgccagaagcaggggctgtccgtggtcgacctgaagggcactaatgacttctacctctgccccaacgacctggtatacatacccagcgacgacgagctggagaacatcaacaacatcgacttcaagaacatcgccaaggagaagaacgagcggatctacaaggtggtctccttcagcggtagccagatcttcttcgtgcgccaggacatcgccacctccatcgtgaacaaggccgagctcagcaccctgaacaagatggagcgggcgatggacggctccatgatcaaggagagctgcgtcaagctgaacgtggaccgcctcggcaacatctccaaggcctga

SEQ ID NO: 8029 - RNA, 4401 nt, synthetic construct; identical to SEQ ID NO: 2229
  misc_feature 1..4401: note = Cas9 variant
  source 1..4401: mol_type = other RNA

SEQ ID NO: 8030 - RNA, 4401 nt, synthetic construct
  misc_feature 1..4401: note = Cas9 variant
  source 1..4401: mol_type = other RNA
atgaagaacatactgggcctcgacctcgggaccaacagcatcggctgggccctggtgaaggaggacttcgagaacaagcagggggagatcctcggcttaggctcccgcatcatccccatgagccaggacattctgggcgagttcggccgggggaactccatcagccagaccgcggaccgcaccggctacagaggggtccggcggctccgcgagcggcacctcctgcgccgggagcgcctccaccgtgtgctgaacatcctgggtttcctcccgaaccactacgcgaaggagatcgacttcaccaagcgcctggggaagttcattaaccacgccgagcccaagctgtcgttcgacaaggagttcatcttcaaggacagcttcaacgagatgctcaaggacttccagcagaaccagcccggcttcatcatcaacaagcacggcgaggaggccctggtgccctacgactggaccatctactacctacgaaagaaggccctcacccagaagatcgacaaggaggaactggcctggattctgctcaacttcaaccagaagcgcgggtactaccagctgcggggcgaggaggaggaggagaacacgaataagctggtcgagttctactccctcaagatcatagacgtgatcgcggacaacgaggtgaacaagaagggggaggtctggtacagcctgcacctggagaacggctggatctaccgccggtccagcaagatctccctcgtggactggaaggacaaggtgcgcgacttcatcgtcaccaccgacgtgaatgacgacggcagcgagaagctggacaaggacggggtggtcaagcggtccttccgcgccccgtctgccgacgactggaccttactcaagaagaagacggagcaggacatcgacaactccaacaagaccgtgggcgcctacatatacgagaacctgctgctaaaccccaagcagaagatcaaggggaagctggtgcggaccatcgaacgcaagttctacaaggacgagctgaagcagatcctcgaaaagcagaaagagttccaccaggaactgcagaacgagcagctgctccaggactgcgtccgcgagctgtacaagtacaacgagcagcaccagcagatgctggagagcaaggacttcgtgcacctcttcctgaacgacatcattttctatcagcggcccctgcgctcccagaagtccctcatctccaactgcaccctggagaaacgggtgagccgcgacggcgtcgtgttccccatcaaagtgattagcaagtccaacccgtactaccaggagttccggctgctccagtggctgcagaacctggcgatctaccgcaaggacgacgacgtcaacgtgacgcaggagtttctgaacagcatcgagtcctgggagaacctcctccagttcctgaacgccaagaaggagatcaagcaggagcagctcataaagttcctgctggagcaaaaggggctcaagggcaacagcctgaagaccgccatcctgacctaccggtggaactacgtgaccgacaaggtctaccccatgaacgagacgcgctccctcatccaggacaagctgaaaaaggtggagaacgtcgccaccgacttcctgagcttcgacaacgagatggccctctggcacatcatctactccgtgaacgacaagatcgagtacgagaaggcgctggccaagttcgccagcaagcacaacctggatgagatctccttcgtggagagcttcaagaagttcccgcccttcaagtccgactacggcagcttctcagagaaggccatcaagaagctcctgcctctgatgcggttcgggtcagtctggaacaagaacaacatcgtgccctccgtgttagaccgcatcgacaagatcctgaccggcgagtacgatgagaagatcaagatccgggtccgcgagaaggccgagcagttccagttgaaccagatcgaggactttcagaacctccccctgtggctggcgcagtacgtggtgtacgaccggcacagcgaggccgagatcgccgggaagtggaactccgtcaaggacctcgagaactacctgaaggagttcaagcagcactcgctacgcaaccccatcgtggaacagattatcaccgagacgctccgggtggtcaaggacatatggcagcagtatggcaacggggtgcagaacttcttcgacgagatacacatcgagctgggccgcgaaatgaagaacaccgccgacgagcggaagcgcatcaccaactccgtcaccgaaaacgagaacacgaacctgcggatcaaggccctcctggtggagctgaaggaggacaccaacatcgagaacgtgcgcccgcacagccccatgcagcaggagatcctcaagatctacgaggagggcgtgctaaacgcggtcgagaacatcgacgaggacatactgaagatcagcaagaccgcccagccctccaagagcgagctcatccgctacaagctgtggctggagcagaagtaccagtccccctacaccggggagatgatcccgctcagccggctgttcacgtccgactacgagatcgagcacgtgatcccccagagccgctacttcgacgactccctgagcaacaaggtgatctgtgaggccgccgtcaacaagcggaaggacaaccagctcggcctggagttcatcaagaaccatcactccgaaaagatcgagctggggaacggcagaaccgcacaggttctcgaggtggaggcgtacgagtccttcgtcaaaaagaactacgacaagaaccgggggaagcgcaacaagctgctgcttgaggacgtgcccgagaagatgatcgaaaggcagctgaacgacacccgctacatctccaaattcgtgacccacctcctgagcaacatcgtccggaaggacgaggtgaactccaaggacgacggcataaacagcaagaacatcatccccggcaacgggaagatcacgtcccagctgaagcaggactggggactgaacgacgtgtggaatgagctcatcctgccgcgcttcgagcggatgaacaacctgaccaacagcaccgacttcacctccacgaacaccaacgggaagatcatccccaccgtccccctcgagtacagcaagggcttcagcaagaagcgcatcgaccaccggcaccacgccctggacgccctggtgatcgccctcgcgacccgggaccacgtgaacctgctgaacaacgagtccgccctccccaagaaggaccggaccaaggaggaacagaagtcctttcgcttcgacctgcaggtcaacctgcggaacaaggagaagtacttcaatgtgaaggagggccgcgagaaggagaagttcacgaccttcaagaagccgtggaacaccctcacacaggacacacgggacgccctggagaacatggtggtgagcttcaagcagaacttacgcgtaatcaacaaggcaaccaactactacgagagctatacggacgagaacgggaacctccggctggacaagtacggcaaccccaagaaggagctgatctcccagaaggggaccaactgggccatccgcaaaagcctccacaaggagacggtgtccggccagatccacttagaccgcgtcaaggtgaccaaggggaagatcgtgaccgcgacccgcaagagcctggactccagcttcaacgagaagtccatcgagagcatcacggataccggcatccagaagatcctccggaactacctgaaggccaaggacaacaagcccgacgtcgctttctccccggagggcatcgaggaactgaataagagcatctccgtgtataacgaggggaagaaccaccagcccatcatcaaggtgcggatcttcgagcagggcagcaagttccccgtcggggagaccggcaacaagatcgccaagttcgtggaggccgcgaaggggaccaacctcttcttcggcatctaccaggacaagacgggcaagcgctcctacgataccatccccctgaacctggtgatcgagcggttaaagcagggcctgagcccggtccccgagaccaacgagaagggccaccagctgctgttccacctgtcccccaacgacctggtgtacgtgcccaccatcgacgacaacgagcagctcgacagcaaccgcgtctacaagttcacggacagctccgacacaacctgcaacttcatcccgtctaatatctccgccatcatcttcaacatcaacagcaaggagcaggagaagcgggggatcaactaccccatccagaacgagctgggcgtggggagcccccagagcaagaaccagaagtccttcgacggcttcatgatcaaggaggtctgcatcaaactcaaggtggaccgcctcggcaacatcagcaagacctga

SEQ ID NO: 8031 - RNA, 4416 nt, synthetic construct
  misc_feature 1..4416: note = Cas9 variant
  source 1..4416: mol_type = other RNA
atgtgtaagtacttctacatcaagaacttcatcacattcgtgctgagcaagtccatcataccaatgaagcacatcctcggtctggacctggggagcaactcaatcggctgggccttcgtccagcaggacttcgagaacaagcaggggaagatcatcgccaccggcagccgcatcatcccgatggaccaggggatcctcggtgattttgagcggggcaacactgtgtcccagaccgcagagcgcaccacctaccgtagcacgcgccggctgcgcgagcggcacctcctccgccgggagaggctgcaccgggtactgcacatcctcggcttcctgcctccccactatgacgctcagatcgacttcaccaagcgctacggcaagttcatcgacaacgccgaacccaagatcgcatacaacaatgggaacttcatcttcatgaactccttcaacgagatgatcgaggacttcaaaaagcaccagccccagctattctacaagaagagtaacggcgaggagagcaagatcccctatgattggaccatttactatctccggaaaaaggccctgagccagaagattacccagcaggagctcgcctggctaatcctgcacttcaaccaaaagcgcggttactaccagctgaggggcgaagaggagacggagaaccccaacaaggaggtcgccttccactccctcaaggtggtggacgtcgaggccgaggctcccaacaagaagggcgagatctggtacaccatccgcctggagaacggatggatctaccggcggaccagcaagatcccgctagacgactggaagggcaagaccagagacttcatagtgacgaccgacctcaacgatgacgggaccatcaaggttgacaaggagggcaaggagaagcgttcgtttagagcgcccgacgagaatgactggaatctgctgaaaaagaaaaccgaacacgacatcgacttcagcggcaagactgtcggggcctacatttacgatcacctcctgcagaaccccaaccagaagatcaaaggcaagttagtgcggaccatcgagcgcaagtattataaggacgagctcaaggcaatcctggccaaacagatcgccctgcagccggagctgttcaccgagaccttgctggcggactgcatacgggagctctaccgcaagaacgagacgcagcagcagaacctgctgtccaaggactttctccacctgttcgtggaggacatcatcttctaccagcggccgttgaggagcaagaagtccaccatcgccaactgcaccctcgagaagcgtagctacatcgacaaggagaccaacgagcgcaaggacgccccaataaaggtctgcgccaagtccaacccctactaccaggagtttcgggtgctgcagtggctccagaacctccgaatctacgagatcgagacggaccgggaggtgaccgccgagttcatcgagacgccccaggactgcgaggcgctattcaacttcctgatgagccaaaaggagatcgacaacaaggggctcctcaaatacttcctgttcgccaagaacccgcaaatcaaggacaaggccgccaaaagcgagctcaagaagtggctgaccacctaccgctggaactacgtctacgatgccgcggacaactccagcaagaagtaccccatgaacgagaccggctacgagctgcagaggtacctgcagaaggtggaaggactccccgccaatttcctaacctttgacatcacctaccagctgtggcacctcctgtactccgtgaaggacaaagtcgagttcgagaaggccctgaagaagttcgccaaaaagaagcagctggacaagactagcttcgtagatagcttcaagaacttcaagccctacccgaatgagtatggcagcttctccgaaaaagccatcaagaagttactgccgctcatgcgctttggcaatcactgggacttcaaccggatcgacgtgagcacccagaagcgcatcgatgacctgatcaacggggtcgcgaacgaggacattcggaccattatccgcgagaaggccgagaagtaccagctgaactccgaaacctgcttccaggacctccccctgtggctggcccagtacgtggtgtacaaccggcacgccgaggcgacggacatcgagaagtggaccagcgtctctgatctcgaggcctacctggaggacttcaagcagcacagcctgcgcaacccaatcgtggagcaagtcgtgaccgagaccctccgggtggtccgcgacatttggcagcagtacggagggggccaggcgaacttcttcgacgagatccacatagaactgggtcgcgagctgaagaagaccgccgaggagcggaagcaactttccgacaaaaatcaggaaaacgaaagcacgaatctgcgcattaagaagctgctcgccgagctgaaggaggacgcgtcgatacaaaacgtgcggccgtacagcctggtccagcaagagctcctgaagatatacgaggagggcgtcttctccgccaccgatgaagtggaggaggacatccaaaagatacgtaagaaggccgagcccagcaaagccgacctccaacggtacaagctctggctggaacagaagtataagtccccctacaccggggaggtgatctccctgacaaagctgttcacggaggagtatgagatcgaacatatcatcccccagagccgctactacgatgactccctcagcaacaaggtcatctgcgagtcggccgtgaataagctgaagaccaaccagctcgggctggagttcatccagaaccaccacggcgagaaagtgcggatcacagcgaacaaggaggtcacgatcttcacagaggagcagtacaaggagttcgtgaagaagcattacgccaacaacagcgccaagcagcagaagctgctactaaatgagatcccggagaagatggtggcccgccagctgaacgacacccggtacatatccaagtacatctcggagatcctctccaagatcgtcagatccgacgagaaggatgagggggttaactccaagaacatcattccctgcaccggcaagataaccacggccctgaaacaggactggggcctgaatgacgtgtggaacaagctcatcctcccgcgattcgagcgcatgaaccagcttacccagacccagctgttcacctcatacaacgaccggctccagaagaacctgccgacggtccccatcgaatacagtcagggcttccagaagaaacgcatcgaccaccgccaccacgcgatggatgccctggtgatcgcctgcgccacgcgtgagcacatcaactacatgaacaaccagcatgcgctggacaagagcaaagacaagaaggagaagcagcagtctcggattgacctgcgcacgatcctctgcgagaagaagaacaacaactggcagttcaaaaagccctggagtaccttcacgcaggaggccaaggaggccctggagcatatcgtcgtctccttcaaacagaacctgagagtgataaataaggccaccaactactacgagaagtgggaggaaaagaacggcgtactcgtcaagaaaaaggtaaaacaggaggggaccaactgggccatccgcaagcccctgcacaaggagaccgtgagtggcaagatcgtcttggaccggaagatcgggaaggataagatcctcacagcgacccgcaaggccgttgacatcaccttcaccgaaaagatcatctccagcatcacggacaccgggatccagaagatcctgctgaactatctcaagtacaagggcagccctgaggtggccttctccaccgaggggctggaagagttaaacaagaacattgcccagtacaacaacggcaaaaagcaccagccgatatacaaggtccgcatcttcgaggaggggtcgaagttccccctcggggaaaccggggccaaagcgacgaagtacgtggaggccgccaagggcaccaacctgttcttcggcgtgtaccaggggaagggcaagcggacctacgccaccatccccctgaacgaagtcatcgagcgccaaaagcaggggctcccgtccgtcccagagaggaacgaaaagggcgagcccctcttattcagcctctccccgaacgacctagtgtacgtcccgatggagggggagatcgccgaaacgatcgacttcaacaacctgagcaaggaacagaaggagcgcatctacaagaccgtgtccttcaccggcaaccagtgcttcttcgtgcaggaggcggtcgccacccccatcgtgaacaagatggagtacagccccctcaacaaaatggagcgggacatcctgggcaccatgataaaggaggtgtgtattaagctgaaagtcgatcgcctcgggaacattacgaaggcctga

SEQ ID NO: 8032 - RNA, 4416 nt, synthetic construct
  misc_feature 1..4416: note = Cas9 variant
  source 1..4416: mol_type = other RNA
atgggctacaaggcgccccgcaacgacaaaggggagatcgactacggcgtggggctggacctagggaatggatcggtcggctgggtggccatggacaaagactaccatctgatccgggcccgcggacacgagcttattggggcccggctgttcgacccggcaaactcagccgagaaccggcgggaatcacgcaccacgcggcgacggctgtcgcgccggcgctggcggctacgcatgctcgattccctgttcgcctccgaactggcgaagatagacccgaattttctcgccagaagaaagtactcgtgggtgcaccccaaagacgagcagaaccacgagaactggtacggctccatcatcttcgggagcaaggagcaggacaagcagttctacaaggactaccccaccatatatcacttgcggaagaagctcaccgaggacaccgagcgccatgacatccgggagatctatgttgccatccaccatatcgtgaagtatcgcggccacttcctcagggagggggaaatcaacagtgaaaacctgtttgacccagagggcttcgtggaattgatcaaggacgtcatcaagctgaacaactcgtacgacgaatccacccccatattcgaggccagccccgccgacgtttccgaggcgctgctgaacgagcacacgagccgctccggacgcatcgaggataccctcgacaagctagatttcagcgtgtcccgggtcgacaaacatgagctgaaaggaatgcgcgacgcggctaaggccgtaatcggcgcgatcgtcgggaacaccgccgatttcagcaaaatcttcaatctcgataatttggacaaggactccaaggacaacctgaagctaaagttcgccgatagtaacttcgacgagaagtacggcggagtcgttggctcgggattgctggacgagacccagatcgaactcgtggaccgaatccacgccgtatacgacgccgtggcgctgaaagggatcctgggcgatgctcatactatctccgaggccaaggtagagtcctacgaaaaacaccgcaaaaactggaagctcatcaaggaggagctgcggaccaaggaaaacaaggatgaggtggacctgtggtacggggacctcagtggcaggcagtataagaacccacccgaccccgagaagggcccggacgaaggctcgaagaaagactcccccatccgggacagtgaccaaaagcagaacctgatcaaaaaggccaacgactacttcacggagctgatcgacgactcgcagctcagtgaggagcagaagaactgcctgaagaatgacattaacaacggccaactgttccccgtgcaacgctccagcgacaacggggtcattccctaccaaatccacctcaacgagttgcggcggattatcgagaaccagaaacaatactacccctttctggccgagaccttcatccgcaagacggcggaagggaagtcctacgaggaaaataagattgtagccctcttaaagttccgcgtcccctactacgtggggccgctggtaagcaaggaggacatggaggagcactcctctggcaactccgcctaccactggatggcccggaaccccggtcgcggtgaggccatcacaccctggaacttcgacgaggtcgtagacaaggatgagagcggcgcgcgttttattagccgcctcaccgggacggatacgtacctgctgggcgaacccacgcttccgcagcactcactgctgtatgaggagtacatggtgctgtccgaactaaacaacgtgcggctgaacgttcgccagggaaaccactggtctgacaagaaccggcagcgcctgagctacaaacagaaggagttcctcatcgagaatctgttcaaagaacacaagaccgttacccggaagcgagccgaggattgcctgagtagcatgggctgcggcgaggtgcagctgttcgggctgtccgatgagaagaagttcgcctcttccttaagctcctacataacgctcaagaaaatcctcggcaaggccttcgtcgatgacagcggtaactccgcgatcctggagcgcatcatcgaggttcagaccgtgttcgaggaccgggagcccctcacgcaccaactgagcctgatcgactcccttaccgtcgagcagcgaaagcagcttgccaagatccattacacggggtggggcaagctgtctcgcaaactcctcacctccaagaaagggtcctacaagatccactcccaaaacgagattatgagaacccagcacagcatcatcgacataatgcgcggtgactccctgaacctaatcgagataatccgcgataagaagattggaatcggcgaatggatcgacaacgagaacctggaccgggagaccggtgagagcgacgtctctcgcttagagtccgtgttcgaggggatcgttatgagcccccgggttaagcgcggcgtggtccaggccgtgcgggttatcgacgacctcgccaaggctatcggtaacccgccccaacgcatctttattgagatggcggacgaggtccaggcttcccaacggacggtatcacgcttatcccggctgaaggccctctacggcagcccctccctgcagaaggagttcaacgacctgaaggacttgcgcaaaagtctgaacgaaaccaaggacgcggacctgcaggaggatcgactatacctgtactacatacagctgggcaaagacctctatactggcaaagagattagtatcgacagtctgtccagcgcctacgacattgaccacatcgtcccccaagcgctcacccaagacgacagtatcgacaacagggtactcgtaagccgaaaagagaacgcccgcaaaacggactcctacctgtacacccccgacctgatcaagaacatgcgaccgctctggggtaaactgttggcagccgggctcatgagtcagaagaagtacgacgccctgactcgggtggacgacttcaaggacagagagaagcaacggttcgtccagagatccttagtggagacccggcagatcatgaaaaacgtgtcgacaattctccgcacctactacggcgaagacacaaacgtcgtgaccttgaaatccagcatcacccacgatatgcggaagtatctggggtttccgtacaagaatcgcgacatcaacgactaccatcacgcgcaagacgccctctgcatcagcgcggccggacagttcatgctgaaccggcatttcgtctccgggggcgaagtcacggatggcgcaagcaacgcctacaacatgtacctggcagagtacctccaagagtttcgcgacgccaaggcccggggcgagcgcaagcggtccactgcgttcggcttcgtggtggggtcgatgtccagcaaggacgacgagaagcgcaccgatcaccgaaccggcgagatcgtatggagcgagacgaacgccgagtatttacgcaaggtgatgaactacaagaagatgctgatcacacagaaggtgggggacgtcaagacgagagctctctatgatgagacccgctacgggcacaaggagagctccgcaaagagcatcaagttcgacaacttaaggcgcgacacgtccctgtacgggggcttcagcggcgcctccaccgcgtacatgatgcttgtggagtacaagaagaaaaacaagctggtgagcatcaccgctcaagaggccagcctgctcgccgtagccgaccagaagaacgacaccgtgagcgtgatggacgggatcctagcgtcccacggcttaagtggggccaagatcctcctccccaaaatcgtcacggggcaactgctcgattactccgacgccctggtgactctccaaagcgccagcgagctcaatactgcgagacaaatgtggctgccacggaacgactacaacgacatcgacatcattctgaagtccaaggacatagaggacgccgcccacaagctcggttacgattcggacactgtgcacgtcctgcgccgaatccagaagctgttcgaggccgttttccgcgtggctgagtcccagttccccctccaccagttgagcaaggaccagcaagaggaaatactgcgagatccacaaaactatggattcggctccgcggtcaagctcctagggggactgctcaaagccttgcacgccaacgccgagaatactaatttagccgggctcgtaaaagtgctgcacggtgacaaggaatacagcgacgacggcaaggcgaaggagttcaagaagtttggttttagcccccgctggagacgcatctcgaacccgaccggattcacgctgagtgactcggacaccttcatctaccagtccccgagtgggatattcgagcagcgggtcacggtgaaagagctcaaggagaaggccgacaagcaaaaatga

SEQ ID NO: 8033 - RNA, 4422 nt, synthetic construct
  misc_feature 1..4422: note = Cas9 variant
  source 1..4422: mol_type = other RNA
atgaaaaacatcctgggcctcgacctggggaccaacagcatcggctgggccctgatcgagaaggacaccgatcagaagaacgggaacatcctcggcacgggatcccgcatcatccccatgtcccaggacatcaaagacgagttcggcaaaggcaattccatcagccagaccgccgaccggaccaagttccgctccgtgcggcgcctccgggagcgccacctcctccggcgcgaaaggctgcaccgcgtcctgaacgtgctcgggttcctgccgaagcactacgcggaccagatcgacttcaagaagcggctgggcaagctcgtgaacgagacggagcctaagctggtctatgacaacaagaacttcatcttcaaaaagagctttgaggccatgctgagcgacttcaaccagcaccagcccctcctgctggccgacgggaagaaggtgcccttcgattggacgatctactatctccgcaagaaggccctgaccgagaagattgagaaggaggagctggcctggctcatcctgaactttaaccaaaagcggggctactaccagctgcgcggggaggaggaggaggagaacccgaacaagatggtggcgttccacagcctaaagatcgtggaggtgatcgccgatgagtcccagaagggcaaggccgagacatggtactcgcttatcctggagaacggctggatctaccggcgctccagcaagacacctctctatgactggaaagggaaacagcgcgacttcatcgtgaccaccgacctgaacgacgacgggtccatcaagaccgacaaggagggtctggagaagcggagcttccgagcccccgtcgaggatgactggaccctcgttaagaagaagacggagcaggagatcaaccgctcccacaagaccgtgggcacgtacatctacgagaacctgctgcaggaccccaagcagaagattaagggcaaactcgtcagaactatcgagcgcgagttctataaggacgagctgaagatgatcttaaagaaccagcagaagttccacccggagctcaacgacgagcacctgtacatcaactgcgtgcgcgagctgtaccgcaacaaccaggcacaccagacgatcctcagcaagaaggacttcgtgcacttattcatcgacgacatcatcttctaccagcgccccctgcggtcccagaagtcctccatcagcaactgcaccctcgagttccgcaagtacaagaacgagaacgggaccgaccagaccgactacctgaaggccatcccaaagagccaccccctgttccaggagttccggctctggcagtggatctacaatctgggcatctaccaaaaggaggatgacacgaacgtcacagatgagctgatcaagaacatcgacggataccaggacctcttcgacttcctgaacaacaagaaagagatccgccaggacatcctgatcaagttcctggtggagcagaccggcctcaaggggaagccgctgtccagcgtggtcgccaagtatcggtggaacttcgtggaggacaagatctacccgtgcaacgagaccggcacgcagatccgcaccagactggccaaggtggagaacacacccgaggacttcctcacggccgagacggagatcaagctgtggcacatcatctactccgtgaatgacaaagcggattacgagaaggccctgaagaccttcgccgagaagcacaacctcgacacccacagctttgtggagaacttcaagaagttcccgcccttcaagtccgagtacggcagcttctccgagaaggccatcaagaaactgctgcccctcatccgcctggggaagtactggagctgggagaacatcgacaagaagacccaggagcggatcgagaagatactgacgggcgagttcgacgaggccatcaagtcccgcgtgagggacaaggcgatccacctcaccgaggaggaccacttccaggggctgcagctgtggctcgcctcttacgtcgtgtacggccgccactccgaggccgataacctggacaagtggcacaccgtcgccgacctggaggactacctggccgaatttcggcagcacagcctgcggaatcccatcgtcgagcaggtcatcaccgagacgctacgggttgtgaaggacatatggctccagtacgggcagggcgcgaaggacttcttctccgagatccacatcgagctggcccgcgagatgaagaacaccggcgacgagcggaagcgcctgaccagcctcgtgaccgacaacgagaacaccaacctgcgcatcaaggtcctgctctccgagctgttaaacgacgggaacgtggagaacgtgcggccctacagcccgatgcagcaggaggccctcaagatcttcgaagacggcgtcctgaactccgacatcgagatcgaggacgacatcctgaagatcagcaagatggcccagcctacgaacaccgaactcaagcgctataagctgtggctggagcagaagtaccggtccccatacaccgggcaaatcatccccctcaaccgcctgttcaccgccgactacgagatcgagcacatcatcccgcagagccggttcttcgacgactcgttctccaataagatcatctgcgagagcgcggtgaaccagctgaaggacaagcagctcggcctggagttcatcaagaaccactccggaacgatcgtgaagctgggcatgggcaagaccgccaaaatcctcgacgtcgagagctacaacgagtttgtgaaagggaactacaccaagaacatctccaagcgcaacaaactgatgctggaggagatccccgacaagatgatcgagcggcagctcaacgacacccgctacatcagcaagttcatcatctccgccctgagcaacatcgtgcggtccgagagcaacgacgacggcttcaactccaagaacgtcctgcccgggaacggcaagatcacgagccgcctcaagcaggactggggcatgaacgacatctggaacgagctgatccttccccggttcgagcggatgaacaagatcaccgactccgccgtattcaccgcatggaacgagaacaatcagaagtttctcccgatcgtgcccctggagttcagcaaggggttccagaagaagcgtatcgaccaccgccaccacgccctggacgccctcgtcattgccgccagcacccgggagcacatcaacctgctgaacaacgagcacgccaagagcgacaagcgcttcgatctcaatcggaagctgcgcaagttcgagaaggtggcgtacaatgaccccaagacgggcaagcggatcgagaaggaagtgccgaccattttcctgaagccctgggagaccttcaccgtcgacgcgaagaacagcctcgagagcattatcgtgtcattcaaacagaacctgcgcgtgatcaaccgggccacgaactactccgagagctacaacgatgagaacggggccctgcgcctcggcaaggacgggaaccccctgaaggagaagattaagcagtccaagggcgactcctgggcgattcgcaaacccatgcacaaggacttcgtgtacggcaaagtgcacctccagaacgtcaagctgccgaaggacaagttcatcaccgccatccgtaagtccctggacgtcaccttcgacctgaagcgcatcgagactatcacagacactgggatccagaagatcctcaagaactaccttcacagcaaggagaacaaggtggagctggccttctcccccgagggcatcgaggatatgaaccaacacatcgagcggtacaacgacgggaagaagcaccagcccatccacaaagtgcgcgtcttcgagatcggcagccggttctcactcggggagagcggtaacaaaaagaccaagttcgtggaagcagccaagggcaccaacttgttcttcgcagtgtaccaggacgacaacaaggggaagcgcaactatgagacgatccccctgaacatcgtcatcgagcggcagaagctcggcctgcactccgtgccgaccgaggacgccaagggcgggaagctgctgttccacctgagccccaatgacatggtgtacgtccccacctccgaggagctggaggacaatcttgccagcgtgaacatcaagcgcctgaacaccgcccagcggaagaggatctacaaggtggaaaaggcgtccggtgtagagtgctacttcatccggcaggacatcgcctacctgatcaagaactatgacgccaagacgaagatcggcgagcttgaaagccagaacaagctgcagacgaccatgaccgacgaccgcctgaagatcacggacgtttgcgtgaagctcaacatcgaccggctgggctcaatcgccgagaccttcctggggaaccagtacggcgccagcaagaagacctga

SEQ ID NO: 8034 - RNA, 4422 nt, synthetic construct; identical to SEQ ID NO: 2234
  misc_feature 1..4422: note = Cas9 variant
  source 1..4422: mol_type = other RNA

SEQ ID NO: 8035 - RNA, 4425 nt, synthetic construct
  misc_feature 1..4425: note = Cas9 variant
  source 1..4425: mol_type = other RNA
atgaagaaaatcctgggcctggacctaggtacgaacagcatcggctgggccctgatagagtccgactttgagaagaagcaggggaagatcaacggcctcggaagccgaataatacccatgtcccaggacatcctgggcaaattcgacagcggcgtgtccatcagccagaccgcggagcggacgtcctaccgcggggtccggcgcctgaaccaaaggaacctcctgcgcagggagagactgcacagggtgctcaacatcctggacttcctgccgaagcactacagcaacgcgattgacttcgagaagaagctcggacagttcaaagagaacgtggaggaaaagctgaactacgctaaaaaccagatcggacgccacgagttcatcttcatggactccttcaaggagatggtaaaggagttcaagcagacccaaccccagctgttctataagcgggagaacggcatcgaaaccaagatcccctatgactggaccctctactacctgcgaaagaaagccctgagccaaaagatcaagaaggaggagttggcatggatcatcctgaacttcaaccagaagcgggggtactatcagctgcgcggcgaggatgtgctcgacgagtctaagatcgaggacttctacagcttgaaggttgtcgaggtgcaggaaacggaggacaagaatgcccggggcacctggtataacgtgatcctggagaacgactgggtctacaagcgccagagtaaggaatctctcgacaactggatcgggaagaacaaggagtttatcgtgaccaccaacaaggagaaggacggctccctgaagctggacaaggcgggcaacgtgaagcggaactttcgcgccgtcgacagcgagaaagactggatcgccatcaaaaagaagacggaacaggatgtggagatctccaagcacaccgtgggccagtacatctacgagaccctattgcaaaacgccaagcagaagatcaagggcaagctggtcaagaccatcgagcggaagttctataaggaggagttcatcaagatcatcaaggagcagcttaagcaccaccccgagctgcagagcaagacactgtatgagacttgcatccaggagctctacccacgcaatgaagctcaccagaacaacatcaagtccaaagggttcgagtacctgtttaccgacgacatcatcttctaccagcggcccctcaagagtaagaaatccaccatcagcggctgccagtacgagacgcgcctcttcaagaagaccgtgctgaacaaggtcaccaacaaggagaacgagatctggcagaaggagccccttaaagccataagtaagagtcaccccctcttccaagagttccgcctgtggcaatttctgaagaacttaaagatctaccagaaggaagacgtcaaggggaatctgatcgaccacgacatcaccagcgacctgctcaagacggaagcggactgggtagagctgttcgacttcctgaacatcaagaaggagatagagcagaagcaaatcatccagttcttcattaacaacaagcagatcgagaaaggcaagaagaacaactaccggtggaactacgtggaagacaaaaagtacccgtgtaacgagaccaagtcccagctcatcagccgcctgaagaaggtcaagaacctggatctgaacctcttcttcacgtcggaaaccgagctgaagctgtggcacatcatctactccgtgaaggacaagatccagtacgagaaggccatcaagaacttcgccataaagaacaacatcgacatagattccttcgtcgagaacttcaaaagattcccgccgttcaagaacgagtacgccgcgtacagcgagaaggccatcaagcgcctccttcccctgatgcgtatgggggagtactggaacgagtccgagatcaagcaggaggtcaaggaccgggcctacagcatcatagaacggctcaagggcatcgacttcaacaaggacaagatagacgaaaagattacggacgacgacatcaagaagcagctgctcaagtccttcatcgactttaaggacaagaaccctctcaagggacttaacacctaccaggcatgctacttagtatacaaccgccacagcgaggtcaactccatcgcgtactggaagtcccctgacgacatcaacaagtatctcgaggggttcaagcaacactcgctgcggaaccccatcgtggagcaggtagtgaccgagactctgagaaccgtgcgggacatctggcagtattacggcaaagggaaggccagcttcttcaacgagatccacgtggagctcggccgtgagatgaaaaacccagcctataagcggaaggcctctaccaaccgcgtcaccgagaacgagaacaccaaccaccggatcaaggagattctgaaagagctgcagaacgaaggtgtacaggaagtcaagagctactctcgtaaccagcaggagatcctcaagatctacgaggagggcatctaccagtccatcgacgtggtggacgacgctatcgaaaagatccggaagaatagctccccgacgaaggcggagattatcaaatacaagctgtggctggagcagggctacaccagcccctatactggaaagaccatccccatgtccaaactgttcacgaccgactaccaaatcgagcacatcatcccccagagcctgtacttcgacaactccttgagcaacaagatcatctgcgaaagcgaggttaatcagctcaaggacaaccaaaccgcctacgagttcataaagaagcatggcaccgagaaggtcagcctcgggaagaacaagaccgtggagatcttcacgctggagcagtacgagaagcactgcaaccagtacttcaagaagaacaagaacaagctcaagaaactgctgtccgaggagatcccggagggcttcataaacaggcagctcaacgacagccggtacatctccaaattcatcaaggggctgctgggaaacctcgtgcgcgaggaggatgagcaggaggtcaccaccaagcacatcgtgccggtgaccggcgcgatcacgagcaagctgaagcaggactggggattaaacgacaagtggaacgagctcgtcgccagccgctttcagcggctgaacaccatgaccaacagtaacaacttcggctactgggacaccaagatcaacgccttccgcgtccaagtgcccgacgagatctccaaggggtttagcaagaagcggatcgatcaccgccaccacgcgctggatgcgctcgtcatcgcatgctgcacgcggaaccacattaactacctgaacgccctgaacgcggagaagaagaactacggcctccgcgacttgctgctcatcaagaacgacaagaaccactacaccaagtttttcaagcacccctgggacggcttcccggtggaggctaagagcgtgctggagaagaccatcatctccttcaagcagaacacccgggtcatcaacaagacgaacaacaagacctggcagtgggccgagaaggaggggcagctgaagaaggtgctcgtgaagcagaccaagggcgacaactgggccatccgcaagcccatgcacaaggagaccgtcagcgggaagctgaacatccccacgcccaagggcaaaatcgccaccgcgtcccgggtgtcactgagcgaaatcaagacccgcaagcagttagacaagatcaccgacataagcatacagaagatactggagcggcatctcaacaactacctcgacgataaggggaaggagaagttcgacctcgccttcaacgccgacggggtggaggaactgaacaagaacatcaaggtcctcaacaagggcaagaatcaccagccgatctataaggtgcgcctgtacgagatcgggtccagattcaaggtgggcaactctggaaacaagaaagacaaatacgtcgaagccgccaagggcacgaacctgttcttcgcgatttatctcaacgagaaggacaagaagcgcgtgtacgaaaccatacccctgaacgaggtgatcgagcaccagaaacaggtctccaacctgcccaaaaacgagcggaccccggtgcccgtgaaccataccaagggcaaattcctcttctccctgtctccgaacgatctcgtctacgtgcccacggacgaggagatcgacaacccgagcctcgtaaactttaacaacttgaacaagaagcaggtcgaaaagatctacaagaccgtgtcctgcagcacctaccagtgcttcttcgtacacaacaccatctccaagcccatccagaacaaagtcgagttcagcgccctgaacaagatggaaaagagcatcgacggcatcatgatcaaggatagatgttggaagctcaagatggaccggctgggcaacatcatcagcgtgatacgctga

SEQ ID NO: 8036 - RNA, 4443 nt, synthetic construct
  misc_feature 1..4443: note = Cas9 variant
  source 1..4443: mol_type = other RNA
atgaagaccatcctgggcctcgacctggggaccaacagcatcggctgggccaaggtgtgtgtcgacaacgatgggaactacctgcgtgacattaagctcggctccaggatcatacccatgtcgcaggacacgctcgggaacttcgacaagggcgtgaccgactccccgaccgccgccaggaccggcttccgcggggtgcgtcggatccgcgagcgggccctccagcgccgggagcgcctccaccgggtcctgcacgtgatgaagttcctgccgccccactatgagaacgcgattggctggaatcgcgaggaggccaccacctacggaaaattcttaaaccacggcgagccaaaactggcctgggagaagcaggaggacgggtctatgcgattcctgttcatggactcctttcacgagatgatggcggatttcgccgagagccagcccggcctggttgccggagggaagaaaattccactcgactggaccctttactacctccgcaagaaggccctaacccaggcgatccggaaggaggaactagcctggatcctcctcaacttcaaccagaaacgcggatactaccagctgcgcggggaggaagacgaggagaaccccgccaagagggaggagtaccacgagctcaaggtcgtgtcagtagaggccgcagaagagggcaaaggcgggaacacgtggtacaacgtcaccctggagaatggctggatctaccggcgccaaagcaaggtggagctgcacgactgggtggggaagacccggcagttcatcgtcaccacggaatacgagaaagacggagtgaccatcaagaaggacaagaacggggaagttaagcggtcctttcgcgcccccagcgaggatgactggggcctcagaaagaagcgcaccgagtccctgttagaggatagcggcaaaacggtcggcgccttcatctacgaccacatattgtccgagccgacggataagatccggggcaacttcatccgtaccatcgagcggaagtactataagaaggagctggaggccattctgctcgagcagaccaagcaccacaaggaactgaaggaccagaacaccctgatcgcatgcatcaaagagctataccagagcaataagccccaccaggactccctgatgaagaaggacatgacgtatctgctcatcaccgacttaatcttctatcaaaggcccctcaagagcaagaagtccctcatcgccgactgcccgtacgagtactacgagtacaccatcaaggagaccggggagatcaagcggcagggcatcaagtgcatcgctaagagtaacccgtactaccaggagttcagactgtggcagtttatcatcaacctgcggctgttcgaccgcacggacgacaaggaggtgacatccgagtacctgagcagcatggaggactacacgaagctgttcacttacctcaacgaccggaaggacatcaaccaggagacgctgctgaaggacttcttcaaacagaagaaggtgaagatggggatggagaaggagttccccatccgttggaactacatcgaggacaaggagaagaaatatccctgcaacgaaactcggcacgagctcctggcggccctggacaaggcaggcatcgatcactcctggctggacgacaaagagcggttctaccggctctggcacctcctatacagcgtcgagtccaaggaggaagccgagggcgcgctccgtaaactcaaggacaacgacgacttcgtgaacgcctttctgaaggtgaagcccttcaagaaagactacggggcctattctgaaaaagccgtcaagaaactcctggccattatgcggatgggcgggctctggaacgagaccgacatctgtgagcaaacccgcaaccggatccaatccataatcaagggcgagatagacgaaaagataaaggaacggatggggcgcacgttctgccagctgagcgacttccagggcctcccggagtggttagcgtgctacgtggtctacggacggcattccgaagccaccgacatacagcgctggactaagcccgagaacctcatggcgtacatcaacgggttcaagcagcacagcctgcggaacccaatcgtcgagcagtgcatcttggagaccctccgcaccgtgcacgacatctggaaggaagccggccatattgacgaaatccacgtcgagctgggtcggtctatgaagtccaccgcggaccaacgcgcccgaatgagcaagagcatcctgcagaacgagaacaccaacctccgcataaagtcactgttgatggagctcaagaacgcgaaggaaatcgagaacgtgcggccctacagcccgatgcagcaggagatcctgcgcatctacgaggagggcgcgctacaggagctcacgaaggaggacgcccaataccccgagatttccaagatctctcagatggcgcaaccctccgcgaaggagcttctaaagtaccggctctggctggagcagaagtactgcagtccctacaccggcaagccgattagtctgagcaagctgtttacgagcgcctaccagatcgagcacattatcccccagtcacgctacttcgacgatagcttcaccaataaggtcatctgcgagacggaggtcaaccaactgaaatccaacatgctggggtacgagttcatcaagaagcacagcggtgagatcgtgcactgtaccacgatcggggacgtgaagatcttagacgctaaagagtactataacttcgtcaccgaacactacgccaacaaccgacgtaagaaggagaaacttcttctcgaggacatcccgcaggagttcctgaaccggcagatgaatgactcccgctacatcagcaagaaagtgatggcgatcctgagcaacatcgttcgggaggaggacgagcaagagaccaacagcaagttcgtagtgtcctgtagcggcgggatcaccgacagactgaagcaggactggggcctgaacgatgtgtggaactccatagtctacccccggttcgagcgcctgaacaagctcacgcagacagaggccttcggccggtgggagaacaaagaggggaagcaggtcttccagaccagcctgccgctggagctccagcgcgggttctccaagaagagaatcgaccaccggcaccacgccatggacgccctggtgatcgcatgcgccagccgcaacatcatcaactacctaaacaatgaatccgccaagagccaggagcagcgtgaggacctccggaagaagctgtgcgataagaaccggatcatacgcaagccttgggagacctttacgcaggacgcccggaccgccctggaggacgtcgtggtgagttttaagaattacgtcagagtgatcaacaaggcaacaaactattacgagaagtacgacgagagcggaaagaagggcatggccgagcagaaagggcaggacatgtgggccatccgcaagcctatgcacaaggagaccgtatttggacaggtcaacctcaggaggaaagtgactgtgaagctgaaagacgccctggaaaacattccggccatctgcgacaaggcgctccgcgactacgtaaacgacctgatcgccaagaagttcaacaccaagcaaatgctggcacatttcaagagcatcaactacagactcaacatgaagagtgtcaacaaggtgggcatatgggtattcagcgacgagaaggagcctatggtggcgacgcgcaaggcaatcgacatctccttcgacgcgaagcggattgatacgatcacggacaccggtatccagcagatcctgtgcaagtacctcaagtccaaggggaatgaccccaacgtggcattcactcccgaggggatcgccgagatgaacaaacacatcatcgattacaataacggcaagcaacaccagccgatcctgaaggtgcgcgtgtccgagccgaagggggccaaataccaggtgggcgagacgggcaacaagacgaagaagttcgtcgaagcccagaagggtaccaacctgtacttcgcgatctacgaggacaaggacggcaatcgaagctacaatactatcccgctgaatgaagtggccgagcgcctcaaacaagggctgtcgcccgtgccagagaagaacgaaaagggcatcagcctgaagttttacctctcccctaatgacctggtctacgtgcccaccgaggaggaaaagctgtcgaacgagtgcaaactcagcaaagagcgtatctacaagatggttagctccacgagcaatgaatgccatttcattccctacaccaccgccaaaccgatctacgataagttcgagtacgaggccaagaacaagatgggacgcgcgctgacgggcgagatgatcaaggcagtctgctggaaacttgaagtggaccgccttggcaacatcttaaagatcatcaagtga

SEQ ID NO: 8037 - RNA, 4452 nt, synthetic construct
  misc_feature 1..4452: note = Cas9 variant
  source 1..4452: mol_type = other RNA
atgaagaccatcctgggcctcgacctcgggaccaacagcattggctgggccaagatctccatagacgacaacgggaattacctgcgcgacatccagatgggctctcggatcatccccatgtcacaggacgtgctcgggaactttgacagcggcgtcacggagtcacagaccgccgtgcgcactggcttcagaggcctgcgccgtatccgcgagcggagccttctccgccgggagcgcctgcaccgggtgctgcatgtcatgggcttcctcccgccccactacgactccgcgatcgggtggaacaaggaggagcccaccacttacggcaagttcttaaaccacggggagcccaagctggcctgggagcgccagggagacggcagcatgcggttcctcttcatggactccttccacaagatgatggaggacttcgccccgcaccaacccgccctggtggccgacgggcgcaaaatccccctggactggaccctctactacctgcggaagaaggccctgacacagcccatcaagaaggaggagctcgcctggatcctgctgaactttaatcagaaacgcggttactaccagctccgcggggaggaggaggaggagaacccgaccaagcgagaggagtaccatgagctgaaggtagtaagcgtggaggccgctgaggagggcaagggcgggaacacgtggtacaacgtgaagctggagaatggctggatctaccgccgctccagcaagatccccctcgatgactgggtcgggaagacccggcccttcatcgtgaccaccgagtacgaggcggacggcatcacgctgaagaagaacaaggagggggaggtgaaaaggtccttccgcgccccgggcgaggacgactgggggctgcggaagaagcgcaccgagagccagctcgaggcctccgggaagaccgtcggcgcctttatctacgaccacctcctggccgagccggcggacaagatccgggggaatttcatccgcaccatcgagcggaagtactacaagcaggagctggctgacattttgcgcgagcagagcaagtaccacgaggagttgcagtccaagaagatcctcgccgactgcgccgaggagctgtatcggagcaaccagccccaccgcgactccctgctcaagaaggatatggtgtacttactgctcacggacatcatcttctaccagcggcccctcaagagcaagaagtccctgatcgccgactgtccctacgagtactatgagtacgtggacaaggagaccggcgagatcaagcgccaggggatcaagtgcgtcgccaagagcaacccgtactaccaggagttccggctgtggcagttcgtacttaacttacgcctctacgaccggaccgaggacaaggaagtgaccgcagagtacctgcccagcaaggaggactacgccagactgttcgtctacctcaacgaccggaaggagatcaaccaggagacgctgctgaaagacttcttcaagctgaagaaggtcaagcagcgctccgagaaagagttccccgtgcggtggaactacatcgaggacaaggagaagaagtacccctgcaacgagacccgccacgagctcctgatggccctggaccgggccggcatcgagagaagctggttagacgacaccgcgcgccagtgccggctgtggcacctcctgtactccattgaggtcaaggacgaggccgagcgcgccctcaggaagctgaaggatgatgatgagttcgtgagcgcattcctcaaggtgaagcctttcaaaaaggactacggcgcctactcagagaaggcggtcaagaagctactggccgtgatgcgcatggggagccactggtgcgaggacgacatctgtaaggagaccaaggagaggatcgaacacatcctccagggcgacgtcgaggagaagatcaaggagcgcatgaaccacaccgcttactccctgggggagctgagcgatttccaggccctccccgagtggcttgcgtgctacgtagtgtacggccggcactccgaggccacggacatcaaacactggaagacacccgagagcctgatggcctacatcaacgggttcaaacagcactccctccgcaaccccatcgtcgagcagtgcatattggagaccctgcggacggtgcacgacatctggaaggaggccggccacatcgacgaaatacacgtggagctcggccgcagcatgaagtccaccagcgaccaacgggcacgcatgaccgagaacatcctgcggaacgagaacaccaatctgaggatcaagtccttactgatggaactgaagaacgacgcggacatcaaagacgtccggccgtacagccccatgcagcaggagattctccgcatctacgaggagggcgctctgcaggagttaacgaaagaggacaacgactacgaggagatcttcaagatttccaagatgcctcagcccagcgccaaggagctcttgaagtacaagctgtggctcgagcagaagtaccggagcccgtacaccggcaagcccatctccctgagcaagctgttcacctccgcctaccagatcgagcacatcatccctcagagccgctatttcgacgactcattcaacaacaaggtgatctgcgagtcagaggtgaacgccctcaaggggaacatgctgggctatgagttcataaagaaccacggcggggagatcgtccactgcaccctgctcggcgacgtgaaggtgcagaacgagtcagagtacaaggcgttcgtcacggagcactacgccaataacaaatacaagaaggagaagctgcttatggaggacatccctcaggacttcctcaaccggcacctgaacgacagccgctacatctccaaggtggttaagaccctgctcagcaacatcgtccggaccgaggatgagatggagaccacctccaagttcgtggtgagttgcaccgggggcatcacggaccgcctgaagaaggactgggggctgaacgacgtctggaactccatcgtgtacagccgcttcgagcggctcaatgaactgaccaagtccgacgcgttcggccgctgggagaacaaggagggcaagagggtgttccagaccagcgtccccctggagctccagcgcgggttcaacaagaagcgaatcgaccaccgccaccacgccatggacgccctggtcatcgcgtgcgcttcccggaacatcatcaactacctgaacaacgaaagcgccaacagccccaagaagcgcgaagacctccggcagcagctgtgcgacaagaaccgcatcatccggaagccctgggagtccttcacgcaggacgcccgcgccgcccttgaggacgtggtcgtgagcttcaaaaactacgtgcgggtcatcaacaaggccaccaattactacgagcgctacgacgctgacggtaagaagaccatcacaaagcagaagtcccgggagatgtgggccgttcgcaagccgatgcacaaggagacggtgttcggtcacgtcaatctccggcgcaaggcgatcgtgaagctgaaggacgcgctggagaacatccctagcatctgcaacaaggagctccgggactacatcaacggcctggttgagcgcaacttcaacaccaagcagctgcatgcccacttccgctccaccgactaccggtggaacaagcagaatgtcgacaaggtggaagtgtggcgcttcagcgacgagaaggagcccctcgtcgccacccggaagcccttggacacgtccttcgacgccaagcgcattgacaccatcaccgacaccggtatccagaagattctgctcaactacctggaggccaagggaggcgacccgctgattgccttcacgcccgaggggatcgccgagatgaaccagaacatcgccctctataacgacggcaagatgcaccagcccatcctgaaggtgcggatcagcgagcccaagggggccaaataccagatcggccagacgggcaacaaggcggacaagttcgtggaggcacagaagggcaccaacctgtactttgccatctacgaggacgaggaccgcaaccggacctataacacgatcccgctcaatgaggtcgccgagcgcctgaagcagggcttaccgcccgtgcccgaaaagaacgagaaggaggtgcccctcaagttctacctgtcccctaacgacctggtctatgtgcccaccgaggaggagatcctcatgaaggagtgcaagctgaacaagaaccggatctacaagatggtgagctccaccgggaatcaatgcttcttcatacccttccgcgtcgcggtgagcatcgtgaacaaaatggagtactccccgctgaacaagatggagaaggccatcagctccgagatgatcaaggccgtctgctggaagctcgaggtggaccggctgggcaatatcatccgcgtggtcaagtga

SEQ ID NO: 8038 - RNA, 4452 nt, synthetic construct
  misc_feature 1..4452: note = Cas9 variant
  source 1..4452: mol_type = other RNA
atgaagaccatcctggggctcgaccttggaactaacagcatcggctgggctaaggtgtcgctggatgacaacggtaactatctccacgacatcaagctgggttgccgaatcatccccatgagccaggacgtcctggacaacttcgggaagggggtgactgtgtcccagaccagcgtccggacaggattccgcggggtacggcggatccgggagcgctcacttcagcggagagaacggctgcacagagtcctgcaccggctcggcttcctgccgcagcactacgacgccgctatagggtgggactctgactgcgctaaaacatacggcaaatttctggacaacggagagccaaagctcgcatgggagcgccaggaggacggctccatgcggttcctgttcatgaatagcttctacgagatgatagccgactttacgtcccatcaacctgcgctggtcgcggacggcaagaagatccccctcgattggaccctgtattaccttcgcaagaaggccctcacccaggccatccgtaaggaggagctagcatggatcctgttgagcttcaaccagaagcgcgggtactaccagctgcggggcgaggaagaggacgagaacccgaccaaacgcgaggagttttgcgagctgaaagttgtcgcggttgaggccgccgagaaggggaagggcgacgacatatggtacaacgtgcacctcgagaacggctgtatctaccgacgctccagcaaaatttccctggacgactgggtaggaaagaccaagcagttcatcatcaccaccgagtacgagaaggacggcgtgacccccaagaaagataaagacgggaaggagaagcgttcttaccgggcacccaaagaagacgactggggccttcgcaaaaagcgaacggagaccgacctagaagcgtccgggaagactgttggcgctttcatctacgagcacctcctggccgagcctttcgacaagatccgcggcaacttcatccacacgatcgagagaaagtactaccgcgccgagctggaggccatcctgacggagcagcgaaagtaccacgaggagctgcgcagcgagcagatgctcgccgtgtgcgctgaggagctgtatcggtccaaccttcctcaccagcagagcctcctgaagaaggacatggtctacctgctcctgagtgacctaatattctaccaacgccccctcaagagcaagaagagtctgatcgccgactgcccctacgagtactaccgctacgtggacaaggagaccggggagatcaagaagcagggcataaagtgcatcgccaaaagcaatccctactatcaggagttccgcttatggcagttcgtgctcaatttacggctgttcgatagaatgaccgacaaagaggtcaccgccgactacttgccgacgaaagaggactacgtgcggctgtttgactacctgaacaacaggaaagagattaaccaggagaccctgctcaaggacttcttccggcttaagaaggtgaagttggggcgcgagaaggagtttgaaatccggtggaactacattgaggacaaggaaaagaaatacccctgcaacgagacccgctacgaactcctcgtcgccctggaccgcgcagggatcgaccgcagctggatcgatgaggacgggcgccagtaccggctctggcacctcctctactccatagaagtgaaagccgaggccgagagcgccctgcggaagctgaactccgatgatgcattcgtgagctccttcctgaaggttaagcccttcaagaaggactacggtgcgtacagcgagaaggccgtgaaaaagctcctggccgtcatgagaatgggctctatgtggagcgaggccaacatatgcgaggagacacagaaccgcatcagatccatcatccgcggcgacatagaggagaaaatcaaggaaagaatgggccacacggcgcgcagcttcaaccagatcgacgatttccaagctctgcccgagtggctcgcatgttacgtggtgtacggtcggcactcagaggtaaccgacatccagcattgggagaccccggaacaactgcagtcgtacatcaacggattcaaacaacactccctccgaaaccccatcgtggagcagtgcatactcgagaccctgcggacggtacatgacatctggaaggaagccgggcacatcgacgagatccatgtcgagctgggccgtgacatgaaacggactgctgaccagcgcgcgcggatgacgaagaatatcctcaagaacgagaacaccaacctgcgcatcaaaagcctcctcatggagctgaaaaaggatactgacatcaaggaagtgcggccctattccccaatgcagcaggagatcctccgcatctacgaagaaggggcgttactgcagctgaagcgggatgacgaggccttcgctgacatcagtaagatctcccaaatggcccagccgaccgcgaccgagctccgtaggtacaaactgtggctggaccaaaagtaccgcagcccctacacggggaagttcatcagcctctccaagctgtttacgagcgcctatcagattgagcatgtgatcccccagtcccgctatttcgatgatagcttctccaacaaagtcatctgtgaggccgaggtcaaccgactcaaaagcaacatgctgggctacgagttcataaaggcccacgggggagaaatcgtgcattgcaccatgctgggcgatgtcaagatactctccgagagcgagtacaaggcctttgtcaacgagcactatgtgaaccaccgcgcgaagaaagagaaattgcttatggaggacatcccccaggagttcctgaatcgtcagatgaacgacagtcgctatatcagcaaggttgtgaaggctctcttatccaacatcgtgcggaccgaggatgagatggacgtcaccagcaagttcgtggtcccgtgctccgggggaatcaccgaccggctgaagaaggactggggattaaacgacgtctggaacagcatcgtgtacccacggtttgagcgcctgaacaggatgacgggaactgaggcctttgggcactgggagaacaaggagggcaaacgggtgttccagacctcagtacccattgagctgcagctcggcttcagcaagaagcgcatcgaccataggcaccacgccatggacgcactggtaatagcctgtgcctcccggaacatcatcaactacctgaacaacgaaagcgccaattcacagaagaagcgagaggatctcagacgtctgctgtgcgacaagaaccgtatcattcgcaaaccttgggagtccttcacccaggacgcccgagtggcgcttcaggatatagtcgtgagtttcaagaactacgtgcgaatcattaacaaagcaacgaattactacgagcgctacgacgagcaaggaaagaaaaccaccgccgaacagaagtccagcgagatgtgggccatccggaagccaatgcacaaggagaccgtcttcggccacgtgaacctgaagcgcaagacaacagttaagctgaagaacgccatcgagaacatccccaacatctgcaacaaggagctcaaggcgtacatcaacgagctggtggagaaacatttcaacaccaagcaaatgttagcgcatttcaagtccattaactaccggtggaatcgccagaacgtagagaaagtagaggtctggcaatacagcgacgaaaaggaacgaatggcggccacccgcaagccactcgacacgtcctttgacaagaagcggatcgagaccatcaccgacaccgggatacagaagatcttgctgaactacctcgaggagaaaggcggagacccgaatatcgccttcacgcccgaaggcattgcagagatgaacaagaacatcagcctcttcaatgatggtaagctgcaccagcccatcctaaaggtccgggtcgctaagaccatgggagctaagtaccaagtcggccagaccgggaataaggccgcgaagtacgtaggcgctcaggaggggaccaacctgtactttgccatctacgagaacgaggagggcgaacggtcctacaatgccgtgcccctaaacgaggtcgcggagcgccttaaacagggtatgagcccggtacccgagaagaacgagaaggacgtccccctgaagttctacttgtcgccaaacgacctcgtatacgtaccgacggaggaggacaagctgagcaatgagtgcaagctggataacgagcggatctataagatggtcagcgcaactgggaagaaatgccacttcctcccatactccgtcgccaacattatctataacaaggtggagttcgagagtatgaacaagatgggcaaggccctgagcggggagatgatcaaagccgtgtgctggaagctggaggtcgaccgacttggcactatactgcgggtgattaagtga

SEQ ID NO: 8039 - RNA, 4452 nt, synthetic construct
  misc_feature 1..4452: note = Cas9 variant
  source 1..4452: mol_type = other RNA
atgaagaccgagctggacctcaacaaggacagactgtacaagcacgtgctgggcctcgacctgggtgtcaccagcatcggcttcgcccacgtggtcgagtccgagaaccggaacgagtccgaaatcaagcagatcggggtccgcgtgattcagctggacaacttcgacaaagtggacaagtccggaaagaccagcgagtccaagaacccggctgtcgacttcgcggccgggaaggggctcaccccgaacggcagccggaccaagaagcgcggggcccggcgcaaccttgaccgctatcaggacagaagagacaacctcctcgaagtgctgacgaagagtggcttcatcaactccgagacgaagcgtaccgaggacggtaagcacaccacccaccagacatgggagatccgggccaaggccgtgtccgagaaggtcgagaaggaggaatttgcgcgcatcctgttagcaattaacaagaagcggggctacaagagctcccgcaaggccaagaacgaggacgaggggcaggccgtggacggcatggcggtggctaaacggctgtacgaggagaacctaacccccggacagtacgcctacgaggtcctgtcagggggcaagaagtccattcccgacttctacagaagcgacctgcaggccgagttcgacaagatctggaacttccagaagcagttctaccccaacatccttaccgacgagttctacgaggagctcaaggggaaggggcagcgggccacgtccgcggctttctggaagatccaccagttcaacacggccgacatcaaggacctggaggacgagctaaagaacgaacgcaccatcaagctcagcaagcgggatcagaagaagctgcaggcctacaagtggcgctccgaagcggtggtaaagcagttgggcaaggaagaggtcgcgtacgttctcaccgagataaacaataacctgaataacagctccgggtaccttggcgccataagcgaccggtcaaaggagctctacttcaacaagcagaccgtgggacagttcctgtacaagcagctgaaggagaacccgcatacgcgcctcaaaaaccaggtcttctaccgccaggactacctggacgagttcgagaccatatgggagatgcaggcccagttccaccccgagctgacccaggagttgaaggaggagatccgagatatcatcatcttctaccagcgcaagctgaagtcacagaagggtctgatctcgttttgcgagctcgagtccaaagaggttgtgatcaacgacacgaagaagatcatcgggctgcgggtcgcccctaagagcagccccctgttccaggagttcaaaatctggcaaaatctcaataacgtgctggttcgcaagaagggaagccggaagaggatggtcaaggcccagaaccagcactccctgtttgaggagccgaaggagatcttcagcctcgacctggcatctaaggagaaacttttcgaggagctcaacctgaagggcaatctgtcggccaagaactgcctcgacatcctggggctgaactccaacgagtgggagctgaactacacgcagctagaaggcaaccggaccaacaagtcactgtacgaggccttcctgaagatcctagacatcgaggggtacgacgtgaaggacctgctgaaggtcaagtcatccaaggatgaagtggaattggacgacctgaaggtgcccgcctccgagatcaagaacatggtccgcgagatcttcagcacgaataagatcgacaccgagatcttggacttcgacgccgagatcgacggcaaggctttcgagaagcagtccagctaccagctctggcacttactttacagctacgagggtgacgatagccagagcgggaacgagaagttatacgagctgctggccaagaagttcggcttcaaacgggagcacgcccagatcttggccaacgtctccctggtggacgactatgggaacctgagctccaaggcgatgcgcaagatctacccccacatccgggagaacaactatagcactgcctgcgaactcgtcggctacaggcactccaagcacagcctgaccaaggatgagctgaaggatcgggtgctcgaggaccgcctggaactgttaaagaaaaactctctgcggcagcccgtggtcgagaagatcctgaaccagatgatcaacgccgtgaacgccctcatcgagaagaacagcgagcgcgacgagaacggaaacataaccaagtacttcaagttcgacgaaatccggatcgagctggcccgcgaactgaagaagaacgcggcggagcgcgccgagatgacgacgaacatcaacgccgccaagctcgtgcacgagaagatcttcaagatccttcagaacgaatttggcatcaagaacccgacacgaaatgacataatccgctaccgcctgtacgaggagctgaaggggaacggctacaaggacttatactccaacacctacatcccccgcgagatcctgttcagcaaccagatcgacatagatcacatccttccccaatccaggctgttcgacgacagcttctccaataaggtagtggtgttccgcaaagacaacctgaagaagggcaaccaaacggcaatcgactacatcgggagcgaggtcggagaggaggggctgaagaacttcatcgagcgggtggagtctctgtacgagctgggcaagaagaacaaggaggaaggcatcagcaaggccaagtaccagaagctactgaagtccgccagcgagataggggacggcttcatcgagcgtgacctgcgggagagccagtatatcgccaagaaggccaaggagttactattcaaggtgactcgctccgtggtcagcacctccgggagcattacagatcggctgcgcgaggactggggactcatcaacgtaatgaaagagctgaacttgcccaagtacaagagcctcggactcacagagatccaggagcggcgcaacggtcaccaggtcgaagtgatcaaggactggacgaagcggaacgaccaccgccaccacgccatggatgccctggcagtggccttcactaagcacaaccacatccagtacttaaattacctgaacgcgcggaagaacgagagccacaagctgcacggcaacatcatagccatcgaaacccttgaaacagaggtcaagatcgacgacctcgggaataagaagcgcgtgttcaaggagccgatcccaaacttccgccaggtggcaaaggagcatctggagaacgtcctcatttcccacaaggccaagaacaaggtcgtcaccaaaaacaagaacaagatcagcgggaaggagaagctgcagatcacgctgacgccccgggggcagttacacaaggagactgtttacggcaagtaccggttctaccagtccaaggacgagaaggtcagcgccaagttcgacctggaaaccatcgagaaggtggcgaacccctcctacaaggccgccctgctgcagcgcctgaacgagaacgaaaacgaccccaagaaggccttcagcgggaagaatgccctgtcaaagaaccccatctacatcagcatggagaatgacatcaaagtcccggacaccgtgaagctcgtgtggctagaggaggactactccatccggaaggacgtcacacctgagaacttcaaggacgagaagtcaatcgagaagatcctggacgaaggcgtgaaacgcatcttgaagaaccgcctgaaggagttcggcggggacgcgaaggaggccttttccgatctggacaagaacccgatctggctcaacgaggaaaaaggaaccagcatcaagcgggttcgcatctccggggtcaagaacgccgagccactgcactataagaaggaccactttggcaacgacattctggacggtaacggcaacaagatccccgccgactttgtgagcaccggcaacaaccaccacgtggccatctacaaggagcccgagttcgacaagaaggggcagccggtcctcgacgagcttggcaaccaaaagtacaacctgcaagagaaggtggtgtcgttcttcgaggctgtcgagcgcgtgaaccaggggctccccatcatcgacaagacgtacaaccagcacctgggctggcagttcttcttcaccatgaagcaaaacgagatgttcgtgttccccaacgagaagacccgcttcaacccgatcgagatcgacctgctcgaccccaacaacaagaagctgatctctctgaacctcttccgggtccagaagatcgccaacaagaactacatgttccgccaccacctggagacaaacgtcgatgacaagaaggagatgaagaacatcgccttcatccatatccaaagctgcaacctgcttaaggagatcatcaaggtgcggctgaaccacctgggggatatcgtctccgtgggcgagtactga

SEQ ID NO: 8040 - RNA, 4452 nt, synthetic construct
  misc_feature 1..4452: note = Cas9 variant
  source 1..4452: mol_type = other RNA
atgaagaccatcctaggcctcgacctggggaccaatagcatcggctgggccaaggtgtcagtggacgaccacggtaactacctgcacgacataaaactcggcagccgcatcatacccatgtcccaagacatcttggggaactttgacaagggcgtgacggagagccagaccgctatccggactggcttcaggtccgtgcggaggatccgagagcgcagcctgctgcggagggagcggctgcaccgagtactgcacgtgatgggctttctcccgcctcactacgacagtgcgatcggctggaaccgggaggaggctagcacctacgggaagttcctgaaccacggcgagcccaagctggcctgggagcgcctcgaggatgggtccatgcggttcctctttatggactcgtttcacgagatgatggcgaacttcgcacgccaccaacccgcgctggtggccgacggtcggaaaatcccgctcgactggacgctgtactacctgcgcaaaaaggccctctcccaagctgtcggcaaggaggagctggcctggatcctgctcaacttcaatcaaaagcgggggtattgccagctccgaggcgaggaggaggaggagaccccaacgaagcgggaagagtactacgagctgaaggtggtgtctgtcgaggccgccgaggagggtaagggcggcaacacctggtacagagtgcagctcgagaacggatggatctaccggcgcccgtccaagatagccctagacgactgggtgggcaagacgaaacagttcatagtcactaccgagtacgagaaggacgggaccacactgaagaaggacaaggacggcgaggtgaagcgcagcttccgagccccgggggagaacgactggggacttcgcaagaagcggaccgagtcgcagctggaggcgagcggtaagaccgttggggcattcatctacgaccacctcctggccgagccggccgacaagatccgcggcaacttcattcggactatcgaaaggaagtactacaagcaggagctggaggccatcctacgggaacagacgaagcaccacgaggagctccgcagcaaggagatgcttgccaagtgcgcggaggagttgtaccagagcaaccagccccatcgtaagtcgctcctgaataaggacatgacatacctgctcctgaccgacctgatcttctaccagcgacccctcaagagcaagaagtccctcatcgccgaatgcccttacgagtactacaagtacaaagacaaggaaaaagggaaaaagaagcggcagggcataaagtgcgtcgccaagtcgaacccgtactaccaagagttccgcctatggcagttcatcgtgaatctccgtctgttcgaccgcaccgacgacaaggaggtgacggctgagtacctgcggtctcgcgaggactacgcgcggctgttcgcttacctgaacgatcgcaaggagatcaatcaggagaccttgctgaaggatttcttcggtctaaagaaggtcaagatcggcgcagagaaagagttcgccatccggtggaactacatcgaggacaaggagaagaagtatccctgcaacgagacccgccatgagctactgctagccctggaccgagcgggcatggaccggtcctggctggacgacagcgaactccagtaccgcctgtggcacctcctttactccgtggaggcccgggacgaagccgagggggccctgcgcaagctgcgggacgacgacgagttcgtgggagcatttctcaaggtcaagccctttaagaaggactacggggcttacagcgagaaggccgtaaagaaactgctggcagtgatgcgcatgggatcctggtggcacgaggaggacatctgcaagcagacccgggatcgcatcgagcggatcgtccagggcgacatcgaggagaaaatccgtgagcgaatgggccacgcagcgtacagtttttcccgcttagccgacttccagggcctacccgagtggctggcctgctatgtggtctacgggcggcacagtgaagccacgcacatcctccgctgggactccccggacaaactgttaagctacataaagggcttccggcagcacagcctccgcaaccccatcgtggagcagtgcattctggaaaccttacggacggtacacgatatctggaaggaggctgggcacatcgacgagatccacgtcgagctcggacgcagcatgaagtccaccgcggagcagcgggcccacatgacgaagaacatcctgcggaacgagaacaccaacctgcggatcaagtgccttctgatggagctaaagaacgatgccgacgtgaaagacgttcgcccatacagcccgatgcagcaggagatcctccgcatctacgaagagggcgccctgcaacagctgaccaaggacgacgctgagtacgcggagatttccaaaatcagcaagatggcacagccgagtgccaaggagctcctgcgatacaagctgtggctagagcagaagtaccgctcgccttacaccggcaagcccatcagcctgtccaagctgttcacgagcgcctaccagatcgagcacgtcataccccagtcccggtatttcgacgacagcttcaacaacaaggttatatgcgaatccgaagtgaacaccctcaagagcaacatgctgggctatgagttcatcaagaaccattgtggggaaatcgtccattgcaccatgctgggcgacgtgaaggtgttctctgagagcgagtataaggcattcgtcactgaacactattctaacaataagtacaagaaggaaaagctcttactggaggacatcccgcaggagttcctcaatcgccagatgaacgatagccggtacatctccaaagtggtgaaggggctccttagcaacgtcgtgcgcacggaagacgagctcgaggccacctccaagttcgtggtcagctgcaccggcggcatcaccgaccggctgaagaaggactgggggctgaatgacgtctggaactccatcgtgtacagccgcttcgagcggctcaacggcttaaccaagtccgagcacttcgggcactgggagaacaaggagggtaagcgggtcttccagacgagcgtgccaatggagctgcagagggggttcaataagaaacgcattgaccaccggcaccacgccatggacgctctcgtgatcgcatgcgcgagcagaaacatcatcaactacctgaacaacgagttcgccaagtcccctaaacaacgggaggacctgcgccagctcctgtgtgacaagaacaggatcatccgcaagccctgggagaccttcacgcaggacgcccgggccgccctggaggacgtggtggtgagcttcaagaactacgtccgcgtgatcaacaagaccacgaactactacgagcgctacgacgcggacggcaagaagaccatggtaccgcagaaggggaacgaaatgtgggccgtccgcaaacccatgcacgaggggaccatgtacggccgcgtgaatctccggcgcaaggccgtggtcaagctgaaggaggccctggagaatatatccagcatctgcaacaaggaactccgtgactatatcaatgtgctggtggagaaacaattcaacaccaagcaactcctcgcccactttaagtccatggactaccgctggaacaaacagcatatcgataaggtagaggtgtggaggttcagcgacgagaaggtgcaaatggttgcggcccgcaagcctctggacacgtccttcgacaaggaatgcatcgccagcatcaccgacaccggaatccagaagatcctgctcaactacctggagtccaagggcggcgatccggccatcgcgtttaccagcgagggcatcgccgagatgaaccaaaacatcgccgtatacaacgacggcaagaagcaccagcctgttatcaaggtccggaagtccacgaagttaggtaagaagtttgccgtgggccagattgggtgtaagagcaaacaatttgtggtagccgaagcgggcaccaacctatacttcgcaatttatgaagacgaggaggggaagcgaagctacgataccatccccctgaacgaggtgactgagcggctgaaacagggcctcagcccagtgccggagaagaatgagaaggaggtcccgcttaaattctacctgtcccccaacgacctagtatacgtgccgacggaggatgaaatgcagatgaaggagtgcaaactgaataaggagcgcatctataagatggtcagcagcaccggcaatgagtgccatttcctgccgtactctgtagcatccgtgatctacaacaaagtggagttcgagagcatgaacaagatggggcgggccctcaccggtgagatgatcaaagcagtgtgctggaaactagacgtcgaccgcttagggaacattctccgggtgatcaagtga

SEQ ID NO: 8041 - RNA, 4452 nt, synthetic construct
  misc_feature 1..4452: note = Cas9 variant
  source 1..4452: mol_type = other RNA
atgaagaccatcctaggcctcgacctgggcaccaactctatcgggtgggccaagatctccatcgatgataacgggaactacctgcgcgatatccagctcggctcgcggatcatccccatgtcccaagacgtgctggggaacttcgacaacggcgtgacggagagccagaccgccgtgcgcaccgggttccgggggctgcgaagaatccgcgagcggtccctcctgcgccgggagcgcctgcaccgggtgctccacgtcatgggcttcctgccgccccattacgacagcgcgatcggctggaacaaggaggaacccaccacgtacggcaagttcctgaaccatggggagcccaagctcgcctgggagcgccagggagacggctccatgcggttcctgttcatggacagcttccacaagatgatggaagacttcgctccgcaccagcccgcactggtggccgacgggaggaagatccccctcgactggaccctatactacctgcggaaaaaggcgcttacccagcccataaagaaggaggaactggcctggatcctgctcaacttcaaccagaaacgcggttactaccagctgcgcggggaggaggaagaggagaacccgaccaagcgggaggagtaccacgagctgaaggtggtcggcgtggaggccgccgaggaaggcaagggcgggaatacgtggtataacgtgaagttggagaacgggtggatctaccggcgcagtagcaagatccccctggacgactgggtcggcaagacccggcccttcatcgtcaccaccgagtacgaggcggacgggattacgctgaagaagaacaaggagggcgaggtgaagcgctccttccgcgcccctggcgaggacgactgggggctctggaagaagcggacagagagccagctggaggcctccggcaagaccgtaggagccttcatctacgaccacctcctggccgagccggcggacaagatccgcggcaacttcatccggaccatagagcgcaagtactataagcaggagctggccgacatcctgcgggagcagagcaaataccacgaggagctccagtccaagaagattctggccgactgcgcagaggagctgtaccgcagcaaccagccccacagggactccctcctgaagaaggacatggtgtacctgctcctgacagaccttatcttctaccagcgacccctcaagagcaagaagtccctcatcgccgactgcccctacgagtactacgagtacgtggacaaggagaccggggagataaagcggcaggggatcaaatgcatcgccaagagcaacccgtactaccaagagtttcgtctgtggcagttcgtgctcaacctgcggctgtacgaccgcaccgaggacaaggaggtgaccgcggagtacctccccagcaaggaggactacgcccggctgttcgtgtacctgaacgaccgcaaagagatcaaccaggagaccctgctcaaggacttcttcaaacttaagaaggtcaagcagcggagcgagaaggacttccccgttcggtggaactacatcgaggacaaggaaaagaagtacccctgcaacgagacccggcacgagctgctcatggccctggaccgcgccggcatcgagcggagctggcttgacgacaccgcgcgccagtaccgcctctggcacttactgtactccatcgaggtgaaggacgaggccgagcgcgccctgcgcaagctgaaggacgacgacgagttcgtcagcgctttcctgaaagtgaagcccttcaagaaggactacggggcatactctgagaaggcggtgaagaagctcctcgccgtcatgcggatgggcagccactggtgcgaggacgacatttgcaaggagaccaaggagcgcattgagcacatcctgcagggcgacgtgggcgaaaagatcaaggagcggatgaaccacacggcatactccctcggggagctgagcgacttccaggccctgcccgagtggctcgcttgctacgtcgtatacggccgccattccgaggccacagacattaagcactggaaaacccccgagagcctgatggcctacatcaacggcttcaagcagcattccctgcggaatcccatcgtggagcagtgcatcctcgagaccctgcgcacggtccacgacatctggaaggaggccgggcacatcgacgagatccacgtggagcttggccggagcatgaagtccaccagcgaccagcgcgcccgtatgaccgagaacatcctccgcaacgagaataccaacctgcggatcaagtccctgctcatggaactgaaaaacgacgcggacatcaaggacgtgcgcccgtattcccccatgcaacaagagatcctccggatctacgaggagggggctctccaagagctgacgaaggaggacaacgactacgaggagatcttcaagatctccaagatgcctcagcccagcgccaaggagctgctcaaatacaagctgtggctggagcagaagtaccgctccccgtacaccggcaaacccattagcctcagcaagctgttcacctccgcctaccagatcgagcacatcatcccccagagccggtacttcgacgactccttcaacaacaaggtcatatgcgagagcgaggtgaacgccctgaaaggcaacatgctcgggtacgagttcatcaagaaccacggcggggagatcgtgcactgcaccctgctgggggacgtcaaggtgcagaatgaatccgagtacaaggccttcgtgaccgagcactacgccaataacaagtacaagaaggagaagctcctgatggaggacatcccgcaggacttcctgaaccgccacctcaacgacagccggtacatatccaaggtcgtgaagaccctgttgagcaacatcgtgcgcaccgaggacgagatggaaaccacctccaagttcgtcgtgagctgcactgggggtatcacggaccgtctcaagaaggactggggcctgaacgacgtgtggaactccatcgtgtactctcgctttgagcgcctgaatgagctcaccaagtccgacgccttcgggcgttgggagaacaaggagggcaagcgcgtcttccagacgagcgtgcccctggagctgcaaagggggttcaacaagaagcgcatcgaccaccgacaccacgccatggacgcgctcgtcatcgcgtgcgcctcccgcaacatcatcaactacctgaacaacgagagcgccaactcccccaagaagcgcgaagacctgcgccagcagctctgcgacaagaaccggatcatccgcaagccctgggagagcttcacgcaggacgcccgggcggccctggaggacgtggtggttagcttcaagaattacgtgcgtgtgatcaacaaggcgaccaactactacgagcggtacgacgcagatggcaagaagaccataacgaagcagaagtcgcgcgagatgtgggccgtgcggaagccgatgcacaaggaaacggtgttcgggcacgtcaacctgcgacggaaagcgatcgtcaagctcaaggacgccctggagaacatccccagcatatgcaacaaggagctgcgcgactacatcaacggcctcgtggagcggaacttcaacaccaagcagctgcacgcccacttccggtccaccgactaccgctggaataagcagaatgtggacaaggtcgaggtgtggcggtttagcgacgagaaggagcctctggtagccacacgtaagcccctcgacacgagcttcgacgccaagcggatcgacaccatcaccgacaccggaatacagaagatcctgctgaactaccttgaggcgaagggcggggacccgctgatcgccttcacgcccgaggggatcgccgagatgaaccagaacatcgccctgtacaacgacgggaagatgcaccagccgatccttaaagtccgcatcagcgagcccaagggggccaagtaccagatcggccagaccggcaacaaggcggacaagttcgtggaggcccagaaggggaccaacctgtacttcgccatctacgaggacgaggatcggaatcgcacctacaacaccatcccgctaaacgaagtcgccgaacggctcaagcagggcctgccgcccgtcccagagaagaacgagaaggaggtgcccctgaagttttacctctcccccaacgacctggtgtacgtccccaccgaggaggagatcctgatgaaagagtgcaagctcaacaagaaccgcatctacaagatggtctcttccaccggcaaccagtgcttcttcatccccttccgtgtagcggtcagcatcgtgaacaagatggagtactctccgctgaacaagatggagaaggccatcagctccgaaatgatcaaggccgtgtgctggaagctggaggtcgaccgcctcggcaacatcatccgggtggtgaagtga

SEQ ID NO: 8042 - RNA, 4458 nt, synthetic construct
  misc_feature 1..4458: note = Cas9 variant
  source 1..4458: mol_type = other RNA
atgaagaacatcctgggcctcgacctggggaccaacagcatcggctgggccaagatctccatcgacgacaacgggaagtacatcaaggacagcatcaagctgggctcccgcatcattcccatgagccaggacgtcctcagcaacttcagcaagggggtcaccctgtcccagacgagcgagcggacctccttccgcggcgcccggcgcctgcgggagcgcaccctcctgcggcgcgagcggctccatcgcatcctccatctgctgggcttcctcccgaagcactacgagaaggcgatcgggtgggaccggaacgacaacaaaacctacggcaagttcatcaaccacgccgagcccaagctggcctggtgcaaggacaacaacgggaagatgcgcttcctgttcatggacagcttccacgacatgctctcagagttcagcgagaagcaccccgagctgctggctaacggcaagaagatccccctcgactggacgatctactacctgcggaagaaggccctgtacaaggcgattaccaaagaggagctcgcctggatcctgctgaacttcaaccagaagcgcgggtactaccagctccggggcgaggaggaccgcgactccgaggccaacaagaaggagtacctggagctgaaggtgatcggcgtggaggccactggggagaagaagggcaacgacatctggtacaacatccacctcgagaacgggtggatctaccggcgcagctccaagaacccgctgaacgactggctgggcaaggtcaagagcttcatagtgaccacggaccttgacgcggacggaaaccccaagaaggacaaggacgggaacatcaagcgatccttccgcgccccctcagagggcgactggacccttatcaagaagcggaccgagtccctgctcgagaacagcgggcagaccgtgggccagttcatctacaaccacatcctggaggagcccagcgccaagatccgcgggaacttcatccgcacgatcgagcggaagtactacaaggacgagctgaaggccatcctcgagaagcagaaggagtttcaccacgaactgtccagcgagtccctgctcaccgaatgcgccaaggagctgtataagcgcaacattgcacaccaggaggtcctgctaaagaagggcatgatccacctcctgctgaacgacatcctgttctatcagcggccgcttaagatcaagaagtccctaatcgacaactgcccctacgagaactacaagtacgtggacaagaagtccggcgacatcaaggtcaagagcatcaagtgcatcgccaagagcaaccccttcttccaggagttccgcctgtggcagttcgtgagcaacctgcggctgtaccgcaagtccgacgacaaggacgtgaccagcgagcacctcgtgaccacggacgactacgccaatctgttcacctacctgaacaaccggaaggacataaagcagtccgtcctcctgaaagagtacttcaagatcaagaaagtgaagaccatcaacggggccgagtaccccgtgcgctggaactacatcgacgacgacaacaagacctacccttgcaacgagacgcggtacgacatcctgcacgccctcagcaagaccgaactgaagtccgagtggctgacccccgagcgcacctaccggctctggcacctcctgtacagcatcgagtccaaggaggagacgaagaaggcgctgaacaagctgaacctgagcgacgacttcaccgaggccttcctcaccatcaagccctttaagaaggagtacggctcctacagcgagaaggccatcaagaagctgctgtccctcatgcgaatgggttacctgtggagcgaggacgaggccatcaagcaggtcggcgccgagatcgagaagaccatcgagggggagctgcccgactacgtgctccagcggctggagaagtcccagcacaactacaacaagatcagcgacttcagcggcctgccgctctggctggcgtcctacatcatctatgggcgccacagcgaagccaaggagatcatccactgggacaaccccgagtccatgatggcctacatcaaagacttccggcagcacagcatgcgcaaccccatcgtagagcagtgtgtcctggagaccctccggaccgtgcacgacatctggaaggaaatcgggcacatcgacgagatccacatcgagctgggccgcgagatgaaatccaccagcgagcagcggaaggccatcacccagaacgtgctgcacaaccagaacacgaacatccgcatcaagctcctgctgcaggagctcaagaacgacaacaacatcaccggcgtccgcccctactccccgatgcagcaggagatcctgcggatctatgaggagggcgccctgcaggggctaaccaaggaggacaaggactacaacgacatcctgaagatcagccagacagcgcagcccacgtccaacgagctgacccgctacaaactctggctggagcagaagtaccggagcccttacaccggcaaggccatctccctgagcaagctgttcacgtccgcctaccagatcgagcacgtgatcccccagagccgatacttcgacgactccctgagcaacaaggtgatctgcgagagcgaggtcaacaccctgaagaaggccatgctcggcatggagttcatcaagacgtgcggaggccagaaggtgcactgcaccctgctgggggacgtcgagatctacaacgaggaggactacaaggcgttcgtgaacgagcactactccaacaaccggaccaagcgcaacaagctcctgatggaggacataccgcaggagttcatcaaccggcagctgaacgacagccgctacatctccaagatggtgaagcagctcctgagcgccatcgtccggggccaggaggaggtggaggccacctccaagttcgtgatcccctgcacgggcgggatcacagaccgcctgaagaaagactggggcctcaacgacatctggaacaacctggtgagccctcggttccagcgcatgaacgccctgaccgggtccgaatacttcggccactgggagaacaaggaggggaagcgggtgttccagaccacgatgcccatccagctccagcagggcttcagcaagaagcgcatcgaccaccggcaccacgccatggacgcgctggtgatcgcctgcgcctcccgcaacatcatcagctacctgaacaacgagaccgcccaggacaccgagcggcgccgggatctccgccagaagctgtgcgacaagggcgggtccgtccggaagccgtgggacagcttcacccaggacactcagtacgccctgaaggacatcatcgttaccttcaaaaactacgtgcgcatcatcaacaaggcgaccaactactacgagcactacaagaccgacggcaaaaagggtatgatctcccagaagggcgacgagctctgggccatcagaaagcccatgcacaaggagacggtcttcgggaaggtgaacttacggcgccccaagcgggtgagcctgtccaaggccatcgacagcgtcgacgtgatctgcaaccgcaagctcaagaagtacatcaaggcccggctgaacgaaggcctgcagaagaagcagatcctcaacatcttcaaggaggtgaacaacgtctgggagggcatcgacgtgaacaagatcgacatctgggagatgtccaacgacaaggagccgatggtggccacccgcaagcagctggacaccagcttcgacgagaaaaagatccggtccatcagcgacacagggatccagaagatcctgctcaactacctgatcacgaagaacaacaaccccgagctggcgttcacccccgagggcatccaggagatgaacagcaacatcagcgagtacaacgaccacaagaagcaccagcccatctacaaggtccgcgtgaccgagccgctcggggccaagtaccccatcggcaccatggggaacaaccccaagaagttcgtggaggcccaggccggcacgaacctgtacttcgcgatctacgaggacaaggagggcaaccggaactacgacaccatccccctgaacatcgccgccgagcgcctcaaccagcagctgagcccggtccccgagaccaacgagaacaacacgcccctgaagttttacctctcccccaacgacctggtgtacgtgccctccgaggaggagcggcactccgggaacaacatccagctggacaagaaccgcatctacaagatggtttcctccacctctaagcagtgtttcttcatccaccaccgggtggccatttccctcgtggacaagaaggagttctccgcccagaacaagatggagcgctccatcgacaacgagcaggtcatgatcaagagcgtgtgctggaagctgatcaccgaccggctgggcaacatcattaaggtgatcaagtga

SEQ ID NO: 8043 - RNA, 4458 nt, synthetic construct
  misc_feature 1..4458: note = Cas9 variant
  source 1..4458: mol_type = other RNA
atgaagaacatcctgggcctcgacctggggaccaacagtatcggttgggccaagatctccatcgatgacaacgggaagtacattaaggacagcatcaagctgggctcccgcatcatccccatgagccaggacgttctctccaactttagcaagggggtcaccctgtcacagacgagcgagcggacctcattccggggcgcccggcgcctgcgggagcgcactttactgcggcgcgagcggctgcaccgcatcctccacctcctgggcttcctcccgaagcactacgagaaggcgatcgggtgggaccggaacgataacaagacctacggcaagttcatcaaccacgccgagcccaagctggcgtggtgcaaggataacaacgggaagatgcgcttcctgttcatggacagcttccacgatatgctctccgagttcagcgaaaagcaccccgagctgctggccaacggcaagaagatccccctcgactggacgatctattacctgcggaagaaggccctgtacaaggcgatcacgaaagaggagctcgcctggatcctgctgaacttcaaccagaagcgcgggtactaccagctccggggcgaggaggaccgtgactccgaggccaacaagaaggagtacctagagctgaaagtgatcggcgtggaagccaccggggagaaaaagggtaacgatatctggtacaacattcacctcgaaaacgggtggatctaccggcgcagctccaaaaacccgctgaacgactggctgggcaaggtcaagagcttcatcgtgacgacggacctcgatgcggatggcaaccccaagaaggacaaggacgggaacatcaagcggtcattccgcgcccccagcgagggcgactggaccctgatcaagaagcggaccgagtcactactcgaaaacagcgggcagaccgtgggccagttcatctacaatcacatcctggaggagcccagcgccaagatccgcgggaacttcatccgcacaatcgagcggaagtactacaaagatgagctgaaggccatcctagagaagcagaaggagtttcatcacgagctgtccagcgaatccttgctcaccgagtgcgccaaggaactgtacaagcgcaacatcgcgcaccaggaggtactgctcaagaagggcatcatccacctcctgctgaacgacatcctgttctaccagcggccgctgaagatcaagaagtccctgatcgacaactgcccctacgagaattacaagtacgtggacaagaagtccggcgacataaaggtcaagagcatcaagtgcatagccaagagcaaccccttcttccaggagttccgcctgtggcaattcgtatcgaacctgcggctgtaccgcaagtcggacgacaaggacgtgaccagcgagcacctagtgaccacggacgactacgccaacctgttcacctacctgaacaaccggaaggacatcaagcaaagtgttctcctgaaggaatacttcaagatcaaaaaggtgaagaccatcaacggggccgagtacccggtgcgctggaactacatcgacgacgacaacaagacgtacccgtgcaatgagacgcgctacgacatcctccacgccctcagcaagactgagctgaagtccgaatggctgacccccgagcgcacataccggctctggcaccttctgtatagcatcgagtccaaggaggagactaagaaggcgttaaacaagctgaacctgagcgacgatttcaccgaggccttcctcaccatcaagcccttcaagaaagagtacggctcctacagcgagaaagccatcaagaaacttctgtccctaatgcgcatggggtacctgtggagcgaggacgaggccattaaacaggtgggcgccgaaatcgagaagaccatcgagggggagctgcccgactacgttctccagcggctggagaagtcccaacacaactacaacaagatcagcgacttcagcggcttaccgctctggttggcgtcctatatcatctacggccgccacagcgaggcaaaggagatcatccactgggacaatcccgagtccatgatggcctacatcaaggacttccggcagcacagcatgcgcaaccccatcgtggagcagtgcgtcctggagacgctccggaccgtgcacgacatctggaaggaaatcgggcacatcgacgagatccacatcgagctgggccgcgagatgaagtccaccagcgagcagcggaaggcgatcacacagaacgtgctgcacaatcagaacacgaacatccgcattaagctcctgctgcaggagctcaagaacgacaacaacatcaccggggtccgcccctactccccgatgcagcaggagatcctgcggatctacgaggagggagccctgcaggggctcaccaaggaggacaaggactacaacgacatcctgaagatcagccaaaccgcgcagcccacgtctaacgagctgacccgctacaaactctggctggagcagaagtacagatcgccgtacaccggcaaggccatctccctgagcaagctattcacctccgcctaccagatcgagcacgtgatccctcagagccgctacttcgacgactccctgagcaacaaggtgatctgcgaaagcgaggtcaacaccctgaagaaggccatgctcggcatggagttcataaagacgtgcgggggccaaaaggtgcactgtaccctgctaggggacgtcgagatctacaacgaggaggactacaaggcgttcgtgaacgaacactactccaacaaccggaccaagcgcaacaagctcctgatggaggacatcccgcaggagttcatcaaccggcagctgaacgacagccgctacatttccaagatggtgaagcagctcctgtcagccatagtccggggccaggaggaggtggaggccaccagtaagttcgtgatcccctgcacgggcgggatcacagaccgcctgaagaaggactggggcctcaacgacatctggaacaacctggtctcaccccggttccagcgcatgaacgccctgaccgggtccgagtacttcggccactgggagaacaaggaggggaagcgggtgttccagaccacgatgcccattcagctccagcagggcttcagcaagaagcgcattgaccaccggcaccacgccatggacgcgctggtgatcgcatgcgcctcccgaaacatcatcagctacctgaacaacgagaccgcccaggacaccgagaggcgccgggacctccgccaaaagctgtgcgacaagggcgggtccgtccggaagccgtgggacagcttcacccaggacacgcagtacgccctgaaggacatcattgtgaccttcaaaaactacgtgcgcatcatcaacaaggcgacgaactactacgagcactacaagaccgacggcaagaaaggcatgatctcccagaagggcgatgaactctgggccatccgcaagcccatgcacaaggagacggtcttcgggaaggtgaacctgcggcgccccaagcgggtatcgctgtccaaggccatcgacagcgtcgacatcatctgcaaccgcaagctcaaaaagtacatcaaggcccggctgaacgagggcttacagaagaagcagatcctcaacatcttcaaggagctgaataacgtgtgggagggtatcgacgtgaacaagatcgacatctgggaaatgtccaacgacaaggagccgatggtcgccactcgcaagcagctggacacgagcttcgacgagaagaagatccggtccatcagcgacaccggaatccagaagatcctcctgaactacctgatcacgaagaacaacaaccccgagctcgcgttcacccccgagggcatccaggagatgaacagcaacatctccgagtacaacgaccacaagaagcaccagcccatctacaaggtgcgcgtgaccgagccactgggggccaagtaccccatcgggaccatgggcaacaacccgaagaagttcgtcgaggcccaggccggcacgaacctgtacttcgcgatatacgaggacaaggagggcaagcggaactacgacaccatccccctcaacatcgccgccgagcgcctgaaccaacagctgagcccggtgcccgagaccaacgaaaacaacacgcccctcaagttctacctgtccccgaacgacctggtgtacgtcccgagcgaggaggagcggcactccgggaacaacattcagctcgacaagaaccgcatctacaagatggtgtcttccaccagcaagaggtgcttcttcatccaccaccgcgtggccatctccctggtcgacaagaaggagttcagcgcccagaacaagatggagcggagtatcgacaacgagcaggtcatgatcaagagcgtctgctggaagctgatcaccgaccgcttaggcaacatcataaaggtgatcaaatga

SEQ ID NO: 8044 - RNA, 4458 nt, synthetic construct
  misc_feature 1..4458: note = Cas9 variant
  source 1..4458: mol_type = other RNA
atgaagaacatcctgggcctcgacctggggaccaacagcatcggctgggccaagatctccatcgacgacaacgggaagtacatcaaggacagcatcaagctgggctcccgcatcatccccatgagccaggacgtgctctccaacttcagcaagggggtcaccctttcccagacgagcgagcggacctccttccgcggcgcccgtaggctgcgggagcgcaccctcctgcggcgcgagcggctgcaccgcatcctccacctcctgggcttcctcccgaagcactacgagaaggcgatcgggtgggaccggaacgacaacaagacctacggcaagttcatcaaccacgccgagccaaagctggcctggtgcaaggacaacaacgggaagatgcgcttcttattcatggacagcttccacgacatgctctccgagttctctgaaaagcaccccgagctgctggccaacggcaagaagatccccttggactggacgatctactacctgcgaaagaaggccctgtacaaggccatcaccaaggaggagctcgcctggatcctgctgaacttcaaccagaagcgcgggtactaccagctccggggcgaggaagaccgcgactccgaggccaacaagaaggagtacctggagctgaaggtgataggcgtggaggccaccggggagaagaaaggcaacgacatctggtacaacatccacctcgagaacgggtggatctaccgacgcagctccaaaaacccgctgaacgactggctgggcaaggtcaagagcttcatcgtgaccacggacctcgacgcggacgggaaccccaagaaggacaaggatgggaacatcaaacggtccttccgcgcccccagcgagggcgactggaccctgatcaagaagcggaccgagtcgctgctcgagaactcagggcagaccgtgggccagttcatctacaaccacatcctggaggagcccagcgccaagatccgcgggaacttcatccgcacgatcgagcggaagtattacaaagacgagctgaaggccatcctcgagaagcagaaggagttccaccacgagctgtccagcgagtccctgctcaccgaatgcgccaaggagctgtacaagcgcaatatcgcgcaccaggaggtcctgctcaagaagggcatgatccacctcctgctgaacgacatcctgttctaccagcggccgctgaagatcaagaagtccctcatcgacaactgcccctatgagaactacaagtacgtagacaagaagtccggcgacatcaaggtcaagagcatcaagtgcatcgccaagagcaaccccttcttccaggagttccgcctatggcagttcgtgagcaacctgcggctgtaccgcaagtccgacgacaaggacgtgacaagcgagcacctcgtgaccacggacgactacgcgaacctgttcacctacctgaacaaccggaaggacatcaagcagtccgtcctcctgaaggagtacttcaagatcaagaaagtgaagaccatcaacggggccgagtaccccgtgcgctggaactacatcgacgacgacaacaagacctacccttgcaacgagacgcggtacgacatcttgcacgccctcagcaaaaccgagctgaagtccgagtggctgaccccagagcgcacctaccggctctggcacctcctgtacagcatcgagtcaaaggaggagacgaagaaggcgctgaacaagctgaacttaagcgacgacttcaccgaggcctttctcaccatcaagcccttcaagaaggagtacggctcctacagcgagaaggccatcaagaagctcctgtccctcatgcgcatggggtacctgtggagcgaggacgaggccatcaagcaggtcggcgccgagatcgagaagactatcgagggggagctgcccgactacgtgctccagcggttagagaagtcccagcacaactacaacaagatcagcgacttcagcggcctgccgctctggctggcgtcctacatcatctacggccgccactctgaggccaaggagatcatccactgggacaacccggagtccatgatggcctacatcaaggacttccggcagcacagcatgcgcaaccccatcgtggagcagtgcgtcctggaaacgctccggaccgtgcacgacatctggaaggagatcgggcacatcgacgagatccacatcgagctgggccgcgagatgaagtccaccagcgagcagcggaaggccataacccagaacgtcctgcacaaccagaatacgaacatccgcatcaagctcctgctgcaggagctcaagaacgacaacaatatcaccggggtccgcccctattccccgatgcagcaggagatcctgcggatctacgaggagggcgccctgcaggggctcaccaaggaggacaaggactataacgacatcctgaagatcagccagaccgcccagcccacgtccaacgagctgacccgctataagctctggctggagcagaagtaccggagcccctataccggcaaggccatctccctgagcaagctgttcacctccgcctaccagatcgagcacgtgatcccccagagccgatacttcgacgactccctgagcaacaaggtgatctgcgagagcgaggtcaacaccctgaagaaggccatgctcggcatggagttcatcaagacgtgcgggggccagaaggtacactgcaccctgctcggggacgtagagatctacaacgaggaggactacaaggcgttcgtgaacgagcactactccaataacagaaccaagcgcaacaaactcctgatggaggacatcccgcaggagttcatcaaccggcagctgaacgacagcaggtacatctccaagatggtgaagcagctcctgagcgccatcgtccggggccaggaggaggtggaggccacctccaagttcgtgatcccctgcacgggcgggatcaccgaccgcctgaagaaggactggggcctcaacgacatctggaacaacctggtcagcccccggttccagcgcatgaacgccctgaccgggtccgagtacttcggccactgggagaacaaggaggggaagcgggtgtttcagaccacgatgcccatccagctccagcagggcttcagcaagaagcgcatcgaccaccggcaccacgccatggacgcgctggtgatcgcctgcgcctcccgcaacatcatcagctacctgaacaacgagaccgcccaggacaccgagcggcgccgggacctcaggcagaagctgtgcgacaagggcgggtccgttcggaagccgtgggacagcttcacccaggacacgcagtacgccctgaaggacatcatcgtgaccttcaagaactacgtgcgcatcatcaacaaggcgaccaactactacgagcactacaagaccgacggcaagaaggggatgatcagccagaagggcgacgagctctgggccatccgcaagcccatgcacaaggagacggtcttcgggaaggtgaacctgcggcgccccaagagggtgagcctgtccaaggccatcgacagcgtagacgtgatctgcaaccgcaagctcaagaagtacatcaaggcccggctgaacgaggggctgcagaagaagcagatcctcaacatcttcaaggaactgaacaacgtgtgggagggcatcgacgtcaacaagatcgacatctgggagatgtccaacgacaaggagccaatggtcgccacccgcaagcagctggacaccagcttcgacgagaagaagatccggtccatcagcgacaccggaatccagaagatcctcctgaactatttgatcacgaagaacaacaaccccgagctcgcgttcacccccgagggcatccaggagatgaacagcaacatttccgagtacaacgaccacaaggaacaccagcccatatacaaggtgcgcgtcaccgagccgctgggggccaagtaccccatcggcaccatggggaacaagcccaagaagtttgtggaggcccaagccggcacgaacctgtacttcgcaatctacgaggacaaggagggcaaccggaactacgacaccatccccctcaacatcgccgccgagcgcctgaaccagcagctgagcccggtgcccgagaccaacgagaacaacacgcccctcaagttctacctgtcccccaacgacctggtttacgtgccgtctgaggaggagcggcactccgggaacaacattcagctcgacaagaaccgcatctacaagatggtgtcctccaccagcaagcagtgcttcttcattcaccaccgtgtcgccatcagcctagtggacaagaaggagttcagcgcccagaacaagatggagcgctccatagacaacgagcaggtcatgatcaagagcgtgtgctggaagctgatcaccgaccggctcggcaacatcatcaaggtgatcaagtga

SEQ ID NO: 8045 - RNA, 4461 nt, synthetic construct
  misc_feature 1..4461: note = Cas9 variant
  source 1..4461: mol_type = other RNA
atgaccaagatcctaggcctcgacctggggaccaacagcatcggctgggcgatccgcgaggacgagaacgagggggttaaccaaatcatcgacaagggcgtccggatcttttccgaaggggtcaagagcgagaacggtaaggagatctcccgcgccgcagagcggactgcctacagaagcgcccgtaagataaagtacaggcggaaactgcgcaagtacgagaccctcaaggtgctgtccgtgaatggtatgtgccccctgagcgtggaggaagtggaacagtggaagaagtccggattcaaggagtacccgctcaaccccgagttcctgaactggctacgcaccaacgaggataaaaacatcaatccttacttcttccgcgataaagcctctaagcagaaggtcaccctattcgagctgggccgggccctgtaccacatagcgcagcgccgggggttcctctccaaccgcctagaccagtcggccgaaggcgtgttcgaggagcacaacccccagatccagaacctgatcgaggacctagactccagcaacacgattctgaacgaactgaaggaatactacataaacttagggatcatcgacgagtccgagaagtccggcttcaagaaggacctggacgagggcgagaaaaacctgaaaaagctctatacctccctagtgagtatcaccaagaagaacgccaacgacatcgagacttgcaagcaggagctgatcgcccggttgaacaagaaggaggacctggggaaagtgaagggcgaaatcaaggacatctcccaggccatgctggacgggaacttcaaaacgctcggccagtatttcttcagcctgtacaacaagacccgaatccgtaaccagtacacatcccgcgaggagcactacctggaggagttcatcatcatttgccagacccaaggcatcgaggagataaatacgaacgagaagctccccgagaagaagttcacagggctggccaaggacctgtaccgggcaatcttcttccagaggcccctcaagagccaaaagggcctaatcgggaaatgcagcttcgagaagaacaagtcccggtgcgcagtgtcccaccccgactacgaagagttccgtatgtggtcctacctgaacaccatcaagattggcacccagagcgagaagacgctccgcttcttaaccctggaggaaaagctcaaactggtgccaaagttctacaggaagaacgacttcaacttcgaagtcttagccaaggagctcgtggagaagggggcgtccttcggctactataaaagcagtaaaaagaatgagttcttctattggttcaactacaagcccactgactctgtgtccgcttgcgtcgtgagcgcctccctggagaacgccatcggcaaagactggaagaccaaaactttcgaataccagaccagcaacaccaagaaggaggaggtgaccaagtccgtcaactacaaggacctgtggcacctcctgagcgtggctacgtccgacacctacctttatgacttcgcgatcgagaagctcaagctggagcccaagaacgccaaggccttcagcaaaactaaactgaaaaaggacttcgcctccttgagcctagccgcgatcgccaagatcctgccctacttaaagcaggggctcctgtactcccacgccgtgttcatcgccaatatcgagaacatcgtcgacgccgacatctggaaggacaaggagcagcagaaattcatacagagcaagatcgtggacctgatagacaactacctcgtggagaagtccaagttggagatcatcaactgcttgctcaagatctacaacaccgaggatatagagggccgcaaggtctactacagcaaggaggcggagagcctgttcgaggccgacctgcggaagaagctagtccccttctacaaggccaatacgatctccgagcagcaggagcaggagattatcttcaaggacctgttcccggtcctgatcgagcagttaaagaagcaggagttcattaagatcgtgcgcctggataagaagatcgaggccttcctgaagggcgaaaacgaagagggccagatcttctgcaactaccccgagaaattcaaaaagctctaccacccgagcgacatcgaagtgtttaagaagaaaatcatcaaggacgagtgggggaacgagaaagtcgtgctgggcagccccctcaccaccagcattaaaaacccgatggcgatgcgggcgctccaccagctgcgcaaggtgctgaacaccctcatcctggatggccagatcgacgagaagacgcggatccacatcgagatggcgcgcgagctgaacgacgccaacaagcggaaggggatccaggatttccagaaggagcgcgaggagctctacaagatctacgaggccaagatcaaagaactgtaccaggtcaaaacagggaaagagctgctccacgtgaccgatgaggacctccaaaagttcgagtgggcactggagcagaccaaggacgggcggattatcacgaaggaggagctcataaagtacaagatctgggaggagcagaaccacatctgtatctacaccggcaagacgatatccatcgacagcttcctcgggggcaaccccaagttcgacatcgagcatactatcccccgctccatcagccaggacaactccctgatgaacaaaaccctgtgtgacaaggacttcaaccgttccgtgaagggcaagaagatgcccgtcgagctgtcgaactacaacgagatactgccgcgcattgctcactggaagaagcaggccgaggagctgacgcggcagatagagaccataagcaggtctatcaagtccgccgcaacaaaggtggctaaggacaagaacatacggaagcgccactacctaaccctgaagcgcgactacatccaggggaaatacgacaggttcacgtggggcgagcccaaggtgggtttcaagaactcccaaatcccggacaccggcatcatcaccaagtatgcccaggcctacctcaagagttactttaagcgagtcgagagtgtaaagggcggggccgtggccgagttcagaaaactgtggggaatccaggagtccttcatcgacgagaacgggttcaagcacttcaaggagaaggaccgcagcaagcacacccaccatacgatcgacgcaatcaccatcgcctgcatgcccaaagacaagtacgacctgctcgcccacgcctggcgactggaggacgagcagaacaagaaggcggccaaggccctgatcgagcaggccaaaccgtggaagaccttcaaggaggacatcgagaagattgaggctgagatcctcgtcagtcacttcacccccgacaacgtgaagaagcaggcaaagaagatcctgcgcgtgcggggcaagaagcagtacgtcgccgagatcgagcgcaacgccaacgggaaggccatccccaagaaggacgcctctggcaagatcatctacaagctgaacgagcggggcaacaagatcccgattctccagcagggggacacgatccgcggttcactgcaccaggattctatctacggggccataaagaaccccctgaacaccaacgagatccggtacgtgatacgcaaggacctcgaatccctgaaagccaacgacatcgagaacatcgtggacgagaacgtcaaggccaaggtgaaagaggccgttgccaacaagattctgttgatcagcagtaacccccagcaaaagaacaagttcgcggagggcaagaacgtttggatgaacgaggagaagaagattcccatcaacaaggtgcggatctacgccaacagcgtgaagaatcctatcgagattaaaaagcactccaccctgagtaagagtaagcatgagcacaagcagacagtctacgggcagaacgatgagaactatgccatggccctgtacgagctcgacggtaagcgcgagttcgagctcatcaacaactttaacttggcgaagctcctgaagcagggccaagggtactaccccctgcacaaggagaaggagataaagggcaagaaggtgctcataccgatcgagaagcggaacaaccgcgacgtggtcctgaagcggggccaacaggtcgtgttctacgataagacggtggagaacagcaaagacatctccgagatcgtcgacttccgcggccgggtgtacttaatagaggggctcaccatccagagacaaaaagacaagaagaccggcaaggttaatgagtacggcatcatccagctgaggtacttcaaggaagcccgcaagagcgaggagatctccaaggacagcttcaagcccgacggggagttcaagatcaacgagaacaagccaacccggaaaatgaaccacaaccaattcacggccttcgtggagggcatcgacttcaaggtgctgccctccgggaaattccagaagatctga

SEQ ID NO: 8046 - RNA, 4464 nt, synthetic construct
  misc_feature 1..4464: note = Cas9 variant
  source 1..4464: mol_type = other RNA
atgaagaacgtgctgggcctcgacctggggagcaactccgtcggctgggccctggtgaagaccgaggacaacgggaaccccatcggcagcatcaagatggggtcccgcataattccgatgagccaggacatcctcggctccttcgagaagggcgacaccgtgagccagacggcccagcggaccctgtaccgcgggaagcggcgcctgatcgagcggcacgtcctgcgccgggagcgcctgtgccgggtgctgcacatcatgaacttcctccccgaccacttcgacaagctgctgggctgggacaaaaccgacaacaagacctacgggaagttcatcgacgactccgagcccaaactcgcctggcgccagaacaagaacgagaaggagaagatggagttcgtgttcatggacagcttccacgagatgctgtctgacttcgccaaacaccagccccagctgatcgccaacggtaagaaggtcccgctcgactggacgatctactacctgcggaagaaggccctgacccagctcatcagcaaggaggagctggcctggatcctgctcaacttcaacaagaagcgcgggtactaccagctgcggggcgaggaggaagaggagcagcccaccaagaaggaggagtacaaggtgctgaaagtgatctccgtcgacgcggacgagggccagaagggaaacggcatctggtacaacatccacctcgaggacgggggcatctacaagcgcaagagcgacacgcccctgtacgactgggtgggcaagaccctgcagttaatcgtggtcaccatctacgaaaaggacgggaagacccccaagatcttcgactccggcaagcagaacccgagctaccgtctgcccaaggaggacgactgggggctgatcaagaagcgcaccgagtctcagatccagagctccggcaagacggtgggggccttcatctacgacaacatcctctcaaagcccgacgacaagatccgggggaacctggtgcgcacaatcgaacggaagtactacaagaaggaactgatcgagatcctccagcagcaggccaagtaccacgacgagctgcacaaccagaacctgctcgagtcctgcgccaaggagctgtacgcgcacaacgacgtccgctacaacgaggtggtcaagagcaacatgatccacctcctggtggacgacatcatcttctaccagcggcctctcaagagcaagaagtcgctgatcgccaactgcaagtacgagagctacgagtacgtggacaaggagaccggcgaggtgaaggagatgccgatcaagtgcatagccaagtccaacccctactaccaggagttccgcctgtggcagttcatccataacctgcgcctgagcgacgtcgtcacccgggaggacgtgacggcgcagtacctctccacgccacaggactactgcaacctgtttacctatctgaacgaccgtaaagagatcaagcaagacatcctcctgaaggacttcttcaagatcaagaaggtacagatcgacaaggagaaggtgttccccatcgagtggaactacatcaaggacgccaccaaaacctacccatgcaacgagaccagatacgaactgctgtccgcgctcaagcgcgccgggatggacaagcagtggctggacgacacacccaacatgcagtaccggctgtggcacctcctgtacagcgtcgaggagcaggaggagagcgccaaggccctgcgcaagctctacgataatgacaacttcgtgtccagcttcctgaagatcaagcccttcaagaagtgctacggcgcctactccgagaaggcgatcaagcggctgctcaccctgatgcgcatggggaaggcctgggacgagcaagcaatcgacgccaagacgctgaagtgcatccagcagatcatcaccggaaacatcgacagcaagctcaaggagaagatcgacgactcccggtacgtcctgcatcacgtcagcgacttccaggggctgcccacctacctcgcctcctacgtgatctacggccgccacagcgaggtgaccgacatccggtgctgggacacgccgaaggacctgctgaagttcatctgtggcttcccccagcactccctccgcaaccccatcgtcgagcaggtcatcctcgagaccctgcgggtggtgtacgacatctggaaggcggagaagcatatcgacgagatccacgtggaggtggcccgcgagatgaagctcaccgcgcagcagcggaacgaggcaaacctgcgcaacctgaacaacgaggccaccaatctccggatcaagtacctgctggaggagctcaagaacgacacgttcatcaaggacgtccgccccctgagcccgatgcaccaggaaaagatgagaatctacgagcaggcggtgctggggaacctcaacaagcaggataaggactacgacgacatcatcaagatctccaagaaggagcgccccaccagcgctgagctgatccgctacaagctgtggctcgagcagaagtactgcagcccctacaccggcaaggccatctccctgagcaagctgttcaccacggcctaccagatcgagcacgtgatcccccagtcccggtacttcgacaacagcttcaacaacaaggtcatctgcgagtctgaggtgaacaaggagaaggacaagatgctcgggtacgagttcatcaagggccgcgggggcgaccgtatctactgcaccgcgcacggcaaagaggtgaccatcctgaaggaggaggagtacaagcagttcgtcaacgagcactacgcccacaacaagcgcaagcgggacaacctgctcgccgagaacatcccggagagcttctccagccgccagctgaacgacacccggtacatcaccaagacgatcatgtccctgctcagcaacgtggtgcgccagcagggggaggaggaggccaccgccaagaacctgctgccctccagcggcgccgtaaccgacaagctcaagaacgactgggggctgaaggacgtgtggaacaccatcgtgacgccccggtttgagcgcctgaacaagctctccggcaccaacgatttcggcgagatgaaggaggagaacgggaatagatatttccagaccaacgtcccgagcgagtacgagaagggcttcaagaagaagcgcatcgaccaccggcaccacgccatggacgccctggtgatcgcctgcaccacgcgcaacatggtgaactacatctccaacgtcaacgccaacagccccaagcagcgggaggacctgcgccagctcctgtgcgacaagaaccggatcatcaacaagccctggaacaccttcacccaggacgcgctgaaggccctcaacgacatcgtggtgtccttcaagaacaacgtccggatcatcaaccgggccaccaaccgctaccagcggtacgacaagaacgggaagaagatgatctgcagccagaagggcaacgacatgtgggcaatccgcaagagcatgcacaaggagactgtgttcgggcgcgtgaacctgatccggaaggaggccctgcccatcgcgaaggccctcgacaacatctccgccatctgcaacgcccagttacgcgcgtacgtcaacgacctggtggacaagcacttcaacaagaagcagctcgtggcccacttcaagagcttagactacaagtggaaccggcaggacgtctccaaggtggaggtgtggatctcttccgacgacaagacaccaatggtcgctgtgcgaaagcccctggacaccagcttcgacaagaagaagatcgcctccatcaccgacacgggcatccaggccatcctcctgaactacctggagagcaaaggtggggacgccctcgtggccttcgcccccgagggcatccaggagatgaactccaatatcgagctgtataacaacgggaaggcccacaagcccattaagaacgtccggctgagcgagaccctcggcgccaagtaccaggtgggggagcgcggcgcgaagaccaagaagtacgtggtcgccgataaaggcaccaatctgttcttcgcgatctatgaggacgaggaggggaagcggtactactactccgtgccgctgcgcgaggccatcgagcggcaaaagcagaagctcagccccgtgcccgagtacaacgagaagggcgtcgccctgaagttctacctgtcccccaacgacctcgtgtacgtgccgacggaggaggagcgcaccatggggacctgccacatagacaagaccagaatctacaagatggtaagctccagcgagaaccgctgctgcttcgtgccctccacgatcgcgaaggtcatcgccgacaaggtggagctgttgtcacacaacaagatcgagaaggccatcaccggcgagtccatcaaggaggtgtgctggaagctcaaggtcgaccgactgggcaacatcctgaacgtgatcaagtga

SEQ ID NO: 8047 - RNA, 4464 nt, synthetic construct
  misc_feature 1..4464: note = Cas9 variant
  source 1..4464: mol_type = other RNA
atgaagaacgtcctgggcctcgacctggggagcaattccgtcggttgggccctggtgaagaccgaggacaacgggaaccccatcggcagcatcaaaatggggtcccgcatcattccgatgagccaggacattctaggctccttcgagaagggcgacaccgtgagccagacagcccagcggaccctgtaccgcggtaaacggcgcctaaccgagcggcatgtcctccgccgggagcgactgtgccgggtgctgcacatcatgaacttcctccccgaccactttgacaagctgctgggctgggacaaaaccgacaacaagacgtacgggaagttcatcgacgactctgagcccaagctcgcgtggcgccagaacaagaacgagaaggagaagatggagttcgtgttcatggacagctttcacgagatgctgtccgatttcgcaaagcaccagccccagcttatcgccaacggcaagaaggtcccactcgactggaccatatactacttgaggaagaaggccctgacccagttgatcagcaaggaggagctggcctggatcctgcttaacttcaacaagaagcgggggtattaccagctgcggggcgaggaggaggaggagcagcccaccaagaaggaggagtacaaggtactgaaggtgatctccgtcgacgcggacgagggccagaaaggtaacggcatctggtacaacatccacctcgaggacggcggcatctacaagcgcaagagcgacatccccctgtacgactgggtgggcaagacgctgcagctcatcgttgtcaccatctacgagaaggacgggaagacccccaagatcttcgactccggcaagcagaatcctagctaccggctgcccaaggaggacgactgggggctgatcaagaaacgcaccgagtcccagatccaaagctccggcaagacggtgggggccttcatatacgacaacatattgagcaagcccgccgacaagatccggggcaacctggttcgcaccatcgagcggaagtactacaagaaggagctgatcgagatcttacagcagcaggccaagtaccacgacgagctgcacaaccagcacctcctggaatcctgcgcgaaggagctgtacgcccacaacgacgttcgctacaacgaggtggtcaagtcaaacatgatccacctcctggttgacgacatcatcttctaccagcggcccctcaaaagcaagaagtccctgatcgataactgcaaatacgagagctacgagtacgtggacaaggagacaggcgaggtgaaggagatgccgatcaagtgcatcgccaagtccaacccctactatcaggagttccgcctgtggcagttcatccacaacttacgcctaagcgacgtcgtgacccgagaagatgtgacggcccagtacctctccacgccccaggactactgcaacctattcacctacctgaacgaccgcaaggagatcaagcaggacatcctactgaaggacttcttccagatcaagaaggtccaaattgacaaggagaaggtgttccccatcgagtggaactacatcaaggacgccaccaagacctacccgtgcaacgagaccaagtacgagctgctgtcggcgctcaagcgggccgggatggacaagcagtggctggacgacacccccaacatgcagtaccgcctgtggcacctcctgtattccgtcgaggagaaggaggagtctgccaaggccctgcggaaactttatgacgacgataacttcgtttcctccttcctgaagatcaaacccttcgagaagtgctacggcgcctactccgagaaggcgatcaagcgcttactcaccctgatgcggatgggcaaggcatgggacgagcaggccattgacgccaagacgctgaagtgcatccagcagatcatcaccggcaacatcgacagcaagctcaaagagaagatcgacgactcccgctacgtgctgcaccacgtcagcgacttccaggggctgcccacctacctcgcctcctacgtgatctacggccggcacagcgaggtgaccgacatcagatgctgggacacgccgaaggacctcctgaagttcatctgtggcttcccgcagcactccctccggaaccccatcgtcgagcaagtcatcctggaaaccctgcgcgtggtgtacgacatctggaaggcggagaagcacatcgacgagatccacgtggaggtggcccgggagatgaagctcaccgcacagcagcgcaacgaggccaacctgcggaacctgaacaacgaggccaccaacctccgcatcaagtacctgctggaggagctcaagaacgacacgttcatcaaggacgtccgccccctgagcccgatgcaccaggagaagatgcgaatctacgagcaggcggtgctggggaatctcaacaagcaggacaaggactacgacgacatcatcaagatctccaagaaggagcggcctaccagcgccgagcttatcaggtacaagctgtggctcgagcagaagtactgcagcccgtacaccggcaaggccatctccctgagcaagctgttcaccacggcctaccagatcgagcacgtgatcccacagtccaggtactttgacaacagcttcaacaacaaggtcatctgcgagtccgaggtaaacaaggagaaggacaagatgctcggttacgagttcattaagggcagagggggcgaccggatctattgcaccgcgcacggcaaggaagtgacgatcctgaaggaggaggagtacaaacagttcgtcaacgagcactacgcccacaacaagcggaagcgcgacaacctgctcgccgagaacatcccggagagcttttccagccggcagctgaacgacacccgctacatcaccaagacgatcatgtccctcttgagcaacgtggtgcggcagcagggggaggaggaggctaccgccaagaatctgctgccctcctcgggcgcggtgacggataagctcaagaacgattgggggctcaaggacgtgtggaacaccatcgtgacgccccgcttcgagcggctgaacaagctctccggcaccaatgacttcggcgagatgaaggaagagaacgggaaccgctacttccagaccaacgtcccgagcgagtacgaaaagggcttcaagaagaagcggatagaccaccgccaccacgccatggatgccctggtgatcgcctgcaccacgcggaacatggtaaactacatctccaacgtaaacgccaacagccccaaacagcgcgaggacctgcggcagctcttatgcgacaagaaccgaatcatcaacaagccctggaacaccttcacccaggacgcgcttaaggccctaaacgacatcgtggtgtctttcaagaacaacgtccgtatcatcaaccgcgccaccaaccggtaccagcgctatgacaagaatgggaagaagatgatctgcagccagaaaggcaacgacatgtgggccatccgcaagagcatgcacaaggagacggtgttcgggcgggtgaaccttatccgcaaggaggccctgcctatagcgaaggccctcgacaacatctccgccatctgcaacgcccagctgcgggcgtacgtcaacgacctggtggacaagcacttcaataagaagcagctcgtggcccatttcaagagcctggactacaagtggaaccgccaggacgtctccaaggtggaagtgtggatcagctccgacgacaagaccccgatggtcgccgtgcggaagcccctggacaccagcttcgacaagaagaagatcgcctccatcaccgacacgggcatccaggccatcctcctgaactatttagagtccaagggcggggacgcgctagtggccttcgcccccgagggcatccaagagatgaactctaacattgagctgtacaacaacgggaaagcccataaacccatcaagaacgtccgcttaagtgagaccctcggcgccaagtaccaggtgggggagcggggcgcaaagaccaagaagtatgtggtcgccgacaagggcaccaacctattcttcgcgatctacgaggacgaggaggggaagcgctactactactccgtgccgctgcgggaggccatcgagcgccagaagcagaagctcagccccgtgcccgagtacaacgagaagggcgtcgccctgaagttctacctgtcccccaacgacctcgtgtacgtgccgaccgaagaggagcggaccatgggcacttgccacatagacaagacccgcatatacaagatggtcagctccagcgagaaccggtgctgctttgttccttccacgatcgcgaaggtcatcgccgacaaggtggagctgctgagccacaacaagatcgagaaggccatcactggcgagtcaatcaaggaggtgtgttggaaactcaaggtcgaccgcctggggaacatcctgaacgtcatcaagtga

SEQ ID NO: 8048 - RNA, 4464 nt, synthetic construct
  misc_feature 1..4464: note = Cas9 variant
  source 1..4464: mol_type = other RNA
atgaagaacatcctgggcctagacctggggagcaactccgtgggctgggccctggtcaaggtggaggagaacgggaaccccatcggcagcatcaagatggggtcccgcatcatcccgatgagccaggacatcctcggctccttcgagaagggcgacaccgtgagccagaccgcccagcggacgctgtaccgcgggaagcggcgcctgatcgagcggcacgttctccgccgggagcgcctgtgccgggtgctgcacatcatgaacttcctccccgcgcacttcgaccgcctgctgggctgggacaagaccgacaacaagacctacgggaagttcatagacgactccgagcccaagctcgcctggcggcagaacaagaacgagatgggcaagatggagttcgtgttcatggacagcttccacgagatgctgtccgacttcgccaagcaccagccccaattgatcgccaacgggaagaaggtcccgctcgactggaccatctactacctgcggaagaaggccctgacgcagctcatcagcaaggaggagctggcgtggatcctgctcaacttcaacaagaagcggggctactaccagttacgcggcgaggaggaggaggagcagcccaccaagaaggaggagtacaaggtgctgaaggtgatttccgtcgacgccgacgaggggcagaagggcaacgggatctggtacaacatccacctcgaggacggcggcatctacaagaagaagtccgacatccccctgtacgactgggtggggaagaccctgcagctcatagtggtcaccacgtacgagaaagacggcaagacccccaagatcttcgacagcgggaagcagaacccgagctaccggctgcccaaggaggacgactggggcctggtgaagaagcgcaccgagtcccagctccagagctccgggaagaccgtgggagccttcatctacgacaacatcctgagcaagcccgacgacaagatccggggcaacctggtccgcacgatcgagcggaagtactacaagaaggagctcatcgagatcctgcagcagcaggccaagtaccacgacgagctgcacaaccagaacctcctggagtcatgcgcgaaggagctgtacgcccacaacgacgtgcactacaacgaggtgataaagagcaacatgatcaacctcctggtcaacgacatcatcttctaccagcgccccctcaagagcaagaaatccttaatcgccaattgcaagtacgagagctacgagtacgtggacaaggagaccggggagataaaggagatgcccatcaagtgtatcgccaagtccaacccctactaccaggagttccggctgtggcagttcatccacaacctgcgcctcagcgacgtggtcacccgcgaggatgtgaccgcccagtacctgtccacgccccaggactactgcaacctgttcacctacctcaacgaccggaaggagatcaagcaagacatcctcctgaaggactttttcaagatcaagaaggtgcagatcgacaaggagaaggtcttcccgatcgagtggaactacatcaaagacgcgaccaagagctatccgtgcaacgagaccaggtacgagttactctccgccctgaagcgagccggcatggacaagcaatggctggacgacacgcccaacatgcagtaccgcctctggcacctcctgtacagcgtggaggagaaggaggagtccgccaaggccctgcggaagctgtacgacgacgacaagttcgtcaccagctttctgaagatcaagcccttcaacaagtgctacggcgcttactccgagaaggccatcaagcgcctcctgaccctgatgcggatgggcaaggcctggaacgagcaggccatcgacgccaagaccctcaaatgcatccagcagatcatcacggacaacgtggacagcaagttgaaggagaagatcgacgactcccgctacgtgctgcaccacgtctccgacttccaggggctccccacctacctggcgtcctacgtgatctacggccggcacagcgaggtgaccgatatccagtgctgggactccccagaggacctgctcaagttcatccgcgacttcaagcagcacagcctgcggaaccccatcgtcgagcaggtcatcctggagaccctccgcgtggtgtacgacatctggaaggccgagaagcacatcgacgagatccatgtggaagtggcccgggagatgaaactgacggcccagcagcgcaacgaggccaacctgcggaacctcaacaacgaggcgaccaacctgcgcatcaagtacttgctcgaggagctgaagaacgacaccttcatcaaggacgtccggcccctgtcccccatccaccaggagaagatgcgcatctacgagcaggccgtgctcggcaacctgaacaagcaggacaaggactacgacgacatcatcaagatcagcaagaaagagcatccgaccaacgccgagctgatcaggtacaagctgtggctggagcagcgctattgcagcccctacacggggaaggccatctccctgagcaagttattcaccaccgcgtacgagatcgagcacatcatccctcagtcccgctacttcgacaacagcttcaacaacaaggtgatctgcgaggccgaggtcaacaaggccaagggcaacatgctcgggtacgagttcatcaagaagcagggcgggcagaagatctactgcacccagctgggcaaagccgtgacgatcctcaaggaggaggcctacaagcagttcgtgaacgagcactacgcgcacaacaagcggaagcgcgacaacttgctggccgagaacatccccgagtccttctcgtcccgccaactcaacgacacccgctacatcaccaagaccatcatgagcctgctgtccaacgtcgtacggcagcagagcgaggaggaggccaccgccaagaacctcctgccgtccagcggctccgtgacggaccgcctgaagaacgactgggggctcaaagacgtctggaacaccatcgtgacgccccggtttgagcgcctgaacaagctgtctggtaccaacgatttcggggagatgaaggaggagaacggcaaccggtacttccagaccaacgtgcccctcgagtacgagaagggcttcaagaaaaagcgcatcgaccaccggcaccacgctatggacgcgctggtcatcgcctgcaccacccgcaacatggtgaactacatctccaacgccaacgcaaacagcccgaagcagcgggaggacctgcgccagctcctgtgcgacaagaaccggatcatcaacaagccctgggacacgttcacgcaggacgccctgaaggcgctcaacgacatcgtggtctctttcaagaataacgtgcgcatcatcaaccgggccaccaatcgctaccagcggtacgacaagaacgggaagaagatcatcttcagccagaagggcgacgacatgtgggccatccgcaagagcatgcacaaggagaccgtgttcggacgggtcaacctgatccgcaaggaggtgctgcccatcgccaaggcgctagacaacatctccgccatctgcaacgcccagctgcgcgcctacgtgaacgacctggtcgacaagcacttcaacaagaagcagctcgtggcccacttcaagagcctgaactacaagtggaaccggcaggacgtgtccaaggtggaggtgtggatcagctccgacaacaagacccccatggtggcggtccgcaagccgctggacacgagcttcgacaagaagaagatcgcctccatcaccgacaccggcatccagaccatcctcctgaactacctggagagcaagggcggagacgcctccgtggccttcgcccccgagggcatccaggagatgaacagcaacatcgagctctacaacaacgggaaggcgcacaagccaatcaaaaacgtgcggctgtccgagcccctgggcgccaagtaccaggtcggggagcgcggcgccaagacgaagaagtacgtggaggccgacaaggggaccaacctcttcttcgccatttacgaggacgaggagggcaagcggtactactactcagtgccgctgcgcgaggcgatcgagcggcagaagcagaagctgtcccccgtccccgagtacaacgagaagggggtggccctcaagttttacttgtcccccaacgatctggtgtacgtcccgaccgaggaggagcgcaccatggggacgtgccacatcgacaaggcccggatctacaagatggtgtccagcaccggctgctcctgctacttcgtgcccagcaccttcgccaaggtcatcgttgacaaggtcgagctccagtccctgaacaagatggagaaggcaatcaccgacgagtgcatcaaggaggtgtgctggaagctgaaggtggaccgccttgggaacatcatcaacgtcatcaagtga

SEQ ID NO: 8049 - RNA, 4485 nt, synthetic construct
  misc_feature 1..4485: note = Cas9 variant
  source 1..4485: mol_type = other RNA
atgaagaatatcctgggcctcgacctggggaccaacagcataggctgggccctgatcgacaacgagagccaccgcatcatcaagagcgggtcccggatcattcccatggacgccgcgaccatgggcgactacgagaaggggaatctcaaaagcgcagactggaagcgcacgtcctttcgcggcatgcgccggctatacgagcgcgccaagctacggcgcgagcggttgttacgcgtgctgaacatcctcggctttctgccggaggagttccgccgccagatcgacttcgagcaccaccccgggcagttcatcgacggcaaggagcccctgatcgcctaccaccacgacgagaacgggcagcgtgtcttcagctacatgtccgccttcgaggaaatgctcaccgacttccgcgcgacccagtcagagctggtgcgagacggccgccgcgtgccgtacgactggaccatctactatctgcgccacaaagccctcacgcaaccggtcaccaaggaggagctggcctggatcatcctgaacttcaacaccaagcgggggtactaccagctccgatccgagagcgaggaagtgaccacgaacaagaacgaagagtacgccgagctgaaggtggtctccgtggagaagaccggcgaggacaagaagcgggcgggctactactggtacaccatcacctacgacaacgaggccgagcagaaaatcacgagcaccatcccgccccgccaaatcggggacaaggtggagctgatcgttaccactgcccgcgacaaggccggcgagataaagaagtctgtgcggagccccaaggaggacgactggacgctcatgaagaaacgcaccgagcacaacatcgaggaagaggagtgcaccgtggggtcctacatctaccagcacatcctcgccgacccaaccgtcaaagtgcggggcaagctggtgcacacgattgagcgcaagttctacaagaaggagttgaagcagattctgaacaagcagaaggagttcatccccgagctgcaggacgcgagtctctacgaggcttgcatcaaggaactttacagaaacaacgaggcccatatccaatccattgccaacaaggacttcaccgacctcttcgtcaacgacataatcttttatcagcgccccctcaaaagcaagaagtccaccattagcaactgcccctacgagagctactactacaagaacaaggaaaccggcgagctgatccggaaaccgatcaagtgcatcgccaagtccaaccccctgtaccaggagtttcgcctctggcagttcgtgcacaacctgcggatctacaagaagtccgaggaagttagcgggcgcctgcagacggacgtagatgtgaccgaccggtttcttacaacccccgacgactacgcgaaactgttcagctggctgaacgaccgcaaggagataaagcagaaggagctcctgcggtacgaggccttcggcctgtccaagagctacggggactaccgctggaacttcgtggaagacaagccctacccgtgcaacgaaacgctccacgagatcaaccggcgcatgaagtccatcctgagcgataagaagctgtccagcgaggcctaccagcagctctggcacatcctgtattccatcgacgaccccatcgagatccggaaggccctgaccagctttgcccagaaccaggaaatcaactccgacgacttcgtcaacgcgttctaccagtacgtgcccgagaagaccaagagctacggcgcctactccgagaaggccatcaagaagctcctgcccctcatgcgccgggggtcctactgggccatcggcaacatcgacgagaagacccaccgccgcctggacaatatcatcaacggcgtggccgacgacagcatcagcacgtgtacacgggagaagctcaacaacctgaccgacatcaccatgtgccagggcatgccgctgtggcaggcgtgctacgccgtctacgaccgccactccgaggccgccgacacaaccaagtgggagcagccagatgacatcgacacctacctcagcaccgagctgaagcagcacagcctgcgaaaccccatcgtggagaccgtcatctccgagacgctccgcgttgtgcgggacatctggaaggcgtacggccgccccgaggaaatccatgtcgagctggggcggaacctgaagcaggacgccaagagccgaaagcaggatgccatccgcatggccgaaaacgagcagaccaacctccgcatccgggccctgctgcaggagctctccaacccggagtgcggcgtggagaacgtacgtccccacagcccctcccagatggagctgctgaagatctacgagaacgaggtcctccagagcaccgacgacatccccgaggagatctccaacatcataaaggacctggggaaaaccgacagcaagaagcgaccgtccctgagcgacatcacaaagtaccgcctctggctggagcagaagtaccagtccccttacaccggccacatcatccccctgagcaagctgttcaccccggcgtaccagatcgagcacgtgataccccagtcccggtacttcgacgacagcatctccaacaaggtgatctgcgaggccgaggtcaacaaggagaaggaccgcatgctgggctacgagttcatcatcaataagggcgggagcatcgtgaaggggtcattcggccagcagttcaagatcttcgacaaggtgcagtacgaggacttcgtcaagcagcggtacgcccacaacaagaccaaaatgaaaaagctgctcatggacgacatccccgacgggttcatccagaggcagctgaacgacagccggtacatgagcaagaagataatctccatcctgagcaacatcgtgagggaggacggcgaaaaggaggccacgtccaagcacatcatcgtgaccagcggagccatcaccgaccggctcaagaaggagtgggggatcaaggacgtctggaacgacatcatcgcgccccgcttcaagcgcctgaacaagctgaccgactccaacaactacggcatggagacggagaaggaggggcggcagtacttccagatcaacgtgccgaccgagttgagcaccggcctgatcaagaagcgcatcgaccaccggcaccacgccatggacgccatcatcatcgcgtgcaccacccgcaaccacgtgaatttcctgaacaactccaccgccgcgagcgaccagaaggacatccggcgcgacctccaacacacgctgtgcactaagacgaagaccgactccaacggcaactacgtctggcggttcaataagccctgggacaccttcacccaggacacgcgccaggaactggaggggatcatcgtgagctttaagcagaacctcagaatcatcaataaaatgtccaactactaccagcactacgtggacggccggaagaccataagccggcagaacaagggggatggctgggccatccgcaagtccctgcacaaggccaccgtcagcgggaaggtgaacctgaagaggtccaagaccgtgggcttcaaggaggccctcaatgactggtccgcgatcaaggacaaaacgtccaaggccatcctgcagaagataatcgcccagtacaagaactacgaccccaagaccattttcaagtacttcaaggatcgcaactttaaggtcgagggcaaagacttcagcaagctggaggtgtactacaacacctcggacaaggagcccatgagcgcacaccgtgtgaatatcgacaccacgttcgacgagaaggagatccgcagcatcaccgacaccggcatccagaagattatgctaaagcacctccacacttacgacgacgcccagggcaagacgcacccggaggcggccttctcccccgagggtatcgagaagatgaatcagaacatccgaatgctaaacggcgggaaggatcataagcccatcttcaaggtacgcaaggcagagatcctcggcatgaagtttgccgtgggcgagcgggggcacaaggacaagaagtgggtggaggccgacaagggcaccaatctgttcttcgcgatctacgagagcgaggagaacaagcgctcatacagctccatacccctgaacgaggccatcgaccgcctcaagcgcggggaaaacatcgccgacgagcgggaccaaaacggcaacaagctactgttcgtcctctcaccgatggacctggtgtacgtgcccgaccccgacgacgcccatatcgacgaggtcaaagggaacaacaacatctttaagatggtgagctgtaccggtaccgagtgctacttcgtgcccgagacctacgccaacgtcatctgcaagggcaaggagctggagagcaagaacaaggtggagtcctacgacgggatcaacatcaagaaatcctgctataagatcacggtggaccggctcggcaaggtccgcaagatcttcaaggggtga

SEQ ID NO: 8050 - RNA, 4491 nt, synthetic construct
  misc_feature 1..4491: note = Cas9 variant
  source 1..4491: mol_type = other RNA
atgaagaccatactgggcctcgacctggggaccaacagcatcggctgggccaaggtgtgcgtcgacgacaacgggaactacctgcgagacatcaagctcggctcccggatcatcccgatgagccaggacgtgctggggaactttgacaagggcgttacggaatcccagaccagcgtccgcaccggcttccgcggggtgcggcggatccgcgagcggtccctgctacgccgggagcgcctgcaccgggtgctgcacgtcctcggctacctgccgccccactacgacagtgccatagggtggaacaagaacgagccctccacctacggtaagttcctgaatcacggcgagcccaagctcgcgtgggagcataaggaggacggctccatgagattcctgttcatggagtccttccacgagatgatggccgacttcgccaagagccagccgtccctggtgtcagatggcaagaagatccccctcgactggacgatctactacctacggaaaaaggccctgtcccagcccatccgcaaggaggagctggcctggctgctgctcaacttcaaccagaagcgggggtactaccagctgcgcggcgaggaggacgacgacaaccccaccaagtgcgaggagtactacgagctcaaggtggtcgggatcgaggcggacgaggagggaaagaacggcaacacctggtacaacgtgaagctggagaatgggtggatttaccggaggcagagcaagatcccgctggacgactggatcggcaaggtgcgggagttcatagtcaccacggagtacgagaaggacgggatcacgttgaagaaggacaagaacggcgacgtgaagcgctctttccggagcccctccgaggacgactggggactccgcaagaagcgcactgagaagctgctggacagctccaagatgaccgtgggcgccttcgtctacgaccacctcctggccgagcccagcgacaagatccggggcaagttcatccgcacgatcgagcggaagtactacaagaaagagctgtacgccatcctctgcgagcagagcaagtaccacgaggagctgcgctccggggactacctgaacaagtgcgcggaggagctctataagaacaaccagccccaccggaacagcctgctgaccaaggacctggcctacctgctgctcgaggacctgatcttctaccagcgccccctgaagaccaagaagtccctcatcgctgagtgtccctacgaggcctacaagtacgttgacaaggagaccggcgaaatcaaacggcagggcatcaagtgcatcgccaagagcaatccctattaccaggagttccgtctgtggcagtttatctccaacctgcgcctcttcaacaaggcggacgacaaggaggtgacggccgactacctgcccacccaggacgactacgtccggctgttcgcgtacctgaacgaccggaaggagatcaaccaggagaccctcctgaaggagttctttaagctgaagaagatcaccgtgaacagcgagaaggtgttcccgatccgctggaactacatcgaagacaaggagaagaagtacccctgcaacgagacgcggcacgagttgctgctggccctcgaccgcgcccggatcgaccactcctggctggagaagcccggccaggaatatcgcctgtggcaccttctgtacagcgtagagtccaaggaggagaccaaggaggcgctgcggaagctcaaggacgacgacgccttcgtggagagcttcctgaaggttaagcccttcaagcgcgagtacggggcctactccgaaaaagccataaagaagttactcgccgtaatgcggatgggcagcctgtggcgcgagacggacatatgcgacaccacgaagggcaacataaccaagatcctgcaaggggagatcgacgagaagctcaaggagaagatcagcgcgagcgtgtccagctataaccagctgtccgacttccaggggctgccggtctggttggcctgttacgtggtgtacgggcgccacagcgaggccgccgagatccagcactggaagacccccgagtccctgttggcctacatcaatggcttcaagcagcacagcctccggaatcccatcgtcgagcagtgcatcttagagaccctgagaacggtgcacgacatctggaaggaggttgggcacatagacgagatccacgtcgagctcggccggaacatgaagtcgaccgcggatcagcgcgcccggatcagcgagaacgtgctgcgcaacgagaacaccaaccttcggatcaagagcctcctgctggagctcaagaacgaccccaacataaaggacgtgaggccgtactcccctatgcagcaggagaagctacggatatacgaggagggcgtcttgcaggagctcaccaaggacgacaaggacttcacggagatcaccaagattagcaccatggcccagccctccgccaaggagctccagcgctataagctgtggctcgagcagaagtaccggagcccctacacgggcaagagcatcagccttacgaagctgttcacctccgcgtaccagatcgagcacgtgatcccgcagagccgctacttcgacgactccttctccaacaaggtgatctgcgagtccgaggtcaacagcctcaaggacaacatgctggggtacgagttcatcaagaaccacgggggcgaaatcatccactgcaccatgctgggcgacgtgaaggtgctctctgagagcgaatacaaggccttcgtgaacgaccactacgcccacaacaaacggaagcgcgagaacctgctgctcgaggacataccccaggagtttctaaaccggcagatgaacgactcccgctatatcagcaaggtcgtgaaggccctgctcagcaacatcgtccgggccgaaggcgaagaggaggcgacctccaagttcgtggtgagctgctcaggcgggatcaccgatcgccttaagaaagactgggggctgaacgacgtttggaacaagatcgtgtacccccggttcgagcgcctcaaccgactgacagggaccgaggccttcggccagtgggagaacaaggacggcaaacgcgttttccagaccgccgtcccgctggagctccagcgcgggttcaataagaagcggatcgaccaccggcaccacgccatggacgccctggtgatcgcgtgcaccagccggaacatcatcaactacctgaacaacgagtccgccaacaaccccaagaagcgcgaggaccttcggcagaaactgtgcgacaagaaccgcacgatccggaaaccgtgggaaaccttcacccaggacgccaccgccgccctggaggacgtgatagtcagcttcaagaactacgtgcgcatcatcaacaaggccacgaactactacgagcggtacgacgtggagggcaagaaggtcatcgccgagcaacgcggtgacgacatgtgggccatccggaagccaatgcacgaggccacctactacggacgcgtgaacctccggcgcaagaagaaggtgaacctgcgggtcgcgctggagaacatctctagcatctgcgacaacaagctccgcatttacatcaacgggctggtggagaagggcttcaacaccaagcagatcctggacaagtttaagaacacgaacgaccacttctccatgcagaagatcgataaggtggagatctggcagttcacgaacgaggaggagaagctcgtcgccacccggaagcctctggacacctccttcgacaccaagaagatcgcctccatcacggacaccggtatccagaccattctgctcaactacctggagaccaagggcggcgacagcacgattgccttcacccccgaggggatcgtggagatgaaccagaacatctccaagtacaacaacggtaaggagcacatgcccattctgaaagtacgcctctacaccaagttagggaagaagattcccgtcggccagaccggctgcaaggccaaacaattcgtaatcgcggaggccggcaccaatctgtacttcgccatctacgaggacgaggagggcaagcgtagctaccgcaccataccgcttaacgaagtggtcgaacgcctgaagcaggggctgtcccccgtgcccgagaagaacgacaaggacgttcacctcaaattttacctgagccccaatgacctggtctacgtgccgatcgaggacgagcacgagtccttggccaaggaccacatctataagtttgtggacagctccggcaccaccgccaacttcattcctcaccggagcgcgaacgtcatcttcgagctgaacaagaaggacgccgagaagttctgcagcgggtccatcatccagaacgagtacggcgtgggctcatcccagagcaagaaccagaaggccattacgggggagatgatcaaggccgtgtgccgcaagctggaggtcgaccggctcggcaacgtgatcaaggtcatttga

SEQ ID NO: 8051 - RNA, 4497 nt, synthetic construct
  misc_feature 1..4497: note = Cas9 variant
  source 1..4497: mol_type = other RNA
atgaagcacatcctgggcctcgacctggggaccaacagcatcggctgggccgtgatccgcgcccaccaggacgcggacgggcacaccacgctgcaggacatcctcgccgccggctcccggatcatccccatggacgccgccaccctgactgacttcgacaaggggaacgcgcgcagcggcaccgccgagcggacgtccttccgcagcatgcggcgccggcgcgagcggcagctgctgcgccgggagcgcctgcaccgggtcctgatgctcctggggttcctgccgcagcactacgccaactccctcaccaggtacggggagttcgccgacaaccgggagtgcaagctgccctgggtgaaggacgagagcgacggcaagtaccacttcctgttccaggacgcgttccacgagatgtgcgaggactttcgccagctcgcgccccagtgggtggccgacgggaagaaggtcccctacgactggaccctgtactacctgcggtgcaaggccctctcccgaaagatcagcaaggaggagctggcctggatcttactctccttcaaccaaaagcggggctactaccaggcccgcgacgaggaggacgaggtgaccacgaacaagctggaggagtactacgccgggaaggtggtccgggtggacgacaccggcgagcgcaaggggaagaacgtgtactacgacatcaccctggagaacgggtgggtctaccgctacgccgcccggatctacccggactgggtgggccaggtgaaggagttcatcgtcaccacgaccctcaaccccgacgggacccccaagaccgacaaggccggcgaggtgaaacgtagcttccggatgcccaaggacgacgactggacgctaatcaagaagaagaaggagcgcgacatcgaccggtcccaggagaccatcggccagtacatctaccacgcgctgctcaaggacccgagccagaagatccgcgggaagctgatcggcaccgtggagcggaagtactacaaggacgagctgcgccggatcctcgaccgccagatccagttccaccccgagctgagggaccgcgagctgtactacgcctgcctccaagagctgtacccctccaacgtcgccttccggaacaccctggtgaaccgcgacttcacgtacctcttcctggacgacatcctgttctaccagcggcccctcaagagcaaaaagagccagatcagcgactgcccgtacgaggagcacttctacaccgacaaggagaccggggagcgcatctccgtgcccgtcaagtgcatcgccgtgagccaccccctgtaccaggagtaccggctgtggcagttcatccagaatttgaggatctactgccgggaggcccgcattgacggcaacctcatgatcgactgggaggtgaccaacgagctgttgcagacggaggaggacaagaccgcgctgttcgactggctgaacgacaaggagtccgtcaagcagcccgagctcgtggccttcctgctcgggggcaaggccaacaagaagcagatcaaggcgtaccgctggaactacatggacgacgacaccaagggctacccgtgcaacgagacgcgggccagcctgctcaagtacctgcgcgaggcgcagacggacagctccttcctgacccgggagcgcgaggaggccttatggcacatcctgtacagcatctccgacaagggggagctcaagtctgcactgggcaagttcgccgtgaagcatgggctgaacgaacggttcgtcaccgtgttctccaagttcccgcccttcaagaaggactacggcagctactccgccaaggcactgaagaagctcctgcccctgatgcgcatggggcaccactggcaggaggccagcttcatcccctccacccggcagcgcatggagaagttcatcaacggcgagtacgacgacagcatcgacaagcggacgtacgagaagctcgagtccctgaccgaggtcagccagtaccgcggcctgccggggtggctggcctgctacgtggtgtacgaccggcactccgaaggccgcgacatcgagcggtggacctcgccctccgacatcgacagctacctggcccagttcaagcagcactcgctgcacaaccccatagtcgagcgcgtggtactcgagaccctgcggacggtccgcgacatctggaagcaggtcgaccacatcgacgagatccacattgagctggggcggaacatgaaactcccggcggacaagcgcaggcagatgaccgagcaggcctggaagaatgagcagaccaatctgcgcatcaaggccctgctcctggagttcgcccggcctggctacgacatcgagaacgtgcgcccctacagcccctaccagcaggaccagctgcgcatctacgaggaggccgtgctcggggcgaacgagtgcccggacgacatctccgccatcctgaagaagtttaacggcctgaacccgcccaccagcgccgaggtgctccggtataagtgctggctggagcagaagtaccgaagcccctacaccggccgtactatccccctgtcgaagctgttcaccagcgcctacgagatcgagcacatcatccccaagcagcgctacttcgacgactccttcagcaacaaggtgatctgcgagtccgaggtcaacaagaagaagggggccatgctgggctacgagttcatcaagagctaccacggggcgtccatcaccctgaaccggggcggcaccgccagcatcttctccgttgaagcctacgagaacttcgtgaaggagcactacgcccacaaccgcgggaagatgaagaagctcctgatggacgacgtccccgacagtttcatctcccggcagctgaacgacagccgctacatctccaagctcatgaagtccatcctgagcaacctggtgcgggaggagggcgagaaggaggcgatcagcaagaacctcatcgtgtgcaccgggggcatcaccgaccgcctgaagaaggactgggggatacacgacgtctggaatgacatcatcttcccgcggttcaagcgcctggacgagatggactccagccacacctacatcaccctcaacacacatcggcatcccatccccagcatgcccctggagttccagcgcggcttctccaagaagcggatcgaccaccgccaccacgccatggacgccatcgtgatcgcctgcgccacccggaacatcgtgaactaccttaacaacgagagcgcgcgccacgatgccaagacctcccggatggacctccagcgcctgctgtgcaccgccaaccgcaagctcatcgacaagccgtggaagacgttcacccaggacacgtgcaaggtactggaggacatgatcgtgagcttccagcgaaccctgcgcatcatcaacaagacgaagaactactacttgcggttcgaagacggcaagaagcgccgggtgttgcagaccaagggggataactgggccatccgcaagcccctgcacaaggagaccttctacggcgagatcaacctccggcgcatcgagaccctgtccctgaacaaggccctcgagcggatccccgacatcgtcgagcgcgacctgcggaaaaagctgagcgaactcctgtctctggggtacaacgccaagcgcatcaagggctacttcgaggagcacaaggaggagtggagcgacgtgaacctctccaagataaaggcctactacttcacgaagcagaagaacaagcggtacttcgccgctcgcaccgagctggacactagcttcaacaaagacaagatcgagaacaagatcgccgacaccgcgatccagaagatcctgctccagcacctggaggcctacgggaacgacgtagagcaagccttctcccccgagggcatcgacacgatgaaccggaacatccgccagctgaacggcgggcggagccaccagccaatctacaaggtcagggtgtacgaggaggccaccaagttcgcggtgggccggcgcgggaacaagtccaccaagttcgtcgaggccgccaagggcaccaacctcttcttcgccatctacgagattagccaggtggacggcaacggcaacagacagacgtccagaaccttcagctctatccccctgaatgtggccgtcgagcgcctgaagcagggcctcccacccgtgcccgaggacgaggaggggaacgcgcccaagtacgtgctcagccccaacgacctggtctacctaccgaccgagaaggagctgaagcggcgcgagatagccatgccgatcgacaagtcccggatctacaagatggtgagctgcaccggcaaggactgcttcttcatccccgccaacacggccgtgcccatcgtcgaccgctacgagtacagctccatgaacaagatcgggcgggccctgaccggcgagatgatcaaggagatctgcctccccctgaagatcgaccgccttgggcagattatcgagatcagcaccttctga

SEQ ID NO: 8052 - RNA, 4506 nt, synthetic construct
  misc_feature 1..4506: note = Cas9 variant
  source 1..4506: mol_type = other RNA
atgaagaaaatcctgggcctcgacctggggaccaacagcatcggctgggccgtgatcaacaaggccgagaacgaggggaaggacgtcctgtgcggcatcgaggcggccgggtcccgcatcatccctatggacgccaccatcatgggcgatttcgagaagggcaacagcgtgtcccagacgaaggaccggcgcgagcaccggagcacccgccggctctacgagcgcgggaagctgcggcgcgagcggctgaaccgcgtgctctccgtcatgggcttcctgccggaccactacgtgagccagctggaccggtacgggaagttcctctccaacaccgagcccaagctggcctgggtgcgcaacgccgactgcaagtaccacttcctgttcatggacagcttctccgagatgctccaggagttcaagaccaacagcccccagtacatctccgaggagagcaaagtcccctacgactggacgctttactacctgcggaagaaagcgctcacccacaaagtgaccaaggaggagctggcctggatcctgctcaatttcaaccagaagcgcggctacttccagctgcgggacgagtccgaggaggagaagaagccgagcaaaatccgccagtacttcgagcaccagaaggtggtcgacatcatagacaccaacgaggtgtacaaggggctgaaggtgctcatcgtcatcctggcgaacggcatctccggcaagatcttcaagaaagagatccccgactggatcggggtggagaaggacatcatcgtgaaggtcgacatcgacaaggacggcaaggacaagttcaacgaggacgggagcctgtcctgccggttcaacatccccacggaggccgagtgggacaccgagtgggagttgatcaagcagaagacccagaacgatctggacgcgagcggcaagacagttggcgagtacatcttcgacacgctgctccgcaaccccgagcagaagatccgcggaaagctggtgcgcaccatcgagcgacgctactacaaggaggagatcaacgccatcctgaagaagcagaaggagttccacccggagctctccgaccgcgcgctgtacgagaagtgcgtcgaggagctgtacccgaataaccccgcgcaccggaacatgatgctcatccacgacctgagctacttcctggtgaacgacatcctcttctaccagcgccccttaaagagcaagaagtccctgatcgacgagtgcccgtacgagagccacctctacatcgacaagaagtcgggcgagcggaaacccgtggccgtgaagtgcatcgccaagagccaccccctgtaccaggagttccgcctgtggcagttcatctccaacctccggatctatcagaagaccaaggaggtggggaacagcctcaaggtggacgtcgacgtgaccaacgagttcctaaagggcgagaatgactacgtcgaactgttcgactggctgaacacgaagaaggagatcaagcaggaggacttcctgaagtacaagcccttcgggttcaccaagggcaacatcaacaactaccgctggaactacgtggaggacaagatttacccgtgcaacaagacccactacaccatcttaaagggcctggagaaggcggacatcacgttcgacgagttcatctcccacgacagcctggccgaggagaacctttggcacatcctctactccgtgagctccaaggaggagctgaagcacgccctggagagcttcgccgacaagcggggactctccatcaagttcgtcgacgcgttcatcaacacccccgccttcgagaagtcctacggcgcctacagcgccaaggccatcaagaagctgctacccctcatgcgcatggggaagtactggaaggaagagaacatctgcgacagcacccgggagcgcatcgacaagataatcaccggcgagtacgacgagaacatccgggaccgcgtgcgggagaagtccatcaacctgacggacatcaccctgttccgcgggctccccctttggctggcgtgctacgtggtctacgaccggcacagcgaggccggcaacaccgagcgctggacctccccgagcgacatcgatcactacatccggaagtttaagcagcacagcctccgcaaccccatcgtggagcagatcgtgctggagacgctgcggactgtccgcgacgtgtggaccgaggtgggcgggatcgacgagatccacgtggagctcggtcgcgagatgaagaacccctccgacaagcggcgcaagatgagcctgcagatgcaggaaaacgagaacaccaacctgcggatcaaggcactcctggccgagttcatcaacccagagctggggatcgagaatgtgcgcccgtactcccccagccagcaggacctcctgcggctgtacgaggagggcgcctggaactcacccgagatcgacgagaagcaggtcgacgagatgctcgcgatcctgaagaagttcaacgagacggacagctccaagcgccccaccaagagcgagatcaagcggtaccggctgtggctcgagcagaagtaccggtccccgtataccgggaccccgatccccctgagcaagctgttcaccaccgcctacgaaatcgagcacgtgatcccgcgctcccgtttcttcgacgacagcctcaccaacaaggtgatctgcgagtccgaggtgaacaagctgaagggcaacatgctgggatacgagttcatcaagagccactacggggagaaggtccagctctccagcggctccgaggtgcagatcttcagcgtgaacgactacgagaagttcgtcaaagaccactacagcaagaacaaagccaagatgaagaagctgctgatggacgacatccccgagaagttcaccgagcgccagatgaacgactcccggtacatcagccgcctcatcgtgtccctgctgagcaacatcgttcgggagaagggggagcaggagtccatcagcaagaacgtactcgtgtgtaccggcggcgtgacggaccgcctgaagaacgactggggcgtcaacgacgtgtggaacaagatcatcctgccccggttcaagaggatgaacgagatcaccgactccaccgactacaccagcgtgaacacgtccgggcacattatccccgccatgccgctccacctccagaaggggttcaacaagaagcggatagaccaccgccaccacgcgatggacgccatcgtcatcgcctgcgccggccggaacatcgtgaactacctgaataaccagagctccaagagcgacgtgtcccgccacgacctgcgcaacctgctgtgcgagaaggacaagagcgaccggaaggagctcatcatcaagccctgggacaccttcacccaggacgtctactccgtgctgagctccatcatcgtgagcatcaagcagaacttgcgcgtcatcaacaagaccaagaacatctaccagcggaaggaggacggtaaggtgatcatctccaagcaggagaacaacatcaactggtgggccatccgcaagcccctccataaggagacggtgagcggcgaggtcaacctgcggaaggagaccaccatcagcctgaaggaggcgatcgacaaccccgcccgcatcatcgacaaggacttcaaaaagaagctccgggagctgatcctgatgggctacaacgagaagctgatcaagaaatatttctacgacaacaacgaatcctggcaggacgtgaacctgaagaaaatcccggcctactacttcacaaaggacacgaacgaccggtacttcgccagccggtccctgctcgacgagaacttcgacaagaagaagatcgagaacaaggtgaccgacaccgggatccgcaccatcctgcttcggcacctcgaggtcgaaggcggggacagcaaggttgccttctcccccgagggcctggagcgcatgaacaagaacatcgagatcctgaacgggggcaagaagcacaagcccatctataaggtgcgggagtacgagaaggcggagaagttcgccgtcggcatgcgcgggaacaaggccagcaagttcgtggaggccgccaaaggcacgaacctcttcttcgcggtgtacgacaacgggaagaagcggtccttcgccaccgtccccctgaacgaggtgatccgcctgcagaaggagggcctcccgagcgcccccgccaacgaggaggggctgttgcccaagttcgtgctctcccccaacgacctggtctacgtgccgaccgaggacgagctgcggagcggcctcctgcccgagaaccccgcgcccgagcgcatctacaagatggtctcctgcaccggctaccagtgcttcttcatccacttcagcgtgtccggggtcctgtgcgacaagaaggagttcagctccctcaacaagatggagcgggccatcagcggcgagatgatcaaggagatctgcatcccgctgaaggtcaaccgcttggggaagataatgtacaacctctga

SEQ ID NO: 8053 - RNA, 4506 nt, synthetic construct
  misc_feature 1..4506: note = Cas9 variant
  source 1..4506: mol_type = other RNA
atgaagaccatcctgggcctcgacctcgggaccaacagcatcggctgggcgaagatcagtattgacgacaacgggaactacctgcgcgacatccagttaggcagccggatcatccccatgtcccaggacgtgctggggaaattcgacaacggcgtcacggagagccaaaccgccgtgcgcacaggctttcgggggctgcgccggatccgcgagcggagtctcctccgccgggagcgccttcaccgggtgctccatgtcatgggcttcctgccgccccactacgacagcgcgatcgggtggaacaaggaggagccgtccacctacggaaagttcctcaaccacggggagcccaagctcgcctgggagcgccagggcgacggcagcatgcggttcttattcatggattccttccacaagatgatggaggacttcgcccctcaccagcccgccctggtggccgacggtcgcaagatccccctcgactggaccctgtactacctgcggaagaaggcgctcacacagcccatcaagaaagaggagctagcctggatcctactcaatttcaaccagaagcgcggctactaccaactgagaggagaggaggaggaggagaatccgaccaagcgggaggagtaccacgagctgaaggtggtcagcgtggaggccgcggaggagggcaagggcggtaacacctggtacaacgtgaagctcgagaacggctggatctaccaccggccctccaagatcgacctgtctgactgggtcgggaagacgaagcagttcatagtgaccatggagtacgaggcggacggcataacgctgaagaagaacaaggagggcgaggtgaagcggtcgtttagggtccccgacgaggacgactggggcctccgcaagaaacgcaccgagagccagctggaggcctccggcaagacggtgggggccttcatctacgaccatctcctggctgagcccgccgacaagatccggggcaatttcattcgcaccatcgagcggaagtactacaagcaggaactggccgatatcctgcgcgagcagagcaaataccacgaggagctccagtccaagaaaatcctggccgactgcgccgaggagctgtaccggagcaaccaaccgcatagggacagtctcctaaagaaggacatggtgtatctgctcctgaccgacctcatcttctaccagcggcccctcaagagcaaaaagtccctgatcgcgaactgcccctacgagtactacgagtacgtcgataaggagaccggcgagattaagcgccagggtatcaagtgcgtggccaagagcaacccctactaccaggagtttcggctgtggcagttcgtgctcaacctacgcttatacgaccgaaccgaggacaaagaggtaaccgcggaatacctcccgagcaaggaggactacgcccgcctgttcgtgtatctgaacgaccggaaagagatcaaccaggaaacccttctcaaggacttcttcaagctgaaaaaggtcaagcagcgctccgaaaaggagtttcccgtccggtggaactacatcgaggacaaagagaagaagtacccctgcaacgaaacccgccacgagctgctcatggccctagaccgggccgggatggagcgcagctggctggatgacactgcgcggcagtaccgcctctggcacctcttgtactccatcgaggtgaaggacgaggcggaacgcgccctgcggaagctgaaggacgacgacgagttcgtgtcagccttcctgaaggtaaaacccttcaagaaggactacggcgcgtactccgagaaggcagtgaagaaattgcttgcggtcatgcgcatgggcagccactggtgcgaggacgacatctgcaaggagaccaaggagcggatcgagcacatcctgcagggggacgtggaggagaagattaaggagcgcatgaaccacaccgcctactccctcggcgagctgagcgactttcaggggcttccggaatggctcgcctgctacgtggtctacggccggcattccgaagccaccgacataaaacattggaagacgcccgaaagcctgatggcgtacatcaacggtttcaagcagcactccttacgcaacccaatcgtggagcagtgcatcctcgaaaccctgagaaccgtgcacgacatttggaaggaggccggccacatcgatgagatccacgtcgagctgggccgcagcatgaagtcaaccagcgaccagcgggcacgcatgacagaaaacatccttcgcaatgagaacaccaacctgcgcatcaaatccctgctcatggagcttaagaatgacgccgacataaaggacgtgcggccctacagcccgatgcagcaggagatcctgcgcatctacgaggagggggctctccaggagctaacgaaggaagacaacgactatgaggagatcttcaaaatctccaagatcccccaacccagcgcgaaggaactgttgaagtacaagctatggctggagcagaagtaccggagcccctacaccggtaagccaatctccctcagcaagctgttcacgtcagcctatcaaatcgagcacatcatcccccagagtcgttacttcgacgactccttcaacaacaaggtgatctgcgaaagcgaggtcaacgccctgaagtccaacatgttagggtacgagtttatcaagaaccacggaggcgagatcgtgcactgcaccctgttaggggacgtcaaggtacagaacgagagcgagtacaaggccttcgtgaccgagcactacgccaacaacaagtataagaaggagaagctgcttatggaggacatcccccaggacttcctaaaccggcatctcaacgactcccgctacatcagcaaggtggtcaagaccctactgtccaacatcgtgcggacggaggacgagatggagaccaccagcaagttcgtggtctcctgcaccggcgggatcaccgacagactcaagaaggactggggactgaacgacgtctggaacagcatagtgtactcccggttcgaacgcttgaacgagttgaccaagagcgacgcgtttggccgctgggagaataaagagggcaagagggtgttccaaacgtccgtcccgctggagctgcagcgcggcttcaacaagaagcggatcgaccaccgccaccacgccatggacgccctcgtgatcgcctgcgccagccggaacattatcaactacctaaacaacgagtcagcgaactcccccaagaagcgcgaggacctgcggcagcaactctgcgacaagaaccgcatcatccggaagccctgggagagcttcacccaagacgctcgcgccgccctggaggacgtcgtcgtgtccttcaagaactacgtccgcgtgatcaacaagaccacgaactactacgaaaggtacggggcggacggcgagaaaaccatcgccaagcagaagaacagcgagatgtgggcggtgcggaagcccatgcacgaggccaagtactacggccgcgtcaatctgcaacggaagactgaggtgcgactgaaagctgcgctggaagacattccgtccatatgtaacaaggagctgcgggactacatcaaccgcctcgtcaagagcggcctgaacgcccggcagctgctcgcccacttcaaatctaccgattactgctggaacaaacagaacgtggacaaggtggaggtctggagattcagcgacgaaaaggagcccctggtcgccatccgcgaatccctcgacacgagcttcgacgccaagcggatcgacactatcaccgacaccgggatccagaagatcctccttaattacctggaagcgaagggcggcgaccccgccatcgccttcacgcctgaggggatcgccgagatgaaccagaacatggcactctacaacaacggcaagatgcaccagccgattctgcgcgtgcggctgtccaagaagcgcgggaagaagtaccaagtgggtcagaccgggtgcaaggccaagcagttcgtcatcagcgaatctggcaccaacctctacttcgccatttatgaggatgaggaccggaaccgcacgtacaacacaatccccctgaacgaggtggccgaacggctgaagcagggcctcagccccgtccccgagaagaacgagaaggaggtcccgctgaagttctacctgtcccccaacgacttggtgtacgtacccaccgaagaggagatcctgatgaaggagtgcaagctgaacaagaaccgtatttacaaattcatcgacagcagcgggaccaccgccaacttcgtcccacacagaagcgcgtccctcatctacaacgtagacaagaagctggccgaggccttctgcaacgacgagatcatccagaacgaatacggtgtggggagcccacagtcgaagaaccagaaggccctgacgggcgagatgattaaagcagtctgctggaaattggaggtggaccgcctggggaacatcatacgggtaattaagtga

SEQ ID NO: 8054 - RNA, 4515 nt, synthetic construct
  misc_feature 1..4515: note = Cas9 variant
  source 1..4515: mol_type = other RNA
atgaagaacatcgtgggcctggacttggggaccaatagcatcggctgggccgtcgtgaacggaaacatcaatgacgacggctccgagcagctggtgaaaatccaggctagcgggtcccgtattatacccatggacgcggccatgatcggcgacttcaacaagggcaactcgatctcccagaccgccgagcggacgaggctgcgggggatccgccggctcagcgagcgctacctgctgcggcgcgagcggcttcaccgcattctggacatcctgggtttcctcccgtcccacttcgcccgtgacctggaccgttacggcaaaatcgtaaaggacaaggagcccaagctggcctggcggaaaaacgaggcgggccagttcgagttcatcttccaaaacagcttcaaagaaatgctcgaggacttcaagctgaaccaccccaacctgatcactgacgacaaaaaggtgccctacgactggaccatttactacctccgcaagaaagggctgacctccaagatcagtaaggaggagctggcctggatactcctgaacttcaaccagaagcgtggctactaccagctgcgcggcgaggaggaggaggagaacaagaacaagcaggtcgagttctacgccctaaaggtcatcgccgtggaggactccggggagaagaagggcaaggacacgtggtacaacgtgcacctggagaacgggtggatctaccggcggacgagcaacatgccgctcgactgggtcggcaagaccaaggagttcatcgtgaccacggacctcgagaaggacggtacccccaagaaggacaaggaggggaacatcaaacggtccttccgggcgcccaaggaggacgactggagcctggtgaagaagaaaaccgaggccgacatcgaccaaactcacaagacggtcggcacctatatctacgacaccttactcgggaacccctcccagaagatccggggcagactggtgcgcaccatcgagagaaagtactacaaggaggagctgaagctcatcctggataagcagaaggagttccacccggagttacaggaccgcgccctctacgcagcctgcgtggaggagctgtacaccatcaacgaggcgcaccggaacaacatagggaaccgcgacttcacatacctgttccttgaggacatcttattctaccagaggcccctcaagagcaagaagtccctgatcgacaactgcccctacgaggagaaccactgcctggataaagagaccggtgagatcaagttcttccctgtcaagtgcatcgcgaagtcccaccccctcttccaggagttccgcctctggcagttcatcgttaacctgcggatctacaggaaaggcctggcccaggacgtggacgtcaccaacgagctcctgaagacggaggaggactacgtcgccctgttcgactggctcaacggaaagaaggagatcgaccaaaaggccttcctgaagtacccgccgttcggcctgaagaaggaggtggagaactaccggtggaactacgtccaagacaagtcctacccctgcaacgagactcgcagcctgatgctcgcgcgattagagaagtgcgacatcagcatcgagttcctgaccaaggaaaacgaggaggcgctctggcacatcctatattccgttgaggacaagaacgaaatcgtgaaagccctgcagaagttcgccgacaagcacaacctcaacgccagcttcgtcgacgtgttccagaagttccccagctttaagaaggagtacggatcctactccgcgaaggccatcaagaagctcctgcccctcatgcgcatgggcaagtactggagcgaggactccatcgacaaagggacccgggagcgcatggataagatcatcacgggcgagtacgacgagaagatcgagaaccgggtccgcgagaaggccatccacctggcggacatcagcgagttcaaggggctgcccctctggctggtgtgctacatcgtgtacgggcggcactctgagagcaaggagatagccaagtgggagtcccccgcggacatcgacagctacctgaagtccttcaaacagcacagtctccgcaacccgatcgtcgagcagatcatcatcgagaccctgcgggtggtgcgcgacatctggaagcaggtcggcaacatcgacgagatccacgtggagctggggcgcgagatgaagaacccggccgacaagcgtcgcaaaatgacccagcagatctccgagaacgagaacaccaacctccggatcaagtatctgctgacggagttcctcaaccccgagtacgaggtggagaacgtcaggccctacagcccgtcccagcaggacatcctgcgcatttacgaggagggggtgctgaacagcgtttccaacctccccgaagagataagcgacatcctgaagaagttcaccgagaccgacctgaagaagcgccccagtcggtctgaggtcctccgctacaagctgtggctggagcagaagtaccggagcccctacaccggggaggtgatcccgctcggcaagctgttcacgcccgcctacgagatcgagcacgtgatcccccagtcccgctacttcgacgacagcttctccaacaaggtgatctgcgaggctgaggtgaataagctcaagagcaacctgctgggccacgagttcatcgtgaagcaccacggggagatcgtcgagctgccgttcggcaagaaggtaaagatcttcaccgtggacgagtacgagcagttcgtcaaggacaactactcccggactcgagggaagatgaaaaagctcctggtggacgacatccccgaggagttcgtggcgcggcagctgaacgactcaaggtacatctccaaggtcgtcaagagcctcctgtccaacatcgtgcgggagaaaggcgaggaggaggccatctcgaagaacgtgatcccctgcaccggcggggtgacggaccgcctgaagaaggactggggtgtgaacgacgtgtggaacaagatcatactcccccggttccagcgcctgaacgaactgaccgggaccaacaagttcaccaccatgtccctcaacaaccacgagatccccgcgatgcccctggagctgcagaagggcttcaataagaagcggatcgaccaccgccaccatgccatggacgccatcatcatcgcgtgcgctaaccggaacatcatcaactacctcaacaacgagagcgccacggccaaggctgagctgtcccgctatgacctgcagcgcctcctatgcgacaaggccaagaccgacgacaacgggaactacaagtgggtgatccggaagccctgggccagctttacccaggatgtgcacggcgtcctggaggatataatcgtgtccttcaagcagaacctccgtgtgatcaacaaggccacaaaccatttcttacactacaacgaagagggcaagaagatcttcgtcaagcaagaaaagggggacagctgggccatccgcaagtccatgcacaaggacacggtgtttggcgaagtgaacctgcggcggatcaagaccgtcgcgctcaatgaagcgatgaagaacccccagtccatcgtggtgaaggacttcaagcgcaagctgctggagctcctgaacctggggttcgacgccaagcggatcaaaaagtacttcgaggacaaccgcgaaacctggagcgacatcaacctctccaagatcaccgtctactatttcagcaaggatacgaaggatcggttcttcgccacccgcaagccgctggacacctccttcgaccggaagaaaatcgagaacaacatcaccgacacgggcatccagaagattctgctccgccacctggagctgaaggacaacaaccccgacatcgccttcagccccgacgggatcgatgagatgaaccggaacatcatccagctcaacaacggcaagtatcaccagcccatcatcaaggtgcgctggtacgagcaggcggacaagttcgccgtgggccagaccgggaacaagtccagcaagtttgtcgaggccgccaagggcacaaacctgttcttcgccgtgtacgagtccaacatcctggacgagaagaccaacacgatcatcaaaaagcggaactacgcgaccatcccgctcaacgtggccatcgagcgccagaagcaggggctgagcgtcgcccccgaggaggagaacgggaacgatcccatattcgtgctgtcccccaacgacctagtgtacctgccgaccaccgacgagctggccaacggggtcgtggcccagcccctcgacaaggagcgcatctacaagatggtcagctgcactggcaacgagggacacttcatacccgcgcgtatcgccaaccccatcctgcagaccatcgagctggggtccaacaataaggcccagaaggcctggaccgacgagatgatcaaagagatctgcatgccgattaaggtcgaccggctcggcaacatcctggagagctccagcctgcacaagaagtga

SEQ ID NO: 8055 - RNA, 4515 nt, synthetic construct; identical to SEQ ID NO: 2255
  misc_feature 1..4515: note = Cas9 variant
  source 1..4515: mol_type = other RNA

SEQ ID NO: 8056 - RNA, 4515 nt, synthetic construct
  misc_feature 1..4515: note = Cas9 variant
  source 1..4515: mol_type = other RNA
atgaagaacatagtgggcctcgaccttgggaccaacagcatcggctgggccgtcgtgaacgggtccgtgaacgacgacggcagcgagcagctggtcaagatacaggcctccgggagccgcatcatccccatggacgcggccatgattggcgacttcaacaagggcaactccatcagccagaccgccgagcggacgcgcctgcgcggggtgcggcggctctccgagcgctacctgctgcggcgcgagcggctccaccgcatcctggacatcctgggcttcctcccgttccactttgcccaggacctggaccggcacgggaagatcgtgaagggcaaggagcccaagctggcctggcgcaagaacgaggcggggcagttcgagttcatctttcaggacagcttcaaggagatgctcgaggacttcaagctgaaccaccccaacctgatcaccgacgacaagaaggtcccctacgactggaccatctactacctccggaagaagggcctgacctccaagatcagcaaggaggagctggcctggatcctcctgaacttcaaccagaagcgcggctactaccagctgcgtggggaggaggaggaggagaacaagaacaagctcgtggagttctacgccctgaaggtggtcgccgtagaggactccggcgagaagaaggggaaggacatctggtataacgtgcacctggagaacggctgggtctaccggcggacgagcaacatgccgctcgactgggtgggcaagaccaaggagttcatcgtgaccaccgacttggagaaggacgggacgcccaagaaggacaaggagggcaacgtcaagcgctccttccgggcgcccaaggaggacgattggagcctcgtgaagaagaagaccgaggccgacatcgaccagacccacaagaccgtgggggcctacatctacgatacgctcctgggcaatccctcccagaagatccgcgggcggctggtccgcaccatcgagcgcaagtactacaaggaggagctcaagcagatcctggagaagcagaaagagttccacctggaactccaggaccgcgccctgtatgccgcgtgcatcgaggagctgtacccgatcaacgaggcccaccgcaacaacgtgggcaaccgggacttcacatacctctttctggaggacatcctgttctaccagcgccccctcaagagcaaaaagtccctgatcgacaactgcccctacgaggagaaccagggcctggacaaggagaccggcgagatcaagagcttccccgtgaaatgcatcgccaagtcccacccactcttccaggagttccgtctgtggcagttcatcatcaacctgcgcatctaccggaaggacctcgcccaggacgtcgacgtgacgaacgagctgctgaagaccgaggaggactacgtggccctcttcgactggctgaacggcaagaaggagatcgaccagaaggcgtttctgaagtacccggtcttccgcctgaagaaggagatcgagaactaccggtggaactacgtgcaggacaagccatacccctgtaacgaaacccgcagcctcatgctagcccggctggagaagtgcgacatcagcatcgagttcctcaccaaggaaaacgaggaggccctgtggcacatcctgtactccgtcgaggacaagaacgaaatcgtgaaggccctccagaagtttgccgacaagcacgacctgaacgcgagcttcgtggacgtcttccagaagttcccgcccttcaagaaggagtacgggtcctacagcgccaaggccatcaagaagctgctccccctgatgcgcatgggcaagtactggtccgagaacagcatcgacaaagggacgcgggcccgcatcgacaagatcatcaccggcgagtacgacgaaaagatcgagaaccgggtgcgggagaaggccatccacctggcggacgtgtccgacttcaagggcctccccctgtggctggtctgctacatcgtgtacgggcggcacagcgaggccaaggagatcatccagtggaagtccccggccgacatcgacagctacctcaggagtttcaagcagcacagcctgcggaaccccatcgtggagcagatcatcatcgagaccctgcgcgtcgtgcgcgacatctggaagcaggtcggcaacatcgacgagatccacgtggagctcgggcgggagatgaaaaatcccgccgacaagaggaagaagatgacccagcagatgtcggagaacgagaacacgaacctgcggatcaagtacctgctcaccgagttcctgaaccccgagtacgaggtggagaacgtgcgaccgtacagcccctcccagcaggacatcctgcggatctacgaggagggcgtcctcaacagcgtgtccgacctgcctgaggagatcagcgacatcctgaagaagttcaccgagaccgacctcaagaagcgcccctcccggagcgagatcctgcgctacaagctgtggctcgagcagaagtaccgcagcccgtacacgggggaggtcatccccctgggaaagctgttcacccccgcgtacgagatcgagcacgtaatcccgcagtcctgctacttcgacgacagcttctccaacaaggtgatctgcgaggccgaggtgaacaagctcaagagcaacctgctgggccacgagttcatcgtcaagcaccacggggagatcgtggagctcccattcggcaagaaggtgcgcatcttcaccgtcgatgagtacgagcagttcgtgaaggacaactactcccggacccgcagcaagatgaagaagctgctgatggacgacatccctgaggagttcgtgacgcggcagctcaacgactcccgctacatcagcaaggtcgtgaagtccctgctgagcaacatcgtgcgggagaagggggaagaggaggccatctccaagaacgtcatcccctgcaccggcggcgtgaccgaccgcctcaagaaggactggggaatcaacgaggtatggaacaagatcatcctgccgcggttccagcgcctgaacgagctcactggcacgaacaagttcaccaccaagaacgtcgggctgcaggagatccccaccatgcccctggagttgcagaagggcttcaacaagaagcggatcgaccaccgccaccacgccatggacgccatcataatcgcgtgcgccaaccggaacatcatcaactacctgaacaacgagagcgccactgccaaggccgagctgtcccgctacgacctccagaagatgctgtgcgacaaggcgaagacggacaacaacgggaactacaagtgggtgatcaggaagccctgggccagcttcacccaagacacctacctggccctcgagaacatcatcgtgtccttcaagcagaacctgcgggtcatcaacaaggccaccaaccgcttccttcactataacgaggagggaaagaagatcttcgtgaagcagggcaagggggacaattgggccatccgcaagagcatgcacaaggacacggtgttcggcgaggtcaacttacggcggatcaagaccgtggcgctgaacgaggccatgaagaacccgcagtccatcgtggtcaaggacttcaagcgcaagctgctcgaactgtggaacctcgggttcgacgccaagaggatcaagaagtacttcgaggacaaccgcgaaacctggagcgacatcaacctcagcaagatcgaggtgtactacttctccaaggacaccaaggaccggttcttcgctacgcgcaagcccctggacaccagcttcgaccggaagaagatcgagaacaacatcaccgacaccggcatccagaagatcctgctccgccacctggagctgaaggacaacaaccccgacatcgctttctcccccgacgggatcgacgaaatgaacagaaacatcatccagctcaacaacggcaagtaccaccagccgatcatcaaggtgcgctggtacgagcaggccgacaagtttgccgtcggccagacggggaacaagttcagcaagttcgtggaggccgccaagggcaccaacctgttcttcgcggtgtacgagtccaacatactggacaagaagacgaacaccatcatcaagaagcggaactacgccacgatacccctcaatgtcgccatcgagcgccagaagcaggggctgcccgtggcccccgaggacgagaacggcaacgacccgatcttcgtgctgagccccaacgacctcgtctacctgccaaccgacgacgagctggccaacggtatcatcgcgcagcccctcgaccggggccgcatctacaagatggtgtccagctccggcgagcagtgcttcttcataaagcacatcgtcgccaacgtgctggtggacaagttcgagttcagcccgctgaacaagatggagcgggccctcaccggggagatgatcaaaatgatctgcatccccatcaaggtcgaccgcctgggcaacgtgctggagtccagctccagccacaagaagtga

SEQ ID NO: 8057 - RNA, 4515 nt, synthetic construct
  misc_feature 1..4515: note = Cas9 variant
  source 1..4515: mol_type = other RNA
atgaagcgcatcctcggattagacctggggaccaacagcatcggctgggccctgatcgagaacgacttcaacagaaaggaggggaagatcgaggccctcggctcccgcatcatccccatgtcgcaggacatcctgggcaagttcgactccggcgtgaccgtcagccagacggcggcccggaccaactatcgcggtatcagacgcctgtaccagcgggacaatctccgccgggaacgcctgcaccgggtgctgaacatcctcgggttcctgccgaagcactacgccgagtccatcgacttcgaagaccgtctgggccagttcaagcccgagacggaggtgaagctcccctaccggaaggactctgacgataactaccacttcatcttccaagagtccttcaacgagatggtcgaagagttccagttcaagaaccccagccttttctacaccaaggccaacggggaacagtccaagatcccgtacgactggacgctgtactacctccgcaagaaggccctgtcaaagaaaatctccaaggaggagctggcgtggatccttctgaacttcaaccagaagcggggctattaccagctgcgcggtgaggaggaggcagacagcaaggataagctcgaggagtaccacgcccttaaggtgagtgatgtgcaagccaccgaggataccaacgccaagggcacctggtacaacgtcatcctggagaatggctggatctaccggcgccagagtaaggactccctcttcgattggaaggggaagacgcgggagttcatcgtgaccaccagcctagagaagggcggcgccgtgaagatcgacaaggagggcaacgagaagcgctccttccgggccgtggatagcgagaaagactggatcgccatcaaaaagaagaccgagaacgacctggccaacgcgggcacgaccgttggggtgtacatatacgagacgctcctgcgcaaccctgaccagaagatccgcggcaagctcatcaaaaccatcgagcggaagtactacttggaggagctgaaggccatcctggccaaacagatccaggaacacgcggagctccagaaccgatccctgtacaaggactgcatcgaggagctgtaccaggggaatgaggcccataagaacaacatcaaggagaacggtttcgactacctcttcttagaggacatcatcttctatcagcggcccctcaagagcaagaagtccacgatcagcaactgcccttacgagagcagggtcttcatcaaggacgggaaaaaggagatccagccgatcaagtgcatctccaagagcaacccaatctaccaggagttccggctgtggcagttcatccacaacctgaagatctacgagaaggaggcgatcgacgacggtaagaccgtgatcaacaaggacgtgaccaccgagttcctgaacacgcaggaggcctacgccgccctcttcgagttcctgaacgacaaggccgagatctcccagaacgcgctgctcaagtacttcaagctgtcgaccaacacccaccgctggaataacgtcgaggacaagaagtacccctgcaacgagacccggtcagagttcatcaaacgcctgagcaagatggacggaatcgacctcgggaagacgctgtcccccgctttcgagaagtcactgtggcacattatctacagcgtgaaggacaagaagcagtacgtgcgggcgctggagaccttcgccatgaaaaacggcctcgacatcaaccagtttcgtgagaacttcgagaagtttaagccgtacgacagcgcctacggggcgtactccgagaaggccctgaagaaggtgctgcccctcatccggcgcggcacctattggaagaaggacgccatccccgccgcggtgcaggagcggatcgtgaacatcatgaagcgcatagaaagcgtcgacttcaacctggagaagatcgagaacttcgccgacgatgacatccccaagcagctgcttaagtccttcgccaaggggaaggacccgatgcagggcctgaacacctaccaggcctgctacgcggtgtacaaccggcacagcgaagtaagcgacatccaactgtggaagtccccagaggacatcacgaagtacctcgacagcttcaagcagcacagcttacgcaaccccatcgtcgaacaggtcgtgatggagaccctgcgggtggtgcgcgacatctggcagtactacggcaacggggcgaaggacttcttcagcgagatccatgtcgagctcggccgggagatgaagaacgacaaaaagacccgcgagcgcatctccaagagcatcaccgagaacgagaacacgaacgagcggatcaagaacatcctgaaagagctgatgggggacgaggccctccagggcgacatccgcccatactcaaaggggcaccaggacatcctgaagctgtacgaggagggcgttttcgccaacgccccggagacctacaaaaacatcaagatcgacgacatcgagaagatccggaagaacaatagcccctccaagagcgacatcgtcaagtacaagctctggctggagcagggctacatctccccctacaccgggagccccatcccgttatcccgcctcttcaccacggactaccagatcgagcacatcatcccccggagccgctacttcgacgactccatgggcaacaagatcatctgcgagagcgccgtcaacgaggagaagaccaacaagaccgcgtacgagttcatcaaggagaacgcggggcggatcatcgacctgggccagggcaagcaggtcccactgtttgacctcgaagcctacgagtcccactgccgcggttacttcaagggcaacaccaagaagctgaagttcctgctcagcgaggacatccccgagggcttcatcaaccggcagctgaacgactcccgctacatcagcaaggtggtgacctccctgctcagcaacgtggtgcgggaagagggtgagcaggaggccacgagcaagaacctggtcccgctggtggggaccatcacctccaagctcaagaaggactggggcctggaggccatatgggacgacctgatcgcgccccgcttcgagcggatgaaccagctcaccaagagcacggatttccgcaaggaggtgatcgacggccacgggaaccggtactttatcaacaccgtccccgacgacatcaagaagggcttctccaagaagcgcatcgaccaccggcaccacgccctggacgccctggtgatcgcctgcaccaccaaggaccacgtgaactacatcaccagcttaaacacccagcggaacaaccggtccctggtcagcaagctgcgcaagatcgaagagaaaaccatcaaggacaagcggaccgggcagccgaaaacgatcaagatcgcgaaggcctaccacaagccatggccaaacttcaccaaggagaccttcgagaagctctccaaaaccgtggtgagcttcaagcagaaccagcgcatcatcaacaagacgaacaacaaaacctggggctgggagaaggtcgacggggtgatgaagaaggtgctaaagaagcaggagaagaggaactgggccatccggaagcccatccacaaggaaacctactacggcaaggtaaagggcttcgactccccgaagggtaagatcaccacggccacgcgcaagagcctgagggagatcaccaacgagcgccagctcaacaccatcacggactccggcatcaagaagatcctaaacaaccacctgaagaccttcatcgacgagagcgggaagatcaacttcgagcccgccttcaaccaggacggcatcgacctcctgaacaagaacatccagcagctgaacgaggggaagaaccaccagcccatctataaggtgaggatgtacacccacaacaccatgttctccgtgggcgacgagggcaacaagagcacgaagtacgtgatccccgagtccggcaccaacctcttcttcaacgtatactgggacgaggagaacaacaagcgcaacttcgagaccgtgccgctgaaccgggtcatcgcgttccagaagcagaccagccacatccccaggaaggaccggacggacgtgcccatcgacaataccctgggccgcttcctcttcaccctgtcccccgacgacctggtgtacctcccgaccgacgaggagtccgagtcctttactaccttcgagatcgacagcctgaacagcaagcaggtcgccaatatctacaaattcgtggatgggtccggcaccaccgggaacttcgtgcccgccgaggccgcccgggtcatcgcgaacatcaaggataagaaggtgaggagcaacttctgcaagcggaacaatctgtccgacaagcagctcatcaaaaacgagttcggcctgggcagcccccagctgaagaaccagaactccctcgacgggcgccagatcaagagcatctgctggaagttagagatcaaccggctggggaaaatcatcaaggtcatcaagtga

SEQ ID NO: 8058 - RNA, 4515 nt, synthetic construct
  misc_feature 1..4515: note = Cas9 variant
  source 1..4515: mol_type = other RNA
atgaagaaggtgctgggcctcgacattgggacaaacagcgtcggatgggccgtggtgaaccagaacgacaagggggagttcctgtcgatcgagaagatcggcagcaggatcatccccatgtcccaagacgtcatggacaaattcggggccggccagaccgagagctccacggcgcagcggacccagtaccgcggcgtgcggcgccttcgggagcgctctctcttgcggcgcgaacggctgcaccgcgtgctccacatcctgcacttcctgccgcagcactacgatgccgcgatcgggtggaacaaaaaggagaacaagacctacggcaaattcctccccggggtcgaggtaaacattccctgggtggccaccgaccagggtcaccagttcatcttcatggactcctatgccgagatgctgaaggacctgaagcagcaccagccccacctcttcgagaagtccagcacgcctgtccccttggactggaccatctactaccttcggaagaaggcgctcacccaggccatcagcaaggaggagctggcctggatcctgctaaacttcaaccagaagcgcgggtactaccagctgcggggcgaggaggtggaagacaacaccaagcgcgaggagttctacgccctgaaggtggtcaaggtagagctcgacaaggataacacgtccgcgaaaacctggtacaaggtccacctggaaaacggcttcatctacccctgccccagtgacaccccgatagactcctgggttgggatggtgaaggatttcatcgtgaccacgaccctggagaaggacggtagcgagaagcggacggccgacggggagatcaagcgctccttccgggcccctaaggaggacgattggaccctcctgaagaagaagacggagagcgagctggagaagtccggcaaacaggtcggcgccttcatctacgacaccctcctgagtaaccccgatcagaagatcatcgggggcctgatcaagaccatcgagcgcaagtattacaagaaggaactcgagcagattctagagacccagcagaagttcatcgctgagctgtccgacaagaagctgttccaagcgtgcgccgaggagctgtaccccctgaacgacagtcaccgggaaaacctcctggagcgcgacttcaagcacctgttcgttcaggacatcatcttttaccaccggccgctcaagacgaagaagtccctgatttcaaactgcacctacgagtaccgcaccttctacaagaacggggagaagcaaatcagccccatcaagtgcatcgccaagtccaaccccctgttccaggagttccgcgtctggcagttcgtccagaacctccgcattctgcagagacagaggagcgagggcgacagtatcaagtacaacgtggatgtgaccgccgagttcctgaaggacgagaacgacatcgccaacctcttcacgtggctgaacgagaggaaagtcatcaaacaggaccagctgctcaaaagctacttcaagctgaaagtcaacaaggagaccaaggagctggactaccggtggaactacgtcgacgacaagaacaaggagtacccctgtaacgcgacccgcacccacatcctgtccttcctcgagaagtgcaaggaggagaagcggatcgaggacgaccgcttcgtgtacagcctgtggcacctcctctactccgttgtcgagccgatcgagctgagaggggccctggcgaagttcgcggagcgcgagcacctccacccgagcttcgtggacgtgttcgcccaattcccgcccctggagaaggagtacggctcctacagcgagaaggcgatcaagcggctgctgcccctgatgcgcatgggggactactggcacgaagacaagatcgacgtcaagactaagcagcggatacagcgcattatcgacggcgaggcggacgacgacataacccaccggtcccgcgagaaggtggagaacctgagaagcatcaccgacttcaagggactccccctgtggaaggccgggtacgtggtctacaaccgccactccgagagcggggagctgaccaagtggaagacgccccacgagctctctaactacatccagaacgagttcaagcaatacagcttgagaaaccccatcgtggagcagatcgttctggagaccctccgcgtcgtgcatgacctgtgggtgaagcacggggacttctccgagatccacctggagctcggccgcgacatcaagaacagcagcgacaagcggaagcgcatggccgaacggcagcaggagaacgagaactcccgtcagcgcgtcctggagatgctgatcgacctcaagaaggaggccgcgttcgccgacctgaacccgtacagcccctcccagcaggagaagctgcgcatcgtggaggatggcgtgctacggtccaacatcgagatccccaaggacatcgagaagatcaccaagtccgccaagcccaccagccgagaactgacgaaataccggctgtggctcgaccagaagtaccgctccccgtacacggggcagcccatcagcctggcccagctgtttacctccaagtacgagatcgagcacgtcatcccccaggcgaagtacttcgacgacagcttcacgaacaaggtgatctgcgagtccgaggtgaacaaggagaagggcagcatgctcgcccacgagttcatcctgaagaacggtggctctaccgtcaacgtgggcgggcgccaggtgcaggtcctgaagaacgatgcctacgtggagctcatcaaccggctgtacggcaagaacaatccggtgaaggccaagaagctgctcgccgaggacatcgacgaggttgttggggacttcagcgagagacagctaaacgacacgcgctacatctcccgggtggtccagaagctgctcagcaacattgtgcgcgaggaggacgagcaggagtccaccagcaagcacgtgatcggctgcagcgggcaggtcacaaccgccctgaagaaagactggggcctgaacgacatctggaacaagatcatccagccccggttcgaacgcctcaacgagatgacggccaccgaggactacggcgtttggcagtcacccaaccacttccagatccgggtgcccgaggagatccagaaggggttcaccaagaagcgcatcgaccaccggcaccacgccatggacgccctggtcatcgcatgcgcgacacgctcacacatcaactacatctccaaccgcagcggccaggaccggaacgccaagttcgagacgacccgcaccgacctgcggtccaagctctgctacaaggagaacagctccgggaacaactacaactacatattcaacaagccgtgggacaccttcacgcaagacgcccaccgcgccctggaaaacatcgtggtgtcacacaaacagaaccttcgggtcctcaccaagaccaacaactacacccaattcattaacaaggacggcaagaaggacctgcagaagcaggtcaagggggaccacttcgccgtgcgcaagcccatgcaccaggagacgatctacggaagagtgtccatccgcagcatcaaggaggtggcgctgaaaaaggccctcgagaactggaagcagatcgtggaccggacgctgaaggacaagatccgcgagctgatcggcgcctacgggaagtacgacgcccaaacgatcctcaagtacttcaaggaccgggactacaagttcaacaacctgaagatcaaccgcgtcgaggtgtatgagtacgaccataactgcgcggccgtgcggaagtccatcggcgatgacctgaccatcaagcagatcgagcgcatcactgacgagtctatccggaagatcctcatgaaccatctgagtaactacgacgacaacctgaaggaggccttcagccccgaggggctcatggagatgaacaagaacattaaggagctgaacggcgggaagaaccaccagcccatttacaaggtccggctgttcgaggacctcgggtccaagttcccgctgggggtgagccacaacaaccccgacaagtacgccatcgccgcgaaggggaccaacttgttcttcggcatctacgaggaccaggaggggaagcggatgttcgactccatccccctcaacatcgtgatcgaccgcctgaaggagaagaagtccccagtcccggagacctacaacgagagcaagctgaagtttcatctctcccccaacgacctggtctacgtccccaccgacgaggagcagaagcagccggagctggtggacgtggaccacctcagcgacgaacagaaaggccgggtctacaaggccgtgtccttcacagggaaccgagctttcttcgtgaaccaccgcgtcagcaaggtgatccacgattacgtggagttcggcaccaagaacaagatcgagaacgacgacgacaagcgatccctgaagcatatctgctggaaactgaaggtcaaccgcctcggcgagatcaccgacgtgaagcggtga

SEQ ID NO: 8059 - RNA, 4515 nt, synthetic construct
  misc_feature 1..4515: note = Cas9 variant
  source 1..4515: mol_type = other RNA
atgaagaacatcgtgggcctggatctcgggaccaacagcatcggctgggccgtcgtgaacgggtccgtgaacgacgacggcagcgagcagctggtcaagatccaagcctccggtagccgcatcattcccatggacgccgcaatgatcggcgacttcaacaaaggcaactccatcagccagaccgccgagcggacgcgcctgcgcggggtgcggcggctctccgagcgctacctgctgcggcgcgagcggctccatcgcatcctggacatcctgggcttcctcccgttccacttcgcccaggatctggaccggcacgggaagatcgtgaagggcaaggaacccaagctggcctggcgcaagaacgaggcggggcagttcgagttcatcttccaggacagcttcaaggagatgctcgaggacttcaagctgaactaccccaacctaatcaccgacgacaagaaggtcccctacgactggactatctactacctccggaagaaaggcctcacctccaagatcagcaaggaggagctggcctggatcctcctgaacttcaaccagaaacgtggctactaccagctgcgcggggaggaggaggaagagaacaaggacaaactcgtggagttttacgccctgaaggtggtcgccgtggaggactcgggcgagaagaaagggaaagacatctggtacaacgtgcacttagagaacggctgggtctaccggcggacgagcaacatgtccctcgactgggtaggcaagaccaaggagttcatcgtgaccaccgacctggagaaggacggtacgccgaagaaggacaaggagggcaacgtcaagcgcagcttccgggcgcccaaggaggacgactggtccctggtgaagaagaagaccgaggccgacatcgaccagacccacaagaccgtgggggcctacatctacgacacgctcctgggcaatcccagccagaagatccgcgggcggctggtccgcaccatcgagcgcaagtactacaaggaggagctcaagctgatcctggagaagcagaaggagttccacctcgagctgcaggaccgggccctgtacgccgcgtgcatcgaggagctctaccccatcaacgaggcccaccgcaacaacgtgggcaaccgggacttcacatacctgttcctggaggacatcctcttctaccagcgcccgctgaagtctaagaagtccttaattgacaactgcccctacgaggagaaccagggtctcgacaaggagaccggggagatcaagagcttccccgtgaagtgcatcgccaagagccaccccctgttccaggagttccggctgtggcagttcatcatcaacctccgcatataccggaaggaccttgcccaggacgtcgacgtgacgaacgagctgctcaagaccgaggaggactacgtggctctgttcgattggctgaacggcaagaaggagatcgaccagaaggcgttcctgaagtacccggtcttcgggctcaagaaagagatcgagaactaccgctggaactacgtgcaggacaagccctacccctgcaacgagacccggagcctgatgctggcgcgcctcgagaagtgcgacatctccatcgagttcctgaccaaggagaacgaggaggccctgtggcacatcctctacagcgtcgaggacaagaacgagatcgtgaaggccctgcagaagttcgccgacaagcacgacctgaacgcgtccttcgtggacgtcttccagaagttcccgcccttcaagaaagagtacggcagctactccgccaaggccatcaagaagctcctccccctgatgcggatggggaagtactggagcgagaactccatcgacaagggcacgcgcgagcggatcgacaagatcatcaccggcgagtacgacgagaagatagagaaccgcgtgcgggaaaaggccatccacctcgccgacgtgagtgacttcaaagggctgcccctgtggctcgtctgctatatcgtgtacggacgccactcggaggcgaaggagatcatccagtggaagtcgcccgctgacatcgacagctacctgcggagcttcaagcagcactccctgcgcaacccgatcgtggagcaaatcatcatcgagacgctccgcgtcgtgcgcgacatctggaagcaggtagggaacatcgacgagatccacgtggagcttggccgcgagatgaagaaccccgccgacaagcggaagaagatgacccagcagatgagcgagaacgagaacacgaacctgcgcatcaagtacctcctgaccgagttcctgaaccccgagtacgaggtagagaacgtgcggccctactccccgagccagcaggacatcctccgcatctacgaggagggggtcctcaattccgtgagcgacctgcccgaggagatctccgacatcctgaagaagttcaccgagaccgacctgaagaagcggcccagccgcagcgaggtgctgcggtacaagctctggctggagcagaagtaccgctccccctacacgggcgaggtcatcccgctgggcaagctgttcacccccgcctacgagatcgagcacgtgatcccccagagctactacttcgacgactccttcagcaacaaggtgatctgcgaggcggaggtcaacaagctcaagtccaacctgctcgggcacgagtttatcgtgaagcaccacggcgagatcgtcgagctgccgttcgggaagaaggtccggatcttcaccgttgacgagtatgagcagttcgtgaaggacaattacagccgcacccggtccaagatgaagaagctgctcatggacgacatccccgaggagttcgtcacgcgccagctgaacgacagccggtacatctccaaggtggtcaaaagcctgctctccaacattgtgcgcgagaagggcgaggaggaggccatcagcaaaaacgtgatcccctgcaccggcggggtgaccgaccggctgaagaaggactggggcatcaacgaggtctggaacaagatcatcctgccccgcttccagcggctgaatgagctgacagggacgaacaagttcaccaccaagaacgtgggcatccaggagatcccgaccatgcccctggagttacagaaggggttcaacaagaagcgcatcgaccaccggcaccacgccatggacgccatcataatagcctgcgcgaaccgcaacatcatcaactacctgaacaacaagtccgcaaccgccaaggccgagctgagccggtacgacctccagaagatgctgtgcgacaaggccaagacggacaacaacggcaactataagtgggtgatccgcaagccctgggcgtccttcacccaggacacctacctggccctcgagaacatcatcgtcagcttcaagcagaacctgcgcgtgatcaacaaggccaccaaccggttcctgcactacaacgaggagggcaagaagatctttgttaagcaggggaagggcgacaactgggccatccgcaagtccatgcacaaagacacggtcttcggggaggtgaatctccggcgcataaagaccgtggccctgaacgaggcgatgaagaacccccagagcatcgtcgtgaaggacttcaagcggaagctgctcgagctgtggaacctgggcttcgacgccaagcgcatcaagaagtacttcgaggacaaccgggagacctggagcgacatcaacctctccaagatcgaggtgtactacttcagcaaggacacgaaggaccgcttcttcgccacgcggaaaccgctggacacctccttcgaccgcaagaagatcgagaacaacataacggacaccgggatccagaaaatcctgctccggcaccttgagctgaaggacaacaaccccgacatcgccttcagccccgacggcatcgacgagatgaaccggaacatcatccagctcaacaacggcaagtaccaccagcctataatcaagatccggtggtacgagcaggcggacaagttcgccgtcgggcagacgggcaacaagtccagcaagttcgtggaggccgccaaggggaccaacctgttcttcgccgtgtacgaatccaacatcctggacaagaaaaccaacaccatcatcaaaaagcgcaactacgcgacgatcccgctgaacgtcgccatcgaacggcagaagcagggcctgcccgtggcccccgaggacgaaaacgggaacgaccccatcttcgtgctgagcccgaacgacctcgtctacctgcccaccgacgacgagctggccaacggcatcatcgcccagcccctcgaccgcggccggatctacaaaatggtgtccagctccggggagcagtgcttcttcatcaagcacatcgtcgcgaatgtgctggtggacaagttcgagttcagccccctgaacaagatggagcgcgccctcaccggcgagatgatcaagatgatctgcatcccgattaaggtcgacagactgggcaacgtgctggagtccagctccagctacaagaagtga

SEQ ID NO: 8060 - RNA, 4515 nt, synthetic construct
  misc_feature 1..4515: note = Cas9 variant
  source 1..4515: mol_type = other RNA
atgaagaacatcgtgggcctggatctcgggaccaacagcatcggctgggccgtcgtgaacgggtccgtgaatgacgacggcagcgagcaactggtcaagatccaagcctcagggtcgcgtatcatccccatggacgcggccatgatcggcgacttcaacaaagggaactccatctcgcagaccgccgagcggacgcgcctccgcggggtgcggcgtctgtccgagcgctacctgctgcgtcgcgaacggctacaccgcatcctggacatactgggcttcctcccgttccacttcgcccaggaccttgaccggcacggcaagatcgtgaagggcaaggagcccaagctagcctggcgaaagaacgaggcggggcagttcgagttcatcttccaagacagcttcaaggagatgctcgaggatttcaagctgaaccacccgaacctgatcaccgatgacaaaaaggtcccctatgactggaccatatactacctccggaagaaaggcctgacctccaaaatcagcaaggaggaacttgcctggattctcctgaacttcaaccagaagcgcggttactaccagctgcgaggggaggaagaggaagagaacaaaaacaaactcgtggagttctatgcccttaaggtggtcgccgtggaggatagcggcgagaagaaaggaaaggacatctggtacaatgtgcacctggagaacggctgggtctaccggcggacgagcaacatgccactcgactgggtggggaagaccaaggaatttatcgtgaccactgacttggagaaggacggcacgcccaagaaggacaaggagggcaacgttaagcgttcctttcgggcccccaaggaggacgactggagcctgctcaagaagaaaacggaggcagacatcgatcagacccacaagaccgtgggggtatacatctacgatactctgctgggcaacccctcccaaaagatccgcgggcggttggtccgtaccatcgagcgaaagtactacaaagaagaactaaagcagatcctggagaagcagaaggagttccacctcgagctgcaggaccgcgccctgtacgccgcctgcatcgaagaactctacccgatcaacgaagcgcaccgcaataacgtgggcaaccgggacttcacgtaccttttcctggaggacattctcttctaccaacgccccctcaagagcaagaagtccctgatcgacaactgcccatatgaggaaaatcaaggcctcgacaaagagaccggggagatcaagagcttcccagtgaaatgtatagctaagtctcacccgctgtttcaggagttccggttgtggcagttcatcgtaaatctccggatataccggaaggacctggcacaggacgtggacgtgaccaatgaactgctcaaaaccgaagaggactatgtcgccctcttcgactggctgaacggtaagaaagagatcgaccagaaggcgttcctgaagtatcccgtgttcggtctcaagaaggagattgagaactaccgctggaactacgtccaggacaagccctacccctgcaacgagacccggagcctgatgctggcgcgcctcgagaagtgcgacatcagcatcgagttcctgaccaaggaaaatgaggaggccctgtggcacatcctctactctgtggaggacaagaacgagatcgtgaaggcgctgcagaagttcgccgataagcacgacctgaacgctagcttcgtcgacgtgttccagaaattcccgcccttcaagaaggagtacggctcctattctgcgaaggcaatcaagaaactcctgcccctgatgcggatggggaagtactggtccgagaacagcattgacaagggcacaagggagcggatagacaagatcatcaccggcgaatacgacgagaagattgagaaccgcgttcgggagaaggcaatccaccttgcagacgtctccgacttcaaggggctgcccctgtggctcgtatgctacatcgtgtacggtcgccactctgaggccaaggagatcacccagtggaagtcccctgcggacatcgacagctaccttcggtccttcaagcagcactctctgcgcaaccccatcgtcgagcagataataatcgagaccctccgggtagtgcgtgacatctggaaacaggtcggaaacattgacgagatccacgtggagctgggccgcgagatgaagaaccccgccgataagcggaagaagatgactcagcagatgtccgagaacgaaaacaccaacctgcgcatcaagtacctcctgaccgagttcctaaaccccgaatacgaggtggagaacgtgcggccgtacagcccctcccagcaggatatccttagaatctacgaggagggggtactgaacagcgtgtccgatctgccggaggagatctctgacatattgaagaagttcaccgagacggatctgaagaagcggccctcccgcagcgagatcctgcggtacaagctatggctggagcagaagtaccgcagcccttatacgggagaggtcatcccgctgggcaagctgttcacccccgcgtacgagatcgaacacgtgatcccgcagtcctgttacttcgatgactcattctccaataaggtcatctgtgaggccgaggtcaacaagctaaagagcaacctgcttggtcacgagttcatcgtcaaacaccacggcgagatcgtggagctccccttcggtaagaaggtccggatctttaccgtggacgagtacgagcagttcgttaaggacaactattcccgcacacgtagcaagatgaagaaactactcatggacgacatccccgaagagttcgtcacgagacagctgaatgactctcggtacatcagcaaggtcgtgaagtccttgctctcaaacatcgtccgcgaaaagggcgaagaagaagcgatctccaagaacgtgatcccctgcactggcggggtgaccgaccggctgaagaaggactggggcatcaacgaggtttggaacaaaatcatcttaccgcgcttccagcggctcaacgagctcacgggcaccaacaagtttaccaccaagaatgtgggcatacaggagatacccaccatgcccctggagcttcagaaggggttcaacaagaagcgcatagaccatcggcatcacgctatggacgctattatcatcgcctgcgccaaccgcaacatcatcaactacctgaacaacgagagcgcgacagccaaagccgagctgtcccggtacgacttacagaagatgctgtgcgacaaggccaagaccgacaacaatggcaactacaagtgggtgatcaggaagccttgggccagctttactcaggacacctacctagccctcgagaacatcatcgtctccttcaagcagaacctgcgcgtgattaataaggccacgaatcggttcctgcactataacgaggagggaaagaagatctttgtgaagcagggcaagggcgacaactgggccatcagaaagagcatgcacaaggacactgtcttcggggaagtgaatctcaggcgcataaagacggtggccctgaatgaggctatgaagaacccgcagtctatagttgtgaaggacttcaagagaaagctgctcgagctctggaacctgggcttcgacgcgaagcgcatcaaaaagtacttcgaagacaaccgtgaaacctggagcgacatcaacctcagcaagattgaggtgtactacttttccaaggacacgaaggatcgcttcttcgccacccggaaacccctggacaccagcttcgaccgcaaaaagatcgagaacaacatcaccgacacggggatccagaaaatcctgctccggcacctggagcttaaggacaacaaccccgacatcgccttctcccccgacggcatagacgaaatgaaccgcaacatcatccaactcaacaacggcaagtatcaccagcccatcataaagatccggtggtacgagcaggccgacaaattcgcggtcgggcaaacaggcaacaagttcagcaaattcgtggaagccgccaaggggaccaacctgttctttgctgtgtatgagtccaacatcttagataagaagacaaacacgatcatcaagaagcgcaactacgcgactatccctctcaacgtcgccatagagcggcagaagcagggcctccctgtggctcccgaggacgagaacggtaacgacccgatcttcgtgctgagccccaacgaccttgtctacctgcccaccgacgacgagctagccaatggcatcatcgcccagcccctcgaccgcggccggatctacaagatggtgagctgcacaggcaacgaggggcacttcatcccggcgcgcatcgccaatcccatcctgcagacgatcgagctggggagcaacaacaaggcccagaaggcctggaccgacgaaatgatcaaggaaatttgcatgcccatcaaggtcgaccggctcggcaacgtgctcgagtccagcagcagctacaagaagtga

SEQ ID NO: 8061 - RNA, 4521 nt, synthetic construct
  misc_feature 1..4521: note = Cas9 variant
  source 1..4521: mol_type = other RNA
atgaagaccatcctgggactcgacctggggcccaacagcatcggctgggccaaggtggaggtcgacgatgaggggaactatctgcgcaacatcaagttaggctcccggatcatcccgatgacccaggacatgctgggggacttcgacaagggcgtgaaggtaagccagacggccatccgcaccgacttccggggcaaccgccggctgatagagcgccacctcctgcgacgcgagcggctgcaccgcgtcctccacgcgctgaagttcctgcccaagcactacgaggacgccatcgggtgggaccggaacgagcccgccacctacggcaagttcgtgaacaactccgagcctaagctcgcctgggagaggcaggaggacgggagcatgcgattcctgttcatggagagcttcaacgagatggtcgccgacttcgcgcagaaccagccgagcctggtctccgacggcaagaagattcccctcgattggaccatctactacctgcgcaagaaggccctgacgcgccccatcaagaaggaggagctcgcttggatcctgcttaacttcaaccagaagcgcgggtactaccagctccggggagaggaggaggaggataacctgactaagcgcaaggagtactacaagctgaaggtggtgggcgtcgaggcggacggggcgcccaagggcgggaaaacctggtacaacatccacctcgagaacggttggaccgcccggtgccagagcaagatcccgctcgacgactgggtgggcaaggtaaaggagtacatcgtcacgaccgagtacgaggacgacgggaagaccccgaaatgcgacaaggagggcaaggtgaagcgctctttcaagagccccgagaaggacgactggcagctgattaaaacccggacggagaagttcatcgacgactccaacaagaccgtgggggccttcatctatgattacctcctggagaagcccttcgacaagatccgcggcaagtacatccgcaccattgagcggaagtactacaagaacgagctgcgcgagatcctccgggagcaaaccaagtaccacgaggggctgcacagcttagaagccttgaagatttgcgccgaggagctgtacaagaacaaccaacagcaccaggaatacctgctcaagaaggacatgacgttcctgctgcttaacgacttaattttctaccagcgccctctgaaatccaagaaatccctcatcgcggactgcccctacgaggtctacaagtacgacgataagctgaccggcaagaagggacagaagaagatcaagtgcatcgccaaaagcaacccctactatcaagagttccggctgtggcagttcatcgccaacctccgcctgttcagcgtgaccgacggaaaggaggtgaccgccgagtaccttaagacggaggaggactatgtccgcctcttctccttcctgaacgacaggaaggatatcaagcaggagaccttccttcggagcttcctgaaactcaagaaggagtccatcggcagcgagaagatctaccccatccgctggaactacatcgaggacgctaacaagagctacccgtgcaacgcgacccggcacgagctgctgctcgccttcgaccgcgccgacatccctcgtgagctgctggacgtagaggagcgcgagtaccggctctggcaccttctctattccatcgaggccaaggaagagaccgagagcgccctccgcaagctgaaggcgaacaaggccttcggggacctgaacatcgacgacgccttcgtgaactccttcctcaagatcaagcccttcgagaaggagtacggcgcctacagtgagaaggccatcaaaaagctgctcgcggtcatgcggcgcgggtccctctggaaggaagcagacatctgcgaagccaccaagcagaacatcgccaagatccttcaaaacgacatcgacgagaagctgaaaaagaagatcgaggcggccgtgagctccttcaacaagctcagcgacttccagggtctgcccacctggctggcatgctacgtggtctacggccggcattccgaggcagcccaaatccagtgttggcagagcccggaggacttgaagacctacatcaacaagttcaagcagcactcgctgcgcaaccccatcgtcgaacagtgcctgctcgagaccctgcgcacggtctacgacatctggaaggatgcggggcagatagacgagattcacatcgagttaggccggaacatgaagtccaccgccgagcagcgcgcccggaagactaaggacatcctccgcaacgagaacaccaacctgcggattaagaacctgctcgtggagctaaagaacgacgacaagatcgagaacgtgcgcccctacagccccagccagcaggagatcctgcggatctacgaggagggggccttacaggagctgagtaaagaggacgagatgttcgaggacatcagcaagatctctaagatggcccagccgagccccacggagctttcccgctacaagctctggctggagcagaagtaccggtcgccctacaccggccgcgtgatccccctgagcaaactcttcaccaccgcgtaccagatcgagcacatcatcccgcagtcccggtacttcgatgacagcttcaacaacaaggtgatttgtgagtccgaggtgaacagcctgaaggacaacatgctggggtatgagttcatcaaggagtgcggcggccgcatcgtccactgcacgctcctgggggacgtgaagatcttcaccaaggaggagtacaaggacttcgtgactaagcactacatcgacaacacctataagcgggacaagctgctcctggaagacatcccccaggagttctccgcccgccagctgaacgacagccggtacatctccaagatggtccagacggtgctcagcaacatcgtgcgcgccgaaaacgagcaggaagccacgtccaagttcgtcgtgagctgtaacggcgccatcaccaaccggctgaagaaggactgggggctgaacgacgtgtggtcctctatcgtgtgcccgcgcttcaagcggctcaacgagatcacgaagaccaacgcgttcggccattgggaggacaaggccggaaagcacgtgttccagacgacagtgccactggagctgcagcgcgggttctccaagaagcggatagaccaccgccatcacgccatggacgccctcgtcatcgcgtgcgccagccgcaatatcgtgaactaccttaacaacgaatccgccaacagccccgagaaacgggaggacctgagaaagaagctatgcgacgagaagcggaaaatccgcaagccctggaagaccttcacccaggacgcgcgggaggccctgtccgacgtggtagtgagcttcaagaactacgtgcgcgtcatcaacaaggcgacgaactactacgagcactacagcagcagcggcaacaaggtgatgatctcccagaaggggaatgacatgtgggccatccggaagcccctgcacaaggagagcgtctttggacgcgtcaacctctgccggaaagtgatcgtgagcctgaagaaggccctggagaacatcccggctatctgtgataaaaccctccgggactacatcaatgccctggtagagaagcatttcaacacccggcagctgctcgcgcacttcaagagcatcaactaccgccttaacagacagtgcgttgaaaaggtggaggtctggcagttctccgacgagaagatcgagatggtggcccgccgcaagagcctggacacctccttcgacgacaagcagatcagctccatcacggacaccgggatccagaagatcctcctaaactacctgcagaccaaggacggcaacgccgagatcgccttcacccccgagggtatagaagagatgaacaagaacatcagcctgtacaatgacggcaaggcccaccagcccatcctgaaagtgcgggtcgcgacgcccaagggcatgaagtacccggtggggcagactggcaacaaggccaccaagttcgtggtcgccgagaaggggaccaacctgtacttcgccatctacgagaacgagcttggcgtgcggtcctacgacacgatccccctgaacatcgtggtcgagcgcctgaaggaaggcctcagccccgtgccccaggcgaacgaggccgacatcccgctgaagttctacctgtcccccaacgacctcgtgtacgtccccacgaaggagaacgaggacgagctgtgccgggaccgcatctataagttcgtggacagctctgggacaaccgccaatttcgtaccccacacgagcgccaacaccatctacaacgtcgacaaggagtacgccgagaagtgctgcaacggcgcggtgttcctgaacgagtacgggctcggctccccacagagcaagaaccaacgcgccctgaccggggagatgatcaaggagatctgctggaagctgaaggtggaccggctcggcaatatcatcaaggtcatcaagtga

SEQ ID NO: 8062 - RNA, 4530 nt, synthetic construct; identical to SEQ ID NO: 2262
  misc_feature 1..4530: note = Cas9 variant
  source 1..4530: mol_type = other RNA

SEQ ID NO: 8063 - RNA, 4530 nt, synthetic construct
  misc_feature 1..4530: note = Cas9 variant
  source 1..4530: mol_type = other RNA
atgaagcgcatcctgggcctcgacctggggaccaactctatcggctggtccttaatcgaacacgacttcaagaacaagcaggggcagatcgaaggcctcggggtgcggatcataccaatgagccaggagatcctgggcaagttcgacgccggccagtccatcagccagaccgccgaccgcacgaagtaccgcggggtccggcggctgtaccagcgcgacaacctccggcgcgagcggctgcaccgcgtgctgaagatcctcgacttcctgccgaagcactactccgagagcatcgacttccaggacaaggttggccagttcaagcccaagcaggaggtcaaactgaactatcggaagaacgagaagaacaagcacgagttcgtgttcatgaactccttcatcgagatggtgagcgagttcaagaacgcgcagcccgagctgttctacaacaaggggaacggcgaggagaccaagatcccctatgactggaccctgtactacctgcgcaaaaaggccctcacccagcagatcacgaaggaggagctggcctggctgatcctcaattttaaccagaagcgggggtactaccagctgcgcggcgaggacatcgacgaggacaagaacaagaagtacatgcagctgaaggtcaacaacctcatcgactccggcgccaaggtgaagggcaaggtgctgtataacgtcatcttcgacaatggctggaagtacgagaagcagatcgtgaacaaggacgagtgggaggggcggaccaaggagttcatcatcaccaccaagacgctgaagaacggcaacatcaaacgcacctacaaggccgtggacagcgagatcgactgggcggccatcaaagccaagaccgagcaggacatcaacaaggccaacaagaccgtcggcgagtacatctacgagtccctcctggacaacccgagccagaagatccgggggaagctggtgaagacgatcgagcgcaagttctacaaggaggagttcgagaagctcctgtccaagcagatcgagctgcagcccgagctgttcaacgagagcctctacaaggcgtgcatcaaggagctatacccccggaacgagaaccaccagtccaacaacaagaagcagggcttcgagtacctcttcaccgaagacatcattttctaccagcgccccctcaagagccagaagtccaacatcagcgggtgccagttcgagcacaagatctacaagcagaagaacaagaagaccggcaagctggagctcatcaaggagccgatcaagaccatatcccggagccaccccctgttccaggagttccgcatctggcagtggctgcagaacctcaagatctacaacaaggagaagatcgagaacgggaagctcgaggacgtgacgactcagctgctccccaataacgaggcctacgtcaccctgttcgacttcctgaacaccaagaaggagctcgagcagaagcagttcatcgagtacttcgtgaagaagaaactgatcgacaagaaggagaaggagcacttccgctggaacttcgtggaggacaagaagtaccccttcagcgagacgcgggcccagttcttgtcccgcctcgccaaggtcaagggaatcaagaacaccgaggacttcctgaacaaaaatacccaggtgggcagcaaggagaactccccgttcatcaagcggatcgagcagctgtggcacatcatctactcagtgtccgacctgaaggagtacgagaaggccctcgagaagttcgcggagaagcacaacctggagaaggacagcttcttaaagaactttaagaagttcccgcccttcgtctccgactacgccagctactccaagaaggctatcagcaagctcctgcccatcatgcgcatggggaagtactggtccgagagcgcagtgcccacccaggtgaaggagcggtccctaagcatcatggagcgcgtcaaggtgctccccctgaaggagggctactccgacaaggacctggccgacctcctgagccgggtctccgacgacgacatccccaagcagctgatcaagagcttcatctccttcaaggacaagaaccccctcaaggggctgaacacgtaccaagcgaactacctggtgtacggccgccacagcgagaccggggacatccagcactggaagaccccggaggacatcgaccggtacctcaataacttcaagcagcactccctgcgcaaccccatcgttgagcaggtcgtgatggagaccctgcgggtggtccgcgacatctgggagcactacggcaacaacgagaaggacttcttcaaggagatccacgtggagctcggccgggagatgaagtcccccgccggtaagcgcgagaagctgagccagcggaacacggagaacgagaacaccaaccaccgcatccgggaggtattaaaggagctcatgaacgacgcctccgtcgagggcggcgtgcgcgactacagcccctcccagcaggaaatccttaagctgtacgaggagggcatctaccagaacccgaacaccaactacctcaaggtggacgaggacgagatcctgaagatccggaagaagaacaaccccacccagaaggagatccagcgctacaagctgtggctcgagcaggggtacataagcccctacacgggcaagatcatccccctgacgaagctgttcacccacgagtaccagatcgaacacatcattccacagtcccgctactacgataacagcctcggcaacaagatcatctgcgagtccgaggtcaacgaggacaaggacaacaagaccgcctacgagtatctgaaggtggagaaggggagcatcgtgttcggccacaagctgctcaatctggacgagtacgaggcccacgttaacaagtacttcaagaagaacaagacgaagctgaagaacttactgtccgaggacatccccgaggggttcatcaaccggcagctgaacgatagccgctacatctccaaactcgtgaagggcctgctgagcaacatcgtgcgggagaacggcgagcaggaggctacctccaagaacctcatccccgtcaccggggtggtgaccagcaagctgaaacaggattggggcttaaacgacaagtggaacgagatcatcgccccgcgcttcaagcggctcaacaagctgaccaactccaacgacttcgggttctgggacaacgacatcaacgccttccgaatccaggtccccgacagcctgatcaagggcttcagcaagaaacggatcgaccaccgccaccacgccctcgacgccctggtggtggcgtgcacgtcccggaaccacacccactacctgagcgccctcaacgccgagaacaagaactactccctccgcgacaagctggtcataaagaacgagaacggggactacaccaagaccttccagatcccctggcagggcttcacgatcgaggccaagaacaacctcgagaagaccgtggtgagcttcaagaaaaacctgcgggtcatcaacaagaccaacaacaagttctggtcctacaaggacgagaacggcaacctgaacctcgggaaggacggaaagcccaagaaaaagctgcgcaagcagaccaagggctataactgggcgatccggaaaccgctgcacaaggagacggtgagcggcatctacaacatcaacgcccccaagaacaagatcgccacctccgtgcgcactctcctgaccgagatcaagaacgaaaagcacctggccaagatcacggacctccggatccgcgagaccatcctgcccaaccacctgaagcactacctcaacaacaagggggaagccaacttcagcgaagcgttctcccagggcggcatcgaggatctgaataagaagatcacaaccctgaacgaggggaagaagcaccagcccatctaccgggtcaagatcttcgaggtgggcagcaagttctccatcagcgaggacgaaaattccgccaagagcaagaagtacgtggaggccgccaaggggaccaacctcttcttcgccatctacctggacgaggagaacaagaagcgcaactacgagaccataccgctgaacgaggtcatcacccaccagaagcaggtcgcgggcttccccaagtccgagcggctcagcgtgcagcccgactcccagaaggggaccttcctgttcacgctgagccccaacgacctcgtgtacgtgccgaacaacgaggagctggagaaccgcgacctgttcaacctcggcaacctgaacgtggagcagatctcccggatctacaagttcacggacagcagcgacaagacctgcaacttcatccccttccaggtctccaagctgatcttcaacctcaagaagaaggagcagaagaagctagacgtggacttcatcatccagaacgagttcggcctggggagcccccagtccaagaaccagaagtccatcgacgacgtgatgatcaaggagaagtgcatcaagctcaagatcgaccgcctgggcaacatcagcaaggcctga

SEQ ID NO: 8064 - RNA, 4530 nt, synthetic construct
  misc_feature 1..4530: note = Cas9 variant
  source 1..4530: mol_type = other RNA
atgaagacgatcctgggcctcgacttagggaccaacagcgtcgggtgggccgtcatcaactccgtgatcaaggagcaggccgagagaatatggatcgagatggcggggtctcggatcatccccatggacgcggccgtgcttggcgactttgacaaggggaatagcattagtcagacgtccgagcgcacccggctacgtggcgtccggaggcttcgggagcgccagctgctccggcgcgagcgactgcacaaggtgctgaacatcctcggcttcctgccgaaccactacctggagtacatcgacttcgagaagcaccccgggaagttcctcagcgacgccgagcccaagctgccctgggtgaaggacgaacagggtaaatacaccttcctgtttcaggcggcgttcgatgagatgctcgccgacttcgctatccaccagccgtccctggtcagcggggacaagaagataccctacgactggaccatctactacctgcgcaagaaggccctcacggagatgatctccaaggaggagctggcgtggatcctgctcaacttcaaccagaagcggggctactaccagctgcgcggggaggaggaggaagacaacgctggcaagagcgtggagttttacgcgctgaaggtgctcaccgtcgaggccacggacgagaagaagggcagagacgtgtggtacaacgtgcacctggagaacgggtggatctaccgcaggtccagctccgtgcccctggactgggagggccaaatcaaggagttcatcgtgaccacggacctcaaccccgacagcaccccgaagctggacaagtacggggaggtgaagagatccttccgcgccccgaaggaggacgactggatgctgataaagaaacgcaccgaggccgacatagccaacacccacaagacggtcggcgcttatatctacgacacgctcttgcagaagccccaacaaaagatcatcggcaagctggtgaagaccgtggagcggaagctctaccgcgacgagctgagcttaatcctccagaagcaatgcgccttccacgccgagctgcaggaccgcaccctgtacgcgcggtgcgtcgaggccctgtaccccaataacgaggtccaacgcaggaacatcgctaaccgcgacttcgtgtatctgctgatggacgacgtcctattctaccagcggccgctgaagacgaagaagtccttgatagccaactgcccctacgaggagaacgagtacgtggaccgcgagaccggggagatcaagaaagcgccgcttaagtgcatcgccaagagccaccccctgttccaggagttccggctgtggaacttcctctccaacatccgcatctaccagaaggagaaggagatcaacggcaccctgcacctggacgtggacgtcaccgccgagttcctgaagacggaagacgactacgtggccctcttcgactggctgaacagccggaaggagattgagcagaagaccttcctgaagtacccaaagttcgggttgaagaaggaaatctcaaattaccgctggaactatgtcgaggacaagcagtacccctgcaatgagacccggcacgccatcctgagccgcctggaaaaggccaacgtgtgcatcgacttcttaagcaacgagaaggaggttgcgctgtggcacatcctgtactccgtcagcgacaaacaggagatcgagaaggccctccggaccttcgccgccaagaacggactcgacgagtcattcgtggaggcgttcaagaagttcccgcccttcaagagcgagtacggggcctactccgccaaagccatcaagaaactgctccccctgatgcgctgcggcaaatactgggacgtgagcagcatagacgacacgaccaaagagcggattaagaaaatcgtcgccggcgagtacgacgagcgcatcgcggtgaaggtacgggacaaggtcatgaatctgagcgacatctcctgctttaagcgattgcccctgtggctggcctgctacatcgtgtacaaccgccacagcgaggacaaggaggccgtgaagtgggagtcgcccgccgacatcgacgcctacctcgcatcctttaagcagcattccctgcgcaatcccatcgtggagcaggttatcacagagaccctgcgcgtggtgcgggacatctggaagcaagtcggacgcatcgacgagatccacatagagctcggccgggagatgaaaaacccggccgacaagcgcaaacggatgacagcccagatcctggagaacgaaaacgccaatctgcgcatcaaagccctactggccgagttcatgaaccccgagtacgaaatcgaaaacgtgcggccctacagcccatcccagcaggagatcctccgcatctacgaggacatggtgctccacgctgaagaccaactgccggaggagatagacgccatcctgaagaagttcaacagcagtaaggtgcccaccaagagcgagttcctccggtacaagctgtggctggagcagaagtaccgcagcccgtacaccggggagctcatcccgctgggcaaactgttcaccgccgcgtacgagatcgagcacgtgatcccccagtcccggtacttcgacgacagcttctccaacaaggtcatatgcgagagcgccgtgaacaagctcaaggacaaccagcttgggtacgagttcatcaagaaccaccacggccagaaggttgaggttggctttggtaagtccgtcgagatcttcagcgtggactcctatgagcgcttcgtcaaggagcaatacgccaagagcgccgtgaagatgaagaagatgctgatggacgacatccccgagcagttcattgagcggcagctcaacgattcgcgatatatctcgaaagtgatcaaggggctgctgtccaacatcgttcgggagaagaacgactccggggagtacgagcccgaggccgtgtccaagaacatcgtggtctgtacgggcagcgtgaccgaccgcctcaagcgggattgggggatgaatgatgtgtggaactcgatcgtctacccgcgattcgagagactcaacagcttaacggacacgcagtccttcggccactgggagaacaagagcggcaaaaaggtgttccagacggagctccccctggagtatcagaaggggttcagcaagaagcgcatagaccaccggcatcacgcgatggatgccatcgtgatcgcctgtgccacccgcaaccacgtgaactacctgtccaatgagagtgcctcccgcaacgcgaagatctctcggtacgacctccagcgcctgctgtgcgacaagtcccggaccgacgacaacggcaattacaagtgggtgatcaagaagccctgggataccttcacccaggacgcccgcgaggtgttaagcaagatcgtcgtgtccctgaagcagaacctgcggatcatcaacaagacaactaacgtgtaccgccacctcgatgcaaccgggaaccgggtctacgagaagcagaaaaccggcgacagctgggccatccgtaagcccatgcataaggacacggtgttcggggcggtgaacctgcggaaggtcaaggttgtgcgactgtccgtcgcgctcgacgccccgaccatgatagtggacaagcgggtcaagaacaaggtgttcgagctgctgtcttacaagtacgataagaagcgcatcgagaagtacttcaaagagaacgccgtcctctggaaggaactggacctggcgcgggtcgcggtgtactactttacggaggccaccacggagcccctcgtggctgtcaggaagcccctggactccacattcaacgagaaaaagattaaggagagcgtaacggacaccgggatccagaagatcttactcaaccacttatgcacgaaggagggcaagcccgacctggccttttccgccgagggaatcgaggagatgaaccggaacctcttgcagctgaacaacggcaagcgccaccagccgatctacaaggtgcgggtctacgagccccgcgggaacaagtttagcgtgggcgtgctcggcaataagggtaccaagtgggtcgaggcggccaagggcacaaacctgttcttcgccatctatatcaccgaggacgggaagcggacgtatgagacaatacccctgaacatggtcatagagcgcgaaaagcaaggcctcgcccccgtgcccgacaaaaacgagaagggggacaagctgctgttctggctctcccccaacgacctggtctacctgcccaccgaggaggagctcgagtttggccgcattaacgagcccatcgatagaggacgcatctacaagatggtaagctccagcgggaaccagtgcttcttcatcccacaatccatcagcaacgccataatccccaccaaggagctgggcgcgaacaacaaggctgagagaagctgggacggggccatgatcaagaacatctgcatcccggtgaaggttgatcgcctcggcaggataatcgaggtgaagtaccgcatcaacgagtga

SEQ ID NO: 8065 - RNA, 4530 nt, synthetic construct
  misc_feature 1..4530: note = Cas9 variant
  source 1..4530: mol_type = other RNA
atgaagacaatactgggcctcgacctggggaccaactccgtgggctgggccgttatcaacagcgtgatcaaggagcaggctgagcgtatttggatcgagatggcgggaagccggatcatccctatggatgccgccgtactgggtgacttcgacaaggggaactccattagccaaacgtccgaacgaacgcggctccgcggcgctcggcgcctgcgcgagcgccagctgctccggcgcgagcggttacataaggtgttgaacattctcggattcctgccgaaccactacctggagtacatcgattttgagaagcaccccgggaagtttctcgccgacgcagaacccaaactggcgtgggtgaaggacgagcagggaaagtacaccttcctcttccaggccgcgttcgacgagatgctagcggacttcgccatacaccagcccagcctggtgtccggggacaagaagattccgtacgactggaccatctattacctcagaaagaaagccctcacggagatgatcagcaaggaggagctcgcctggatcctgctaaacttcaatcagaagcggggctactatcagctgcgcggggaggaggaggaggacaacgccggcaagtccgtcgagttctacgcgctcaaagttctcaccgtggaggccaccgacgagaagaagggccgggacgtctggtacaatgtgcatctggagaatgggtggatctatcgccggagctccagcgtgccgttggactgggagggccaggtaaaggagttcatcgtgaccacggacctcaaccccgacgggacacccaagctggacaagtacggcgaggtgaagcgctcctttcgggccccgaaggaggacgactggatgctgatcaagaaacgcaccgaggccgacatcgccaacacccacaaaacggtcggtgcgtacatatacgacaccctcctccaaaagccccagcagaagatcatcggaaaattggttaagactgttgagcgcaaactctaccgcgacgaactcagcctgatcctccaaaagcagtgcgcattccatgccgagctgcaggaccgcgccctgtacgcgcggtgcgtcgaggcgctctacccctcaaacgaggtgagacggaagaacatcgccaaccgcgattttgtttaccttctgatggacgacatcctattttaccagaggcccctgaagaccaagaaatccctgattgccaactgcccgtacgaggagaacgagtacgtcgaccgggagacgggagagattaagaagacgcccttaaagtgtatcgccaagagccaccccttattccaggagttcagactctggaacttcttgagcaacatccgcatctaccagaaggagaaggagatcaacggtacccttcacctggacgtagacgtgaccgccgagttccttaagaccgaggacgactacgtcgccctcttcgactggctgaactcccggaaagaaattgaacagaagaccttcctgaaataccccaagtttggcttgaagaaggagatcagcaactatcgctggaattacgtggaggacaagcagtacccttgcaacgagaccagacacgccatcctgagctccctggagaaggccaacgtctgcatcgacttcctcagcaacgagaaggaggtggccctgtggcacatactgtacagcgtgagcgacaagcaggagatcgagaaggcgctccgcaccttcgccgccaagaacggtctggacgagtcattcgtcgaggcgttcaagaagttcccgccctttaagtcagagtacggcgcctacagtgcgaaggcaatcaagaagatgctgcctctcatgcgctgcggcaagtactgggacgtgtcttctatcgacgatacgaccaaggagcgcatcaagaagatcgtgaccggggagtacgatgagcgcataagcgtcaaggtgcgcgacaaggttatgaacctgtccgacataagctgcttccggcgcttaccgctctggctggcctgttacatcgtgtacaaccgtcactccgaggacaaggaggccgtgaaatgggagagccccgccgacatcgacgcatacctggcctccttcaagcagcacagcctccgcaaccctatcgtggagcaggtcataaccgaaacgctgcgcgtggtccgggacatctggaagcaggtcggcagaatcgacgagatccatatcgaactgggacgggagatgaagaaccccgccgacaagcgcaagcggatgaccgcccagatcctcgagaacgaaaacgccaacctacgtatcaaggcgctgctcgccgagttcatgaacccggaatacgagatcgaaaacgtacggccttactcccccagccagcaggaaattctgcgcatctacgaggacaccgtgctgcacgcagaggaccagctacctgaagagatcgacgccatcttgaagaagttcaactcctcaaaggtcccgacaaagagcgagttcctgcgatacaaactctggctggagcagaagtaccgctccccctacacgggggaactgatccccctcggcaagctgttcaccgcggcctacgaaatcgaacacgtgatacctcagagcaggtacttcgacgactccttcagcaacaaggtaatctgcgagtccgcagtcaacaagctgaaggacaaccaactcggttacgagttcatcaagaaccaccacggtcagaaggtggaggtggggttcggcaaaagcgtcgagatcttctccgtggatagctacgagaggttcgtgaaggaacagtacgccaaatccgccgtcaagatgaagaagctgctgatggacgatatccccgaacagttcatcgagcgccagctcaacgatagccgctacatctccaaggtaatcaaggggctgctgagcaacatcgtgagagagaagaacgactctggcgagtacgaacccgaggcggtcagcaagaacatcgtggtttgcaccgggtccgtcaccgaccgcctcaagcgggactggggcatgaacgacgtttggaacagcatcgtgtaccctcgcttcgagcgtctgaactccctgacggacacccagagcttcggccactgggagaacaaaagcggtaaaaaggtcttccaaacggagctccccttggagtaccagaaaggcttctccaagaaacgcatcgaccaccgccaccacgccatggacgccatcgtaatagcatgcgccacacgcaaccacgttaactatctaagcaacgagtccgccagccgcaacgccaagatttcccggtacgacctccaacgcctgctgtgcgacaagaacaggacggacgacaacgggaattacaaatgggtcatcaagaagccctgggacacgttcacccaggacgcccgcgaggtcctcagcaaaatcgtggtctccctgaagcagaatctgcgaattatcaacaaaaccaccaacgtgtaccgccacctagacgccaccggcaacagagtgtacgagaagcagaagaccggcgacagctgggccattcgcaaacccatgcacaaggacaccgtcttcggggcggtaaacctgcggaaggtgaaggttgtgcgcctgtccgtggccctcgacacccccgccatgatagtcgacaagagagtgaagaacaaggtgttcgagctcctatcgtataagtacgataagaagcgaatcgagaagtacttcaaagagaatgcatttctctggaaggagctggacctggcgaaggtggctgtgtactactttacggaagcgaccaccgagccgctcgtcgccgtgcggaaacctctggactccaccttcaacgagaagaagatcaaggaatcggttacggataccggcatacagaagatcctgctgaaccacctgtgcaccaaagaaggtaagccagacctggccttctccgcagagggcattgaggagatgaaccgcaacctactccaactgaataacggcaaaagccaccaaccaatctacaaggtccgggtttacgagcctagagggaacaagttctccgtgggcgtcttagggaacaagggcactaagtgggtggaggccgccaaggggacgaacctgttcttcgcaatttacatcacagaggatggcaagcggacctacgagaccatccccctgaacgtggtaatcgagcgcgagaagcagggacttgtgcccgtgccggaccgcaacaagaagggcgacaagctgctgttctggctcagcccgaacgacctggtctacttgcccacggaggaggagcgcgagttcggccgcatcaacgagcccatagaccgggggcgtatctacaagatggtgtcctgtaccggcaacgagggccacttcatccccgccaacgtcgcgaacccaatcgtgcccgtgatcgagctagggagcaacaacaaggcccaaagagcctggaccaacgagatgatcaaggatatctgcatacctatcaaggtggaccgcctggggcacatcatcgaggtaaagtacaggatcgacgagtga

SEQ ID NO: 8066 - RNA, 4530 nt, synthetic construct
  misc_feature 1..4530: note = Cas9 variant
  source 1..4530: mol_type = other RNA
atgaagaagatcctgggcctcgacctggggaccaacagcgtgggctgggccgtcatcaactccgtggtgaacgacgaggggaaagagcagctggtcaacataagctcctgcggcagccgcatcatccccatggacgccgcgaccctcggtgacttcgacaagggcaattccaagagcccggtggccgagcggacacggctgcggggcgtgcgccggctgctcgagcgatccctgctgcggcgcgagcggctccaccgcgtactgagcgtgatggggttcctgcccgagcactacgccgcccagctcgaccggtacggcaagttcctgcccgagaccgagcccaagctcgcatggtacaaggacgagaccgggaagtacagatttttgttccaggactccttcaatgagatgctggaagacttccacgagcaccacccggagctggttgcggagggcaagaagatccactacgactggaccatctactacctccggaagaaggccctgagccagaagatcaccaaggaggagcttgcgtggatcttactgaacttcaaccagaagcgcgggtactaccaactgaggggcgaggaggagcaggaagacaacaaaaagtccgtcgagtactacgccctcaaggtggtggcggtcgaggacagcggggaccgcaaggggaaggacatctggtacaacgttaagctggagaacggctgggtgtaccggcgcgcctccggtgtccccctggactgggtgggcaaggtgaaggagttcatcgtcacaaccgacctcgacgaaaagggcaaccccaagaaggacaaggacgggaacgtgaagcggagcttccgcgccccaaaggaagacgactggggcctgctgaagacccggacgcaggcccagatcgacgagtccgggcaaacggtgggcacctacatctacgagagcctcctgcgcatgccggatcagaagatccgcggtaagctggtccggaccatcgaacgcaaatactacaaggacgagctccggaagatcctgatcaagcagtccgagttccacacggccctgcaggaccacaacctcctgcttgcgtgcatcgaggagctctacccaaacaacgaggcccaccgccggctgctgtctacctccgatttcacctacttcctcgtggaggacattctgttctaccagcgccccctcaagtcccagaagggccagatagacgactgcccatacgaaagccacgtgtaccgggacaagaaggacggctccttgcagcacgtcccgctgaagtgcgtgagcaagtcccaccccctgttccaggagttccgcctctggcacttcctgagcttcctgcggatctaccagcgcgaacggatgatcgacgggtctctgaagctcgacgtcgacgtgaccaacgagttcctgcagaacgaggacgactacgtgaagctattcgactggctcaacgagcgcaaggagatcgaccagaagactatcctggcctacaagcccttcggcctgaagaagaacgagcagagcaagtaccggtggaactacgtagaggacaagtcctacccctgcaatagcacccgcgccgatatgatcttccggttatccaaggccggtgtgccggaggagttcctgacccgggaaaaggaggaggcactgtggcacatcctctactctatctccgacaaaaaggaattaaccaaggcgctgggcacattcgcggagaagaacgggctcaacgaaacctttgtggagattttcagcaagatgccacccttcgagtccgactacgccgcctacagcctgaaggcgatccggaagctgctcgccctaatgcgcatgggcaagtactgggacgagcaggccatcgacgaacacacccggtcccgcatcgagaagattctgaccggcgagtacgacgagacgattcggaccagggtccgcgagaaggccatgcacctcaccgacatcagctccttccgggggctgcccctgtggctggcctgctacgtggtgtacgaccgccacagcgaggcgaaggagctggtcaagtgggagacccccgacgacatcgaccattttctgcggaagttcaagcagcactccctccgcaaccccatcgtggagcagatcatcatggagacgctgcggaccgtgcgcgacatttggaagcaggagggcaaaatcgatgagatccacgtcgagctggggcgggagatgaagaaccccgctaaggagcgcgcccggatcaccgcccaagtgctcgagaacgagaacaccaacctgcggatcaaggcgctgttagccgaatttatgaaccccgagttcgagatcgagaatgtgcggccgtacagccccgcccagcaggagatcctacgcatctacgaagagggcgtcctgtccggggtggccgagaaggacctccccgacgacatcgccagcattctgaagaagttccgggagaacgacgtgaagaagcgccccacgaccagcgaggtcttgcggtataagctctggctggagcagcgctacagatccccgtacaccggccgcatcatcccccttggcaagctgttcacacccgcgtacgagatcgagcacgtgatcccgcagagccggtacttcgatgattccttcacgaacaaggttatctgcgagagcgccgtcaacaagctgaaggacaactgcctggggtacgagttcgtgaagaagcactccggcgagaaggtggagctagggaacggcgagaccgccaccatcttctcagttgaggagtacgagcgcttcgtgaaggactcctacttcaacaactcgaagaagatcaagaagctgctgctcgaggacatccccgacaacttcatcgagcgccagctgaacgactcccggtacatcagcaaggttgtgaagtccctgctcagcaacatcgtgtgcgaggagggcgagcaggagggtatgtccaagaacgtgatcgtctgcacaggcggagtgaccgaccgcctgaagaaggactggggcgtgcaggacgtctggaaccggatcatcctgccccgcttccttcggctgaacaagatgacggaccgcaccgatttcaccgccgtgagcaccaacgggcacctcctgcccgccgtgccactacacctccagaagggcttcaataagaagcggatcgaccaccgccatcacgcgatggacgccatcgtcatcgcctgtgccggccggaacatcgtcaactacctgaacaacgcctccgcgcgcaaggggagcgagatcagcaggtacgacctgcagcatctcctttgcgacaaggtgaagacggacgccaacggcaactacaagtggatcctgagaaagccctgggagaccttcacccaggacctgtacgccgccctcaccaacatcgtcgtgtccttcaagcaaaacctgcgggtgatcaaccgcacgaccaaccactaccagcactacaacgaggacggggagaagaagatgatccctcagaccaagggcgaccgcctggcgatccgcaagcccatgcacaaggacaccgtctacggggaggtcaacctccggaaggagaagacgctgccgctgaaggacgtggtcaagaaccccagcgccgtggtggacaaatccctcaagaacaagttgtacgagctcctcaagagccagtacgatctgaaggcaatcaccaaatacttcgagacccaccaggacgtctgggccgacgtgaacctgaagaagatcaaggtgtactacttcaccaaggagacgaatgagcgcttcttcgccacccggaagtcattagacagctccttcagccagaagaagatcgaggaggaggttaccgacaccggcatccagaagatcctgctccgtcacctccagcagaacggcaacaaccccgacatagcgttctcccccgacggggtggagagaatgaatcagaacatgacgatcctgaacgacggcaagtggcaccagccaatctacaaggtccggacctacgagaaggccgacaagttcgccgtgggggagaagggcaacaaggtgaagaagttcgtcgaggccgccaaggggaccaacctattctttgcggtgtatgagagcatccaggaggacgaagcaaccggtaagcaggtccgcaagcggacgttcgccaccatccccctcaacgaggttataaagcgcaagaagcagggcctgccggccgcccccgaggactccaaggggaacttaccgatctttgtgctcagccccaacgacctggtgtacctgccgaccgaagaggagcggaactccggcaagatcatccaacccttggaccgcgagcggatatacaagatggtcagttgtactgaaggggagtgccactgcatcccggagtacgtggcgaaccccatcctgcagacgatcgagctggggtccaacaacaaggcccagcgcgcctggagcggggagatgatcaaggaaatctgcgtgcccgtcaaagtggacagactcggcaacgtgtccctgatcaagatctga

SEQ ID NO: 8067 - RNA, 4530 nt, synthetic construct
  misc_feature 1..4530: note = Cas9 variant
  source 1..4530: mol_type = other RNA
atgaagaccatcctgggcctcgacctggggaccaacagcgtgggctgggccgtcatcaactccgttatcaaggagcaagccgagcgcatctggatcgagacggcggggagccggatcatccccatggacgccgccgtgctgggcgacttcgacaaggggaactccatcagccagacctccgagcgcacccggctccgcggcgcccggcgcctgcgggagcgccagctgctccggcgcgagcggctgcacaaggtcctgaacatcctcggcttcctgccgaatcactacctggagtacatcgacttcgagaagcaccccggtaagttcctcgccgacgcggagcccaagctggcctgggtgaaggacgagcagggaaagtacaccttcctgttccaggccgccttcgacgagatgctcgcggactttgccatacaccagcccagcctggtgtccggggacaagaagatcccgtacgactggacgatctactacctgcgcaagaaggccctcaccgagatgatcagcaaggaggagctggcctggatcctgctcaatttcaaccagaagcggggatactaccagctgcgcggggaggaggaggaggataacgccggcaagtccgtcgagttctacgcgctgaaggtgctcaccgtggaggccaccgacgagaagaagggccgggacgtctggtacaacgtgcacctggagaacgggtggatctaccgccggagctcaagcgtgcccctggactgggagggccaagtcaaggaatttatcgtgacgaccgatctcaaccccgacgggacccccaagctggacaagtacggcgaggtgaagcgctccttccgggccccgaaggaggacgactggatgctgatcaagaagcgcaccgaggccgacatcgccaacacgcataaaaccgtcggcgcgtacatctacgacaccctcctgcagaagccccagcagaaaatcatcgggaagttggtgaagaccgtggagcggaagctctaccgcgacgagctgagcctgatcctccagaagcagtgcgcattccacgccgagctgcaggaccgcgccctgtacgcccggtgtgtcgaggcgctctacccctccaacgaggtgcgccggaagaacatcgccaaccgcgacttcgtatatctgctgatggacgacatcctcttctaccagcggcccctgaagacgaagaaatccctgatcgccaactgcccgtatgaggagaacgagtacgtcgaccgcgagaccggcgagatcaagaaagcgcccctcaagtgcatcgccaagagccaccccctgttccaggagttccggctgtggaacttcctcagcaacatccgcatctaccagaaggaaaaggagatcaacgggaccctgcacctggacgtggacgtgaccgcggagttcctgaagacggaggacgactacgtcgccctcttcgactggctgaactcccggaaggagatcgagcagaagaccttcctgaagtaccccaagttcggcctcaagaaggagatcagcaattacagatggaactacgtggaggacaagcagtacccgtgcaacgagacccggcacgccatcctgagctccctggagaaagccaacgtctgtatcgacttcctcagcaacgagaaggaggtggcgctctggcacatcctgtactccgtgagcgacaagcaggagatcgagaaggccctccgcaccttcgccgccaagaacgggctggacgagtccttcgtagaggccttcaagaagttcccgcccttcaagagcgagtacggcgcgtactccgccaaggccatcaagaaaatgctgcccctcatgcggtgcggcaagtactgggacgtgagctccatcgacgacacgaccaaggagcgcataaagaagatcgtgaccggcgagtacgacgagcggatcgccgtcaaggtgcgcgacaaggtgatgaacctgagcgacatctcctgcttccggcgcctgcccctctggctggcatgctacatcgtctacaaccggcacagcgaggacaaggaggcggtcaagtgggagtcccccgccgacatcgacgcctacctggccagcttcaagcagcactccctcaggaaccccatcgtggagcaggtcatcaccgagacgctgcgcgtggtgcgggatatctggaagcaggtcggccgcatcgacgagatccacatcgagctggggcgggagatgaagaaccccgccgacaagcgcaagcggatgaccgcgcagatcctcgagaacgagaacgccaatttacgcatcaaggcccttctcgccgagttcatgaacccggagtacgagatcgagaacgtgcggccctacagcccctcccagcaggagatcctgcgcatctacgaggacaccgtcctgcacgcggaggaccagctccccgaggagatcgacgccatcctgaagaagttcaacagctccaaggtcccgaccaagagcgagttcctccggtacaagctctggctggagcagaagtaccgcagcccctacactggcgagctgatccccctcgggaagctgttcaccgccgcctacgagatcgagcacgtgataccgcagtcccggtacttcgacgacagcttctccaacaaggtgatttgcgaaagcgccgtcaacaagctgaaggacaaccagctcggctacgagttcatcaagaatcaccacggccagaaggtggaggtggggttcggcaagtccgtcgagatcttcagcgtggactcctacgagcgcttcgtgaaggagcagtacgccaaaagcgccgttaaaatgaagaagctgctgatggacgacatccccgagcagttcatcgagcggcagctaaacgattcacgctacatcagcaaggtgatcaaggggctgctgtccaacatcgtgcgggagaagaacgacagcggcgagtacgagcccgaggccgtctccaagaacatcgtggtgtgcaccgggagcgtaaccgacagactcaagcgcgactggggcatgaatgacgtgtggaactccatcgtatacccacgcttcgagcggctgaatagcctgacggacacccagtccttcggtcactgggagaacaagagcgggaagaaggtcttccagaccgagctcccgctggagtaccagaagggcttcagcaagaagcgcatcgaccaccggcaccacgccatggacgccatcgtgatcgcgtgcgccactcgcaatcatgtgaactacctgtccaacgagagcgcctcccgcaacgccaagatcagccggtacgacctccagcgcctgctgtgcgacaagaaccggaccgacgacaacgggaactacaagtgggtcatcaagaagccctgggacacgttcacccaggacgcccgcgaggtgctgtccaagatcgtggtcagcctgaagcagaacctgcggatcataaacaagaccaccaacgtgtaccgccacttcgacgcgacagtgaaccgggtctatgagaagcagaagaccggcgactcctgggccatccgcaagcccatgcacaaggacaccgtgttcggggccgtgaacctccggaaggtcaaggtggtgcgcctgagcgtcgccctggacacccccgcgatgatcgtggacaagcgggtcaagaacaaggtgttcgagctcctgtcctacaagtacgacaagaagcgcatcgagaagtacttcaaggagaacgccttcctgtggaaggagctcgacctggccaaggtggccgtctactacttcacggaggccaccaccgagccgctggtggcggtgcggaagcccctcgacagcaccttcaacgagaagaagatcaaggagtccgtcacggataccgggatccagaagatcctgttgaaccacctctgcaccaaggaaggcaagcccgaccttgccttcagcgccgaggggatcgaggagatgaaccgcaacctgctccagctgaacaacggcaagtcccaccagcccatttacaaggtgcgggtgtacgagccgcgcgggaacaagttcagcgtcggcgtgctgggcaacaaggggaccaagtgggtggaggccgccaagggcacgaacctcttcttcgcgatctacatcaccgaggacgggaagcggacctacgaaaccatccccctgaacgtcgtgatcgagcgcgagaagcagggcctggtgcccgtccccgaccggaacgagaagggggacaagctcctgttctggctgtccccgaacgacctcgtgtacctgcccacggaggaggagcgcgagttcggccgcatcaacgagcccatcgaccggggccgcatctacaagatggtgagctgcaccgggaacgagggccacttcatccccgccaacgtcgccaacccgatcgtgcccgtgatcgagttggggtccaacaacaaggcccagcgggcctggaccaacgagatgatcaaggacatctgcatccccatcaaagtcgaccgcctcggtcacataatcgaggtcaagtaccggatcgatgagtga

SEQ ID NO: 8068 - RNA, 4530 nt, synthetic construct
  misc_feature 1..4530: note = Cas9 variant
  source 1..4530: mol_type = other RNA
atgaagaagacattgggcctcgacctgggcaccaactccatcggctgggccgtgattaactccaacatcgacagcgaagggaaggagaagctggtcggcatctcgagctgcggatcccgcatcatccccatggacgccacgaccctcggcgacttcggcaaggggaacaccaagagcccggtcgcagagcggacccgcctgcggggcatccggcggctgcttgagcgctccctactgcggcgcgagcgcttgcaccgcgtgctgagcgtcatggggttcctgcccgagcactatgcctcccagctcgaccggtacggcaaattcctgcccgaaacggagcccaagctggcctggtacaaggacgacagcgggcgctaccagttcctcttccagaagtccttccacgagatgctggaggactttcggcagcaccaaccggaactggtggccggcgagaagaagatcccctacgattggaccatatactacctccgcaagaaggccctgagccaggagatcacgaaggaggagctggcctggatcctcctgaacttcaaccagaagcggggctattaccagctgcgcggcgaggaggagcaagaggagaacaacaagtccgtggagtaccacgccctcaaggtcgtgagcgtggaggactccggcgagcggaaggggaaagacatctggtacaacgtcaccctggagaacggctgggtgtaccgtcgggccagcaacatccccctggactggacgggcaaggtgaaggagttcgtagtgaccaccgagctcgacgacgccgggaaccccaagaaggacaaggaggggaacgtgaagcgctccttccgggcgccaaaggaggacgactgggggctgctgaagaccagaacgcaggcccagatcgacgaaagcggtaagactgtcgggacgtacatctacgagagtctgctctgcatgcccaaccagaagatccgcgggaagctggtgcggacgatcgagcgcaagtactacaaggacgagctccggcagatcctggtgaagcagagtgagtttcacgccgccctgcaggaccacaacctcctgctgagctgcatcgaggagctctaccccaacaacgaggcccaccgccggctgctgtccgcgagctccttcatatacttcctcatcgaggacatcctgttctaccaacgccccctcaagagccagaagggcctcatcgacaactgcccgtacgagtcccacatctacaaagacaagaaggacgggagcctgcaccacgtccccctgaagtgcgtgtccaagtctcatcccctctttcaggagttccggctgtggcagttcctgtcgaacctgcgcatctaccagcgggagcgcatgatggacggcagccttaagctggacgtggatgtcacgcgggaatttctgccctccgaggaggactacgtgaagctgtttgactggctgaacgagcgcaaggagatcagccagaagttcttactcgcctataagccgttcgggctgaagaagaacgagcaggctaactaccggtggaactacgtggaggacaagtcctacccctgcaacgagacccgcgccgagatcaagtcccggctgtccaaggccggcgtccccgaggagttcctcaccgaggagaaggaggaagcgctgtggcacatcctttacagcatctccgacaagaaggagctcaccaaggcactggggacgttcgccgccaaaaactgcctgaacgagagcttcgtggaggtcttcgccaagatcccgcccttcgagtccaattacgcggcctacagcctcaaagccatccgcaaactcctggccctcatgcgcatgggcaagtactggaacgagcaggccatcgaccgccagacccgggaccgcatcgagaagatcctgaccggcgaatatgacgagaccatccgcagccgcgtgcgcgagaaggccatgctgctcacggacatctccagcttccggggtctgcccctgtggctcgcctgctacatcgtgtacgatcgccactccgagagcaaggagctggtcaagtgggagacccccgctgacatcgaccatttcctgtccaagttcaagcagaacagcctccgcaatcccatcgtggagcaggttatcaccgagtccctgcgcaccgtgcgggacatctggaagcaggaaggaaagatcgacgagatccacgtggagctagggcgcgagatgaagaacccggccaaggagcgggcacgcatcacggcccaggtgcaggagaacgagaacaccaacctccggatcaaggctctgctggccgagtttatgaaccccgagttcgaaattgagaacgtccacccatacagccccggccagcaggaaatcctccgcatatacgaagacggggtgctgtccggcatcgccgagaaggacctaccggacgacatcactgcgatcctcaagaagttccgggaaaacgacgtgaagaagcgccccaccacgagcgaggtcctgaggtacaagctgtggctcgagcagcgctataggtccccctacaccggccgcgtgatcccgctggggaagctgttcacccccgcctacgagatcgagcatgtgatcccccagagccggtacttcgacgactccatcagcaacaaggtcatctgcgagtccgccgtcaacaagctcaaggacaactgcctgggatacgagttcatcaagaagcacagcggggagatggtggagctcggcaacggcgagaccgtccccgtgttctccgtggaagagtacgagcgcttcgtcaaggagagctactttgggaacagcaagaagatgaagaagctcctgctggaggacatccctgactccttcatcgagcggcagctcaacgacagccgctatatctcccgcgtggtgaccagcctgctgtcaaacctcgtctgcgaggagggcgagcaggacgggctgagcaaaaacgtgatcgtgtgcaccggcgggatcactgaccggctgaagaaggactggggcgtgcaggaggtgtggaatcgcatcatcttaccccggttcctgcgcctgaacgagataaccggccggaccgacttcacgtccaccagcgttaacgggcacctcctgcccgccctgcccctctacctgcagaagggcttcaacaagaagcgcatcgaccatcggcaccacgccatggacgctatcgtcatcgcctgcgccaaccgcaacatcgtgaactacctgaacaactccagcgcccgaaagaactccgagatcagccgctacgacctgcagcggctactgtgcgagaaggtgaagaccgacgccaacgggaactataagtggatcctccgaaagccgtgggagaccttcacgcaggacgtctatgccgccttaaccaacatcgtggtgtccttcaagcagaacctccgggtcattaaccgcacaaccaactactaccagcactacaacgaggccggcgagaagcggatgatcccccagacgaagggagaccgctgggccatccgcaagcccatgcacaaggacaccgtgtacggagaggttaacctccgcaaggagaagaccctgcccttacgggacgtcgtgaagaacccgagtatcgtggtcgacaagtccctcaagaataaactgtatgagctgttaaagagtcagtacgatctgaaggcgattgcgaagtatttcgagacccaccaggatgtgtgggccgacgtgaacctgaagaagataaaggtctactactttacgaaggagaccaacgagcgtttcttcgctacccgcaagagcctcgaccccagcttcgaccagaagaagatcgaggaggaggtgaccgacacgggcgtgcagaagatcctgctgcaccacctccagcaaaacaacaatgaccccgacatggccttctcccccgacgggatagaccggatgaaccagaacatgaccatcctgaacgacggcaagtggcaccagccgatctacaaagtacggacctacgagaaggcggacaagttcgccgtgggcgagagcggcaataaggccaagaagttcgtcgaggccgccaaggggaccaacctgttcttcgcggtctacgaaagcgtgcaagaggacgaggccatcggcaaacaggtctgcaagcggacattcgccaccatccccttaaacgaggtgatcaagcgcaagaagcagggcctgcccgccgccccagaggacctgaacgggaacctcccgaagttcgtgctgtcccccaacgacctggtctacctccccacggaggaggagcggaacagctcccgcatcattcagcctctggaccgggaacgcatctataagatggtgagctccagcggctcccagtgcttcttcatcaaggtgttcgtagcgaacagcatctgggacaagaacgagtactccagcctgaacaaaatggagcgggccatcaccaacgagatgatcaaggagatatgcgtgccgatcaagatcgaccgactcgggaacgtgtccctgatccaaatctga

SEQ ID NO: 8069 - RNA, 4533 nt, synthetic construct
  misc_feature 1..4533: note = Cas9 variant
  source 1..4533: mol_type = other RNA
atgaagcgaatcctgggcctcgacctgggcaccaacagcatcggctgggccttagtcgactccgaggagcagcggatcctcgggatgggcagccgcataatccccatggaccagggggtcctggacaccttctccggcggcaacccggtggagacgcagaccgccgcgcggaccgtgtaccgcgggacccgtcgcctgcgggagcgcgccctcctgcggcgcgagcggctgatccgcgtcctcaacatgatgaagttcctgcccgagcactacgccagccagatcgacttcgaaaagagactgggccagttcttcgacgagaaggagcccaagctcgcctggaagcagaacgacgaggggcgcttcgagttcatcttccagcagtccttcaacgagatgatcgaagagttcaagaacaaaggcgtggtccgggaggacaagaagatcccctatgactggacgatctactacctgcgcaagaaggccctgagccaggagatcgagaaggaggagttagcgtggatcttactgaacttcaaccagaagcgggggtactaccagctccgcggcgaggaggaggaggagaacccgaacaagctggtcgagtactactcactgaagatcgtggacgtgatcgccgacgagaagcccaacagcaagtccgacatctggtacagcctccacctggagaacggctggatttaccggcgctccagcaagatcccactgttcgggtggaaggacaagacccgggacttcatcgtcaccaccgatctcaacgacgacggcactgtgaagaaggacaaggagggtatcgagaagcgatccttccgcgcccccagcgagaacgactgggtgctgctgaagaaaaagaccgagtccgacatcgagaagtcccataagaccgtcggcgcctacgtgtacgagaccctcctgcagaacccgatgcagaaggtgcggggtaagctggtccgcacgattgagcggaagttctacaaggacgagctaaaacagatcctggagaagcagcgcgagtttcaccctgagctgcgggacgaggacctatacaatgactgcgtgcgcgagctgtaccggagcaacgagacctaccagttcatactcagcaagcgcgacttcgtgcacctctttctggacgacatcctcttctaccagcggcccctccgctcccagaaaagcgccatcggggactgcattctggagttcaagacctacaaggacaaggacggcaacaacatcaaggagtacctgaaggtcatcagcaagagcaaccccctctaccaggagttccgaatctggcagtggctgtacaacctgaagatctaccgcaaggaggacgacgaggacgtgaccctccagttcatcgccaacatcgaggacaaggaacagctgttcgacttcctgtcaaaccggaagagtatcgagcagaagccgctcttggagtacctgatcaaggccaaggggctgaagaaacaggtcaaaacggaggcataccgttggaactacgtggaagacaagatctacccctgcagcgagaccaagaccatgatctccaccagactcgccaaggtggagaacatccccgacaacttcttcacgaaggagatcgagcagaagctgtggcacattatctacagcgtgaccgataagaacgagttcgagaaggctttacgcaccttcgcaaagaagtacgacctcgacatcgcctccttcgtcgacaacttcaaaaagatcccgccgttcaagaacgagtacggcagcttctccgagaaggccatcaaaaagctgctgccactcatgcggctggggaagtactggaagtggaacgacatcgacaacaacacccagaaccgcataagcaagatcatcacgggcgagtacgatgaggagatcaaggacatcgtccgggagaagtccattgcattaaccaacgagaacgacttccagggattacaactgtggctggcgcagtacctcgtctacgggcgccattcagaggccgacatcgccggcaagtggcactccgtggccgacctggagaagtacctgaacgagttcaagcagcacagcctccgcaaccccatcgtggagcagatcatcaccgagaccctgcgggtcgttcgcgatatctggcggaagtacgggcagggcgccgagaactttttctccgagatccatgtggagttagggcgcgacatgaagaacacggcggacgagcggaagaagatcgtcaacgtggtgacagagaacgagaacaccaacttgcgcatcaaggccctgctgatggagctcaagaacaacagcgatgggaagctggaggtcgaaaatgtccggccttactccccgacccagcaggacatcctgaagatctacgaggagtacgccatcagcacgggcctggacaacgagaaagacgagaaggtgaaggaggacataaagaagatatcccgcgtcgctcagcccaccaccaccgagcttcagcggtacaagctgtggctcgagcagaagtattgcagcccgtacacggggaaggtgatcccgctgggcaaactcttcaccgaagagtaccagatcgagcacattatccccaagagtcgctactacgacgactccttcagcaacaaggtgatctgtgaggccgccgtcaacaagctcaaggacaagtgcctggggctggagttcatcaagaattaccacggccagatcgtggaaaccgggttcggccagaaggtgaccatcttcgacgaggaggcctaccagaacttcgtcaagcagcactacgcgtacaaccactccaagcggaccaagctcctgctggaggagatccccgagaagatgatcgaacgccagatgaacgacacgcggtacatcagcaagttcgttctccccctgctgtccaacctcgtgcgcgccaaggagaacgacaacggcgtcaacagcaaaaacgttctgccagtgaacgggaagatcaccaccatgctgaaacaggactggggcctcaacgacgtctggaacgacctgattctgccccgattcgtgcgcatgaacgagctcgcgaagaccatagccttcacgtcctggaacgagcagcaccagaagtatctgcccaccgtgcccctagagctcagcaaggggttccagaagaagcggatcgaccacagacaccacgcaatggacgccctggtcatcgcctgcgcgactcgggaccacgtgaatctgctcaacaacaagcacgccaataccgacacgatccgctacgacctgcagcggaagctgcgcctcttcgagcgcgtgacctacatcgacccacagactaagaacaacgttacgaaggacatccccaaggagttcaagaagccctgggacaatttcacggtggatgcccggaacgagctggagaagatcatcgtgtccttcaagcagaacctgcgcatcatcaacaaggccaccaacatatacaccaagtacgagaacggcaagaagatcaaggtcggccagaagggactcaactgggccatccggaagcccctgcataaagagaccgtgttcgcgaaggtgagcctgcgcaagaggaagacggtccgcctctccgaggccctgaaggactggaagaaaatcgtggacaaaaagctgaagcaggagatcaagcgtctgacctgccagtacggcaagttcgacgtggacaccatcctgcgctactttaaggaccggaagtaccagttcggggaggtggacgtgagcaaggtgaagatgtactacttcgacgaggagaacgccgccgtccgcaaaaacgtggacacctcctttacggagaagttcatccagggcagcgtgaccgacaccggcatccagaaaatcctattaaaccatctggaggccaaagggaacaaggtcgagatcgcgttttcaccggagggcatcgaggaaatgaacaagaacatcatccagctgaacgaggggaagctgcacctccccatcttcaaggttcgggtgtacgagaccatcggcaacaagttcagcgtcggggtgaagggtaacaagaaagacaaatacgtggaggccgccaaggggacaaacttattcttcgccatctacgtggacgagaacggcatccgctcctacgagaccatccccctcaacatcgtaattgagcggctgaagcagggcctgagcgtcgtgcccgagaagaaccgcaaagagcacagccttctgttctacctgtccccgaacgacctcgtgtacgtcccgatcgaggacgagcgggagaacatccacgcggtgaacctagaccagctgaacaacgagcagcgcaagcgcatctacaagatggtgagctgcacagggtccgagtgccacttcgtcccctactacgtggcctcacccatcgtgaacaaggtcgagtactccagcctgaacaagatcggacgctcactaaccggggagatgatcaaggacgtgtgcatcaagctgaaggtggaccggctcggcaacatcaaggggatcagcggcctgtga

SEQ ID NO: 8070 - RNA, 4533 nt, synthetic construct
  misc_feature 1..4533: note = Cas9 variant
  source 1..4533: mol_type = other RNA
atgaagcgcatcctgggactcgacctggggaccaacagcatcggctgggccctggtggattccgaggagcagcggatcctcgggatgggcagccgcatcatccccatggatcagggggtcctggacaccttctccggcggcaacccggtggagacgcagaccgctgcgcggaccgcctaccgcgggacccggcgcctgcgggagcgcgccctcctgcggcgcgagcggctgatccgcgtgctcaacatgatgaagttcctgcccgagcactacgcgagccagatcgacttcgagaagcggctgggccagttcttcgacgagaaggagcccaagctcgcctggaagcagaacgacgagggtcgcttcgagttcatattccagcagtccttcaacgagatgatcgaggagttcaagaacaaaggcgtcgtgcgggaggacaagaagattccctacgactggacgatatactatctgcgcaagaaggcgctgagccaggaaatcgagaaggaggagctcgcctggatcctgctgaacttcaaccagaagcgggggtactaccagctccgcggcgaggaggaggaggagaacccgaacaagctggtggagtactactccctaaagatcgtcgacgtgatcgccgacgagaagcccaattctaagggcgacatctggtactccctccatctggagaacgggtggatctaccggcgcagctccaagatccccctgttcggctggaaggacaagacccgggacttcatcgtgaccaccgacctcaacgacgacgggacggtcaagaaggacaaggagggcatcgagaagcgcagcttccgcgccccctccgagaacgactgggtgctactgaagaagaagaccgagagcgacatcgagaagtcccacaagaccgtgggcgcgtacgtctacgagaccctcctgcagaacccgatgcagaaggtgcgggggaaactggtgcgcacgatcgagcggaagttctacaaggacgagctcaagcagatcttggagaagcagcgcgagttccaccccgagctgcgggacgaagacctctacaacgactgcgtccgcgagctgtaccggagcaacgagacctaccagttcatcctgtccaagcgagacttcgtgcatctgttcctggacgacatcctgttctaccagcggccgctccgcagccagaaatccgccatcggcgactgcatcctggagttcaagacctataaggacaaagacgggaacaacatcaaggagtacctgaaggtgatcagcaagtcgaaccccctctaccaggagttcagaatctggcagtggctgtacaacctgaaaatctaccgcaaggaggacgacgaggacgtcaccttacagttcatcgccaacatcgaggacaaggagcagctgttcgacttcctgtccaaccgcaagagcatcgagcagaagccgctcctggagtacctgatcaaggccaagggcctgaagaagcaggtcaagacggaggcgtaccggtggaactacgtagaggacaagatctacccctgctccgagacgaagaccatgatcagcacccggctcgcgaaggtggagaacatccccgacaacttcttcacgaaggagatcgagcagaagctgtggcacatcatctactccgtgaccgacaagaacgagttcgagaaggccctgcgcaccttcgccaagaagtacgacttggatatcgcgagcttcgttgacaacttcaagaagatcccgccgttcaagaacgagtacgggtccttcagcgagaaggccatcaagaagctgctgccccttatgcggctgggcaagtactggaagtggaatgacatcgacaacaacacccagaaccgcatctccaagatcatcacgggcgagtacgacgaggagatcaaggacatcgtccgggagaagtccattgcgctgaccaacgagaacgacttccaggggctccagctgtggctggcccagtacctcgtgtacggcaggcacagcgaggccgacatcgccgggaagtggcacagcgtagccgacctggagaagtacctgaacgagttcaagcagcactccctccgcaaccccatcgtagagcagatcatcaccgagaccctgcgggtggtccgcgacatctggcgtaagtacggccagggggcggagaacttcttcagcgagatccacgtggagctgggccgcgacatgaagaacacggccgacgagcggaagaagatcgtgaacgtcgtgaccgagaacgagaacaccaacctccgcatcaaggccctgctgatggagctaaagaacaactccgacggtaagctggaggtggagaacgtcagaccctacagcccgacccagcaggacattctgaagatctacgaggagtacgccatctccacggggctcgacaatgagaaggacgagaaggtgaaggaggacatcaagaagatctcccgcgtggcccagcccaccaccaccgagctgcagcggtacaagctgtggctcgagcagaagtactgctccccctacacggggaaggtcatccccctggggaagctgttcaccgaggagtaccagatcgagcatatcatccccaagagccgctactacgacgacagcttcagtaacaaggtgatctgcgaggcggccgtgaacaagctcaaggacaagtgcctgggcctggagtttatcaagaactaccacgggcagatcgtcgagaccggcttcggccagaaggtgaccatcttcgacgaagaggcttaccagaacttcgtgaaacagcactacgcctacaaccggagcaagcgcaccaagctcctgctggaggagatccccgagaagatgatcgagaggcagatgaacgatacgcgctacatctcaaaattcgtcctccccctgctgagcaacctcgtccgggcggaggagaacgacaacggggtgaactccaagaacgtactgcccgtgaacggcaagatcaccaccatgctgaagcaggactgggggctcaacgacgtgtggaacgacctgatcttaccgcgcttcgtccggatgaacgagctcgccaagaccatcgccttcacgagctggaacgagcaacaccagaagtacctgccgaccgtgccccttgagctctccaagggcttccagaagaagcgcatcgaccatcggcaccacgccatggacgccctggtgatcgcgtgtgccacccgcgaccacgtcaacctgctcaacaacaagcacgccaacaccgacacgatccggtacgacctgcagcgcaagctgcgcctcttcgagcgggtgacctacatcgacccgcagaccaagaacaacgtgaccaaggacatccccaaggagttcaagaagccctgggacaacttcacggtcgacgcccgcaacgagctggagaagatcatcgtgagcttcaagcagaacctgcggatcatcaacaaggccaccaacatctacaccaagtacgagaacggcaagaagatcaaggtggggcagaagggcctcaactgggcgatccgcaagcccctgcacaaggagacagtcttcgccaaggtgtccctgcggaagcgcaagacggtgcggctcagcgaggccctgaaggactggaagaagatcgtcgacaagaagctgaagcaggagatcaagcgcctgacctgccagtatgggaagttcgacgtggacaccatcctccggtatttcaaggaccgcaagtaccagttcggcgaggtggacgtctccaaggtgaagatgtactacttcgacgaggagaacgccgccgtgcggaagaacgtcgacaccagcttcacggagaagttcatccaggggtccgtgaccgacaccggcatccagaagatcctgctcaaccacctggaggcgaagggaaacaaggtggagatcgccttcagcccggaagggatcgaggagatgaacaagaacatcatccaactgaacgagggcaaactccacctccccatcttcaaggtccgcgtgtacgagaccatcgggaacaagttctccgtgggcgtcaaggggaacaagaaggacaagtacgtggaggccgccaaggggacgaacctgttcttcgcgatctacgtggacgagaacggcatccggagctacgagaccatccccctcaacatcgtcatcgagcgcctgaagcaggggctgtccgtggtccccgagaagaaccggaaggagcacagcctcctgttctacctgagcccgaacgatctcgtgtacgtacccatagaagacgagcgcgagaacatacacgccgtcaacctggaccagttaaacaacgagcagcggaagcgcatctacaagatggtgtcctgcaccggcagcgagtgccacttcgtgccctactacgtcgcctcccccatcgtgaacaaggtggagtacagctccctcaacaagatcgggcggtctctgaccggcgagatgatcaaggacgtctgcatcaaactgaaggtggaccggctcgggaacgtgaagggcatctccggcctgtga

SEQ ID NO: 8071 - RNA, 4536 nt, synthetic construct
  misc_feature 1..4536: note = Cas9 variant
  source 1..4536: mol_type = other RNA
atgaagaagatcttaggtctcgacctggggacaaacagcatcggctgggccgtgataaacagcgtcgccgacgagagcgtggagaagcgcaacatagagctggcgggctcccggatcatccccatggacgccgccgtgctcggcaattttgacaacggggtcaccaagagccagactgcggagcgcacctcctaccggtcgatccgccggctgcgcgaacggcagctgctccgcagggagcgcctgcacaaggtgctgcagatcctcggcttcctgccggagcactacgtgaatgacatcgacttcgagaaccaccccggcaagatcaaaaagaacaccgagccaaagctgccctggcggaagaactccatggggcagttcgagttcatctttcaggccagcttcgaggcgatgctcaccgacttcgccacgcaccagccggtcttcgtttctgagggcaagaaggtgcactacgactggaccctgtactacctgcgcaagaaggccctcaccgaggagatcagcaaggaggagctggcatggatcatcctgaatttcaaccagaagcgggggtactatcagctccgcggcgaggaggaggaggagcagtccaacaagctggtcgagttctacgcgctgcgtgtggtgaaggtcgaggccaccgacgacaaaaaggggaaggacacgtggtacaacgtacacctcgagaacggttggatctaccgccgaaccagcaacatacccctggactgggagggcaaggtaaaggagttcatcgtgaccaccgacctgaacgaggacgggacgcccaaactcgacaagtacggcgaggttaagcgctccttccgggccccgaaggaggacgactggaccctgatcaagaagaagaccgagagcgacatcgccaactcccacaaaaccctgggatgctacatatacgacgccctgctacagaatccgaaccagaagatcaagggccgcctggtgcgcacggtcgagaggaagttctacaaggaggagctccgtctgatcctggagaagcagctcagcttccaccccgagttacaggaccgggatctgtaccgcgcgtgcatcgacgctctctacgtgtccaacgaggcccacaagaacaacatcagcggccgggacttcgtgtacctgttcatcgacgacatcatcttctaccagcgccccctgaagaccaagaagtccctcatcgacaactgcccctacgagaagaaccagtacatggaccgggagaccggggaagtcaagcaggcccctatcaagtgcatcgccaagagccatcccctgttccaggagttccgcctgtggcagttcatcagcaacatccggatctaccagcgcgagcgggtgatggacgacgggaagctggagaccgacgtggacgtcacgcccgacttccttaagaccgaggacgactataccaccctgttcgaatggctcaacgaccgcaaggaggtggaccagaaggcgttcctgaagaacccccagttcgggctgaagaagacgttcaccgagtaccggtggaactacgtcgaggacaagtcctacccgtgtaacgagacccgcaacgccatcctcaacggcctgcaaaaggccggggtaagcgccgacttcctgtcccgcgaggtggaagaggccctgtggcacatcttatacagcgtcgaggacaagatcgagatcgagtccgcgctgcgcaagttcgccagcaaacacgatctggacgaccgcttcgccgacgtgttcaagaagctcccgcctttcagaaaggagtatggcgcctacagcgccaaggcgatcaagaagctgctgcccctcatgcggatgggcaagtattgggagctgagcaacatagacgacaagacgaaggagcgcatcgacaagatcattacgggggagtgggacgagaacattcacaatcgggtgagggagaaggctatcaaactgtccgacatcacagacttcaagggcctccccctgtggctgagctgctacgttgtgtacaaccgccactccgaggccagagccatcgcgaagtgggagagccccgaggacatcgactcctacctccgcctgttccggcagcacagcctgcgcaaccccgtggtcgagcaagtcatcaccgagaccttgcggacggtgcgcgacatctggaagcgtattgggcaaatcgacgagatccacgtggagctgggccgcgagatcaagaaccccgccgacaagcgggccaagatgaccgcccagatcgtcgagaacgagaacaccaacctgcgcataaaggccctcctggcagagttcatcaactccgaatatgagatagagaacgtgcggccgtacagcccggggcagcaggagatcctgcgcatctacgaggacaccgtcctcaactcagttgaggagatcccggaggacatcagcgccgtgttaaagaagttccgggaatccgacctgaagaagcgccccactaagagcgagttcctccgttacaagctgtggctggagcagaagtaccgcagcccgtacacgggcgacatcatccccctcggcaagctgttcacctccgcctacgagattgagcacatcatccctcagagccggtactttgacgactccttcagcaacaaggtcatctgcgaggccgaagtgaacaagctgaagtccaacgagctcgggtacgagttcatcaagaaccaccacggccagtacgtggagattgggttcggcaaggtcgtgcagatctttagcattgaggcctacgagaagttcgtaaaggcgaactactccgggatcggtagcaagatgaagcgccttctgatggacgacatcccggaaaccttcatcgaacgccagctcaacgactcccgctacatcagcaaggtcgtgaagtccctgctgagcaacatcgtgcgggagaaggactccaacggcgagtacgagcccgaggccatctcaaagaacgtaatcgtgtgcaccgggtccgtgacggaccgactcaagcgcgactggggcgtcaacgatgtctggaatagcatcatatacccccggttcgagagactgaacgaactgaccggctctcagcagttcggctgttgggagaacaaggagggcaaacgggtgttccaaaccgccgtgccactcgagatgcagaaggggttcagcaagaagcgcatcgaccatcggcaccacgccatggacgccatcgtgatcgcgtgcgcgatccgcaaccacatcaactacctgagcaacgagtccgccagcaagaaggccaagatttcccggatagaccttcagcgcctcctgtgcaccaagtgccggacggacgacaatggcaactacaaatggatcgtgaagaagccgtggcccgcgttcacccaggacatccgcaaggccctggagaacataaccgtcagcttcaaacagaatctccgggtgatcaacaaaaccacgaactactacgtgcacttcgacgagtccgggaagaaggtcttggagaagcagatcaacggagacagctgggccatccgcaagcccatgcacaaagacacagtgttcgggaaggtaaacctgcagaaggttaaggaggtgcggctctccctggccctggacacccccaagatgatcgtggacaaaaagctcaaggagaaggtcctgcagctgtactcatacaagtatgacaagaagcggatcgacaagtacttcaaggagaacgcctccctctggaaggacctgaacctgagcaaggtggcggtgtactacttcaccaacgactccacggagccgctcgtcgccgtgcggaagccgctggacaccagcttcaacgccaagaaaatcaaggagtccgtgaccgacaccggcatccagaagatcctgctcaaccacctgagcaacaaccaggacaaccccaacctggccttctcccctgacggaatagacgagatgaaccgcaacctcacaaccctgaacgacgggaagtaccaccagccgatatacaaggtccgggtgtgcgaaccgcagggcaacaagttctccgtcggtacctccggcaacaagaccagcaagtacgtggaggccgctaaggggacgaacctgttcttcgccgtgtaccagaccgaggacggcaagcgcaactacgagactatccccctcaacgtcgtgatcgaacgggagaaacttgagtgggcccccgtgccggagaacaacaacaacggcgacaagctcctcttctggctgagtcccaacgacctggtctacgtgcccaccgccgacgagctcaataacgggatgaggctggacaacatggacaagggacgcatctacaagatgatcagctgtagcggcccgcagtgctttttcatcccgcagaacgtgtccaaccccatcatccccgtcatcgagctgggcgtgaataataaagccgagaagtcgtggaacaacgagatgatcaaggtggtctgcgtacccatccgggtggaccgcctcgggtgcatcacgcagatcaacaaccagaagtga

SEQ ID NO: 8072 - RNA, 4539 nt, synthetic construct; identical to SEQ ID NO: 2272
  misc_feature 1..4539: note = Cas9 variant
  source 1..4539: mol_type = other RNA

SEQ ID NO: 8073 - RNA, 4539 nt, synthetic construct
  misc_feature 1..4539: note = Cas9 variant
  source 1..4539: mol_type = other RNA
atgaagaaaatcctgggactcgacctggggaccaacagcatcggctgggccgtggtcaacgccgacgagatcacccgcgacgacgggtcccggtacctgaagcctaacggcatcagcgcggccgggtcccgcatcatcccgatgagcgccgacatcctcggcgacttcgagaagggcaactccatcagccagacggccgagcggacccgcatgcggatggcccgccggctgcacgaacgcgcgctgctccggcgcgagcggctgctgcgcgtgctgaacctgctggacttcctccccaagcacttcgccgacaagatcgaccggtacgggaagttcaccgacgactccgagccaaagctggcctggcgcaagaacaccgagggcaagtacgagttcatttttcaggacgccttcaacgagatgctggccgagttcaaggacaagcagcccgagatcgtggaggaggggaaaaagatcccgtacgactggacgatctactacctccggaagaaggcgctggagaaagccctcagcaaggaggagctctcctggatcctgctgcagttcaaccagaagcgcggctactaccagctccgcggggaggaggaggagatcccccaggacaagaagatcgagtacctggcccagaaggtcgtgaaggtggaggccaccgaccagaagaagggcgacgacgtctggtacaacgtgtatctggagaacggcatgatctaccggcggaccagcaaggcgcccctcgactgggaggggaaggtgaaggagttcatcgtcaccacggaggtggagaacgacggcgagaccccaaagaaggacaaggaagggaatatcaagaggtccttccgggccccgaaggaggacgactggaccctgctgaagaagaaaaccgaggccgacatcgagaacagccacaagacggtgggctgctacatctacgactccctcctgaacaaccccaagcagaagatcatcggcaagctggtccgcaccgtggagcgcaaattttacaaggaggagctcacccagatcctgaagaagcaggtcgagctgatccccgagctccgggacgacaacctgtacaagcagtgcatcgaggagctgtaccccatcaacgaggcccaccgcaacaccatcgccaagacggacttcgcgaacctctttatcaacgacatcctgttctaccagcggccgctcaagagcaagaagtctcagatcgacaactgcccctacgaggagcgcatcttcatcgacagcaagactggggagaagaagaaggtgcccgtgaagtgcatcgccaagtccaaccccctgttccaggagttccggctgtggcagttcatccagaacctgcgcatctaccagcgggaaaaggagatcgacggcaagctcctgaccgacatagacatcaccagcgagtgcctgaagtccgaggaggactacgtgcgcctcttcgactggctgaacgaccgggagacgatcgagcaggaggacctgctcaagcacctgttcaacaccaagaagtccaagaacaaggagaacccgtaccgctggaactacgtcgaggacaaggtgtacccctgcaacgagacccgggccaccatcctaaaggggttcagcaagtgcggcatcaacgccagcgtgctgagccccgagctcgagatggccctgtggcacatactgtactccgtcgaggacaagaaggagatcgagactgcgttgacccacttcgcccagaagcaagggtggaacgacgacttcgccaaggtgttcagcaaagccaagcccttcaagaaggactatggctcctacagcgagaaggccatcaagaagctgctgtccctcatgcgcatgggcaagtattggaaccaagacaacatcgacaagaacaccctggaccggatcgacaagatcatcaacggggagtacgacgaaaagatcagcaaccgcgtgcgggacaacgccatcaacctgaaggatatatctgacttccgcggcctcccggtctggctggcctgctacatcgtgtacgacaggcacagcgaggccaaggactgcaccaagtggaactcccccgaggagatcgacagctacctgaagaagttcaagcagcattccctccgaaaccccatcgtcgagcaggtcgtgacggagaccctgcggaccgtgcgcgacatatggatccaggaggagcagatcgacgagatccacctggagctcgggcgagacctgaagaaccccgccgacaaacggaagaagatgagcgagaacatcctgaagaacgagaacaccaacctccgcatcaaggcgatgctgatggagttcatgaacccgtccatgggcatcgagaacgtgcgaccctacagcccctcccagcaggacatcctgcgtatctacgaggagaacgccctcgataacctgacgaaggacgacaaggacttcgacttcatcagcaagataagtaagcaggcacagcccagcaagaccgacatcatccgttacaagtgctggctggagcagaagtaccgcagcccgtacaccgggaagaccatctccctcagcaagctgttcacccccgcctacgagatcgagcacgtgatcccccagtccctgtacttcgatgactctttttccaacaaggtcatctgcgaggccgaggtgaacaagttgaaggaccggcagctaggctacaagttcatcgcggagcaccacggcgagaaggtgcagctgagccagggggaggtcgtggagatcctctccgtggacgcctacgagaagttcgtcaaggagaactacgccaacaaccgcatcaagatgaagaagttactgatggagagcatcccggacgagttcatcgagcggcagctcaacgactcccgctacatcagcaaggtggtgaagggcctgctatccaacatcgtccgggagaagatcgacgacgagaactacgagcccgaagccgtgagcaaaaacctaatctcctgcaacggggccatcaccgaccgcctgaagaaggactggggcatgaacgacgtgtggaacagcatcatcctgccccggttcatccgcatgaaccagatcaccgggaaggactgcttcaccaccacgaacgcggagggccatctcatcccccagatgccgctggagctgcagaagggcttcaacaagaagcggatcgaccaccgccaccacgccatggacgccatcgtcatcgcctgcaccacccgtgaccacgtgaatctcctgaacaatgaggccgcgcactccaagttcaacgccacccgctaccagctgcagcggaagctccgtcggttcgagaaggccgtgatcgacgggaaggagcgtgaggtcgccaaggagttcctgaagccctgggatagcttctccagcgacagcaagaacatcctggagaacatcatcgtgtccttcaagcagaatcagcgcgtgatcaacaagacgacaaacgcgttcctccacttcgacgagaacggcaagaagaccttcatcaagcaagggaagggcgacagctgggccatccggaagtccatgcacaaggacaccgtcttcggcgagatcaacctgcgcaaggtgcgaagcgtgtccctgaacgaggccatcaaggtccccgagcgcgtgctcaacaagaagatcaaggagaagatcttagagctgaagaataacaagatcgacgccaagaacatcaagaagtacatcgaggagaaccacaccgggggctatgggatcgacagctccaagatcgacgtgttctacttcacgaaggagaccaaggagcggttcttcgccacccgcaagacgctcgacaccagcttcaaccaggcgaagatcaaggactccatcgccgacagcggcatccagaagatcctgctggcccacctcaaatccaagaacggggacgccgagcaggccttcagcccagacggcatcgacgagatgaacaagaacatcgtcgagctgaacaacggcaagttccaccaaccgatactgaaggtgcgggtgtacgaaaaggcggacaagttcgccgtcgggcagaagggcaacaagaaagtaaagttcgtggaggccgccaaggggaccaatctcttcttcgccatcttcgagaaggacggcaagcgctcctacctgaccatccccctgaacgtcatgatcgactgccagaagcagtacgggaaccagtggaagaacaacatcgaggcgtacctcaaggagaaggagctggtggagaaggacgtgaagctgcagttcatcctcagccccaacgacctggtctatctgccaacggaaggctccatcgacaagaagcggatctacaaggtggtgtcatttaccaacaaccgcctctacgccatcccgtacgccatcgccaagtccatcgtcgacaagaacgaatttacccagctgaacaagatcgagttcaccgacaacaaggagagcatcaaggacgcgtgcgtgcccgtgatcatcgaccggctgggcaacgtcatcgagttcaacgggaagcgcctctga

SEQ ID NO: 8074 - RNA, 4539 nt, synthetic construct
  misc_feature 1..4539: note = Cas9 variant
  source 1..4539: mol_type = other RNA
atgaagaacatcctgggcctcgacctgggtactaacagcataggctgggccgtgatcaacagcgaggaggacgggcccatcgtcaagaagcgcatcgagctggccggcagccggatcataccgatggacgcggccgtgctcgggaacttcgactccggcgtgaccaagagccagaccgcagagcgcacctccttccgaagcatccgccgactgcgcgagcggcagctgctccgccgtgagcgcctgcacaaggtcctgcagatcctcggcttcctgcccgagcactacgtgaacgacatcgacttcgagaaccaccccgggaagatcaagcgaaacaccgagcccaagctgccgtggcgcaagaactccatgggccagttcgagttcatcttccaggacagcttcgaggccatgctcaccgacttcgccacgcaccagcccgtgttcgtctccgaggggaagaaagtgccctacgactggaccctgtactacctgcggaagaaggcactcaccgagggcatcagcaaggaagagttagcctggctgatcctcaacttcaaccaaaagcgtgggtactaccagctgcgcggcgaggaggaggaggagcaatctaacaaactggtagagttctacgctctccgcgtcgtgaaggtggaggccaccgacgacaagaagggcaaggatacgtggtataacgtccacctggagaacgggtggatctaccggcgcaccagcaacatacccctggactgggagggcaaggtgaaggagttcatcgtgacgaccgacctcaacgaagatgggacgccgaagctggacaagtacggcgaggtcaagcgttcgttccgcgcgcccaaagaggacgactggaccctgataaagaagaagaccgaaagcgatatcgcgaactcccacaagaccgtgggctgctacatctacgacgccctcctgcagaacccccaccagaagattaaggggcggctggtgcgcacggtcgagcggaagttctacaaggaggagctccggctgatactggagaagcagctcagcttccaccccgagctgcaggaccgcgacctgtaccgggcctgcatagacgccctctacgtgtccaacgaggcgcacaagaacaacatcagcggcagggacttcgtgtacctattcatcgacgacatcatcttctaccagcggccactgaaaacgaagaagtccctcatcgacaactgcccctacgaggagaaccagtacatggaccgcgagaccggggaggtcaagcaggcccccatcaagtgcatcgccaagagccaccccctgttccaggagttccggctgtggcagttcataagcaacatccgcatctaccagcgggagcgcgtgctcgacgacggcaaattagagaccgacgtggacgtcacgccggacttcctgaagactgaggacgactacaccaccctcttcgagtggttcaacgaccggaaggaggtggaccaaaaggccttcctgaagaacccccagttcgggctgaagaagacgttcaccgagtatcgctggaactacgtcgaggataagtcctacccctgcaacgagacccggaacgccatcctcaacggcctgcaaaaggcgggcgtgagcgccgacttcctgtcccgcgaggtggaggaggccctgtggcacatcctctacagcgtcgaggacaaaatcgagatcgagtctgccctgcggaaattcgccagcaagcacgacctggacgaccgcttcgcggacgtgttcaagaagctgcccccgttcaagaaagagtacggggcctactccgccaaagccatcaaaaagctgctgcccttaatgcggatcggaaagtactgggagctgagcaacatcgacgacaaaaccaaggagcgcatcgacaagatcatcacgggggagtgggacgagaacatccacgaccgcgtacgcgagaaggccatcaagctgtccgacatcaccgactttaagggactccccctgtggctgagctgctacgtcgtttacaaccgccactccgaggcgcgggctatcgccaagtgggagtcgcccgaggacatcgactcctacctccgtctgttccggcagcactctctgcgcaacccgatcgtggagcaggtcatcaccgagaccctccggactgtgcgcgatatctggaaacgggtggggcagatcgacgagatccacgtcgagctgggccgcgagatcaagaacccagccgacaaacgggcgaaaatgacggcccaaatcgtggaaaacgagaacaccaatctgaggatcaaggccctcctggccgagttcatcaactccgagtatgagatcgagaacgtgcggccctacagctccaaccagcaagagaagctgaagatttacgaggacaccgtactcaacggcgtgaaggagatccctgaggacatcaacacgatcctgaagaagttccgcgagagcgacctgaagaagcggccgacaaagtccgacttcctccactataagctgtggctggagcagaaatactgcagcccctacaccggccgcatcatccccctcggtaagctgttcaccagcgcctacgagatcgagcacatcatcccgcaagcgcactacttcgacgacagtttcagcaacaaggtgatctgcgaggccgaggtcaacgggctgaaggacaagaagctcggctacgagttcatcaaacacaacccggggaagatggtggagattggcttcggcaagccgcccgtgcgtatcttctccgtcgaggagtacgagcgcttcgtgaaggagaactacagcgggatcaagaacaagatgaacaaactgctgatggacgacatccccgagaccttcatcgagcggcagctcaacgactcacgctacatcagcaaggtggtcaagtccctgttaagcaacatcgtgcgggagaaggacagtaacggcgagtacgagcccgaggccatcagcaagaacgtgatcgtctgcacggggagcgtgaccgaccgcctcaagcgggactggggcgtgaacgacgtctggaacagtatcatctacccccgcttcgaacgcttaaacgaactgacaggctcccagcagttcgggtgctgggagaacaaggaggggaagcgggtgtttcagaccgcagtgcccctcgagatgcagaaggggttcagcaagaagagaattgaccaccggcaccatgccatggatgcgatcgtcatcgcctgcgccacgcgcaaccacatcaactacctgtccaacgagagcgcctccaagaaggccaagatcagccggaccgacctgcagcgcctcctgtgcaccaagtgccggaccgacgacaacggcaactacaagtggatcgtgaagaagccgtggcccgcgttcacgcaggacatccgcaaggccctggagaacatcaccgtgagctttaagcagaatctccgggtgatcaacaagactaccaactactacgtgcacttcgacgagtccgggaagaaggtgctggagaaacagatcaacggcgacagctgggccatccgcaagccgatgcataaggacacggtcttcggcaaggtgaacctgcagaaggtgaaagaggtccggctctccctcgccctggacacccccaagatgatcgtggacaaaaagctcaaggagaaggtgctgcagctgtacagctacaagtacgacaagaaacgcatcgacaagtacttcaaggagaacgcgtccctctggaaggacctgaacctgagcaaggtcgccgtgtactacttcaccaacgactccaccgagcccttagtggccgtccgaaaaccactggatactagcttcaacgctaagaagataaaagagtctgtgaccgacaccgggatccagaagatcctgctcaaccacctgagcaacaaccaggacgaccccaacctggccttctcccccgacgggatcgacaagatgaacaagaacctcaccgcactgaacgacgggaaatatcaccagccaatctacaaggtgcgcgtctgcgagccccagggaaacaagttcagcgtggggacgtccggcaataagaccagcaagtacgtcgaggccgccaagggcaccaacctgttcttcgccgtgtaccagaccgaggacgggaagcgctcctacgagacgatccccctcaacgtggtcatcgagcgcgagaagctgggctggacccctgtgcctgagaacaacaacaacggggacaagttactcttctggctgagccccaacgacctggtgtacgtccccacagctgacgagctcaacaacggcatgaggttggacaacatggacaaggggcgcatctacaagatgatctcctgctcaggcccccagtgcttcttcatcccgcagaacgtgtccaacgcgatcatccccgtgatcgagctgggcgccaacaacaaggccgagaagtcctggaacaacgagatgatcaaggtcgtgtgcgtgcccatcagggttgaccgcctcgggtgcatcacccagatcaacaaccagaagtga

SEQ ID NO: 8075 - RNA, 4551 nt, synthetic construct
  misc_feature 1..4551: note = Cas9 variant
  source 1..4551: mol_type = other RNA
atgaagaacatattgggccttgacctgggcaccaacagcatcggctggtctgtgatccaagagaagcacaacgaaaataacgagtgccagaagctcatcctcggggccggcagccgcatcatccccatggacgccgccgtgctgggggacttcgccaaaggcaacactatatcccaaacgaaggaccggacccagtaccgcggtgtgcggcgcctgcgggagcgctgccttctgcggcgcgagcgtctttttcgcgtcctcgacatcatgggattcctgccgcagcacttcagtaacgccctgacccggtacggcaagttcaaagacgccgacgaggagcccaagatcgcctggcgcaaggacgatgaggggaagatgcacttcctcttcgcggactccttcaacgagatgatcgaggagttccggagcgtccagcccgagctgttaaagcgcggcatgaaggtgccctacgactggaccctgtactacttgcggaagaaggcaatgcgcgaggccgtgacaccgttcgagctggcctggctcatactgtccttcaaccagaagcgggggtattaccagctgagaggcgaggaggagggcgaagcggacaatagcaagtccgaggaatacctcgcccagcgggtcgttgacgtgatcgacaccggggagaagaagggcaagagcacctggttcgacatcgtcctggagaacggaatggtgtaccaccgccccgccgagatcaagcccgactggatcggcaagaccaaggaatttatagtgacgacccagttcgacaaggacggcaaccccaagaaggacaaggaggggaacgtcaagatgtcctttcggatgccgaatgagaacgactggaacttacagaagaagaaagccgagaaggacatagacgagagcggcatgaccgtgggggaatacatctacaatgcccttctgcacaaccccaagcagaagataaagggcaagctagtgcgcgtcgtggagcgcaaatactacaagaacgagctccagaaaatcctagagtcccagaagcggttcatcccccagctgagcgactccgcactctacgagaagtgcatcaaggagctctatcagagcaacgaggcctaccgcaactccatcagcacacggaacgacttcacgtacttgttcgtcgacaacatcattttctaccaacgccccctcaagtccaagaagtcacttatcgacaactgcccatacgagagcctggcgtacaccaaggacggggaggagcacaaggcccccgtgaagtgcatcgccaagagccaccccctctaccaggaatttcgtctgtggcagttcatcagcaacctacgcatctaccagcggcagaagcaggtcggcgacaaggtcaagctcgacgtggacgtgaccgatgagttcctgccaaccgacgaccgccgggagtccctgttcgactacctcaacgacaagacggagatcaagcaagacgttctgctgaaggagttcttcagcatgaagaagcctaagggcaaggactccgtctacccctaccgctggaactacgtggaggacaagagctacccctgcaacgttacccgggggaagatcctcgcgaagctgaaccgcgccggcatctctgcggacttcctgagctccaacgggaacgaggagagcctctggcacatcctgtactccgtggaggacaaaggcgagttgcggaaggcgttggcccgcttcgcggccaagaacgggttggacgacgccttcaccgaggccctggccgacatcgaaccctataagaaggagtacggcgcgtacagcgccaaggccctgaagaagttactgcccctgatgcggctcggcaagtactggaattacgacaatatagcacccgcgaccaaggcccgcatctccaagattattgacggggagtacgacgagaacatccggaacagggtgcgagagaaagccatgagcctgaactccgccagccagttccagggcctgcccctctggctggcctgctacatcgtctacgatcgtcactctgagcgcgcggactccgggcggtggtccagtcccgaggacatcgacaaatatctgagcgacttcaagcagcactcccttcgcaatccgatcgtggagcaggtcgtgaccgagaccctgcggaccgtgcgcgacatctggaaacggtacggcgagatctcagagatccacgtcgaactggggcgcgagatgaagaatcccgccgacaagcggtccaagatgaaccgccgaatgctcgagaacgagaacgccaatatgcgcgcgaagctgctgctcactgagtttatgaatcctgagttcggaatcgagaacgtccggagctactcccccagccagcaggagctgctccgcatttacgaggacggcgctatctccaatgcgggcagcgagatcgacgacgagatctccgacatcatgagccggctctcccaagtggacgtgaagaagcagccaacggcctccgaggtcaagcgctacatcctgtggctcgagcagaactaccggtccccctacaccggccagatgatacccctcgcgaagttatttaccccggcatacgagatcgagcacgtgatcccccagagcaggtacttcgacgactccttcagcaacaaggtgatctgcgaggccgaagtgaacaagttgaaagaccggatgctcggctacgagttcatcaagcaacacaagggtgagaaggtgtccctgagcatgggcgggaccgtggagatcctgagccccgaggagtacgtccgccacgtggagtcccagtacaaaaacaacaaggccaagatgcggaagctcttgatggacgacatccccgacgagttcatcaaccgccaactgaacgacagccgatacatctccaaacttataatcagcctgctgtccaacatcgtgcgcgaggagggcgaggaggaggccacctctaagaacgtaatctcatgtaacgggagcatcaccgaccgcctcaagaaggactggggcatcaacgacgtgtggaatcacatcatccttccgcggttccgcaggttaaatgagctcaccggaactgataagttcacgacctccaacaaggagggccacgaggtgcccgagatgccccttgagctgcagaagggcttcaacaagaagcgaatcgaccaccggcaccacgccatggacgccatcgtcattgcgtgcatcacccgagaccacgtgaacctcttgaacaatgaggccgccatgagcaagaacaacgccaaccggatccagctgtccaagaagctccgccgttacgagtccgtcgagatcgagaaggatgggatacgcaagcagatttccatggccaaggagttcaagaagccctgggagggcttcaccgccgacgtcgaacgaacgctgcgcgacatcgttgtgagcttcaagcagaacctgagagtcattaacaagaccaccaactactaccagcacttcaaggacgggaagaagatctattccccgcaaagcaagggcgactcttgggccatccgcaagagcatgcacaaggagaccgtcttcggggagatcaacattcggcgcatcaaggaggtgtccctcaaggaggccatgaagcggatcaaggacatcgccgataaagagctacgcagcaagatcgtcgagctgatggccctccagtacaacgagaagaagatcaagcagtacttcagcgacaacaaagacgagtggtccgacgtgaacccgaagaagatcaaaattcattacttcaccaaggaaacgaacgagcggttcttcgcgacccgcaagcccctggacaccagcttcgacaagaaaaagatcaaaacccaggtagctgacacggccatccaaaagatcctgctcaatcatctctccgcccacggcgacaaggccgagaccgctttcagccccgatggcatcgacgaaatgaaccgcaacatcatcgagctgaacgacgggaaattccaccagccgatcctcaaggtccgtatctacgagaaggccgacaagtacgccgtgggccagcagggaaacaagaagaagaagtacgtggaggccgcgaagggaaccaacctgttcttcgccatctacgccgaggagaagatagacgagaagaccggggacacggtcattacccgcacgtatgactctatccccctgaacgtggtcattgacagagagaagcgtggcctcagccccgttcccgagaacgagaacggcgccaagccaaagtacgtgcttagtccgaacgacctggtgtacgtccccaacgaggaggagcgggaaaccgggcgcatctgcgagcccttagacaaggagcggatctacaagatggtttcgtccaacaagaagcaggctttctttatcaaatccgaggtggcttccactatcgtcgacaagtttgagttcagcgccctgaacaagcaggaacgcgccctgtccggcgagatgatcaaggagatctgcatcccgatcagcattaataggatcggggagatcaccctccgctga

SEQ ID NO: 8076 - RNA, 4554 nt, synthetic construct
  misc_feature 1..4554: note = Cas9 variant
  source 1..4554: mol_type = other RNA
atgaagaagatcgtcggcctggacctcgggaccaacagcatcggctgggccctgatcaacgcctatatcaacaaggagcacctgtacgggatcgaggcgtgcggctcccgcatcatcccaatggacgccgccatcctcgggaacttcgacaagggcaacagcatctcccagaccgccgaccggacgagctaccgcggcatccggcgcctgcgagagcgccacctcctccggcgcgagcggctgcaccgcatcctggacctcttagggttcctgccgaagcactactccgacagcctcaaccggtacggcaagttcctgaacgacatcgagtgcaagctgccctgggtcaaggacgagaccgggtcctacaagttcatcttccaggagagtttcaaggaaatgctcgccaacttcaccgagcaccaccccatcctgattgcgaacaacaagaaggtgccctacgactggaccatctactacctgcgcaagaaggccctcacgcagaagatctccaaggaggagctggcctggatcctgctcaacttcaaccagaagcggggctactaccagctgcgcggggaggaggaggagaccccgaacaagctggtggagtactactccctcaaggtcgagaaggtggaggactccggcgagcggaagggcaaggacacctggtacaacgtgcacctggagaacgggatgatctaccgccggaccagcaacatccccctggactgggagggcaagacgaaggagttcatcgtcaccaccgacctcgaggctgacgggtcccccaagaaggacaaggagggcaacatcaagcgcagcttccgggcccccaaggacgacgactggaccctgatcaagaagaagacggaggccgacatcgacaagatcaagatgaccgtgggcgcctacatctacgacaccctactccagaagcctgaccagaagatccgcgggaagctggtgcggaccatcgagcgcaagtactacaagaacgagctgtaccagatcctcaagacgcagtccgagttccacgaggagctgcgcgataagcagttgtacatcgcctgcctcaacgagctgtaccccaacaacgagccccggcgcaacagcatctccacccgggacttctgccacctgttcatcgaggacataatcttctatcagcgccccctcaagagcaagaagtccctgatcgacaactgcccgtacgaggagaaccggtacatcgacaaggagagcggcgagatcaagcacgcctcaatcaagtgcatcgcgaagtcccaccccctgtaccaggagttccgcctctggcagttcatcgtcaacctgcggatctaccgcaaggagaccgacgtggacgtgacccaggagctgctccccacggaggccgactacgtcaccttattcgagtggctgaacgagaagaaggagatcgaccagaaggccttcttcaagtaccctcccttcgggttcaagaagaccacatccaactaccggtggaactacgtggaggacaagccctacccctgcaatgagacgcacgcccagatcatcgcccgcctcggcaaggcgcacatccccaaggccttcctgtccaaggagaaggaggagaccctgtggcacatcctgtacagcatcgaggacaagcaggagatcgagaaggccctccactccttcgccaacaagaacaacctgagcgaggagttcatcgagcagttcaagaacttcccgcccttcaagaaggagtacgggtcctacagcgccaaggcgataaagaagctgctccccttgatgcggatgggcaagtactggtccatcgaaaacatagacaacggcacccgcatccgtatcaacaagatcatcgatggggagtacgacgagaacatccgcgagcgggtgcgccagaaggccattaacctgaccgacatcacgcattttcgggccctccccctgtggctggcctgctacctcgtctacgaccgccacagcgaggtgaaggacatagtgaaatggaagaccccgaaggacatcgacctgtacctgaagtccttcaagcagcacagcctccggaaccccatcgtcgagcaggtcataaccgagaccctgcgcacggtccgcgacatctggcagcaagtcggccacatcgacgagatccacatcgagctcgggcgggagatgaagaaccccgccgacaagcgcgcgcggatgtcccagcagatgatcaagaacgagaacaccaacctccgcatcaaggccctgctgaccgagttcctcaaccccgagttcggcatcgaaaacgtgcggccgtacagcccctcccagcaggacctcctgcgcatctacgaggagggggtgctcaacagtatccttgagctaccagaggacatcggcatcattctcggcaaattcaaccagaccgacacgctgaagcggccgacccgctccgagatcctacggtacaagctctggctggaacagaagtaccgctcgccctacaccggggagatgatccccttgtccaagctgttcacccccgcctacgagatcgagcacatcatcccgcagagccggtacttcgacgacagcctttccaacaaggtgatctgcgagagcgagatcaacaagctgaaggaccgctccctcggctacgagttcatcaagaaccaccacggggagaaggtggagctggccttcgacaagcccgtcgaggtgctgagcgtggaggcgtacgagaagctcgtccacgagtcctactctcacaaccgttccaagatgaagaagctgctgatggaggacatacccgatcagttcatcgagcgccagctcaacgacagccggtacatctccaaggtggtcaagtccctcctgtccaacatcgtgcgcgaggagaacgagcaggaggccatcagcaaaaacgtgatcccctgcaccggcgggattacggaccggctcaagaaggactggggcatcaacgacgtgtggaacaagatcgtcctgccgcgcttcatccggctgaacgagctcaccgagtccacccgcttcaccagcatcaacacgaacaacaccatgatcccctccatgcccctggagctgcagaagggcttcaacaagaagcgtattgaccaccgccaccacgccatggacgccatcatcatcgcttgcgcgaaccgcaacatcgtgaactacctcaacaacgtgagcgcctccaagaataccaagatcacccggcgagacctgcagactctgctctgccacaaggacaagaccgacaacaacgggaactacaagtgggtcatcgacaagccttgggagacattcacccaagacacgctgaccgccctgcagaagataaccgtgagcttcaagcagaacctccgggtgattaacaagaccacgaaccattaccagcactacgagaacggcaagaagatcgtcagcaaccagtccaagggggatagctgggccatccgcaagtccatgcacaaagagaccgtgcacggcgaggtgaacctgcggatgatcaagaccgtcagcttcaacgaggccctgaagaagccgcaggcgatcgtggagatggacctcaagaagaaaatcctggccatgctggagctcggctacgacacaaagcgcatcaagaactacttcgaagagaacaaggacacgtggcaggacatcaacccctccaagataaaggtgtactacttcaccaaggagaccaaggaccggtacttcgccgtccgcaaacccatcgacaccagcttcgacaagaagaagatcaaggagtccatcacagacaccgggatccagcagatcatgttgcggcacctggagaccaaggacaacgaccccacgctcgccttcagcccagacggcatcgacgagatgaaccgcaacatcctgatcctgaacaaggggaagaagcaccagcccatctacaaggtgcgggtgtacgagaaggccgagaagttcacggtcggccagaaggggaacaagcgcaccaagttcgtggaagcggccaagggcaccaacctcttcttcgccatctacgagaccgaggagatagacaaggacacgaagaaggtgatccggaagcgctcctacagcaccatccccctgaacgtcgtgatcgagcggcagaaacagggcctgtcaagcgcccccgaggacgagaacgggaacctcccgaagtacatcctgtcccccaacgacctggtctacgtccccacccaggaggagataaacaagggcgaggtggtgatgcccatcgaccgcgaccggatctacaagatggtcgacagctccgggatcaccgcgaacttcatcccggccagcacggccaatctcatcttcgccttgcccaaggccaccgcggagatctactgcaacggcgaaaactgcatccagaacgagtacggtatcgggagcccccagtccaagaaccagaaggccatcacaggcgagatggtgaaggagatctgcttcccaataaaggtggaccgcctgggaaacatcatccaggtcggctcctgcatcctcaccaactga

SEQ ID NO: 8077 - RNA, 4563 nt, synthetic construct
  misc_feature 1..4563: note = Cas9 variant
  source 1..4563: mol_type = other RNA
atgaagaagatcgtgggccttgacctcgggaccaacagcatcggctgggccctgatcaatgcctatatcgacgagtacaacaaggagcacctgtacgggatcgaggcgtgcggctcccgcatcatccccatggacgccgccatcctcgggaacttcgacaagggaaacagcatctcccagaccgccgaccgcacgagctaccgcggcatccggcgtctgcgggagcgccacttactccggcgcgagcggttgcatcgcatcctggacctcctggggttcctgccgaagcactactccgacagcctgaaccggtacggtaagttcctgaacgacatcgagtgcaagctgccctgggtcaaggacgagaccgggtcctacaagttcattttccaggagagcttcaaggagatgctcgccaacttcaccgagcaccaccccatcctgatcgcgaacaacaagaaggtgccctacgactggaccatctactatctgcgcaagaaggccctcacgcagaagatctccaaggaggagctggcctggatcctgctcaacttcaaccagaagcggggctactaccagctgcgcggagaagaggaggaaaccccgaataagctggtggagtactacagcctcaaggtcgagaaggtggaggactccggcgagcggaagggcaaggacacctggtacaatgtgcacctggagaacgggatgatctaccgcagaaccagcaacatcccccttgactgggaaggcaagacgaaggagttcatcgtcaccaccgacctcgaggccgatgggtcccccaagaaggacaaggagggcaacatcaagcgcagcttccgggcgccgaaggacgacgactggaccctgatcaagaagaaaacggaggccgacatagacaagatcaagatgaccgtgggcgcctacatctacgacaccctgctccagaagccggaccagaagatccgcgggaagctggtgcggaccatcgagcgcaagtactacaagaacgagctgtaccagatcctcaagacgcagtccgagttccacgaggagctccgcgacaagcagctgtacatcgcctgcctcaacgagctgtaccccaacaacgagccccgacgcaacagcatctccacccgggacttctgccacctgttcatcgaggacatcatcttctaccagcgccccctcaagtctaagaagtccctgatcgacaactgcccttacgaggagaaccggtacatcgacaaggagagcggcgagatcaagcacgccagcatcaagtgcatcgcgaagtcccaccccctgtaccaggagttccgcctctggcagttcatcgtcaacctgcggatctaccgcaaggagaccgacgtggacgtgacccaggagctgctcccaacggaggccgactacgtcaccctgttcgagtggctgaacgagaagaaggagatcgaccagaaggccttcttcaagtacccgcccttcgggttcaagaagaccaccagcaactacagatggaactacgtggaggacaagccctacccctgcaacgagacgcacgcccagatcatcgcccgcctaggcaaggcgcacatccccaaggccttcctgtccaaggaaaaagaggagaccctgtggcacatcctgtacagcatcgaggacaagcaggaaatcgagaaggccctccactccttcgccaacaagaacaacctgagcgaggagttcatcgaacagttcaagaacttcccgcccttcaagaaggaatacgggtcctacagcgccaaggcaattaagaagctactccccctgatgcggatgggcaagtactggtccatcgaaaacatcgacaacggcacccgcatccggatcaacaagatcatcgacggggagtacgacgagaacatccgcgagcgggtgcgccagaaggccatcaacctgaccgacatcacgcactttcgggccctccccctgtggctggcctgctacctcgtctacgaccgccacagcgaggtgaaggacatcgtgaagtggaagatcccgaaggacatcgacctgtacctgaagtccttcaagcagcacagcctccggaaccccatcgtcgagcaggtcatcaccgagaccctgcgcaccgtgcgcgacatctggcagcaggtcggccacatcgacgagatccacatcgagctggggcgggagatgaagaaccccgccgacaagcgggcgcggatgtcccagcagatgatcaagaacgagaacacgaacctccgcatcaaggccctgctgaccgagttcctcaatcccgagttcggcatcgagaacgtgcggccgtacagcccctcccagcaggacctgctgaggatctacgaggagggggtgctcaatagcatcctggagttgcccgaggacatcggcatcatcctcggcaagttcaaccagaccgacaccctgaaaaggccgacgcgttccgagatcctgcggtacaagctctggcttgagcagaagtaccgctcaccctacactggggagatgatccccctgtccaagctgttcacccccgcctacgagatcgagcacatcatcccgcaaagccggtacttcgacgacagcctgtccaataaggtgatctgcgagagcgagatcaacaagctgaaggaccgctccctcggctacgagttcatcaagaaccaccacggggagaaggtggagctggccttcgataagcccgtcgaggtgctgagcgtggaggcgtacgagaagctcgtccacgagtcctacagccacaaccggtccaagatgaagaagctgctaatggaggacatccccgaccagttcatcgagagacagctcaacgacagccggtacatctccaaggtggtcaagagcctgctgtccaacatcgtgcgcgaggagaacgagcaggaggccatcagcaagaacgtgatcccctgcaccggcgggatcaccgaccggctcaagaaggactggggcataaacgacgtgtggaacaagatcgttctgccgcgctttatccggctgaacgagctcacggagtccacccgcttcaccagcatcaacaccaacaatacgatgatcccctccatgcccctggagctgcagaagggcttcaacaagaagcggatcgaccaccgccaccacgccatggacgccatcatcatcgcctgcgcgaaccgcaacatcgtaaactacctcaacaacgtgagcgcctccaaaaacaccaagataacccggagagacctgcagaccctgctctgccacaaggacaaaacggacaacaacgggaactacaagtgggtcatcgacaagccctgggagacctttacccaggacaccctgacggccctgcagaagatcaccgtgagcttcaagcagaacctccgggtgatcaataagaccaccaaccactaccagcactacgagaacggcaagaagatcgtcagcaaccagtccaagggcgacagctgggcgatccgcaagtccatgcacaaggagacggtgcacggcgaggtgaacctgcggatgatcaagactgtcagcttcaacgaggccctgaagaagccgcacgcgatcgtggagatggacctcaagaagaagatcctggccatgctggagctcggctacgacaccaagcgcatcaagaactacttcgaggagaacaaggacacctggcaggacatcaacccctccaagatcaaggtgtactacttcactaaggagaccaaggaccggtacttcgccgtccgcaagcccatcgacaccagcttcgacaagaagaagatcaaggaatccatcaccgacacggggatccagcagatcatgctgcggcacctggagaccaaggacaacgaccccaccctcgccttcagcccggacggcatcgacgagatgaaccgcaacatcctgatcctgaacaaggggaagaagcaccagcccatctacaaggtgcgggtgtacgagaaggccgaaaagttcaccgtcggccagaaggggaacaagcgcacgaagtttgtggaggcggccaagggcaccaacctcttcttcgccatctacgagaccgaggagatcgacaaggacaccaagaaggtgatccggaagcgctcctacagcacgatccccctgaacgtcgtgatcgagaggcagaagcagggcctgtccagcgcccccgaggacgagaacgggaacctcccgaagtacatcctgtcccccaacgacctggtgtacgtccccacccaggaggagatcaacaagggcgaggtggttatgcccattgaccgcgaccggatctacaaaatggtcgacagctccggtatcaccgcgaacttcatcccggccagcaccgccaacctcatcttcgccctgcccaaggccacggcggagatctactgcaacggcgagaactgcatccagaacgagtacgggatcggcagcccccagtcaaagaaccagaaggccatcaccggcgagatggtgaaggagatctgcttcccgatcaaggtggaccgcctggggaacatcatccaggtcggctcctgcatccttaccaactga

SEQ ID NO: 8078 - RNA, 4563 nt, synthetic construct
  misc_feature 1..4563: note = Cas9 variant
  source 1..4563: mol_type = other RNA
atgaagaagatcgtgggcctggacctcgggaccaacagcatcggctgggccctgatcaacgcctacatcgacgagtacaacaaggagcacctgtacgggattgaggcgtgcggctcccgcatcatccccatggacgccgccatcctcggaaatttcgacaagggcaacagcatctcccagaccgccgaccggacgagctaccgcggcatccggcgcctgcgcgagcgccacctcctccggcgcgagcggctgcaccgcatcctggacctcctggggttcctgccgaagcactactccgacagcctcaaccggtacggcaagttcctgaacgacatcgagtgcaagctgccctgggtcaaggacgagaccgggtcctacaagttcatcttccaggagagcttcaaggagatgctcgccaacttcaccgagcaccaccccatcctgatcgcgaacaacaagaaggtgccatacgactggaccatctactacctgcgcaagaaggccctcacgcagaagattagcaaggaggagctggcctggattctgctcaacttcaaccaaaaacggggctactaccagctgcgcggggaagaagaggagaccccgaacaagctggtggagtactacagtctcaaggtcgagaaggtggaggactccggcgagaagaagggcaaggacacctggtacaacgtgcacctggagaacgggatgatctaccggcgcaccagcaacatccccctggactgggagggcaagacgaaggagttcatcgtcacaaccgacctcgaggccgacgggtcccccaagaaggacaaggagggcaacatcaagcggagcttccgcgcgcccaaggacgacgactggaccctgatcaagaagaagacggaggccgacatcgacaagatcaagatgaccgtgggcgcctacatctacgacaccctgctccagaagccggaccagaagatccgtgggaagctggtgcggaccatcgagcggaagtactacaagaatgagttatatcagatcctcaagacgcagtccgagttccacgaggagctgcgcgacaagcagctgtacatcgcctgcttaaacgagctgtaccccaacaacgagccccggcgcaacagcatctccacccgcgacttctgccacctgttcatcgaggacatcatcttctaccagcggcccctcaagagcaagaagtccctgatcgacaactgcccgtacgaggagaaccgctacatcgacaaggagagcggcgagatcaagcacgccagcatcaagtgcatcgcgaagtcccatcccctgtaccaggagttccggctctggcagttcatcgtgaacctgcgcatctaccggaaggagaccgacgtggacgtgacccaggagctgctccccacggaggccgactacgtcaccctgttcgagtggctgaacgagaagaaggagatcgaccagaaagccttcttcaaatatccgcccttcgggttcaagaagaccaccagcaactacaggtggaactacgtggaggacaagccctacccctgcaacgagacgcacgcccagatcattacccggctcggcaaggcccacatccccaaggcgttcctgtccaaggagaaggaggagaccctgtggcacatcctgtacagcatcgaggacaagcaagaaatcgagaaggccctccactccttcgccaacaagaacaacctgagcgaggagttcatcgagcagttcaagaacttccctccctttaagaaggagtacgggtcttacagcgccaaggccatcaagaagctgctcccactgatgcgcatgggcaagtactggtccatcaaaaacatcgacaacggcacccggatccgcatcaacaagatcatcgacggggagtacgacgagaacatccgggagcgcgtgcggcagaaggcgattaacctgacggacatcacccacttccgcgccctccccctgtggctggcctgctacctcgtctacgaccggcacagcgaggtgaaggatatcgtgaagtggaagaccccgaaggacatcgacctgtacctgaagtccttcaagcaacacagcctccgcaaccccatcgtcgagcaggtcatcaccgagacgctgcggaccgtgcgcgacatctggcagcaggtcggccacatcgatgagatccacatcgagctggggagggagatgaagtcccccgccgacaagcgggcccgcatgagccagcagatgataaagaacgagaacaccaacctgcggatcaaggcgctgctgaccgagttcctcaaccccgagttcggcatcgagaacgtgcgcccgtactcccccagccagcaggacctgctgcggatctacgaggagggggtgctcaactccatcctggagctacccgaggacatcggcatcatcctcggcaagttcaatcagacggacaccctgaagcgcccgacccggagcgagatcctgcgctacaagctctggctggagcagaagtaccggtccccctacaccggggagatgatccccctgagcaagctgttcacccccgcctacgagatcgagcacataatcccgcagagccgctacttcgacgactccctgagcaataaggtgatctgcgagtccgagatcaacaagttaaaggaccggagcctcggctatgagttcatcaagaaccaccacggggagaaggtggagctggccttcgataaacccgtcgaggtgctgtccgtggaggcctacgagaagctcgtccacgagagctactcgcataaccgcagcaagatgaagaagctgctgatggaggacatccccgatcaattcatcgagcggcagctcaacgactcccgctacatcagcaaggtggtgaagtccctgctgagcaacatcgtccgggaggagaacgagcaggaggcgatctcgaagaacgtgatcccctgcacgggcgggataaccgaccgcctaaagaaggactggggcatcaacgacgtgtggaacaagatcgtcctgccgcggttcatccgcctgaacgagctcaccgagagcacccgtttcacgtccatcaacaccaacaacaccatgatccccagcatgcccctggagctgcagaagggcttcaacaagaagcgcatcgaccaccggcaccacgccatggacgccatcatcatcgcctgcgccaaccgcaacatcgtgaactacctcaacaacgtgtccgcgagcaagaacaccaagatcacgcgccgggacctgcagaccctgctctgccacaaggacaagaccgacaacaacgggaactacaagtgggtcatcgacaagccctgggagaccttcacgcaggacaccctgaccgccctgcagaaaatcaccgtgagcttcaagcagaacctccgcgtgatcaacaagacgaccaaccactaccagcactacgagaacggcaagaagatcgtctccaaccagagcaaaggggactcctgggccatccgcaagagcatgcacaaggagaccgtgcacggcgaagtgaacctgcggatgatcaagaccgtctccctgaacgaggccctcaagaagccgcaggccatcgtggagatggacctgaagaagaagatcctggcgatgctcgagctgggctacgacacgaagcggatcaagaactacttcgaggagaacaaggacacctggcaggacattaaccccagcaaaatcaaggtgtactacttcaccaaagagaccaaagaccgctacttcgccgtccggaagcccatcgacacgtctttcgacaagaagaagatcaaggagagcatcaccgacaccggaatccagcagatcatgctgcgccacctcgagaccaaagacaacgaccccacgctggccttctccccggacggcatcgacgagatgaaccggaacatactcatcctcaacaaggggaagaagcaccagcccatctacaaggtgcgcgtgtacgagaaggccgagaagttcacagtcggccagaaggggaacaagcggaccaagttcgtggaggctgcgaaggggaccaacctgttcttcgccatctatgagacggaggagatcgacaaggacaccaagaaggtgatccgcaagagaagctactccaccatccccctgaacgtcgtgatcgagcggcaaaagcagggcctcagctccgcccccgaggacgagaacgggaacctgccgaagtacatcctgagccccaacgacctcgtgtacgtccccacccaggaggagatcaacaagggcgaggtggtgatgcccattgaccgggaccgcatctacaagatggtcgactccagcgggattacggccaacttcatcccggcatccaccgccaacctgatattcgccctgcccaaggccaccgccgagatctactgcaacggcgagaactgcatccagaacgagtatgggatcggcagcccccagtccaagaaccagaaggcgatcacaggcgagatggtaaaggagatctgcttcccgatcaaggtggaccggttggggaacatcatccaggtcggcagctgcatcctaaccaactga

SEQ ID NO: 8079 - RNA, 4575 nt, synthetic construct; identical to SEQ ID NO: 2279
  misc_feature 1..4575: note = Cas9 variant
  source 1..4575: mol_type = other RNA

SEQ ID NO: 8080 - RNA, 4581 nt, synthetic construct
  misc_feature 1..4581: note = Cas9 variant
  source 1..4581: mol_type = other RNA
atgaagaagatcctgggcctcgacctggggaccaacagcatcggctgggccgtgctgaacgccgcggacgacaactccctcaaatacatcgaggccgccgggagccgcatcatccccatggacgccgccatcctgggcgacttcgaccggggaaactccatcagccagaccgcggagcgcacgcggatccgcggcatgcggcacctccgcgagcggtacctcctgcgtcgggcccgcctgcaccggatcctgaacctgctgggcttcctcccgttccactacgcccaggacatcgaccggtacgggaacttctccgccgacatggagcccaagatcgcgtggcggaagaacctggagggcgagctggagttcatcttcatcgagagctttaacgaaatgctcgaggacttccgcaagaaccagcccgagctggtcgccgacaacaagaaggtgccctacgactgggtaatctactacctgcggaagaaggccctcgagaagaagatctccaaggaggaactggcctggatcctgctcaacttcaaccagaagcgcgggtactaccagctgcggggcgaagacgacgacgaaagcatgaagaccgcaaagacccgccagtactttgacaagcaaatcatcaaaaacatcatcgacaccaaccagacgtacaaggggcagcggatcctgatcgtcgagctccagaacggcgacaagggcaagatcttcaagaaggagatcccggactggatcgggcaggagaagaacatcatcgtgaccgtggacatcgacaaggacggcaacgacaagtacgaggagtccgggagcctgtcctgccgcttcaagatccccaccgacgcggagtgggaaagcgagtggaagctgatcaaaatgaagacccagaaggacttggacgaatccaacaagacggtcggcacctacatctacgacagcatcttgcagaaccccacccagaaggtgcggggcaagctggtgcgcaccatcgagcgcaagtactacaaggccgagctcaagcagatactggagaagcagacggagttccactccgagctgcaggacaaggacctctacatcgagtgcctgaacgagctgtacagcaacaacgacacccaccggaatgccatcaccgaccgcgacttcgtctacctcttcatgaacgacatcctgttctaccagcgccccctgaaatccaaaaagtcactcatcgacaactgcccctacgagcgcaacatctacatcgacaaggagaccggggagatcaaatactcccccatcaagtgcatagccaagagccaccccctgttccaagagtttcggctgtggaagttcatcagctccatccgcatctaccagcgggagagcgtggtggaggtcgtggacaagcagctcgacctgttctccagccagtccacgagcgtgcagaagctggtcaccgacgtggacgtgaccgacaagttcctgacctgcgagaacgattacgtcgccctgttcgagtggctgaacaagaagaagatcatcgaccagaaggagttcctcaagtaccgccccttcggcctgaagggggacatcgacaactaccggtggaactacgtggaggacaagtcctacccgtgcaacgagacgcacgcgatgatcctgacctacttcgccaaggccggcattagcgaggacatcctgaccaaggagatggaggaggccctctggcacatcctgtactccgtggaggaccgccaggagatcaccaaggccctgcggacgttcgcgtctaagtaccacctctccgacagcttcgtcaaggtgttctccaacatcccgcccttcaagaaggagtacgggagctactccgccaaggccatcaagaagctgctgagcttgatgcgcatgggcaagtactggtccgaggacgccatcgacgtgaacacccgggagcgcatcgacaagatagtcaccggcgagtacgacgagaagatccgggaccgcgtgcgggagaagaccatccgcctgaacgacatccggcacttccgcgccctgcccgactggctcgcgtgttacgtcgtgtacgaccgccacagcgagacgcgggagatcaccgagtggaagtcccccgaggagatcgatgagtacatccgcaacttcaagcaacacagcctgcggaaccccatcgtggagcaggtcattaccgagaccctgcgcacggtgcgggacatatggaagcaggtagggtgcatcgacgagatccacgtggagctcggccgcgagatgaagaaccccgccgacaagcggaagcgcatcaccagccagatcatcgagaacgagaacgccaacctgcgagtgaaggccctgctcaccgagttcgtgaaccccgagttcgagatcgagaacgtccgcccgtactccctggggcagcaggacatcctgcggatctacgaggacggcgtgctcaacagcgtggcggaggtccccggggacatcgccggcatcctgaagaagttcaacgagaacgatgccaagaagcgccccaccacgtccgagatcctgcggtacaagctatggctggagcagaagtaccgcagcccctacactggcgagatgatcccgctgtccaagctgttcaccagcgcctacgagatcgaacacgtgatcccccagtcccggtactttgacgacagcttctccaacaaggtgatctgcgaggccgaggtcaacaagctcaaggacaacgcgctggggtacgagttcatcaaaaagcaccacggcgagaaggtggagctcgggttcggcaagatcgtggagatcttcagcgtctccgtgtacgagcagttcgtgaaggacaactacagcagaaaccgggggaagatgaagaagctgctgatggacgagatccccgagcagttcatcgagcgccagctcaatgactcccggtacatctcaaaggtcgtgaagaccctgctgtccaacgtggtccgcgagaaggccgagcaggaggccgtgagcaaaaacgtgatcgtttgcaccggcggcgtgacggaccggctcaagaaggactgggggatcaacgacgtgtggaacaagatcgtcctgccccgcttcctgcgcctcaacgagctgaccaactcgaccaactttaccgccaagaacgccgcgggcaacgagatcccggccatgcccctggagctccagaaggggttcaacaagaagcggatcgaccaccgccaccacgccatggacgccattgtgatcgcctgcgcgaaccggaacatcgtgaactacctgaacaacgagagcgcctcacgcaaggccaagatctcccggcacgacctgcaggcgattctctgcgacaaggtccgcacggacgacaagggcaactaccagtggcgggtgaagaagccctgggacaccttcacccaggacgtgtacgtcgctctggagaacatcatcgttagcttcaagcagaacctgcgcgtgatcaacaagacctccaactactactggcactatgaaaacggcaagaaggtcttggtgaagcaggtcaagggggacagctgggccatccggaagccgatgcacaaggacacggtgttcggcgaggtgaacctgcgcaaggtaaagtccgtcagcctgaacgaggccctcaagaacccccagttcatcgtggagaaggacctgaagcggcagctcctctccctgctgcagcagaacttcgacatcaagaagatcaagaagtacttcgaggagcacaaggacatctggagcgacatctccctcagcaaaatgaacatctactacttcaccaaggagaccaaggaccgctacttcgccacacggaagcccctggacgcctctttcgacaagaaaaagatcgagagctgcatcacggacaccgggatccagcagatcctgctccgccacctggagctgaaggagaacgacccggagcgggcgttctccccggacggcatcgacgagatgaaccgcaacatcatccagctcaacaaggggaagggccaccaccccatcgccaaagtgcgggtctacgagaaggccgacaagttcgaggtcggccagcgcgggaacaagagctccaagttcgtggaggccgccaagggcaccaacctgttcttcgcggtctacgagaccgagtatcccgacgaaaagacgaacagcatcgtgcggaagcgaaactacgccaccatccccctgaacatcgccatcgagcgccagaagcgggggctctccaccgccccggaggacgagaagggcaacgtccccagcttcgtgctgagtcccaacgacttggtgtacctccccaccagcgaggacatcgtcaacgggcacatcacgcagccgatcgacaagagccgcatctacaagatggtgtccagctccggcagccagtgtttcttcatcaagcacaacatcgccaacatcatcgtggacaaatacgagttcagccccctgaacaagatggagcgggcgatcagcaacgagatgatcaaggagatctgcatccccgtgaaagtggaccgcctgggcaatatcgtgaagttggggaagtccgagtga

SEQ ID NO: 8081 - RNA, 4581 nt, synthetic construct; identical to SEQ ID NO: 2281
  misc_feature 1..4581: note = Cas9 variant
  source 1..4581: mol_type = other RNA

SEQ ID NO: 8082 - RNA, 4584 nt, synthetic construct
  misc_feature 1..4584: note = Cas9 variant
  source 1..4584: mol_type = other RNA
atggcaaagatcttgggcctcgacctggggacaaactctatcggctgggccatcgtggagaaggacgggaacgacttctctctggtcgacaagggcgtgcgcatcttcagcgagggggtaaagtccgagaagggcatcgagagctcccgggcggccgagcgcaccggctaccgtagcgcccgcaagatcaagtaccggcgcaagctccggaagtacgagacgctgaaggtcctgtccctcaacgggatgtgccccctgagcatcgaggaggtggaggagtggaagaagtccggcttcaaggaatacccgctaaaccccgagttcctcgagtggttacgcaccagcgacgacgagaacatcaacccctacttcttccgggacaaggcctccaagcagaaggtgactctgttcgaggtcgggcgcgccttctaccacattgcgcagcggcgcggcttcctcagcaaccggctcgaccagtccgccgaggggatcctggaggagcactgccccaagatcgaggccctcgtggaggatctgaacagcaccgatgagatcctgacgtccctcaaggattacttcttcgacacaggcatcctggacgccaacgagaagggcgggttcgcgaaggacctggacgagggcgacaagaagctcgtgagcctgtaccgctccatccaggccatcgtcaagaagaacgacaccgacttcgagaagggtaaggccgagatcatcgagcgtctgaacaagaaggacgtgctcggcaaggtgaagggcaagatcaaggacatcagccaggccatgctggaggggaacttcaagaccctgggccagtacttcttctccctctacaacaaggagcgcatccggaaccagtacacgagccgcgaggaccactatctggaggagttcaagatcatatgcaagttccaggggatcggcagcatcaaccagaatgagaagctgccggagaagaagttcgaggggctcgccaaggagctgtacaaagcgatcttcttccagcggcccctgaagtcccagaagggcctcatcggcaagtgcagcttcgagaagtccaagagccgctgcgctatctcccaccccgacttcgaggagaagcggatgtgggagtacctgaacaccatcaagatcgggacccagagcgagaaggtcctgcgcttcctctcccaggaggaaaagctgaacctgatccccaagttcctccgcaagaaggacaatttcaacttcgaggacctggccaaggagctgatcgagaagggcgccaccttcgggttctacaaaagctccaagcgggacagcttccactactggttcaactacaagccgacggacaccgtgtccggatgccccgtgagcgcctccctcaagagcgtcgtgggggaggactggaagaccaagtccttcatctacaagaccacgaacagcaagggcatcgaagtatcccgcaccgtcaactataaggacctctggcacctcctcagcgtatccaccagcgacatctacctgtacgagtacgcgaagaacaaactgggcctcgaggacaagaacgccaaggccttcagcaagatcaagctgaagaaggacttcgggaacttgtccctgaacgccatcaacaagatcctcccctacatgcgggagggcctgctgtacagccacgccgtgttcatggctaacatcgagtccatcgtcgacgaggtgatctggaacgacctcgggcagcgcaagtacatccaggacaagatcgccgccatcatcgccaacaacatcgtggacaacggcctgctggaggtcgtgaacgggctcatcaaggagtgcaaggtcgacggcgcctactacagcaaggaggcggccgacacctaccggaaggacctgtctaagaagctggttagcttcttcaagttccaccacatagacgacggcatcaagcaggagacgatcctcaacgagctgttccccgtgttcatcgagcagctgaaggcccacgagttcatcaaggtcaagcgcctcgacgagaaggtgctggagttcctgaagggggaaaaccaggacggcgaggtgttctgcaacaacgccaagcaactcaagaagctgtaccacccgtccgacatcgaggtcttcaagaaacagatcgtgaaggacaaggacgggaccgagaccggccagctgatcctgggctctcccctgacctccagcatcaagaaccccatggcgatgcgggccctgcaccagctccgcaaggtgctgaacacgctgatcgtcgaggaacaggtcgactccagcacccggatccacatcgagatggcccgcgagctcaacgacgccaataagcggaaggggatacaagactaccagaacgagaacaagaaggagcgcgagaagtacagggacgagatcaagaagctgtacctggccgagtgcaacaaggagatcgagcccaccgtggacgacctcctgcgctaccagctgtggatagagcaggaccggaaggagatctatgagaacggcaactccatcagcatctgcgacatcatcggggacaacccggcgtacgacatcgagcacactgtgccccgctccatcagccaggacaactcccagatgaacaagacgctctgcagccagaagttcaaccgggacgtgaagaaacagaagatgcccttcgaactgggcaaccacctagagatcctcccccggatcgcccactggaaggaggaggccgacaacctgagccgggaaatcgagatgatcatccgcagcaccaagaccgccgccaccaaggaggcgaaggacaagaagatccgccggcgccactacctgacgctccggcgcgactacctgcaggggaagtacgaccgattcatctggaccgagccgaaggtgggcttcaagaacagccagatccccgacacaggcatcatcacccgctacgcgcaggcctacctgaaaagctactttaaccgggtcgagagcgtaaagggcgggatggtggccgagtttcgcaaaatctgggggatccaggagtcctaccaggagaacggcaagaagtatttcaaggagaaggaccggagcaagcacacacaccacaccatcgacgcaatcaccatcgcgtgcatgaccaaggacaagtacgacgtcctcgcccacgcctggaccctggaggataaggagcagatcacggaggcccgcaagatcgtggccgagtccaagccctggaagaccttcaaggaggacctgaagaagatcgaggaggggatcctcgtgagccactacacccccgacaacgtcaagaagcagtccaagaagatcgtgcgggtgcgcggccggaagcagtacgtcgccgagatagagcgcgacgtgaacggcaaggccgtggccaagaaggacattagcgggaaggtcatctacaagctggacaaggacggcaagaagctgccgcggctccaacagggggacaccatccgcggctccctgcaccaggacagcatctacggcgccatcaagaaccccctgaagacggaggagatccggtacgtgatccgcaaggacctcgagtccatcaaggcgagcgacgttgacaacatcgtcgacgagatggtaaaggagaaggttaaggaggccatcgcctccaaggtcctgatcctgagctccaacccccagcagaagaacaagatcgacggcaaggtgtggatgaacgaggagaagggcatccccatcaacaaggtgcggctctacgccaacagcgtcaagaacccgctggagatcaaggagcactccagtctgagcaagtcccgccatgagcacaagcagaaggtgtacgggcagaacgacgagaacttcgccatggcgatctacgagggcctcgacaaaaaggggaagacggagcgggctttcgagcttatcaactacatggacgccggctactactacaagctgaagaacaagaacgagcgcaagaaggacatcatcagcctcgtgcccgagaagcatatcgaaaccgggtttaacctgctgcgctccaacaagatccccatcatcctcaagaagggcctgaacgtcatcctgtacaagaacgagaaggaggagatcgacttcaacaacccgaacagcatcatcaagcggctctacaagatctccggcctggacaaggacgggatcaagctgatgtactgcatcagcgccaagggctccaccgagaacatcgcctacatgaacgacgtgatcaacaagcagaagttattcgagctcaagagcgagatggagaagctgggactgtgggacaaggtgttctccgacttcaaaaacgacaacttaaagaagtccgacttcttcaagaagctgaatgacctcctgaacaagcactacttcgagaacaacgtctgcgacagcatcggcagcatcaagaaggtgaagatcaaggagtccgggctgacgacccccaagggcggggacgtgatcgacaacttcaaggacttcccctacattaagttcaaggtcagcaacttcaacgcgctcatcgaggggatcgacttcaagatctcccccaccggcaagttcgtgcagatctga

SEQ ID NO: 8083 - RNA, 4587 nt, synthetic construct
  misc_feature 1..4587: note = Cas9 variant
  source 1..4587: mol_type = other RNA
atgaagaagatcctgggcctcgacctggggaccaatagcatcggctgggccctggtggagcaggacttcaagaacaagcagggcaacatcatggggatggggtcccgcgtcattcccatgagccaggagatcctcggcgagttcgcccgcggcaacaccaagtccgagaccgcggaacgcaccaggctgcgcagcgtgcgacgcctgcgggagcgccacctcctgcggcgcgagcggctgcaccgcgtgctccacatcttggggttcctgccgaagcactacgtcaaccagatcgatttccaggagcgtctcggcaagttcttcgaggaatccgagcccaagctggcctacgacaccggggacttcctgttcaagcccagcttcctcgagatgctggaagagttcaagatccaccaaccctccttcgttgagggcgacaagaaggtgccgtacgactggaccatctacttcctgcgcaagaaggccctcacggaacggatcgagaaggaggagctggcctgggtcatcctgagctttaaccagaagcgcggttactaccagctccggggcgaggacgaggaggagaagcccaacaagctggaggagttctactccctgaagatcgtcgacatcaaggtggacgagagccccaacaagaagggcgacacctggtatagtctcaccctcgagaacggttggatctaccgccggagctccaaggtccccctggacgactggctcggaaaaacccgcgacttcatagtcacgaccgacatcgacgaggaggggaacccgaagctggacaaggagggaaaccccaagcggagcttcagggcgccctccgaggacgactgggggctgcgcaagaagaagaccgagaaggagatcctcgacagctccaagacggtggggcacttcattttcgagaacctgctcgcggaccccacgcagaagatcaagggccggctcgtcaggaccatcgagcggaagttctacaaggacgagctgaagcaaatcttagtgagccagaaccgcttccacccggaactcagtgatgcagacatgatggccgactgcgtgcgggagctgtacaagcacaaccacagccaccagaacttcctggccagcaaagacatcaagcatctcctggtcgacgacatcatcttttaccagcgccccttaagatcccagaagtccaccatcgggaattgccccctcgagttcaaaaccttcaagaaggacggcatcgagatcaaggtgccctacaaggtggcgcccaagagccacccgctgttccaggagttccgcctgctccagtgggtcagcagtctgcggatcatccgcaagagcgacgactccgacgtgacgcgggagttcctggggacacaggacaagaccaagcagctcctggactacctcatgacccagagcgagatggactgcaataagctgatgacgttcctcctgacccaggagggctacaagcgcaaggacctgaagtccgaggtgggcaagttccggtggaactatgtcttcgacagcgagaccggggagtccaagacctaccccggcaacagcacgcgcgccgagttcctcaagcggctggggaaggtggaaggcttcgacttctccaagtacaccgaggagttcgaggagagcctgtggcacctcgtgtactcggtcactgacaaggtggagttcgaaaaggccctgaggaagttcagccggaagaacgggatcgagatcaactccttcgtcgaaaacctgaagaagttcccgccctacaagagcgagtacgcctcctacagcctcaaggctatcaaaaagctgctcgcgctcatgcgattcggcgagaactggaaggaggacagcatcgactccatcagcaagcacagaatcgagaagatcctgaccggcgagtacgaccccgagatcaaggacaaggtgcgtgagatctcccgcgccttcgacgaggtggaggacttccaggggctccccgtctggtttgccaactacgtggtatacggccggcattctgaggcatcagagctcatcaagtggacgagctccgatgagatggccgactttatcaaggagttcaagcagcacagcctgcgcaatcccatcgtcgaacaggtcgtgctggagaccctcagggtggtcaaggacatctgggacaagtacgggcacggccagaaggacttcttcgacgaaatccacgtggagctggggcgcgagctgaaaaacccggcggagcagcgggcccgcctcacaacccagatctccgccaacgagaacacgaacctgcgtataaagagcctgctcgtcgagctgctgcacgaccccggcgtggagaatgtacgcccctacagcccaatgcagcaggagatcctaaagatctacgaggagggcgtcctcaagagctcgtttgaggtgccggacgacatcctgaagatctcgaagaccgcccagccctccagctcggacctgaagcggtacaaactttggctagagcagaagtaccgcagcccctacactgggaagatcatcccgctcaacaagctgttcacccccgcctacgaggttgagcacgtcatcccccagagccggtacttcgacgactcctttagcaacaaggtgatctgcgaggcggccgtgaacaagctgaaggacaacagactcggcatggagttcatcaagtgcttccacgggcagcgggtctccctaggcttcggcgaagaagtggagatcttcagcgagtccgcctacaaggcattcatccaggacaacttcccgaagaacccggcaaagaagagaaaattgctcatggacgagctacccgagcagatggtggagcggcagatgaacgacacgcgctacatcagcaagttcgtcacctccatcctgtcgaacattgtgcggtccgaggagaacgacaccgggttcaacagcaagaacatcatccccggcaacggaaagatcaccaccgcgctcaagcaggactggggtctgaacgacgtgtggaacgagcttatcctcccccgcttcgagcggatgaaccagctgacggggaccaccgtcttcaccgcctggaatgagaaccaccagaagttcctgccgacggtgcccctcgagtacgccaagggattccagaagaagcgcatcgaccaccggcaccacgccatggacgcgctggtgatcgcctgcgccacccgcgaccacgtcaattacctgaataacgagcacgccctcggcaagaattataaggggaaggaggagaagcagtccaggcggtttgacttgcgccagaagctgtgcctcaagaagaagaacggccacagccaggagcagtacgagtggatcttctccaagccgtgggacagcttcacccaggatgccaaaaagaacctggagcggatcatcgtgtcctttaagcaaaatctgcgcgtgatcaacaagaccagcaacaagtacttatcctacaaggatgaggaggggaaccttcgcctggacagccagggcaagccagtcaaggcgctcacgcgccagatcaagggtgacgcctgggccatcaggaagtccatccacaaggacaccgtgagcggcctggtgaagctgcgccgggtcaagatggtgaacctcagcgtggccctggacaaccctgagaacatcctgaacaagaagctcaagaagaagatcgcggagctggttaagctgaactacgacaataagctcctgctgaagtacttccgcgaccgggactacatgttcgacggccgcgaggtgtccaagctcgacgtgtactacttcgaggagggcctggcggcctcgagagtctccctggacaccagcttctccgacaagaagatccagagcatcaccgacacgggcatcagaaaaatcctcctggcccatctggccaactaccacgggcggctcgacgagaagggcaaggtgatcccgcccgagacgctggccttcacccccgaggggatcgaggagttgaacaagaacatcaagggcctcaacggcgggaagttccaccagcccatcttcaaggtgcgcacctacgagcccaaaggtaacaagttccaggtcgggttcaagggaaataagaactccaagtacgtggaggcggccaaggggacgaacctgttcttcgccatctacctgaacgacgagggcaagcggagctacgagaccatccccttcaacgtggtcatggagcgactaaagcagggcgaggggcccgtgccccaaaccaacgagaagggcgggaagctgctgttccacctctctccaaacgagctggtgtacgtccccgagaccgacgagaactacacgaatgtggacttcaagaacctgagcaaggagcaggtcgagaagatctacaagatggtttcctccaccggcagcgagtgccacttcgtgagagccgacatcagctccttgatcaaggggtacgacgcgaagacaaaggtcggcgagctagggagcctgaacaagcaggaggtgaccaacaacggtatgactcgcatcaaagagaagtgctggaagataaagatcgaccgcctcggcagtatctga

SEQ ID NO: 8084 - RNA, 4587 nt, synthetic construct
  misc_feature 1..4587: note = Cas9 variant
  source 1..4587: mol_type = other RNA
atgaagaagatcctgggcatcgacctcgggaccaacagcatcggctgggccgtggtcaactccttcgacgagaaccagaacgaggagagcctgaagcacatcgagtgcgtggggtcccgcatcatccccatggacgcagcgatcctgggcgacttcgacaaggggaacagcatctcccagaccgccaagcggacggagttccgcagcgtgcggcacctccgcgagcggcacctcctgcgccgggcccgcctccacaagatcctgtcgctgctcggcttcctgccggaccactacgtccaggacctggacagccacggcaacttccccgtgaacgtggaacctaagatcgcctggcggaaggactccaacggggccttcgagttcatctttaacgacagcttcgacgagatgctccaggacttcgcgacctaccagcccgagctgatcgcctgcaacaagaaagtcccgtacgactggaccatctactacctgcgcaagaaggccctcaccaagaagctgtccaaggaggagctgagctggatcctcctgaacttcaaccagaagcggggctactaccagctgcgcggggaggaggacgacgagtctgtcaagagcgccaagacgcggcagtacttcgaccgccagaagatcaagtccatcgtggacaccaatcagacatacaagggccagaaggtgctcatcgtggagctcgaggacgggatcaagggcaagattttcaagaaggagatccccaactgggtgggccaggaaaagtccatcatcgtcaccatcgacatcgacaaggacgggtgcgataagtacgaggagagcggcgagctgagctgccggttcaagatcccctccgacgcggagtgggagagcgagtggaagctcatcaagatgaagacgcagaaggacctggacgccagcgggaagaccgtgggcgcctacatttacgacgccatcctgcagaacccctcccagaagatccgcggcaagctcgtgcggaccatcgagcgcaagtactacaaggaggagctgaagcagatcctgaagaagcaggtcgagttccacccggagctccgggacaaggacctgttcctggactgcctcaacgagctgtaccccaacaacgacgcccaccgcaacgcgtgtgccgaccgggacttcatctacctgttcatggacgacatcctgttttaccagcgccccctcaagagcaagaagtccctgatcgccgactgcccctacgagaagcacatgtaccgcgacaaggagaccggggagctcaagtacagctccgtgaagtgcatcgccaagagccacccgctgttccaggagttcagactgtggcacttcatctccaacatccgcatctaccagaaggagcgggtggttgacgtggacgcggaccagagcgcgctctccagcgcccgatccgccctcaagagcaagctagaggccgatgtggacgtcacgaacgagttcctgacctgcgaggccgactacgtgtccctgttcgagtggctgaataacaagaaatccgtgagccagaaggactttctgaagtaccccgcgttcggcatcaagaagtccggggacaactaccggtggaactacgtcgaggacaagagctacccctgcaatgagacccgcgccttaatcctgagccacctggagaaggccaacatccggggcgatatcttcacccgcgagcaggaggaggccctctggcacatcctgtactccgtggaggaccggtacgagatcgtcaaggccctgcagagcttcgcggccaagtaccgcttcaacgacgacttcgtgacggtgttctctaagttcccgcccttcaagaaggagtacgggtcctacagcgccaaggccatcaagaagttgctgcccctgatgcggatgggcaagtactggtccgaggcggccatcgacattaagacccgcgagcggatcgagaagatcatcaccggcgagtgcgacgacagcatccgcgagcgggtccgcctcaaggccatccggctgcacgacatcggggacttccgcgccctgcccgtgtggctcgcctgctacgtggtctacgaccgccactcagagagcggcgacatcaccaagtggaagacgccccaggagatggactggtacatccagaacttcaaacagcactccttacgcaacccgatcgtggagcaagtcatcaccgagaccctgcgcgtggtacgtgacatctggaagcaggtagggcgcatcgacgagatccacgtggagctcggccgggagatgaaaaaccccgcggacaaacgcgccaagatgaccgcccggatgatcgagaacgagaacacgaacctgcgcatcaaggccatgctgaccgagttcctaaaccctgagttcgagatcgagaacgtgcggccctacagcgcctcccagcaggatatcctgcgcatctacgaaaacggggtgctgaacagcgtctccgagatcccggaggagatcaccggcatcctcaagaagttcaacgagcgcgagcagcgcaaacggcccagcacctccgaagtgctgcgctacaagctctggctcgagcagaagtacaggagcccctacacgggcaagatgatccccctggggaaactcttcaccccggcgtacgagatcgagcacatcatcccccagtcccgctacttcgacgacagcttcaacaacaaggtgatctgcgaggccgaggtgaacaagctcaagggcaacctgctggggtacgagttcattaagaagcaccacggccggcgcgtggacctcgggctgggcgagatcgtggacatattctccgtcgacgagtacgagaccttcgtgaaggactactacagcgccaaccagcagaagatgaagaagctgctcatggacgagatccccgagcagttcatcgagcggcagctgaacgacagccgctacatctccaaggtggtcaagagcctgctcagtaacatagtgcgggagcaggacgagcaggagagcatttccaagaatctgatcgtgtgcaccggcggggtcacggaccgtttgaagaaggactggggcatcaacgacgtgtggaacaagctcatcctaccgcggttccagcgcttgaacaacatcaccgagaccaccgagttcacggccaagaacatgcaggggcacgagatccccgtggtccccttcgagtaccagcgcggcttcaacaagaagcggatcgaccaccgccaccacgccatggacgcgatcgtgatcgcctgcgcgggccggaacatcgtcaactacctcaacaacgagagcgcccgcaagaaggcgcagatttcccggtacgacttacagcgcctgctctgcgataaggtcaagaccgacgacaacgggaactacaagtggatcctgaagaagccctggagcaccctgacgcaggacgtgtacgccgccctcgacaacgtgatcgtatccttcaagcagaacctgcgggtgatcaacaagaccaacaaccactacgtccactacgaggcaggcaagaagatcatagccaagcaggagaaggcgagctgggccatccgcaagccgatgcacaaggacacggtcttcggcgaggtgaacctgcggaaggtgaaaaccgtctccctcaacgaggccatcaagagcccccactgcatcgtgcagaaagacttcaagaagaagctgctgtccctcctcaagcagaacttcgacgccaaggaggtgaaggcctacttcgaggagcacaaggacgtctggagcgacatcaacctgagcaagatcgaggtgtactacttcaccaaggacaccaaggagcgcttcttcgcgacgcggaagcccctcgacagctccttcgaccgcaagaagatcgagagcgtgaccgacaccggcatccagaagatccttctgcggcacctcgaacagaagaatggggactccgacctggccttcagccccgacggcatcgaggagatgaaccagaacatcgtccagctgaacggcgggcgcaagcaccaaccgatcgtgaaggtgcgggtctacgagaaggccgacaagttcgccatcggccagcagggcaacaaggccagcaagtacgtggaggcggccaagggcacaaacctcttcttcgccgtctacgaggaggaggtgcgggacaagaagacgaacgccgtgatgttcaagcggaactacgcgtccatccccctgaacgtcgccatcgaccgccagaagaaggggctgtccactgcccccgaggacgagaatggcaatgcccccatcttcgtgctctccccgaacgacctggtgtacctgcccaccgccgaggacatcatcaacgcgcggatcagcttccccatcaacaagaaccgcatctacaagatggtctcctgcaccggctaccagtgcttcttcatcaagcaccacgtggccaacgtgatcgtggacaagaaggagttcagcgccctcaacaagatggagaaggccgagacgaacgagatgatcaaggacatctgcgtgcccatcaagctggaccgcctggggaacatcgtgaaaatcggggtctacaagtga

SEQ ID NO: 8085 - RNA, 4587 nt, synthetic construct
  misc_feature 1..4587: note = Cas9 variant
  source 1..4587: mol_type = other RNA
atgaagaagatcctgggcctcgacctggggaccaattcgataggatgggccgtggtaaactccttcgacgagaaccaaaacgaggagagcctgaagcacatcgagtgcgtggggtcccgcatcatccccatggatgcagcgatcctcggcgacttcgacaaggggaacagcatctcccagaccgccaagcggacggagttccgctctgtgcggcacctccgcgagcgtcacctcctgaggcgagcccgcctgcacaagatcctgtccctcctgggcttcctgccggaccactacgtccaggacttggacagccacggcaacttcccagtgaacgtggagcccaagatcgcctggcggaaggactccaacggggccttcgagttcatcttcaacgacagcttcgacgagatgctgcaggacttcgcaacctaccagcccgagctgatcgcctgcaacaagaaggtcccgtacgactggactatctactacctccgcaagaaggcccttaccaagaaactgtccaaggaggagctcagttggattctgctgaatttcaaccagaagcggggctactaccagctccgcggggaggaggacgacgaatccgtcaagagcgccaagacgcggcagtacttcgaccgccagaagatcaagtccatcgtggacaccaaccagacctacaagggccagaaggtgctgatagtggagctcgaggatgggatcaaagggaagatattcaagaaggagatccccaactgggtgggccaagagaagtccatcatcgtcaccatcgacatcgacaaggatgggtgcgacaagtatgaggagtccggcgaactcagctgtaggttcaagattccctccgacgcggagtgggagagcgagtggaagctgatcaagatgaagacgcagaaggacctggacgcgagcgggaagaccgtgggcgcctacatctacgacgccatcctacagaacccctcccagaagatccgcggaaagctggtgcggactatcgagcgcaagtactacaaggaggagctcaaacagatcctcaagaagcaggtcgagttccacccggagctgcgggataaggacctgttcctcgattgcctgaacgagctgtaccccaacaatgacgcgcaccgcaacgcgtgcgccgaccgggacttcatctacctcttcatggacgacatcctgttctaccagcgccccctcaagagcaagaagtccctgatcgcagactgcccctacgagaagcacatgtaccgcgacaaggagaccggggagctgaagtacagctccgtgaagtgcatcgccaagagccacccgctgttccaggagttccggctctggcacttcatctccaacatccgcatctaccagaaggagagagtggtcgacgtggacgcctgccagcccgacctcagctccgcgcgcagcgcactgaagtccaagctggaggccgatgtagacgtcacgaacgagttcctgacctgcgaggccgattacgtgagcctgttcgagtggctaaacaacaagaagtccgtcagccagaaggacttcctgaagtatccagccttcggcatcaagaagtccggcgacaactacagatggaactacgtcgaggacaagagctacccctgcaacgagacccgcgccctgatcctgtcccacctcgagaaagccaacatccggggcgacatcttcacccgcgagcaggaagaggccctgtggcacatcctgtacagtgtggaggaccggtacgagatcgttaaggctctccaatccttcgccgcgaagtaccgcttcaacgacgacttcgtgacggtgttcagcaagttcccgcccttcaagaaggagtacgggagctactctgccaaggccatcaagaagctgctgcctctcatgcggatgggcaagtactggagcgaggccgcgatcgacatcaagacccgcgagcggatcgagaagatcatcaccggtgagtgcgacgactccatccgcgagcgggtccgcctgaaggccatcagactgcacgacatcggggacttccgcgctctccctgtgtggctggcctgctacgtggtctacgatcggcacagcgagtccggcgacatcacaaagtggaagacgccccaggagatggactggtacatccagaacttcaaacagcacagcctgcgcaaccccatcgtggaacaggtcatcaccgagaccctccgcgtggtgcgtgacatctggaagcaggtcgggcgcatcgacgagatccatgttgagctgggccgggagatgaagaaccccgccgacaagcgagcgaagatgaccgcccggatgatcgagaacgagaacactaacctgcgcatcaaggccatgctcaccgagttcttaaacccagagttcaagatcgagaacgtcagaccttactccgcgtctcagcaggacatcctgaggatctatgagaacggggtgctcaactccgtcagcgagatccccgaagagatcaccggcatcctgaagaagttcaacgagcgggagcaacgcaagcggccctccaccagcgaggtgctgcgctacaagctctggctggagcagaaataccggtccccctatacgggcaagatgatcccgctggggaaactgttcacccccgcctacgagatcgagcacatcatcccccagagtaggtacttcgacgactccttcaacaacaaggtgatctgcgaggcggaggtcaacaagctgaagggcaacctgctcgggtacgagtttatcaagaagcaccacggccggcgcgtggacctggggctgggcgagatcgtggacatattcagcgtcgacgagtacgaaaccttcgtgaaggactactactccgccaaccagcagaagatgaagaagctcctgatggatgagatcccggagcagttcatcgagcggcagctgaacgacagccgctatatcagcaaggtggtcaagtccctcctgagcaacatcgtgcgggagcaggatgagcaggagtccatcagcaagaaccttatcgtgtgcaccggcggcgtcacggaccgcctcaagaaggactggggcatcaacgacgtgtggaacaagctgatcctgccccggttccagcgcttaaacaacatcaccgagaccaccgagttcacggccaagaacatgcaggggcacgagatccccgtggtccccttcgagtatcagcgcggcttcaacaagaagagaattgaccaccgccaccacgccatggacgccatcgtgatcgcctgcgccggccggaacatcgttaactacctgaacaacgagtccgcccgcaagaaggcccagatcagccggtacgacctgcagcgactcctgtgcgacaaggtcaaaaccgacgacaacgggaactacaaatggatcctgaagaaaccgtggtccaccctcacgcaggacgtgtacgcggccctggacaacgtcatcgttagcttcaaacagaacctgagggtgatcaacaagaccaacaaccactacgtgcactacgaggccggcaagaagatcatcgccaaacaggagaaggcgtcatgggcgatccgcaagcccatgcacaaggacacggtcttcggggaggtgaacctcagaaaggtgaagaccgtcagtctgaacgaggccatcaagagcccccactgcatcgtgcagaaggatttcaagaagaagctgctcagcctgctgaagcagaacttcgatgccaaagaggtgaaggcctacttcgaggagcataaggacgtttggtccgacatcaacctcagcaagatcgaagtgtactacttcaccaaagacaccaaggagcgcttcttcgctacgcggaagcccttggactccagcttcgaccgcaagaagatagagtccgtgaccgacaccggaatccagaagattctcctccggcacctggagcagaagaacggtgacagcgatctggctttctccccggacggcatcgaggagatgaatcagaacatcgtccagctgaacggcgggcgcaagcaccaacccatcgtgaaggtacgggtctacgaaaaggccgacaagttcgccataggccagcaggggaacaaggccagcaagtacgtggaggccgcgaagggcaccaatctgttcttcgccgtctacgaggaggaggtgcgcgacaagaagacgaatgccgtgatgttcaagaggaactacgccagcatccccctaaacgtcgcgattgaccgccagaagaaggggctctccaccgcccccgaggacgagaacggcaacgccccgatcttcgtgctgagccccaacgacctggtttacctccccaccgccgaggacattatcaacgcccggatctccttccccatcaacaagaaccgcatatacaagatggtcagctgcaccggataccagtgcttcttcatcaagcaccacgtggcaaacgtgatcgtggacaagaaggagttctccgccctgaacaagatggagaaggccgagacgaacgagatgatcaaggacatctgcgttccgatcaaacttgaccgcctcgggaacatcgtgaagattggcgtctacaagtga

SEQ ID NO: 8086 - RNA, 4590 nt, synthetic construct
  misc_feature 1..4590: note = Cas9 variant
  source 1..4590: mol_type = other RNA
atgaagaagatcctgggcctcgacctggggaccaacagcatcggctgggccgtggtcaactccttcgacgagaaccagaacgaggagagcctgaagcacatcgagtgcttagggtcccgcatcatccccatggacgccgcgatcctgggcgactttgacaaagggaacagcatctcccagacagccaagcggacggagttccgcggcgtgcggcacctccgcgagcggcacctcctgcgccgggcacgcctgcacaagatcctccggctgctgggtttcctcccggatcactacgtgcaggatctggacgggcacggcaacttcctggtcaacgtggagcccaagatcgcctggcgcaaggacagcaacgggaccttcgagttcatcttcaacgactccttcgacgagatgctccaggacttcgccacctaccagcccgagctcatcgcgtgtaaccggaaggtcccctacgactggaccatttactacctgcgcaagaaggcactcacgaagaaacttagcaaggaggagctgtcctggattctcctgaacttcaaccagaagcggggctactaccagctgcgcggggaggaggacgacgagagcgtcaagaccgccaagacccggcagtacttcgaccgccagaagatcaagtccatcgtggacaccaaccaaacgtacaagggccagaaggtgctcatcgtcgagctggaggacggcgtgaaggggaagatcttcaagaaggagatcccgaactgggtgggccaggagaagtcaatcatcgtcaccgtggacatcgacaaggacgggtgcgacaagtacgaggagagcggcgagctgagctgccggttcaagatcccctccgacgccgagtgggagagcgagtggaagctcatcaagatgaagactcagaaggacttggacgcgtccggaaagaccgtgggggcctacatctacgacgccatcttgcagaaccccagccagaagatccgcggcaagctcgtccggacgatcgagcgcaagtactacaaggaggagctgaagcagatcctgaagaagcaggtcgagttccaccccgagctccgggacaaggacctgttcctggactgcctcaacgagctgtacccgaacaacgacgcccaccgtaacgcctgcgcggaccgcgatttcatctacctgttcatggacgacatcctcttctaccagcggcccctgaagtccaagaagtccctgatcgccgactgcccctacgagaagcacatgtaccgcgacaaggagaccggggagctcaagtacagcagcgtgaagtgcatcgccaagagccaccccctgttccaagagttccggctgtggcacttcatctccaacatccgcatctaccagaaggagcgggtgatcgacgtggacgcctgccaaccggacctcagctccgcccgcagcgcgctgaaatccaagctggaggccgacgtggacgtcaccaacgagttcctgacctgcgaggccgactacgtgagcctgttcgagtggctgaacaacaagaagtccgtgagtcagaaggacttcctgaagtaccccgccttcggcattaagaagtccggggacaactaccggtggaactacgtcgaggacaagagctacccctgcaacgagacgcgcgccctcatcctgtcccacttggagaaggcgaacatccggggcgacatcttcacccgcgagcaggaggaggccctctggcacatcttatacagcgtggaggaccggtacgagatcgtcaaggccctgcagtcctttgccgccaagtaccgcttcaacgacgacttcgtgaccgtgttcagcaagttcccgcccttcaagaaggagtacggctcctacagcgcgaaggccatcaagaagctcctgcccctgatgcggatgggtaagtactggtccgagagcgccatcgacatcaagacccgcgagcggatcgagaagataatcacgggagagtgcgacgacagcatccgcgagcgggtccgcctcaaagccatccggctgcacgacatagagcacttccgcgcgctgcccgtgtggctcgcctgctacgtggtctacgacaggcattccgagagcggggacatcatgaagtggaagacgccacaggagatggactcctacatccagaacttcaagcagcacagcctgcggaacccgatcgtggagcaggtcatcaccgagaccctgcgcgtggtgcgggacatctggaagcaggtcggccgcatagacgagatccacgtggagctcgggcgggagatgaagaaccccgccgacaagcgcaaggaaatgaccaagcggatcatcgagaacgagaacaccaacctgcgcatcaaggccatgctgaccgagttcctcaaccccgagttcgagatcgagaacgtacggccctactccgcctctcagcaggacatcctgcgcatctacgagaacggagtgctgaactccgtcagcgagatcccggaggagatcaccggcatcctcaagaagttcaacgagcgggagcagcgcaagcggccctccacgagcgaggtgctgcgctacaagctgtggctcgagcagaagtactgctccccctacaccgggaagatgatccccctgggcaagctgttcacccccgcgtacgagatcgagcacgtgatcccccagagccggtacttcgacgactccttcaacaacaaggtcatctgcgaggccgaggtgaacaagctcaaggggaacctgctgggctacgagttcatcaagaagcaccacgggcagagagtggacctcggcctgggcgagatcgtcgacatcttcagcgtggacgagtacgagaccttcgtgaaggactactactccgggaaccagcaaaagatgaagaagctgctcatggacgagatccccgagcagttcatcgaacggcagctgaacgacagccgctacatctccaaggtcgtcaagagcctgctcagcaatatcgtgcgggagcaggacgagcaggagtcgatcagcaagaacgtgatcgtgtgcacaggcggggtgaccgaccgcctgaagaaggattggggcattaacgacgtctggaacaagctgatcctcccgcggttccagcgcctgaacaacataaccgagaccacggagttcaccgccaagaacatggaaggccacgagatccccgtggtgcccttcgagtaccagcgcgggttcaacaagaagcggatcgaccaccgccaccacgccatggacgccatcgtcatcgcgtgtgcctcccggaacatcgtgaactacctgaacaacgagagcgcccgcaagaaggcccggatctcccgctacgacctccagaagctgctgtgcgacaaggtgcggacggacgacaacggcaactacaagtggatcctcaagaagccctgggggaccctgacccaggacgtctacgccgctctggacaacgtgatcgtgagcttcaagcagaacctccgcgtcatcaacaagacgaagaactactacgtgcactacgaggccgggaagaagaccatcgccaagcaggagaaggggtccagctgggccatccggaagccgatgcacaaggacaccgtgttcggcgaggtcaacctgcgcaaggtcaagaccgtgtctctgaacgaggcgatcaagaacccccagtgcatcgtcgagaaggacttcaagaagaagctcctgagcctgctcaagcagaacttcgacgccaagaaggtgaaggcctacttcgaggagcacaaggacgtgtggtccgacatcaacctgagcaagatcgaggtctactacttcacgaaagacactaaggaacggttcttcgccacccgcaagcccctggactccagcttcgacaagaaggagatcgagtccgtgaccgacacgggcatccagaagatcctcctgcggcacctggagcagaagaacggggaccccgacttggcctttagcccggacggcatagaggagatgaaccacaacatcgtgcagcttaacgggggccgcaagcaccagcccatcgtcaaggtgcgggtctacgagaaggcggacaagttcgccatcgggcagcagggcaacaagtccagcaagtacgtggaggccgctaagggcaccaacctgttcttcgccgtgtacgaggaggaggtcagagacaagaagaccaacgcggtgatgctcaagcggcactacgcctccatccccctgaatgtggccatcgaccgccagaagaaggggctgagcaccgcccccgaggacgagaatggcaacgtaccgatcttcgtgctcagccccaacgacctggtgtacctgcccacggccgaggacatcgcgaacgccagcatctcattccccatcaacaagaaccggatctacaagatggtatcctgcaccgggaaccgctgcttcttcattaaacaccacgtggccaacgtgatcgtcgacaagagcgagttctccgtgctcaacaagatcgagaaggctgagaccgacgagatgatcaaggagatctgcgtgccgatcaagatcgaccgcctgggcaacatcgtcaagatcggggtgtacaagtga

SEQ ID NO: 8087 - RNA, 4608 nt, synthetic construct; identical to SEQ ID NO: 2287
  misc_feature 1..4608: note = Cas9 variant
  source 1..4608: mol_type = other RNA

SEQ ID NO: 8088 - RNA, 4608 nt, synthetic construct; identical to SEQ ID NO: 2288
  misc_feature 1..4608: note = Cas9 variant
  source 1..4608: mol_type = other RNA

SEQ ID NO: 8089 - RNA, 4614 nt, synthetic construct
  misc_feature 1..4614: note = Cas9 variant
  source 1..4614: mol_type = other RNA
atgaagaagatcctgggactcgatctggggaccaacagcatcggctgggccctgaccacgaacgacttcgacaccaagaaggggaccatcgagggcctagggtcccgcatcatccccatgagccaggacatcctgggcaagttcgactccggcgtgagcctgtcacagaccgcccagagaacggagtaccgcgggaagcggcgcctcgtccagcggttcctactgcgccgggagcgcctccaccgggtgctgcacattctggagctcctgccgaagcagtacagcgaggcgatcgatttcgacaagaagctgggccagttcaagcccgagcgcgagcagaagatctccttctacaagaacgagagcgggaagaaccagttcatcttcaccaagtcccaccaagagatgctcaccgagttccagacctactaccccaccatcaagaacatcccctacgactggaccatctactacctgcggaagaaggccctgaccgagaagatcagcaaggaggagctcgcctggatcctgctgaacttcaatcaaaagcgcggctactaccagttgcgcggggaggagaaggaggagaacaagaacaagaaggaggagttccacaccctactggtgacggatataatcgagcgggacaagggcaagtccggcacctggtacaacgtcatcctcgagaacgggtggatttacaagcgggagagcaaaatctccctggccgattggatcggcaagaccaagtcattcatcgtgaccacggagtacaacgacgacgggtccgtgaagctgaccaaggacaacgaggagaagcgcagcttccggtccccgaaggaggacgattggggcctcatcaagatccgcaccgagaagaccatcaaccagagcgacaagtccgtcggcgcctacatctacgacgcgctgctgaagaaccccaaccagaagatcaagggggagctcgtgcggacgatcgagcgcaagtactacaaggacgagctgcgggagatcctgaagaaacagctcgagttccactcggacgtgctgaacgacaagatcctgtacaagaagtgcatcgacgaactctacaaaaacaacgacagccacaagaactccatcaaggaccgcggtttcgactacttgttcctggacgacataatcttctaccagcgacccctcaagagcaagacctccctgatcagcgactgctccctggagttccggcccatcaagaacaagaacggggtcctcgtgaaggacaccgacggcaagcagatcgccaaggccttgaagtgcatagcccgcagcaacccgatcttccaggagttccggctgctccagttcgtgaagaacctgaagatctacaagcgcggggtcgtggacgacgtagaggtcaccaacgactacctgaagtccgagaacgacgtggagaagctgttcaactggctcaacgacaaggcggagatcaaccagaagcagttcctggtgaacttcaagctgaaggaggacaagcaccggtggaacttcgtcgaggacaagggctacccctgcaacgagacgcgcaaccagttcctaaacgccatcgccaagatcgacgtggacaagagtttcttcaacaccaagaacacccaggacctgtggcacatcctgtacagtgtgaccgacaagatcgagatcacgaaggccatcaccaccttcgccaagcggcacaacctccccaacgagttcatcatcaacttcagcaagatcaagccctacaagaaggagtacggctccttctccgagaaggcgatcaagaagctgctgcccctcatgcgcttcggatcctactgggacgccaagaacatcgacatcaagactctggaccggatcgacaagatccagacgggcgagttcgacgagaagatccgcaaccgggtccgcgagaaggccatcgacctgcacaagatcgacgacttcaaggacctccccctgtggctagccagctacatcgtgtacgacaagcactcagaggccagcgacgtgtccaagtggaagacccccgcggacatcgagaagttcctcaaacacgagttcaagcaacacagcctgcggaaccccatcgtcgagcaggtcataaccgagaccctgcgcgtggtgaaggacatctggctccagtacggggagggcaaggagaacttcttcaacgagatccacatcgagctggggcgggagatgaagaacgacaaggccacccgggagaagatctccaagaaggtcagcgagaacgagaacaccaacctgcggatcaaggccatcctcaccgagctgaagaacgacggcgtctcggacatccgcccgtactcccccagccagcaggagattctgaagatctacgaggagggcgtgtacaacaatgagtcccggaaggagaagctcgaggaggtggacaagatccgcaagaacgccaagcccaccaccagcgagatcatcaagtataagctgtggctggagcaggggtacgcctccccctacacgggcaagctcataccgatgagcgagctgttcacaaccaagtaccagatcgagcacatcatcccccagtcgcgcttcttcgacgacagcctgtccaacaaggtcatctgcgagtcggaggtgaacgagctcaagtccaacatgaccgcgctggagtttatcctgacgaacgagaaccggatcgtgaccctcaccgggggcgagaccgtcaagatcttcacgaaggaggcctacaaccagcacatcatctcgtactactccaagaacaagaacaagcagaagcgcctgctgaccgaggagatccccgagcagtttatcagccggcagctcaacgacacgaagtacatctccaagatcgtgaagaacctgctgagcaagatcgtgcgtgaggaggacgagcaggaggtcacctccaagcacgtggtgtcgctcaacgggagcatcacgtcccggatgaagcaagactggggcctgaacgacgtctggaacaccatcgtgagcccccgcttcgagcggctgaacaccctcaccaactccaacgacttcggccagttcgagctgaaaaaggacgcctacgggaacgagggcaagcgcgtgttccagacgaccgtcccggacgccatcgccaaggggttcaccaagaagcggatcgaccaccgccaccacgcgctggacgcacttgtgatcgcctgcgtgaaccggacccacatcaactacctgaacaatctgaacgccaaagacacggacgacaaggcggtcaagcacgagctccgcaacaagctgtgcttcaagaccaagcccgacagcaacggcaactacaagtgggagttccacaagccctgggagaagttcacgaaggaggcccaggacaagctgaacacaacgatcgtgtccttcaagcagaacacccgggtgatcaacaagaccgtcaacaagtacgtgagctacaaggacgagaacggcaacctcaacgtggacgccaacgggctgccccagaagaaggtcatcacgcagacgaagggcgataactgggccatccgcaaaccgctgcacgccgagaccgtatcagggaaggtgttcctcaagcggatcaagcagagccacatcaccatcgcgaacgccatcgaacaggtcgagctgatcgtggacaaggaggtgaagaaacagctgaaggccaagatcaagctctaccccaacaacatcgccggcctgaagaagcacctgaaggccttccccgtcatgatcaacgacaaggcaatcgacaagatccagatctacgagaccctcgaggccacggccacccgcaagatccttgacatcaccttcgacgagaagaagatccagaagatcaccgacacggggatccaaaagatcctgcttaaccacctgaagcaggagaagtaccagaacaccgtagacgagaatggcaagaagctggctccgcacgagatcgccttctcagagaacggcctcgaagacctgaacaagaacatcaccttcctgaacgacgggaagaaccaccagcccatcaagaaggtgcggatcttcgaggagggcaacaagttccccctcggggaggttggcaacaagatcaacaagttcgtggagaccgcgaaggggaccaacctgttcttcgcagtgtacgagaacgacgacaagaaacgcaactacaagacgatacccttcaacgaggtcatcgagcggcagaagcagggcctgaacgccgccctcgagatcgacgagaacggcaaccgcctgctgttcactctcagcccgaacgacctggtgtacatccccctggaggacgagatcgggtacctcaacggcgtgtacttcaagaacctgaacaaggagcaaacggtccggatctacaagttcgtgagctgcaccgggggcgaggggcatttcgtgcccaacaactacagcaaggagatcatctccaacgagaacggcagcaacaacaagaacgagcgcatgctgaacttcaacaacttcaacatcatcttcgacggcaaggaaaagcccgtcatgatcaagtccatctgctggaagctcgaggtggaccgccttggcaaggtgatcaagatcatcaagtga

SEQ ID NO: 8090 - RNA, 4617 nt, synthetic construct
  misc_feature 1..4617: note = Cas9 variant
  source 1..4617: mol_type = other RNA
atgaagcacatcctgggcctcgacctggggaccaactcaatcggctgggccttggtgaagtccgagcaggactgcgacgacgtcgagcgcatcaacgggatcgaggccgcgggcagccggatcatccccatggacgccgccgtgctcggcgacttcgccaagggcaacaccaagtcccagacggccgaccgcaccgcggccagaggcatccgccggatgggggagcgccacaagctgcggcgcgagcggctgaaccgcgtactcgacgtcatgggcttcctgccggagcactacagcgccgccctgacccgctacgggaagttcaaggacggcgaggagtgcaagatcgcgtggcgcaaagacgagagtgggcagtggaccttcgtgttcgaggacagcttccgggagatgctcgctgacttcgtggcccaccagcccgagtggctggccggcggccgcaaggtcccgtacgactggactatctactacctgcggaagaaggccctctccaagcccctgacaaagcaggagctggcttggctcctgctgaacttcaaccagaagcgcgggtactaccagctccggggcgaggacgagcacacggacgacaaggggaagctggtggagtactacgccctgaaggtggtcggcgtggaggacaccggcgacaagaaggggaaggacacgtggttcaacatcatgctcgagaacggcatggtctaccgccggccggccgccgaggcccccgactggatcgggaagaccaaggagttcattgtcaccaccgacctggagaaggacggcacgcccaagaaggacaaggaggggaacatcaagcgcagcttccggatgcccaaggaggacgactggaccctgatcaagaagaagaccgagaacgacatcgaccgctccggcaagaccgtgggcgagtacatctacgacgcgctcctggccgacccgacgcagaagatccgcggcaagctggtgcggaccgtcgagcgcaagtactacaaggaggagctcaagaagatcatcaactcccaaaagcggttcatccccgagctgaacgacaacgagctgtacggccgctgcatctccgagctctaccagagcaacgacgcctaccggcagtccatcagctcctgcgacttcacctacctgttcgtggacaacatcatcttctaccagcgccccctcaagagcaagaagtccctgatcgacaactgcccctacgaggagcacagctacaccgactccaagacgggggaggtgaagaccgccccggtcaagtgcgtggctaagtcaaaccccctgttccaggagttccggctgtggcagttcgtgcagaacatccgaatcttcgagcggcagaagaagatcggcgacagcgtcaagaccgacgtggacgtgaccggagagttcatcaagtccgcggacgacgtcgtgagcctcttcgacttcttgaacgaccgcaaggacatcacgcagtccgtcctgctcgggacctacttcaaaatcaagaagcccaaaggcaaggacagcgactacccctaccggtggaactatgtggaggacaagacctacccgtgcaacgagacccgcgccctgatcctgaaggggctcaaggacgccggcatcgacgaggggttcctggacaaggacaaggagtactccctgtggcacattctctacagcgttgaggacaagcaggagatcacgaaggccatggagaagttcgccgcgaagaactctctgggcggtaagttcgccgaggtcttcagctccctgccgcccttcaacaagaactacggcagctactccgagaaggccatcaagaagctcctggccctgatgcggacgggcaaatactggagcgcggacgccatcgacaaacacaccctggagcgcatcgacaagatcatcaacggagagtacgacgagtccatccggacccgcgtgcgggagaaggccatcaacctcacggacgtgagccacttccgcggcctgcccctgtggttggcctgctatatcgtctacgaccggcactccgagagcaaggacatcacgtgctggaactgccccgccgacatcgaccagtacctggaccacttcaagcagcactccctgcgcaaccccatcgtggagcaggtcgtgaccgagaccctccgcaccgtgcgggacatctggcgccagtacgggaagatcgacgagatccacatcgagatgggcagggatatgaagaaccccgcggacgtgcgcgccaagatgagcaagcggatgatcgacaacgagaacgccaacctgcgcatcaaggcaatgctggccgagttcgcggaccccgacttcggcatagccggggtacggccgtactcccccagccaacaggagatgctccgcatctacgaggagggcgccctggagagcgtggacgaggtgcccgacgagatcaacgagatcatctccaagttcaaccagaccgacatcaagaagcggcccacccatggggaaatcatcaagtacaagctgtggctcgagcagaagtaccagagcccgtacactggccgcaccatctcccttagccggctgttcacggacgactaccaaatcgagcacgtcatcccccagtcccgctacttcgacgacagcatgtccaacaaggtgatctgcgaagccgaggtgaaccagctcaaggaccggatgctgggatacgagttcatcaaagcccaccatggcgagaaggtcctgctcagctccggcgagaccgtgaccatcctgaccgcggaggagtacgagcgcctggtgcagctcaacttccggaagaaccccgtcaagatgaagaagctgctgatggacgacatcccggacaagtttatcgagcgccagctcaacgacagccggtacatctccaagaagatcaagagcctgctgtccaacatggtgcgcgacgagggggagcaggaggacatcagcaagaacgtgattgcctgcaacggcgccatcacggaccggctcaagcgcgactggggcgtcaatgacgtgtggaaccacatcatcctgccccggttcgagcgcctgaacgccgtgaccgggtccgaccgcttcaccaccacgagcaccaacgggcacaccatccccgacatgcccctcaacctgcagaagggcttcaacaagaagcggatcgaccaccgtcaccacgcgatggacgccatcgtcatcgcctgcaccacgagatcccacgtgaacctgttgaacaacgaggccgccatgagcaagaacaacgcggtgcgctaccagctgagccggaagctgcgccggtacgaggataccatggtcacccgcaacggcgagacccggacgatctccgtggcccgggagttcctcaagccgtggcccaccttcaacgccgacgtggagaaagccctgcgggggatcgtcgtgagcttcaagcagaacctgcgcgtgatcaacaagaccgtcaacaagtaccagaagttcgtgtacaacgaggagaagcacatcaaggagaagaaggccgtgcggcaggaagaacgcaacggccggcacctcctggcgatccgcaagcccatgcacaaagacaccgtctacggggaggtgaacctccggaggatcaaggaggtgtccctcaaggacgccgtcgccaaccccaaggccgtggtggataaggacctgaagaagaagctgatggcgatgatcgaactcggctacgacctgaagcagatcacgaagtacttcgaggacaacaaggatgcgtggcaggacgtcaacctgaagaagatcaaggtgtactacttcaccaaggacaccggggaccggtacttcgccacccgcttcggcaatgacctcgtgacgctgttcagcaagatcaccaaggccgacgacgccaagaagcagatcgagcgcatcaccgacaccggcatccagaagatcctgaaacggcacttagaggcgaacgggggcgactgccagaaggccttctccgccgacgggatcgacgagatgaaccgcaacatcactcagctgaacgggggtcggccgcacaagcccgtctacaaggtgcgcatctatgagaaggccgacaaattcgccataggcaccaagggcaacaaggcggccaagttcgtggaggccgcaaaggggaccaacctgttcttcgccgtctacctgaaggagtacgaggacagcaccacgggcgagaccatcaagaagcgggtgttcgacaccatccccctgaagaccgtcatcgaccgcctgaaaaacgggcagactcccgcgccggaggagaaggacggcgccaagctcttgttcgtgctgtcccccaacgacctcgtgtacctgcccaccgaggacgtcgtgaagaacggcaccatcaaccggcccctggacaagcgccggatctacaagatggtgagctgcaccgggaccgagtgctactacatcccgttcatcgtcgcctcccccatcgtggacaaggtggagttcttctctctcaacaagatcggcagggccatcaccggggaaatgatcaaggagatctgcatccccatcaaggtcgaccggctgggcaacatcacagaggtgaacaacgagaagatctga

SEQ ID NO: 8091 - RNA, 4623 nt, synthetic construct
  misc_feature 1..4623: note = Cas9 variant
  source 1..4623: mol_type = other RNA
atgaacaagatcctgggcctcgacctgggtaccaacagcatcggctgggccctggtggggacggacgaggagggcaacccaatccgcatttacaagtccgggagcaggatcatccctatgtcacaagacgtcctcggcaactttgaccgcggcaacagcatcagccagacggccgagcggaccagctaccgcggggtgcgccgactgagagagcgccacttgctgcgccgggagcggttacaccgcgtgctgcacctcatggggttcctgcccagccactatgaagaggcaatcgggtgggacaagggcgataacaagaccttcgccaagttctacagcgacacagagccgaagctgccctggcggaagaacgctgagcgcgagcatgagtttctcttcaacacgccctacaacgagatgttagtggacttccggaagaaccagccccagttattcaaaatcaagaagaacggtcaggagtcgctcatcccatacgactggaccatatactacctgcgcaagaaggccctgagcaagccgatctctaaaaaggagctcgcctggatcattcttaacttcaaccagaagcggggctactaccagctgcgcggcgaggaggaggaagaaaacagcaacaagctcatcgagtaccacgcgctaacagtggtgaaggtcatcgccgacgagccacagaaggggaaatccgacatctggtacaacgcagagctggagaacggctgggtgtaccggcgcagctcgaaaacgcccttattcgactgggagtccaaggtcaaggagttcgtagtgaccaccgaccttaacgccgacgggtccctgaaggtggacaaggaaggcggcgtcaaacggagcttccgcgtgccctccgaagacgactggatgctggtgaagaagaagaccgaaagcgacatcgaaaagtcagacaagaccgtcgggtgctacatctacgacacgatcttgcagaacccctcgcagaagatccgcggtaagctggtgcgaacgatcgagcgtaagttctacaagaaggagctcacagagatcctgaacaagcagaaagaatttcactcggagctgcagaataaggagctctaccaggagtgcatcaaagaactgtaccctcacaacgaagcgcactacgactctctgttagtcaaggactacaccgatttattcgtcaacgacatcatcttctaccagcggcccctcaagtccaagaaatcactgataagcaactgcccatacgagtaccgcgtgtatcggaacgactccggcatcgtagagcgcgtccccatcaagtgcatagccaagagccacccgctgtaccaggagttccggctgtggcagttcatccacaacctccgcatctacgaacggcagcgcgaagttaacggcaagcccgagacagatgtggacatcaccgcggagttcatccccaccaccgaggaccgggtcaagctgttcgactggctgaacaacaagaaggaaatcaagcaggacacgctcctgcagtcctatttcaagatcaagaagaagaagggagacgacaaattcccctaccgctggaactacgtggaagacaaggagtacccgtgcaacgagacccgggccctgatactcagtagattaaccaagctgaacctgtctgaggacttcctcaccaaggagatggagctggccctgtggcatatcctctacagcgtcgaggacaaggaggagatcaagaaggcgttcaagtccttcgcccagaaacacaacctggacgacagcttcgtggaccagttcatcaaattcccgcccttcaagaaggattacggctcctacagcgccaaggccatcaagaagctgctccccctgatgagaatcggcaagtactgggatgaaaaggccatctccgggaacacgcgcagccggatcctgagcatcaacgagcgcctcgaggacatgcgtagcagcggcaagaagatcgaggacgtgtccgacgacgacatccccaagcaggtcctcaagagcttcgacaaagttaacggcgtgtactccggcctgaacacctaccaggcatgctacgccgtctacgggcgccacagcgaggcctccgagatcaccaagtggaagacgccccaggacatcgacgactacctgaacgagttcaagcagcacagcctgcgcaaccccatcgtggagcaggtcatcaccgagaccctgcgggtggtgcgtgacatctggaagaagtacggcgacttctccgagatccatatcgagctcggaagagagatgaagaaccccgctgataaacgcgccaaaatgaccacccaaatcagcgagaacgagaacacaaacctgcggatgaaatctctgctcgcggagctgaagaaccacaacgacgtggagaacgtccgaccgtacagccccagccagcaggagatactgaagatctacgaggagggggtgctcaacagcgtatccgagatcccggaggaaatcatcaagatcaccaagagctcccagccgagccagactgagctggtacggtacaaactttggctcgagcagaagtaccgctccccctacaccggcgagatcatccccctagggaaactcttcacgtccgcctatgagatcgagcacgtgattcctcagtcccggtatttcgacgactctctctcgaacaaggtgatatgtgagtcagaagtcaacaagctgaagggcaacctgctcgggtacgagttcgtcaagaaccaccatggcgtgaaggtcgaactgaacttcaacaagaccgtggagatcttcagcatcaacgagtacgaggagttcgtgaagggcaactacgggaagaaccgcggcaagatgaagaagctgctcctggaggacatcccgaagtctttcatcgagcggcaactgaacgacacccgctacatatcaaaggtcgttaaaggactcctgtccaacatcgtgagggaggacggcgagcaggaggccacgagcaagcatgtgattccctgcaccggcggggtcacgaccattctgaagcaggactgggggctcaacgacgtgtggaacaagatcgtcacgccccgctttgagaggatgaacgaactgaccaacacctccctgttcgggcagtgggagaacaaggagggcaaacgcatcttccggaccgaggtgcccctcgagctgcagaagggattcaacaagaagcgcatcgaccaccggcaccacgccatggacgccatcgtgatcgcgtgcgccaccagaagccacgtcacctacctgaacaacgagtccagcaaggccaacgctaaggagattagggacggcctcaagcacaagctctgcttcaagtccaaaacggacgagacgggcaactacaagtggcagttccacaagccgtgggacaccttcacccaggacgtgcaggacacgctggagaacattgtgatcagcttcaagcagaacctccgcgtcatcaacaagaccaccaaccgctaccaaaagtacgaggaagagaagaaaatcctgaagtcccaggagaagggggacagctgggcgatccggaagcccctgcataaggacaccgtattcgcaaaggtgtccttacagaagatcaagtgcgtcaaactggccatggcccttaaggactggaagaacatcgtggataaacaactcaagaaggagatccggcggctgatcctgagctacggcaagttcgacgctgagatcctcaacaagtacttcaaggaccgcaagtacatctttaaggacgtggacatctccaaggtcgatgtatactattttgagacggagtacgttgcgacccggaagaacctggacaccagcttcgaccgcaagagtatagagtccatcacagacacggggatccagaagatcctgctcaaccacctgggagtaaagaacaacaaccccgagctggccttcagcgcggaagggatcgacgaaatgaaccaacggatcgtggaactcaatggcggcaagcaacaccagcccatctacaaggtgcgcatgtacgagccgcttgggaacaagttccaggtcggccggatcggtaacaaaaaggacaagtacgtggaagcagcccccggcacaaacctgttctatgcgatctaccagtccgaggataaaaagcgcatctacgacaccatccccctcaacatcatcatcgagcggcagaagaaggaactgttccccgtgccagagaacaaagaggacaaggacaacctgtacaagctcctgttctggctgagcccgaacgacatggtctacctgcccactgagaaggagtgggccaacccagacctgttcaacttcaacaacatgacgaagaaccagcgcaagaaactttataaattcatcgacggatccggcaccaccgccaacttcatcccgaacaccgtggccaatatcatcttcagcatccccaagaaggactccggcaagtacagcatggggaaccggatcgttcagaacgagttcggcatcggatctccgcagagcaagaaccagaaagccttcacgggcgaaatgatcaaggagcgctgctggaagctcaagataaaccggctgggggacatcatcgaatgcatcaagtga

SEQ ID NO: 8092 - RNA, 4629 nt, synthetic construct
  misc_feature 1..4629: note = Cas9 variant
  source 1..4629: mol_type = other RNA
atggagaagcgcatcctagggctcgatttaggaacaaacagcataggatgggcactcgtcaagggagaacgacacgagaatgacaacgaaacgatcctctcgtacatagaagctgcaggctccagaatcctccccctagacgccgcagcgcagggcgacttcgagaaaggcaaccccgcaaagacacaaaccagtgaaagaacacggatgcgcggaatgagacacctcctcgagcgctccctcctaagacgggaacgactacacagggtcctggacatcatggactttcttcctccacattactcccaaagcctaacacggtacggaaaattcaaagcagacacagaatgcaagctagcatggcgaaaaaccgaaacaggccattacgagttccttttccaagactccttccaagagatgcttcaagacttccagaaccatgggaaactagaggaaaataagaaaatcccctacgattggacaatctactacctaagaaagaaagccctcacacaacccgtctccaaacaagaactagcttggattcttcttaacttcaaccagaaaaggggatactatcagagggaagatcaggcagtcgacgataaccaaaagaaacgggtcgagtaccaagcattgaaagtcatatctgttgaagataccggcgagaagaaagggaaaaacacgtggtacgacgtccgcctggaaaacggcttagtatatcactacagcgcaccaataaaacctgactggaaaggcgagaccaaggagttcatagtcaccaccaccatagaccaaaacggtaaaccagaactggacaaagacggtaaaccaaagtatagtatgcgagccccgaaggaggacgactacaaacttctaatggagaaaaccaagaaagacataactgacagcggcaaaagtgttggagaatatatctacgacgcattgctggtaaacccgcaacagaaaatcagaggtgggcttgtccgaacgatagaacgctacttttataaaaaggagctcgagaaaatcctcctctctcaagaacgctttatacccgaattaaccgacagagaactctaccgccgatgcgtcgaagaactgtacccatccaacgacgcctaccgtcacctgatagaatcaagggatatgcgatatctcctagtagaagacatcttgttttaccagcgccccctcaagtccaagaaatcactcatcgatgactgcccctatgagtcacgctcctatgtggacagggaaacgggcgaaatcaaaagcagcccagtcaaatgcatagcccaatctcacccgctatttcaggaatttcgcctgtggcagttcatacacaacctgcgaatctaccaaaacgagcgaagcgtcgagggaaaattacagctggacgtagacgtaacggaagaagtcttaccgacccccgagagcaaagcggcactctttaggttcctaaatgaccgtgagaacgtaacacaggaaatcctcctcaaagaagtattcaaaggccggaaactcagcgtgaaagactgcccctaccggtggaactacgccggtgaaggaaagaaatacccgtgcaacgaaacccgccacctgatgctgaaactcctaaagaaggccggcatcgatacggccttcctaaccccagaaaaggaacaggcactatggcacatcatgtactccgttgaagacaaagaccaatacgagaaagccctatcaacattcgccaggaaaaatgacctgccggacggcttcaaagaacagttcaagaaagcaccaacattcaaaaaggactacggtgcttactccctccgcgcaatcaaaaagctactaccgctcatgcgggtaggagaatattggagcgcggactgcatcgacagtgaaaccaaagaacggatcagccaaataatccggggcgaaatggacgaaaaagtcagccagcggatgacaaaatccagggactcgttcacggatatatcgcaattccaagggctccccgtgtggcaagcctgctacgtagtctacggcagacactccgaagctaccgaaatacaacgctgggaaaagcccgaagacatagacgtgtacctcaaggccttcaaacaacactcactacggaaccccatagtggaacaagtcgtgctcgaaaccctcagagtcgttcgcgacatatggaaaacatatggaaaggtcgatgagattcacatcgaaatggggcgcgacatgaagaacaccgctgaggagcgaaagcgcattttcaatcgaaaccagcaaaacgaaaacgataacctccgcatcaaagccctactcacggagttcatgaatcccgactttgaaatcgaaggcgtccgaccatacagcccaagccagcaagaagcactgagaatatacgaagacggggcctggagcgggctcgacgaagaaaaagaagacaagaaagagctagaagccatccgggaaatactcggcaaattcagccaaagcgacaaagccaaacgcccgacccacagcgaagtcctgcgctacaaagcatggctagagcagcgctactcgtccccgtacacaggggaggccatacccttagccaaacttttcacaccggcatacgagatcgaacatgtcatcccccaatccaggttcttcgatgactcattctctaacaaagtcgtatgcgaggcagaggttaacaaactcaaagatcggatgctagggtacgagttcatcaaagcccaccaaggcgaagtagtctccctatcgggtacaggaagatgcgcacggatcctcagcccagaagaatacgaacagcgcgtcacagactgctacaagcataatacagccaaaatgaagaaactcctaatggaagaaatcccagacgacttcatccagcgccaaatgaacgactcccgatacatatcaaaactcgtcaaatctctattatcaaacatggtacgagaagaaggagaacgagaagccataagtaagcatgtcatcacgtgcaatggcacaatcactgatagactcaagaaagactggggtgtcaacgatgtgtggaaccacatcatactaccacgattccagaggatgaaagacctgaccgggcgaaacgacttcgttgcagtcaacagccagggccacgaaatcccaagcgtacccccggaattgcaaaaaggctttaaaaagaaaagaatagaccacaggcaccacgcgatggacgcaatcgtcatagcgtgcacgacaagaaatcacgtcaacctactcaacaacgaggccgccatgagcgagaacaaggcgaatcggatcgccctgtcaaggaagctgcgacgttacgagaactgtgcaatttataaaggaggagaaaccaaaaacatatccgtcgccaaggagttcctcaagccatgggcaacgttcccggcagacgtagaacgcgccctaggcgacatcgtcgtgtcattcaagcaaaaccttcgggtgattaacaaagcaacaaaccactacgaacactacaaagacgggaagaaggtaaaggtaccccaaaagaaaggagatatgtgggtagtccggaaaccgctccacaaagacaccgtctacgcacttgtcaacctaagaaacgtcaaaaccgttgggctgaaggacgcaatccttatgccggatagaatagcgaacaaagacctcaaaaagaaagtaaaagaactcctggcacaaggggacgacctgaagaaaatcaagaaatacttcgagacagagaaagacacatggcaggacgtagacgtcaagaaaatagaagtatactacttctctgaggaaacagcaaaccactactacgccacccgcaaaccattcgacgccaacgtgaaaatcgacagcgtgacagacacagggatacagaaaattctacgaagacacctcgaggagaacgggaataaggccgacgtagcgttctcacccgaaggaatcgcccgtatgaatgagaacatcttccgcctcaatgggaacaagcaccatcaaccgatatacaaagtgagagtatacgaaaaagctaacaaataccccgtcggccaaacaggaaacaaggcctccaaatttgtagaagcggccaaaggaacgaacctgtacctcgccgtctacgaatcggaagtcgtcgacaagaaaacagcagagatcagtaagaaacgcagttacgtcatcgttcccctccgagacgcagtcgcccgtcaaaaacaaggcgttcccgtcgcgcccgaacgcaacgaagaagggggcaaactcctgttcgtattatccccaaaagattttgtctacgtccccacagaagaagagaggagcaaaggagaggtattactgccgctagacaaaaatcgaatctatatcatgatggacgcctcagatggcatcgtcaacttcctgccgtacagcgtagccaacctcatctatgcactcccgaaagaccaggcttccggcttctgcacagacggtcgaatgatccaaaacgagttcggactaggatcgcccaaatccaaaaacgaacgagcgctcacaggcgaaatgataaaggagatatgcctaccggtaaaagtagaccgattaggacgcatcacagagatcaatggtaacaaagtatga

SEQ ID NO: 8093 - RNA, 4644 nt, synthetic construct
  misc_feature 1..4644: note = Cas9 variant
  source 1..4644: mol_type = other RNA
atgaagaagatcctgggcctcgacctggggaccaacagcatcggctgggccctgacgaataacgacttcgacaacaagctcgggtccatcgagggcctggggagccgcatcatccccatgtcccaagacgtgctgggcaagttcgacagcggcgtctccatcagccagacggccgagcggaccaagtaccgcgggacccggcgcctcgtgcagcggttcctgcttcgccgggagcgcctccaccggatcctgaacatcctggacttcctcccgcgccactactccgaggcgatcgacttcgacaagaagttcggccagttcaagcccgaacgggaggaaaagctgagcttctacaagaatgagtccgggaagaaccagtttctgttcctcgagagccatcaggagatgttctccgagttcaagctgacccaccccgacctgaagcaggtcccctacgactggacgatctactacctccgcaagaaggccctgacccagaaaatcagcaaggaggaactggcctggatcatcctcaacttcaaccagaagcggggctactaccagctgcgcggggaggaggaggaggtgaataaaaacaagctggaggagttccacaccctcgtgatcgtggacgtcatcgagcgggagaagggcaagtccggcgtgtggtacaacgtgattctggagaacgggtggatctataaacgcgagagcaagatcgccctgttcgactggatcggcaagcagaaaaacttcatcgtcaccacggagctcaacgacgacgggaccatcaagctgaacaaggacaacgaagagaagcggtccttccgcagcccgaaggaggacgactggggcctgcggaagatccgcaccgagcagaccatcaaccagtccgaaaagtccgtgggcagcttcatctacgacgagctcctgaaaaagcctaaccagaagatcaagggggagctggtgcggacgatcgagcgcaagttctacaaggacgagctcagcaagatcctcaaagcccagatcaccttccattacgagatcctgggcgaccgcaacatctacaagaagtgcatcgacgagctgtaccggcacaacgacagccacaagaacaacatcaaggacaaggggttcgactacctgttcctggacgacatcatcttctaccagagacctctcaagtccaagaccagcctgatctccgactgcagcctggagttcgtccccatcaaggacaagaagggcatcctcgtgaaggactccaacgggaagcaggtcgtgaagccgctgaagtgcatcgccaagagcaaccccatctttcaggagttccggctgctccagttcgtgaagaacctgaagatctacaagaaggagatcatcaacgagatcgacgtgaccaacgactatctgaagacggaggaggacctcgtcgagctgttcgactggctgaacgacaaggcggaaatctcccagaagcagttcctggcctaccccaagttcaagctcaaggaggacaagtaccggtggaacttcgtggaggataagatctacccctgcaacgagacccggaaccagttcctgaacgccatcgcgaagatcgacgtcaacaagagcttcttcgacgccaagaacacccaggacctgtggcacatcctctactccgtcaccgacaagacggagctgttcagcatcaacaccgagaccggcatccagtccggcgccctgagcaccttcgccaagcgccacaacctctccaacgagttcgtgagcaacttctccaaaataaagccgtacaacaaggactacgggagctactccgagaaggccatcaagaagttgctgcccctcatgcggttcggctccaactggaataaaaacaacatcgacgcgaagacgctggcccgcatcgataagctgcagaccggggagttcgacgaaaccatgcggacccgcgtgcgggagaaggccatccacctgtcaaagatcacggactttcagggcctgcccctctggctcgccagctacatcatctacgaccgccacagcgaggcttccaacatcagcaagtggaagacgcccgaagacatcgcgtggttcctgaacccgaagaacaagtccggtttcaaacagcacagcttgcggaaccccatagtcgagcaggtcatcaccgagaccctccgcgtggtgaaggacatctggcagcactacggcgagggcaaggagaacttcttcaacgagatccacatcgagctggggcgggaaatgaagaacaacgccaacgaccgcaagcggatcacggagaccatcaaccagaacgagaataccaacctgcgcatcaaggccatcctcaccgagctgaagaacgacggcatcaacgacgtgcggccttactcccccagccagcaggagatcctgaagatctacgaggagggggtctacaactccgagatccgcaaggagaagctcgaggacatcgacaagatccgtaagaacgccaagccgacgcccagcgagatcatcaagtacaagctgtggctggaacagggctacatctccccctacaccgggaagctcatccccctgagcgacctgttcaccaccaagtaccagatcgagcacatcatcccgcagtcccgcctcttcgatgacagcctgtccaacaaggtgatctgcgagagcgaggtgaacgacctgaagggcaacaacaccgccctcgagttcatcctgaagaacgagggccgaatcgtactgctcaccgggggcaagacggtgaagatcttcaccaaggaggcgtacaaccaacacatcacctcctactacatcaagaacaagagcaagcagaagcggcttctgacagaggagatccccgagaagttcatcgaccgccagctcaacgacaccaagtacatctccaagatcgtgaaaaacctgctgagcaagatcgtccgggaggaggacgagcaggaggtgaccagcaagcacatcgtgtccctcaacgggagcatcacctcccgcatgaagcaggactggggcctgaacgacgtctggaacaagatcgtgagcccccggttcgagcgtctgaacgcaataacgaactccaacgacttcggcaagctcgagctgaagaaggacgagttcgggaacgccggcaagcaggtcttccagaccaccgtgcccgacgacatcgccaagggcttcagcaagaaacggatcgaccaccgccaccacgccctggacgcgctcgtgatcgcctgtatcaaccggacccacatcaactacctgaacaacctgaacgccaaggacgagaacgacaagacgatcaagcatgagctccgcaacaagctgtgcttcaagaccaagccggactccaatggcaacagcaagtgggagttccacaagccctgggaaaacttcaccaagaaggtggaagacgagctgaaccagaccatcatctccttcaagcagaacacgcgggtcatcaacaagaccgtgaacaagtaccaggtgtggaaggaggaggacggggccatgaagaaggtcaccgtgaagcagaccaagggcgacaactgggcgatccgcaagcccatccacgccgagacggtgagcggcaaggtcttcctcaagcggatcaagcagtcacacatcaccatcgccaacgccatcgagcagatcgagctgatcgtggacaaggaggtgcgcaagcagctgaaggccaagatcaagcagtacccgaacaacaaggaggggttcaagaagcacctcaaggcgttccccatcatgatcaacggcaaggccatcgacaaggtccagatctacgagaccatcgaggccaccgccacacgggagcgcaacaacctggacatcaccttcgacgagaagaagatcgagaagatcaccgacaccgggatccagaagatcctgctcaaccacctgaagcaggagatctaccagaacgccatcgatgagagcggcaagaagatcgcgccccacgaggtggccttctccgagatcgggatcgacgagctgaacaagaacataaaggtgctcaacaacggtaagaaccaccagccgatcaagaaggtacggatcttcgaggagagcaagcgcttctccctgggccagagcgggtccaagacggacaagtacgtggagaccgccaagggcaccaacctgttctacgccatctacgaggggaagaagggcaaccggaactacaagaccatcccgctcaacgaggtgatcgagcgccagaaacaaggactgaacagcgccctggtcacggacgagaatgagaaccgcctcctgttcaccctgtcccccaacgacctcgtgtacatcccgaccaacgaggagaagaagaacctgaccacgattaacttcgacaagctgagccgggagcagaccgagcgcatctacaagtttgtgagctgcacctccggcgagggccacttcgtcagcaacaactactccaaggagatcattagcaacgagaacgggtccaacaacaagaacgagcggatgctcgagttcaacaatagcaacactatctacgacgagaaggagaagcccgtgatgatcaagtccgtgtgttggaagctggaggtcgatcgcctgggcaagatcaagcggatcatccgctga

SEQ ID NO: 8094 - RNA, 4677 nt, synthetic construct
  misc_feature 1..4677: note = Cas9 variant
  source 1..4677: mol_type = other RNA
atgaagaagatcctgggcctcgatctggggaccaacagcatcggctgggccctggtgaatgtcgacaagaacgggaaccccttcggcatcgaggggctaggctcccgcatcatcccgatggaccaggccaccctgagcgacttcgagaagggaaactccaagagccaaacggcggagcggaccatgttccgcggggcccggcgcctgcgggagcgcaagcacctccggcgcgagcggctgcaccgcatcctgaacgagctcaacttcctgcccatccactaccggtcctgcatcgacttcgtgcaccgcctgggcaagttcaaggccaaccacgagcccaagatcgcctggcggagcaacgaccaggacaagatggagttcatcttccaaaattccttcctcgagatgatgagcgatttcaccaagcgccagcccgagctggtgaaggaagggaagaagatcccgtacgactggaccatctacttcctgcggaagaaggccctcggccagcgcatcgagaaggaggagctggcgtggctgctcctgcacttcaaccagaagcgggggtactaccagctgcgcggcgaggacgagatcgacgccactcggtccgccaagacccgcaagtacttcgaccggaagatcattaagagcatcatcgacaccggcgaggagtacaaggggctcaaggtcctgatcgtggagctggacaacggcaaccaagggaagatcttcaagcaggaggtgcccgattgggtcggccaggagaagaacatcatcgccaccgtggacctcgacaaggacggcaaggaccgcttcgacaagggggtgctgtcccagcgcttcagcatcccctccgacagcgagtgggagacggagtggaagctgatcaagctcaagaccgaggaggacctggaggcgtcccagaagaccgtcggcacctacatctacgacagcctgctcaagaaccccaaccagaagatcaaggggaagctggtgcggacgatcgagcgcaagtactaccgggacgagctgcgcgccattctcaacaagcagcgggagttccacccggagctgaacgacaaaaagctgtaccagcactgcatcttctccctctacccccagaacgaggccttccgcaacagcatcgccaacaaggacttcacttacctgttcctggaggacatcatcttctaccagcggcccctcaaatccaagaagtccaccatcaacaactgcgcctacgaggtgcgccggtacatggacaaggagaccaaggagcttaaggaggtccccctgaagtgcatcgccaagagtcacccgatcttccaggagttccgcctctggcagttcatcagcaacctgcggatctacaagaaggacatcacggacatcgacgtgaccaacgacttcctgcacagccaggacgactacgcgaacctcttcgagtggctgaacaacaagaacgagatcgaccagaaggccttcctgaagtaccccgccttcggcttcaagaaggacgccgtgaactaccgctggaactacgtcgaggacaagtcatacccctgcaacaagacccggtcggcgatcctctccaagctggacaagcacgagcaggagttcctgaccaaggagctggagctcaagatctggcagctgctatacagcgtgaactccaaggaggagatcgacaaggccctcaacgtgaacagccccaagatcaacaacaagatctccatcgaccacacggggatcctgcacgagctcaagagctccagcctctccgacatcagcatccagaggctgaaggccatcaacttcgaggagaaggactacggctcctacagctacaaggccatcaagaagctgctcgcgctgatgcggcagggcaagtactttgacaacaccgcaatcaccgacgccaccaaggcccgcataaactccatcttcgaccggctggagagcatctccttcgaccctgagcgcatcaacagcatcagcgacgacgacatccccaagcagatcctcaagtcgttcatcaagctgaaccggacgtacgggggcttcaacacctaccaggcctgctacgccgtctacgggcgccatagcgaggcgaaagaaatcgccaaatgggagaagccggaggacatcgaccagtacctggccaagttcaagcagcactccctccgcaaccccatcgtggagcagatcatcaccgagaccctgcgggtggtccgcgacatctggaaaaagcacgcctacaagacgatcaacaaggacaaccagggcaacaactgcgagagcgagtccgagctgaccgagatccacatcgagctcgggagggacatgaagaacaacaagagcgagcgcctgcggatctcccgcatcaacagcgagaacgagaacaccaacctgcggatccgcaagctcctgatcgagttcaacgacccggagttcggagtggagaacgtgcggccccactcccccagccagcaggagatcctgcgcatctacgaggacggcgtcctaaagtccggggtggagatccccgagtacgtcgacaacatcatcaagaagttcaaggagaccgacgtgaagaagcagccgagcaagtccgaggtgctgcggtacaagctgtggctcgagcagaagtaccgcagcccctacacgaacgaggtgatccccctgggcaagctgttcacgaacgactaccagatcgagcacatcatcccccagtcccgttacttcgatgacagcttctccaacaaagtgatctgcgaggcggaggtgaaccagctcaaggagaacgagctggggtgcgagttcatcatgaacaacggcgggcgcatcgtcgaactgagcttcggcaagaccgtgcggatcctcgacttcgaggcctatgagcagttcgtgcagcagaactacgccggcaaccgtccgaagctccggaacctgctcatgaccgagatccccaacgacttcatagaccgccagctgaacgacagccggtacatcagtaaggtcgtgaaggggctgctcagcaacatcgtgcgcgaggacggcgaggccgagtccacgagcaagaacctgatctcctgcaccgggggcgtcaccgcgcggctgaagatggactggggcctcaacgacgtgtggaacaacctgatctacccccgcttcgagcgccttaacgagctcaccaacagcaaccagttcgggtactgggataagaaggacggcaagaacgtattccagacccaggtcccgatggacatccagaaggggttcaacaagaagcggatcgaccaccgccaccacgcgctggatgccctggtgatcgcctgcgccacgcggtctcacatcaactacttaaacaacgagagcgccaagtccaacagcaaggagtcccgctacgacctgcggcgcaagctgcggcgcctcgaggtgatccagaaggagtacaccatcaacggccggaaggagatccgcaacatcgaggtcgcgaaggagttctacaagccctggaacagcttcacccaggacgcccagtccgccctggagaacatcgtggtgtcgttcaagcagaacctgcgggtcatcaacaagaccacgaactatttcctacgcttcaacaaggaagggaagaaaatcttcgagacccagacctccggcagcaactgggccatccggaagccgcttcacaaggacaccgccttcggcctggtgaacctcaagcgcaccaagaccgtgtccctggcgaacgccatcctggactatgaccagatcgtgaaccggaagctctggaccaagatcaaggagctcatcagcatcgggtacgacaacaagagaatcctgaagtatttcacggacgacaaggagaactggaacgagatcatctccagcggcatcgaggtgttctactacacagacaacttcgagaagcaggtcgccacccggaagcccctcgacaccagctttacagagtccaagatcattaacagcatcacggacctggggatccacaagattctgctcgcccacctccgcgcgaacgagggcaacccgaacatcgccttctcccccgaagggatcgagaccatgaaccggcacatctgcgagctgaacggcggaaagttccaccacccaatctacaaggtgcgggtgcatgagcccctggggtacaagttcaaggtgggcgacaaggggaaccgcagcaccaagtacgtcgaggccgccaagggcaccaacttattctttgggatctacatcaactcccagggcatccggagctacgagacaatcccgctgaacgtggccatcgagcggcagaagcagggcctctcccccgtgcccgacaacaacgaactgggggagcggctgctgttctggctgtctcccaacgacctggtctacctcccgacctccgacgaggtggagagcggcatctgctgcaacaagctggggatcgaccgcatctacaagatggtgtcctgcaccggctacgtcggggacttcatccccgcgcacatcgctaaccccatcatccagaccctggagctcggcagcaacaataaggcccagcgggcctggacgggcgagatgatcaaggagatctgcatccccgtgaaggtggaccgaatggggaacatcgtcgagatcttcaaccggaacaagaactga

SEQ ID NO: 8095 - RNA, 4695 nt, synthetic construct; identical to SEQ ID NO: 2295
  misc_feature 1..4695: note = Cas9 variant
  source 1..4695: mol_type = other RNA

SEQ ID NO: 8096 - RNA, 4713 nt, synthetic construct; identical to SEQ ID NO: 2296
  misc_feature 1..4713: note = Cas9 variant
  source 1..4713: mol_type = other RNA

SEQ ID NO: 8097 - RNA, 5067 nt, synthetic construct; identical to SEQ ID NO: 2297
  misc_feature 1..5067: note = Cas9 variant
  source 1..5067: mol_type = other RNA

SEQ ID NO: 8098 - RNA, 3924 nt, synthetic construct
  misc_feature 1..3924: note = Cpf1 variant
  source 1..3924: mol_type = other RNA
atgacccagttcgaaggcttcaccaacctgtaccaggtgagcaagacgctccgcttcgagctgatcccccaggggaagaccctgaagcacatccaggagcagggcttcattgaagaggacaaggcccggaacgatcactacaaggaactcaagccgatcatagaccgcatctacaagacctacgccgaccagtgcctgcagctggtccagctcgactgggagaacctgtccgcggccatcgacagctaccggaaggaaaagaccgaggagacgcgcaacgccctaatcgaggagcaggccacctaccggaacgccatccacgactacttcatcgggcgcaccgacaacctcaccgacgcgatcaacaagcggcacgccgagatctacaagggcctgtttaaggccgagctgttcaacgggaaggtgctcaagcagcttgggactgttaccaccaccgagcacgagaacgccctgctccgctccttcgacaagttcacgacctacttcagcggcttctacgagaataggaagaacgtcttctccgcggaggacatcagcaccgccataccccaccgcatcgtgcaggacaacttccccaagttcaaggagaactgccacattttcacccggttaatcacggccgtgccctccctccgcgagcacttcgagaacgtcaagaaggccatcgggatcttcgtcagcacctccatcgaggaggtgttcagcttcccgttctacaaccagctccttacccagacccagatagatctgtacaaccagctcctaggcgggatctcccgggaggccggcacggagaagatcaaggggctgaacgaggtcttaaacctagcgatccagaaaaacgacgagaccgcccacatcatcgccagcttgccccaccgcttcatccccctcttcaagcagatcctgtccgaccggaataccctgagcttcatcctcgaggagtttaagtccgatgaggaggtgatacaatccttctgcaagtacaagaccctgctgcgcaacgagaacgtgcttgagacggccgaggcgctgttcaacgagctgaactccatcgatctcacccacatcttcatcagccacaagaagctggagaccatatccagcgcgctgtgtgaccactgggacacactccggaacgccttatacgagcgcagaatttctgagctgacgggcaagatcaccaaatccgccaaggagaaggtccagcgcagtctcaagcacgaggacatcaacctgcaggaaattatctccgccgccggcaaagagctttctgaggcgttcaagcagaagacctccgagatcctcagccacgcccacgcagccctggaccagcctttgccgaccacgctcaagaagcaggaggagaaggagattctgaaatcccagctggacagcctgctcgggctgtaccacctcctcgactggttcgcagtggacgagtccaacgaggtggaccccgagttcagtgcgcggctgaccggcatcaagctggagatggaaccctccttgagcttctacaacaaggcccgcaattacgccaccaagaagccctactccgtcgaaaagttcaagctgaactttcagatgccgaccctggccagcgggtgggacgtgaacaaggagaagaacaacggcgcgatcctcttcgtgaagaacggtctttactacctggggatcatgcccaagcagaagggccgctacaaggccctctccttcgaaccaacggagaagaccagcgagggcttcgacaagatgtactacgactacttccccgacgccgccaaaatgatcccaaagtgctccacacagctgaaggccgtcaccgcgcacttccagactcacacgaccccaatcctgctcagcaacaacttcatcgagcccctggagatcaccaaagagatttacgacctgaacaaccccgagaaggagccgaagaaattccagaccgcctacgccaagaagacgggtgaccaaaagggctatcgggaggccctctgtaagtggatcgacttcacccgcgacttcctgtccaagtacaccaagaccacgagcatcgacctgagctccttacggcccagctcccagtacaaggacctcggcgagtactacgctgagctgaaccccctcctgtatcacatcagcttccagcgtatcgcggagaaggagatcatggacgccgtggagacaggcaagctgtacctcttccaaatctataataaggacttcgccaaagggcaccacggcaagcccaatctgcacaccctttactggacaggcctcttctcaccggagaacctggccaaaacgagcatcaagctgaacgggcaggccgagctgttctacaggcccaagtcccgcatgaagcgtatggcccaccggctgggggagaagatgttaaacaagaagctcaaggaccagaagacccccatacctgacaccctgtaccaggagctttacgactacgtgaaccaccggctcagccacgacctgtccgacgaggcccgcgccctgctcccgaacgtcatcaccaaggaggtgagccacgagatcatcaaggaccggcgcttcacgtccgacaaattcttcttccacgtgcccatcaccctgaactaccaggccgcgaactccccctccaagttcaaccagcgggtcaacgcctacctgaaggagcacccggaaacccccatcatcggaatcgaccgaggcgagcggaacctcatctacatcaccgtcatcgacagcacggggaagatcctagagcagcgctccctaaacaccatccagcaattcgactaccagaaaaagctcgacaaccgggagaaggagcgcgtggccgcccggcaggcctggagcgtggtgggcaccatcaaggaccttaagcaggggtacctgtcccaggtcatccacgagatcgtggacctcatgatacactaccaagcggtcgtcgtgctggagaacctgaacttcggctttaagagcaaacgcaccgggatcgccgagaaggccgtgtaccaacagttcgagaagatgctcatcgacaagctgaactgcctggtcctcaaggattaccccgccgagaaggtgggcggcgtgctgaacccctaccagctgacggaccagttcacgagcttcgccaagatggggacccagtccggtttcctcttctatgtcccggcgccgtacaccagcaaaatcgaccccctaacggggttcgtggaccccttcgtgtggaagacaatcaagaaccacgagtcccgcaagcacttcctggagggcttcgacttcctccactacgacgtcaagaccggcgattttatcctgcacttcaagatgaaccggaacctgagcttccagcgcgggctacctggcttcatgcccgcctgggacatcgtcttcgagaaaaacgagacacagttcgacgccaagggcacacccttcatcgccggcaagcggatcgtgccagtcatcgagaaccaccgcttcaccgggcggtaccgcgacctgtacccggccaacgagctgatcgcgctcctggaggagaagggcatcgtattcagggacggctccaacattctgcccaagctcctggagaatgacgacagccacgccatcgacaccatggtggccctgatccgctccgtcctccagatgcggaacagcaacgccgcgaccggggaggactacatcaacagccccgtacgcgacctgaacggcgtgtgcttcgacagccgattccagaaccccgaatggcctatggatgccgatgccaacggggcctaccacatcgctctgaagggccagctcctgctgaaccacctcaaggaatccaaggacctgaagctgcagaacgggatcagcaaccaggactggctcgcgtacatccaggagctgcgcaactga

SEQ ID NO: 8099 - RNA, 3903 nt, synthetic construct; identical to SEQ ID NO: 2299
  misc_feature 1..3903: note = Cpf1 variant
  source 1..3903: mol_type = other RNA

SEQ ID NO: 8100 - RNA, 1341 nt, synthetic construct
  misc_feature 1..1341: note = Cpf1 variant
  source 1..1341: mol_type = other RNA
atgaaacccgacatcaaagaccgagaatacatgtaccgtctcattatcggacaactcttctacgacggccaccaacaaatcgcagtcaacctagccaacacactcggctgctccgccccacccccgccgccctccgacaaactattcagacttgtcaccatcgccaagcaattcgtcgaagaccccgactacaaagcagaagaaaacacaatgcccatgcaattcgaaacatcatccgctggcctcgacctccaatacgatgccgacgtagccgccacatccccagaaccctcccaatacgaaaccatatatctcactgtccacaaagccccctgccgcgccgccgcattcaactccgacggctcgctcatcgccaccggctccgccgactgctccatcaaaattatggacgtcgaacgcatactagcccgcgaaaaagaacaccgcgaaatgaacgaaaacggccccgacgcacaccaccccgtcatccggaccctctacgaccacgttgacgtccgccgcgacttcggccgcttctccgacaaaattctcgacttccaagacgtcaacaccgtcatcttccatccccgcgacgcaatactcatatccggctccaacgacaaaacagtaaaactcttcgacttctctaaaactgccgtcaaacgagccatgaaaaccctctccgaagtctaccccgtcagagcattatcatgtcaccccggtggagagttcctccttgtagccaccgaccaccccacagtccgtctttacaacatcgaaaccgcccaagcctacgccagcgccaaccccgacgaccaacaccgcgaatcagtcacagacgtccactattccgaaaacgcccgtctctacgtcaccgccagcaaagacggtgacgtaaaagtctgggacggcgtatcatcccgctgcgtcgaaaccttcaaacgcgcccacgatggttcatccatctgctctgccaaattcaccaaaaacggcaaatacatcctaactagcgggatggactccatcgttaaactctgggaactttcaaccaaccgctgcctcattgtatacacaggcgcaggagccacaggcgcacaagactacccaacgtcagccagcttcaaccaaaacgaagactttgtcctattcccagacgaaaaatcaggctccatgtgctcatgggaagcacgaaacgccgaccggaaacgactacttgccctcggccacacatcagcatgcagaaccttcgtccactccccctccatgcccgccttcatgaccggctccgacgaccaccgcgcacgcttctggtaccgcaaacccacaaccaacgacaactga

SEQ ID NO: 8101 - RNA, 1293 nt, synthetic construct
  misc_feature 1..1293: note = Cpf1 variant
  source 1..1293: mol_type = other RNA
atgaaaccagacataaaagaccgcgaatacatgtacagactcatcataggccaactcttctacgacggacaccaacaaatagccgtcacactagccaacacactcggctgctccgccccagcacccccaccctcagacaaactctaccgcctagtcacaattgccaaacaattcgtcgaagaccccgactacaaagctgaagaaaaatccctgcccatgcaattcgaaaccgtcagcaccggcctcgacctagaatacgacgccgacgtccaacccgtctcccccgaaccttcacaatacgaaactatctacctcacagtccataaagccccctgccgagccgccgccttcaacagcgacggctccctcgtggccacaggctccgcagactgctccatcaaaatcatggacgtcgaacgcatactcgcccgcgaaaaagaacacagagaaatgaacgaaaacggacccgacgcccaccaccccgtcatccgcaccctctacgaccacgtcgacgatgtaaacacagtcctcttccacccccgtgacgcgatcctcatatccggttccaacgacaaaacggttaaactcttcgatttctccaaaaccgccgtcaaacgcgccatgaaaacactatcagaagtctaccccgtccgcgcactatcatgccaccccggcggagagttcctgctcgtcgccaccgaccaccccaccgtacggctctacaacatcgaaaccgcccaagcctacgcctccgccaaccccgacgaccaacaccgcgaatcagtaaccgatgtacactactcggaaaacgctcgcctctacgtaaccgcctcaaaagacggcgacgtcaaaatatgggacggcgtatccaaccgctgcgtagaaacttttaaacgcgcacacgacggatctgccatttgctccgcaaaattcaccaaaaatggcaagtacctccttacctccggcatggactcaatcgtcaaactctgggaactctcaaccaaccgatgcctcatagtctacaccggcgccggcgcaaccggtgcccaagactacgccacctccgcatccttcaaccacaacgaagactacgtactctttcccgacgaaaagagcggctcaatgtgctcttgggacgcccgcaactccgaccgcaaacgcctactcgcactcggccacacctccgcctgccgaacattcgtccactccccctccatgccagccttcatgaccggatcggacgaccaccgagcccgcttctggtaccgcaaaccagccacaaccgacaactga

SEQ ID NO: 8102 - RNA, 3690 nt, synthetic construct; identical to SEQ ID NO: 2302
  misc_feature 1..3690: note = Cpf1 variant
  source 1..3690: mol_type = other RNA

SEQ ID NO: 8103 - RNA, 3903 nt, synthetic construct; identical to SEQ ID NO: 2303
  misc_feature 1..3903: note = Cpf1 variant
  source 1..3903: mol_type = other RNA

SEQ ID NO: 8104 - RNA, 1071 nt, synthetic construct
  misc_feature 1..1071: note = Cpf1 variant
  source 1..1071: mol_type = other RNA
atgaaaaccaactaccacgacaaactagccgcaatagaaaaagaccgcgaatccgcgcgaaaagactggaagaaaataaacaacatcaaagaaatgaaagaaggctacctcagccaagtcgtccacgaaatagcaaaacttgtcatcggctacaacgccatcgtagtcttcgaagacctcaacttcggcttcaaacgaggacgcttcaaagtagaaaaacaagtctaccaaaaactcgagaaaatgctaatcgaaaaactcaactacctcgtcttcaaagacaacgagttcgacaaagccggcggagtcctcagagcctaccaactcaccgcgcccttcgaaacattcaagaaaatgggcaaacaaacgggaatcatctactacgtccccgccgacttcacctcaaaaatctgccccgtcaccggcttcgtcaaccaactataccccaaatacgaatccgtctcaaaatcccaagagttcttcagcaaattcgacaaaatctgctacaacctcgacaaaggctacttcgagttctccttcgactacaaaaacttcggcgacaaagccgccaaaggaaagtggacaatcgcctccttcggctcccgactcatcaacttcagaaactccgacaaaaaccacaactgggacacccgcgaagtctaccccaccaaagaactcgaaaaactcctcaaagactacagcatcgaatacggacacggagaatgcatcaaagccgcaatctacgccgaaaacgacaagaaattcttcgccaaactaacctcgatcctcaactccatcctccaaatgcgcaattcgaaaaccggcacagaactcgactacctcatctcccccgtggctgacgtcaacggcaacttcttcgactcccgccacgcccccaaaaacatgccccaagacgcagacgccaacggtgcctaccacatcggcctcaaaggcctcatgctcctttaccgaatcaaaaacaaccaagacggaaagaaactcaacctcgtaatcaaaaacgaagaatacttcgagttcgtacaaaaccgaaacaaatcatccaaaatctga

SEQ ID NO: 8105 - RNA, 3792 nt, synthetic construct; identical to SEQ ID NO: 2305
  misc_feature 1..3792: note = Cpf1 variant
  source 1..3792: mol_type = other RNA

SEQ ID NO: 8106 - RNA, 2820 nt, synthetic construct; identical to SEQ ID NO: 2306
  misc_feature 1..2820: note = Cpf1 variant
  source 1..2820: mol_type = other RNA

SEQ ID NO: 8107 - RNA, 3795 nt, synthetic construct; identical to SEQ ID NO: 2307
  misc_feature 1..3795: note = Cpf1 variant
  source 1..3795: mol_type = other RNA

SEQ ID NO: 8108 - RNA, 3903 nt, synthetic construct; identical to SEQ ID NO: 2303
  misc_feature 1..3903: note = Cpf1 variant
  source 1..3903: mol_type = other RNA

SEQ ID NO: 8109 - RNA, 3756 nt, synthetic construct; identical to SEQ ID NO: 2309
  misc_feature 1..3756: note = Cpf1 variant
  source 1..3756: mol_type = other RNA

SEQ ID NO: 8110 - RNA, 4173 nt, synthetic construct; identical to SEQ ID NO: 2310
  misc_feature 1..4173: note = Cpf1 variant
  source 1..4173: mol_type = other RNA

SEQ ID NO: 8111 - RNA, 4026 nt, synthetic construct; identical to SEQ ID NO: 2311
  misc_feature 1..4026: note = Cpf1 variant
  source 1..4026: mol_type = other RNA

SEQ ID NO: 8112 - RNA, 4107 nt, synthetic construct; identical to SEQ ID NO: 2312
  misc_feature 1..4107: note = Cpf1 variant
  source 1..4107: mol_type = other RNA

SEQ ID NO: 8113 - RNA, 4149 nt, synthetic construct; identical to SEQ ID NO: 2313
  misc_feature 1..4149: note = Cpf1 variant
  source 1..4149: mol_type = other RNA

SEQ ID NO: 8114 - RNA, 4203 nt, synthetic construct
  misc_feature 1..4203: note = Cas9 variant mRNA product
  source 1..4203: mol_type = other RNA
atggcccccaagaagaagcgcaaagtgggaatccacggggtgccggcggcggacaagaagtacagcatcggcctggacatcgggaccaactcagtgggctgggccgtaatcaccgacgaatacaaagtccccagcaagaagttcaaggtgctggggaacacggaccggcattccatcaagaagaacctgatcggtgccctgctgttcgactcgggcgagaccgccgaggccacccgcctgaagcgaaccgcgcgccggcgctacacgcggcgcaagaaccggatctgttacctgcaggagatcttctccaacgagatggccaaggtggacgacagcttcttccaccgcctcgaggagtccttcctggtcgaggaggacaagaagcacgagcggcaccccattttcgggaacattgtggacgaagtggcctaccacgagaagtaccccaccatctaccaccttcgcaagaagctcgtcgacagcaccgacaaggccgacctgcggctgatttacctcgcgctggcccacatgatcaagttccgcggccacttcctgatcgagggggacctcaacccggacaactccgacgtggacaagctgttcatccaactggtgcagacctacaaccagctgttcgaggagaaccccatcaacgccagcggcgtcgacgccaaagccatcctgtccgcgagacttagcaagagtcgcaggctcgagaacctgatcgcccagcttcccggggagaagaagaacggcctattcggcaacctgattgccctgagcctcggactgacacccaacttcaagtccaacttcgatctggccgaggatgccaaactccagttgagtaaggacacctacgacgacgacctggacaacctcctggcgcagatcggcgaccagtacgccgacctgttcctcgccgccaagaacctgtctgacgccatcctgctcagcgacatcctgcgcgtgaacaccgaaatcaccaaggcgccgctgtccgcctcaatgatcaagcggtacgacgagcaccaccaggatctcacgctgctgaaggcgctagtgcgccagcagttgcccgagaaatacaaggagatcttcttcgaccagagcaaaaacgggtacgctggctacatcgacggcggggcctcccaggaggagttctataagttcatcaagcccatactggagaagatggacggcaccgaggagttactggtcaagctgaaccgggaggacctgctccgcaagcagcgcaccttcgacaatgggagcatcccccaccagatccacctgggcgagctgcacgcgatcctccggcgccaggaggacttctacccgttcctgaaggacaaccgggagaagatcgagaagatcctcacctttcgcatcccctactacgtggggcccttggcccggggcaactcccgcttcgcctggatgacgcgcaagagcgaggagaccatcactccctggaatttcgaggaggtggtcgacaagggcgccagtgcgcagagcttcattgagaggatgaccaactttgacaagaacctgccgaacgagaaggtgctgcccaagcactccctcctgtacgagtacttcacggtgtataacgaactcaccaaggtcaagtacgtgaccgaggggatgcggaagcccgctttcctcagcggcgagcagaagaaggccatcgtggacttgctgttcaagaccaaccgcaaggtcacggtgaagcagctcaaggaggattacttcaagaagatcgagtgcttcgactccgtcgagatcagcggggttgaggaccggttcaacgcctccctgggcacctaccacgacctgctcaaaatcatcaaggacaaggactttctggacaacgaggagaacgaggacatcctggaggacattgtgctcaccctgaccctgttcgaggaccgcgagatgatagaggagcggctcaagacgtatgcccacctgttcgacgacaaggtcatgaagcaactgaagcgtcggcgctacaccgggtggggccggctcagccgcaagttgatcaacggaatccgagataaacagagtgggaagacaatcctggacttcctaaagagcgacggctttgcaaaccgcaacttcatgcagctgatccacgacgactccttgaccttcaaggaggacatccagaaggcccaagtatctgggcagggagactccctccacgagcacatcgccaacctggccgggtcccccgccatcaagaagggcatcctgcagacggtgaaggtcgtggacgagctagtcaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaagagcaccccgtggagaacacccagctccagaacgagaagctctacctgtactaccttcagaacggccgggatatgtacgtcgaccaggagctggacattaacaggctgagcgactatgacgtggaccacatcgtgccccagtccttcctcaaagacgacagcatcgacaacaaggtcctgacacggtccgacaagaaccggggcaagagcgacaacgtgccctccgaggaggtagtcaagaaaatgaaaaactattggagacagctgctcaacgctaagctgatcacccagcgcaaattcgacaacttgaccaaagccgaacgcgggggcctcagcgagctagacaaggccgggttcatcaagcggcagctggtggagacccggcagatcaccaagcacgtagcccagatcctcgactccaggatgaacacgaagtacgacgagaacgacaaactgatccgggaggtcaaggtgatcaccctcaagagcaaacttgtgtccgacttcagaaaggacttccagttctataaggttagggagatcaacaactaccaccacgcgcacgacgcatacctgaacgccgtggtgggcaccgccctgatcaagaagtacccgaaacttgagagcgagttcgtctacggggactacaaggtgtacgacgtgcgcaagatgatcgcgaagtccgagcaggagatcggaaaggctaccgccaagtacttcttctacagcaacatcatgaacttcttcaagacggagatcaccctggcaaacggcgaaatccggaagcgccccctaatcgaaacgaacggagagaccggcgaaatcgtctgggacaaggggcgggacttcgccacggtgcgcaaggtgctctccatgccccaggtcaatatcgtaaagaagaccgaggtgcagaccggcgggttcagcaaggagtccatcctgcccaagcgcaacagcgataagttaatcgcgcgtaagaaggactgggacccgaagaagtacggcggcttcgactcccccaccgtcgcgtacagcgtgctggtggtcgccaaggtggagaagggcaagagcaagaagttaaagtccgtgaaggagctgctcggtatcacgatcatggagcgcagttccttcgagaagaaccccatcgatttcctggaggccaagggatacaaggaggtcaagaaggacctgatcatcaagctccccaagtacagcctgttcgagctggagaacggccggaaacgcatgctcgcctccgcgggggagctgcagaagggcaacgaactggccctccccagcaagtacgtgaacttcctgtacctggcctcccactatgagaagttaaaaggcagccccgaggacaacgaacagaagcagctgttcgtggagcagcacaagcattatctggacgagatcatcgagcagatatccgagttcagcaaacgggtgatcctcgccgacgccaacctcgacaaggtgctctccgcgtacaacaagcaccgtgacaagcccatccgggagcaggccgagaacatcatccacctcttcaccctgaccaaccttggggcccctgccgcgttcaagtacttcgacaccacgatcgaccggaagcggtacaccagcaccaaggaggtgttagacgcgaccctgatacaccagagtatcacgggcctgtacgagacccgcatcgatctcagccagctcgggggcgataagcggcccgccgccaccaagaaggccgggcaggcgaagaagaagaagtga

SEQ ID NO: 8115 - RNA, 4986 nt, synthetic construct
  misc_feature 1..4986: note = Cas9 variant mRNA product
  source 1..4986: mol_type = other RNA
atggcccccaagaagaagcgcaaggtgggcatccacggggtcccggccgcgaacttcaagatcctgcccatcgccatcgacctcggcgtgaagaacaccggggtgttcagcgccttctaccagaagggcacctccctggagcggctggacaacaagaacgggaaggtctacgagctcagcaaggactcctacacgctgctgatgaacaaccgcaccgcccggcgccaccagcggcgcggcatcgaccggaagcagctcgtgaagcgcctgttcaagctgatctggaccgagcagctcaacctggagtgggacaaggacacccagcaggccatcagcttcctgttcaaccggcgcggcttctccttcatcacggacgggtacagccccgagtacctcaacatcgtgcccgagcaggtcaaggcgatcctgatggacatcttcgacgactacaacggcgaggacgacctggactcctacctcaagctggccaccgagcaggagagcaagatctccgagatctacaacaagctgatgcagaagatcctcgagttcaagctgatgaagctgtgcaccgacatcaaggacgacaaggtgagcaccaagacgctcaaggagatcacctcctacgagttcgagctgctggccgactacctcgccaactacagcgagtccctgaagacccagaagttcagctacaccgacaagcaggggaacctgaaggagctctcctactaccaccacgacaagtacaacatccaggagttcctgaagcggcacgcgacgatcaacgaccgcatcctggacaccctcctgaccgacgacctggacatctggaacttcaacttcgagaagttcgacttcgacaagaacgaggagaagctccagaaccaggaggacaaggaccacatccaggcccacctccaccacttcgtgttcgccgtcaacaagatcaagagcgagatggcctccggcgggcggcaccgcagccagtacttccaggagatcaccaacgtgctggacgagaacaaccaccaggagggctacctgaagaacttctgcgagaacctgcacaacaagaagtactccaacctgagcgtgaagaacctcgtcaacctgatcggcaacctgagcaacctcgagctgaagccgctgcggaagtacttcaacgacaagatccacgccaaggcggaccactgggacgagcagaagttcacggagacctactgccactggatcctcggggagtggcgcgtgggcgtgaaggaccaggacaagaaggacggggccaagtactcctacaaggacctgtgcaacgagctgaagcagaaggtcaccaaggccggcctcgtggacttcctgctggagctggacccctgccggaccatcccgccctacctcgacaacaacaaccgcaagccgcccaagtgccagagcctgatcctgaaccccaagttcctcgacaaccagtaccccaactggcagcagtacctgcaggagctgaagaagctccagtccatccagaactacctggacagcttcgagacggacctgaaggtgctcaagtccagcaaggaccagccctacttcgtcgagtacaagtccagcaaccagcagatcgcctccggccagcgggactacaaggacctggacgcccgcatcctgcagttcatcttcgaccgggtgaaggcgagcgacgagctcctgctgaacgagatctacttccaggccaagaagctcaagcagaaggcctccagcgagctggagaagctggagtccagcaagaagctcgacgaggtgatcgccaactcccagctgagccagatcctgaagtcccagcacaccaacgggatcttcgagcagggcaccttcctccacctggtctgcaagtactacaagcagcgccagcgcgcccgggacagccgcctgtacatcatgcccgagtaccggtacgacaagaagctccacaagtacaacaacaccgggcgcttcgacgacgacaaccagctgctgacgtactgcaaccacaagccccggcagaagcgctaccagctcctgaacgacctggcgggcgtgctccaggtgtcccccaacttcctgaaggacaagatcgggagcgacgacgacctgttcatcagcaagtggctcgtcgagcacatccggggcttcaagaaggcctgcgaggactccctgaagatccagaaggacaaccgcggcctgctcaaccacaagatcaacatcgcccggaacaccaaggggaagtgcgagaaggagatcttcaacctgatctgcaagatcgagggcagcgaggacaagaaggggaactacaagcacggcctggcctacgagctcggggtgctgctgttcggcgagccgaacgaggcctccaagcccgagttcgaccgcaagatcaagaagttcaacagcatctactccttcgcgcagatccagcagatcgccttcgccgagcggaagggcaacgccaacacgtgcgcggtctgcagcgccgacaacgcccaccgcatgcagcagatcaagatcaccgagcccgtggaggacaacaaggacaagatcatcctctccgccaaggcccagcggctgcccgcgatcccgacccgcatcgtggacggggccgtcaagaagatggccaccatcctggccaagaacatcgtggacgacaactggcagaacatcaagcaggtcctcagcgccaagcaccagctgcacatccccatcatcaccgagtccaacgcgttcgagttcgagcccgccctggccgacgtgaagggcaagagcctcaaggaccggcgcaagaaggccctggagcggatctcccccgagaacatcttcaaggacaagaacaaccgcatcaaggagttcgccaaggggatcagcgcgtactccggcgccaacctgaccgacggggacttcgacggcgccaaggaggagctcgaccacatcatcccgcggagccacaagaagtacggcacgctgaacgacgaggccaacctgatctgcgtgacccgcggggacaacaagaacaagggcaaccgcatcttctgcctccgggacctggcggacaactacaagctgaagcagttcgagaccaccgacgacctcgagatcgagaagaagatcgccgacacgatctgggacgccaacaagaaggacttcaagttcgggaactaccgctccttcatcaacctgacgccccaggagcagaaggccttccggcacgccctgttcctcgcggacgagaaccccatcaagcaggccgtgatccgcgccatcaacaaccggaaccgcaccttcgtcaacggcacccagcggtacttcgccgaggtgctggccaacaacatctacctgcgcgcgaagaaggagaacctcaacaccgacaagatcagcttcgactacttcggcatccccaccatcgggaacggccgggggatcgccgagatccgccagctgtacgagaaggtggactccgacatccaggcctacgccaagggcgacaagccgcaggccagctacagccacctgatcgacgcgatgctcgccttctgcatcgccgccgacgagcaccggaacgacgggtccatcggcctggagatcgacaagaactacagcctgtaccccctcgacaagaacaccggcgaggtcttcaccaaggacatcttctcccagatcaagatcaccgacaacgagttcagcgacaagaagctggtgcgcaagaaggcgatcgaggggttcaacacgcaccggcagatgacccgcgacggcatctacgccgagaactacctgcccatcctcatccacaaggagctgaacgaggtgcggaaggggtacacctggaagaactccgaggagatcaagatcttcaagggcaagaagtacgacatccagcagctgaacaacctcgtctactgcctgaagttcgtggacaagccgatcagcatcgacatccagatctccaccctggaggagctccgcaacatcctgacgaccaacaacatcgccgccaccgccgagtactactacatcaacctgaagacccagaagctccacgagtactacatcgagaactacaacacggcgctggggtacaagaagtacagcaaggagatggagttcctgcggtccctcgcctaccgcagcgagcgggtgaagatcaagtccatcgacgacgtcaagcaggtcctggacaaggacagcaacttcatcatcggcaagatcaccctgcccttcaagaaggagtggcagcgcctctaccgggagtggcagaacaccaccatcaaggacgactacgagttcctgaagtccttcttcaacgtcaagagcatcacgaagctgcacaagaaggtgcgcaaggacttctccctccccatcagcaccaacgagggcaagttcctggtgaagcgcaagacctgggacaacaacttcatctaccagatcctgaacgactccgacagccgggccgacgggaccaagcccttcatcccggccttcgacatctccaagaacgagatcgtggaggccatcatcgacagcttcacgagcaagaacatcttctggctccccaagaacatcgagctgcagaaggtggacaacaagaacatcttcgcgatcgacacctccaagtggttcgaggtggagacccccagcgacctgcgcgacatcggcatcgccaccatccagtacaagatcgacaacaactcccggcccaaggtgcgcgtcaagctggactacgtgatcgacgacgacagcaagatcaactacttcatgaaccactccctcctcaagagccggtacccggacaaggtgctggagatcctgaagcagtccacgatcatcgagttcgagagctccgggttcaacaagaccatcaaggagatgctgggcatgaagctggccgggatctacaacgagaccagcaacaacaagcgccccgccgccaccaagaaggcgggccaggccaagaagaagaagtga

SEQ ID NO: 8116 - RNA, 3258 nt, synthetic construct
  misc_feature 1..3258: note = Cas9 variant mRNA product
  source 1..3258: mol_type = other RNA
atggcccccaagaagaagcgcaaagtgggcatccacggggtcccggccgcgaagcggaactacatcctgggcctcgacatcgggatcaccagcgtgggctacgggatcatcgactacgaaacccgcgatgttatcgacgccggcgtccggctgttcaaggaggccaacgtggagaacaacgaaggccgccggtccaagcgcggggcccggcgcctgaagcggcgccggcgccaccggatccagcgcgtgaagaagctcctgttcgactacaacctgctcacggaccacagcgagctgtcgggcatcaacccctacgaggcccgggtcaagggtctcagccagaagctctccgaggaggagttcagcgcggccctgctgcacctcgccaagcgcaggggcgtgcacaacgtgaacgaggtcgaggaggacaccgggaacgagctctccaccaaggagcagatcagccgcaactccaaggccctggaggagaagtacgtggcggagctccagctcgagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaagacatcaaggagtggtacgagatgctgatgggccattgcacctacttcccggaggagctccgaagcgtgaagtacgcctacaacgccgacctgtacaacgcgctcaacgacctcaacaacctggtcatcacgcgcgacgagaacgagaagctggagtactacgagaagttccagatcatcgagaacgtgttcaagcagaagaagaagcccaccctcaagcagatagccaaggagatcttggtgaacgaggaggacatcaaggggtaccgggtcacctccaccggcaagcccgagttcacgaacctaaaggtgtaccacgacatcaaggacatcaccgcccgcaaggagatcatcgagaacgccgagctcctggaccagatcgccaaaatcctgaccatctaccagagctccgaggacatccaggaggagctcaccaacctgaacagcgagctgacacaggaggagatcgagcagatctccaacctcaaggggtacaccggcacccacaacctgagcctgaaggcgatcaacctcatcctggacgagctgtggcacaccaacgacaatcagatcgccatctttaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctacccaacgacataatcatcgagctggcccgggagaagaacagcaaggacgcccagaagatgatcaacgagatgcagaagcgcaaccggcagaccaacgagcgcatcgaggaaatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtggaccacatcatcccccgcagcgtgtccttcgataacagcttcaacaacaaggtgctggtcaagcaagaggagaactccaagaaggggaaccggacccccttccagtacctgagctccagcgactccaagatcagctacgagaccttcaagaagcacatcctcaacctggccaagggcaaagggcgcatctccaagaccaagaaggagtacctgctcgaggaacgggacattaaccgcttcagcgtgcagaaggacttcatcaaccggaacctggtggacacgcgctacgccacccggggcctgatgaacctcctgcgctcctactttcgcgtcaacaacctggacgtgaaggtcaagagcatcaacgggggcttcacctccttcctcaggcgcaaatggaagttcaagaaggagcggaacaagggctacaagcatcacgccgaggacgcgctgatcattgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcatatcaaggacttcaaggactacaagtacagccatcgcgtggacaagaagcccaatcgggagctcatcaacgacacactgtactccacccgcaaggacgacaaggggaacaccctgatcgtgaacaacctcaacggcctgtacgacaaggacaacgacaagctgaagaagctcatcaacaagagccccgagaagctcctgatgtaccaccacgacccccagacttaccagaagctcaagctgatcatggagcagtacggggacgagaagaacccgctgtacaaatactacgaggagaccggcaactacctcaccaagtactccaagaaggacaacgggcccgtcatcaagaagatcaagtactacggcaacaagctgaacgcccacttggacatcaccgacgactaccccaacagccggaacaaggtggtgaagctctccctgaagccctaccgcttcgacgtctacctggacaacggcgtgtacaagttcgtcaccgtcaagaacctcgacgtgatcaagaaggagaactactacgaggtgaacagcaagtgctacgaggaggctaagaagctgaagaagatctccaaccaggccgagttcatcgccagcttctacaacaacgacctgatcaagatcaatggtgagctctaccgggtcatcggcgtgaacaacgacctgctgaaccgcatcgaggtgaacatgatcgacatcacgtatcgggagtacttagagaacatgaacgacaagcgcccgcccagaatcatcaagaccatcgcgtccaagacccagagcatcaagaagtactcaaccgacatcctggggaacctgtacgaggtaaagagcaagaagcacccccagatcatcaagaagggcaagcgccccgccgccacgaagaaggccggtcaagccaagaagaagaagtga

SEQ ID NO: 8117 - RNA, 4326 nt, synthetic construct
  misc_feature 1..4326: note = Cas9 variant mRNA product
  source 1..4326: mol_type = other RNA
atggcccccaagaagaagcgcaaggtgggcatccacggggtcccggccgcgctgttcaacaagtgcattatcatcagcatcaacctggacttctccaacaaggagaaatgcatgaccaagccctacagcataggcctggacatcgggacgaactccgtgggctgggccgtgatcacggacaactataaggtccccagcaagaagatgaaggtgctggggaacacttccaagaagtacattaagaagaacttactgggcgtgctgctgttcgacagcggcatcaccgccgaggggcggcgcctgaagcggaccgcgcgccggcgctacacgcggcgccggaaccgcatcctgtacctccaggagatcttctctaccgagatggccaccctggacgacgcgttcttccagcggctggacgacagcttcctcgtgcccgacgacaagcgcgactccaagtacccgatcttcggcaacctggtggaggagaaggtgtaccacgacgagttccccaccatctaccacctccggaagtacctcgccgacagcacgaagaaggccgacctgcgcctcgtctacctcgccttagcgcacatgattaagtaccggggccacttcctgatcgagggcgagtttaactccaagaacaacgacatccaaaagaacttccaggacttcctcgacacctacaacgccatcttcgagagcgacctgtccctggagaacagcaagcagctcgaggagatcgtgaaggacaagatttccaagctggagaagaaggaccgcatcctgaagctgttccccggggagaagaacagcggcatcttctctgagttcctgaagctgatcgtgggcaaccaggctgacttccggaagtgcttcaacctcgatgagaaggcaagccttcacttctccaaggagagctacgacgaggacctggagaccctcctgggatacatcggcgacgactatagcgatgtcttcctgaaggctaagaagctctacgacgcgatcctgctgtccgggtttctcaccgtgacggacaacgagaccgaggcgcccctgagctccgccatgatcaagcgctacaacgagcacaaggaggacctcgccctcctgaaggagtacatccggaacatcagcctgaagacctacaacgaggtgttcaaagacgacaccaagaacggatacgccggctacattgacgggaagacgaaccaggaggacttctacgtatacctcaagaacctgctggccgagttcgagggcgccgactatttcctcgagaaaatcgaccgcgaggacttcctgcgcaagcagcgcaccttcgacaacgggtccatcccgtaccagatccaccttcaggagatgcgcgccatcctggacaagcaggccaagttctaccctttcctagccaagaacaaggagcggatcgagaagatcctgaccttccgcatcccctactatgtgggcccgctggcgcgggggaacagcgacttcgcttggtccatccgcaagcggaacgagaagatcaccccgtggaacttcgaggacgtgatcgacaaggagagctccgctgaggccttcatcaaccgcatgacgagcttcgacctctacctgcccgaggagaaggtcctgcctaagcactccctcctgtacgagaccttcaacgtgtacaatgagctgaccaaggtgcggttcatcgccgagagcatgcgcgactaccaattccttgactccaagcagaagaaggacatcgtccggctttacttcaaggacaagcgcaaggtgaccgacaaggacatcatcgagtacctgcacgcgatctacggctacgacggcatcgaactcaaggggatcgagaagcagttcaacagcagcctgagcacgtaccacgacctgctcaacatcattaacgacaaagagttcctggacgactccagcaacgaggctatcatcgaggagatcatccacaccttaaccatcttcgaggaccgggagatgatcaagcaacgcctctccaagttcgagaacatcttcgacaagagcgtgctgaagaagctgagccgtcgccactataccggctgggggaagctctccgccaaacttatcaacggcatccgggacgagaagtccgggaatacaatcctggactacctcatcgatgacggcatcagcaatcgcaacttcatgcagctgatccacgacgacgccctgagcttcaagaagaagatccagaaggcgcagattatcggcgacgaggacaagggtaacatcaaggaagtcgtgaagtccctccccggcagcccggccatcaagaagggaatcctgcagtccatcaagatcgtagacgagctggtgaaggtgatgggcgggcggaagcccgagagcatcgtcgtggagatggcccgagagaaccagtacaccaaccagggcaagtccaacagccagcagaggctcaagcgcctggagaagtcactgaaggagctcggcagcaagatcctgaaggagaacatccccgccaagctgagtaagatcgacaacaacgccctacagaacgaccgcctgtatctgtactacctccagaacgggaaggacatgtataccggagacgacctggacatcgaccggctgagcaactacgacatcgaccacataatcccccaggcgttcctcaaggacaactccatcgacaacaaggtgctggtcagctccgccagcaaccgcggaaagtccgacgacttcccgagcctggaggtggttaagaagcggaagactttctggtaccagttgctcaagagcaagctgatttcccagcgcaagttcgacaacctgacgaaggccgaacggggcggcctgctgcccgaagacaaggcaggcttcatccaacgccagctcgtcgaaacccggcaaatcaccaaacacgtggcccgcctgctggacgagaagttcaacaacaagaaggacgagaacaaccgggcggtgaggaccgtaaagatcatcacgctcaagagcaccctggtgtcccaattccggaaagacttcgagttgtacaaggtgcgcgagatcaacgacttccaccatgcccacgacgcctacctcaacgccgtcatcgccagcgcgctgctgaagaagtaccccaagctcgagcctgagtttgtgtacggcgactacccgaaatacaactccttccgtgagcgcaagagcgccaccgagaaggtgtacttctattccaatatcatgaacatcttcaagaagtccatctccctggctgacgggcgggtgatcgagcgccccctgatcgaagtgaacgaggagacgggcgagagcgtgtggaacaaggagtccgacctcgccaccgtccggcgcgtgctgagctacccccaggtgaacgtcgtaaagaaggtggaggaacagaaccacgggctggaccggggcaagcccaagggcctcttcaacgcgaacctgtccagcaagccgaagcccaactccaacgagaacctggtcggggccaaggaatacctcgaccccaagaagtacggcgggtacgccggcatcagcaactccttcgccgtgctggtcaaggggacgatcgaaaagggagccaagaagaagatcaccaacgtcctggagttccagggcatcagcatcctcgaccgcatcaactaccggaaagacaagctgaacttcctgttagagaaggggtacaaggacatcgagctgatcatcgaactgccgaagtactcactcttcgagctgtccgacggcagccgccggatgctcgcgtcgatcctcagcaccaacaataagcgtggggagatacataagggcaaccagattttcctgtcccagaagttcgtgaagctgctctaccacgccaagcggatcagcaacaccatcaacgagaaccaccgaaaatacgtggagaaccacaagaaggagttcgaggagctgttctactacatcctggagttcaacgagaactacgtcggtgccaagaagaacggaaagctcctgaacagtgccttccagagctggcagaaccattcgatcgacgagctatgcagctccttcatcggccccacggggagcgagcgcaagggcctcttcgagctaacatcccgggggagcgccgcagactttgagttcctgggcgtgaagataccccgctaccgggactacaccccctccagcctcctgaaagacgccaccctgatccaccagtccgtgacggggctgtacgagacccgcatcgacctcgccaagctgggcgagggcaagaggccggccgccaccaagaaggcagggcaggccaagaagaagaagtga

SEQ ID NO: 8118 - RNA, 3402 nt, synthetic construct
  misc_feature 1..3402: note = Cas9 variant mRNA product
  source 1..3402: mol_type = other RNA
atggcacccaaaaagaaacgcaaagtaggaatacacggagtgccggcagcatggtacgcgagccttatgagcgcccaccatctacgcgttggaatcgacgtaggcacccacagcgtaggactagccacactccgagtagacgaccacggaaccccaattgaattactatcggcactgagccacatccacgatagtggagtcgggaaagaaggaaagaaagaccacgacacacgaaagaaactgtcaggaatagcaagacgcgctcgaagactattacaccaccgacgaacacagctccaacaactagacgaagtcctacgagatctaggcttcccaatcccaacaccgggagagttcctagacttaaacgaacaaaccgacccataccgcgtgtggcgagtccgagcacgactcgtggaagagaaactcccagaggaattacgcggaccagccataagcatggcagtgaggcacatcgcccgacaccgagggtggaggaacccgtatagtaaagtagaatccctactaagccccgccgaggaaagcccattcatgaaagcactccgcgaacgaatcctcgcaaccaccggcgaagtactagacgatggcataacgccgggccaagctatggcccaagtcgcactgacccataacatctcaatgcgcggaccagaaggcatactaggaaaactacaccaatccgataacgcaaacgaaatccggaaaatatgtgcccgccagggggtcagccccgacgtttgcaaacagctactccgggccgtattcaaagccgactcacctagaggcagcgccgtgagtagagtagcacccgatccccttcccggtcaggggagcttccgcagagccccaaaatgcgacccagagttccagcgcttccgaataatatccatagtggcaaacctgcgaatatctgaaacgaaaggcgaaaacagaccactaaccgccgacgaacgcagacacgtcgtcaccttcctaacggaagacagtcaagccgatcttacttgggtggacgtcgcagaaaaactcggagttcaccgccgggacttaaggggaacagccgtacacaccgacgacggagaaagaagtgccgcccggcccccaatcgacgcaacggatagaatcatgagacagaccaaaatcagttccctcaaaacgtggtgggaagaagccgacagcgaacagagaggcgcaatgatcaggtacctgtacgaagacccaaccgattctgaatgcgcagaaatcatagctgaactcccagaagaagatcaagccaaactagactccctacacttacccgcaggacgcgccgcatacagcagagagagtctaacagccttaagcgaccacatgctcgcgacaaccgacgacctccacgaggcacgaaaacgccttttcggcgttgacgacagctgggccccacccgccgaagcaatcaacgcccccgtcgggaacccctcggtggaccgcacattaaaaatagtagggcgatacctctcagcagtcgaatctatgtggggcacgccagaagtcattcacgtagagcacgtccgagacgggttcacgagcgagcgcatggccgacgaacgagacaaggcaaaccgacgaagatataacgacaaccaagaagcaatgaagaaaatccagagagactacggaaaagaaggctacatatccagaggggacatagtaaggctggacgccctcgaactccagggatgtgcctgtctctactgcgggacaacaattggataccacacgtgccaactagaccacatcgtaccccaggcaggaccaggaagcaacaaccgccgagggaacctagtcgctgtatgcgaaagatgcaaccgctcgaaatcaaacaccccctttgcagtttgggcccaaaaatgcggcatcccccacgtcggagtaaaggaagcgatcggcagagtcaggggctggagaaagcaaacaccaaacacatcaagcgaagatcttacaaggctaaagaaggaggtcatcgcacgactaagacgaacacaggaggacccagaaatcgacgaaaggtccatggagagcgtagcctggatggcaaacgaactccaccacagaatcgcggccgcatacccagagacaaccgttatggtctatagaggtagtatcacagcggctgcacggaaagccgccggaatagactcccgcatcaatcttataggagagaagggacgaaaagacagaatcgaccgccggcaccacgccgtggatgcctccgtcgtcgcgctaatggaggcaagcgtcgcaaaaacactagccgaacgcagcagcctgcgcggcgaacagcgcctaaccggaaaagaacagacctggaaacaatatacaggcagtaccgtaggagccagagaacacttcgaaatgtggagaggccacatgctccacctcacggaactgttcaatgaaagactagccgaagacaaagtttacgtaacacagaacatacgcctgcgactcagcgacggcaatgcacacaccgtcaaccccagcaaactcgtatcacaccgactcggcgacggactcacagtacaacaaatcgaccgcgcgtgcactccagccctgtggtgtgccctaacccgagaaaaagacttcgacgagaaaaacggcctaccggcacgagaagaccgggccatccgagtgcatgggcacgaaataaaatcgtcagactacatacaagtgttctccaaaagaaagaaaaccgactcagaccgagatgagacaccgttcggagcaatagcggtacgtggagggttcgtcgagatcggacccagcatccaccacgccagaatatacagagtagaaggaaagaaaccagtctacgcaatgctcagggtgttcacacatgacctcttaagccagcgacatggcgacctatttagcgcggtgataccaccacaaagtatcagcatgagatgcgcggaacccaaactccgcaaagcgataacaacgggaaacgccacatatctagggtgggtcgtagtgggcgacgagcttgaaataaacgtagacagtttcaccaaatacgctattggacgcttcctcgaagacttcccaaacacaacacgatggcgcatctgcggttacgatacaaactcaaaactcacgctgaagccaatcgtcctggccgccgaaggactcgaaaacccgtcctcagccgtcaacgagatcgttgaactgaagggatggagagtagcgatcaacgtcctcacaaaagtccacccaacagtagtccgacgcgacgcactaggacgaccgcgctatagttcgagatcaaacctaccaacaagctggacgatcgagaaacgcccagccgcaacaaagaaagccggacaagcgaagaagaagaaatga

SEQ ID NO: 8119 - RNA, 4263 nt, synthetic construct
  misc_feature 1..4263: note = Cas9 variant mRNA product
  source 1..4263: mol_type = other RNA
atggcccccaagaagaagcgcaaggtgggcatccacggggtccctgccgcgaccaagccctacagcatcggcctggacatcgggaccaactccgtgggctgggccgtgacgaccgacaactacaaggttcccagcaagaagatgaaggtgctcgggaacactagcaagaagtacatcaagaagaacctattaggcgtgctcctgttcgacagcggcatcacggccgaggggcggcgcctgaagcggacggcccgcagacgctacacccggcgccggaatcgcatcctctatctgcaagagatcttctccaccgagatggccaccctagacgacgccttcttccaacggctagacgacagcttcctggtccccgacgacaagcgcgactccaaatacccgatcttcggcaacctggtggaggagaaggcctaccacgacgagttccccaccatctaccacctccggaagtacttggccgacagcaccaagaaggccgacctgcgcctcgtgtacctggcgctggcccacatgatcaagtaccgggggcactttctcatcgagggcgagttcaactccaagaacaacgacatccagaagaacttccaggacttccttgacacctacaacgccatcttcgaaagcgacctgtccttggagaatagcaagcagctggaggagatagtcaaggacaagatctccaagctggagaagaaggaccgcatcctcaagctgttccccggggagaagaacagcggcatcttctccgagttcctgaaactcatcgtgggcaaccaggccgacttccggaagtgcttcaacctggacgagaaggccagtctgcacttctccaaggagagctacgacgaggacctcgagaccctgctggggtacatcggcgacgactactccgacgtgttcctcaaggcgaagaagctgtacgacgccatcctgctcagtgggtttctgacggtcaccgacaacgagaccgaggcgcccctgagctccgccatgatcaagcgctacaacgagcacaaggaggacctcgcactgctgaaggagtacatccggaacatcagcctcaagacctacaacgaggtgttcaaggacgacacgaagaacggctacgccggctacatcgacggaaagaccaaccaggaggacttctacgtgtacctgaagaagctgctcgccgagttcgagggcgcagactacttccttgagaagatcgaccgcgaggacttcctgcggaagcagcgcaccttcgacaacggttccatcccgtaccaaatccacctccaggagatgcgcgccatcctggacaagcaggccaagttctaccccttcctggcgaagaacaaggaacggatcgaaaagatcctgaccttccgcatcccctactacgtcggccctctcgcccgggggaacagcgacttcgcctggtccatccgcaagagaaacgagaagatcacgccttggaacttcgaggacgtgatcgacaaggagagctccgccgaggccttcatcaatcgcatgaccagcttcgatctgtacctccccgaggagaaggttcttcccaagcactcgctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacattatcgagtacctccacgcaatctacggctacgacggcatcgagctgaaggggatcgagaagcagttcaacagctccctgagcacctaccacgacctcctgaacatcatcaacgacaaggagttcctggatgactccagcaacgaagccatcatcgaggagatcatccacaccctcaccatcttcgaggaccgggagatgatcaagcagcgcctgtcaaagttcgagaacatcttcgacaagagcgtgctgaagaagctctcccggcgccactacacgggctgggggaagctgagcgccaagctgatcaacggcatccgggacgagaagtccgggaacaccatcctcgattacctgatcgacgacggcatcagcaaccgcaacttcatgcagctgatccacgacgacgcgctcagcttcaagaagaagatccagaaagcacagatcatcggcgacgaggacaaggggaacatcaaggaggtggtcaagtccctgcccggcagcccggccatcaagaaagggatcctgcagtccatcaagatcgtggacgagctcgtcaaggtgatgggcgggcgaaagcccgagagcatcgtggtcgagatggcccgcgagaaccagtacaccaaccagggcaagtccaacagccagcagcggctgaagcgcctggagaagtccctcaaggagctgggcagcaagatactgaaggagaacatccccgccaagctctccaagatcgacaacaacgcgctgcagaacgaccgcctgtacttgtactacttgcagaacgggaaggacatgtacaccggcgacgacctggacatcgaccggctaagcaactacgacatcgaccacatcatcccccaggccttcctgaaggacaactccatcgacaacaaggtgctggtgagctccgcgagcaaccgcgggaagtccgacgacgtcccgagcctcgaggtggtgaagaaacggaagacgttctggtaccagctgctcaagagcaagctgatctcccagcgcaagtttgacaacctgaccaaagcagagcgtggcggcctgagccccgaggacaaggccgggttcatccaacgccagctcgtcgagacccggcagatcaccaagcacgtggcgcgcctgctggacgagaagttcaacaacaagaaggacgagaacaaccgggccgtgcgcacggtcaaaatcatcaccctcaagtccaccctggtgagccagttccgaaaggacttcgagctgtacaaggtgcgcgagatcaacgacttccaccacgcccacgacgcctacctcaacgccgtggtggcgtccgccctgctgaagaagtaccccaagctcgagcccgagttcgtgtacggcgactacccgaagtacaatagcttccgggaacgcaagtccgccaccgagaaggtctacttctacagcaatatcatgaacatattcaagaagtccatcagcctggccgacgggcgggtgatcgagcgccccctgatcgaggtgaacgaggagaccggcgaatccgtctggaacaaggagagcgacctcgcgacggtgcggcgcgtcctgtcctacccccaggtcaacgtggtgaagaaggtcgaggagcagaaccacgggctggaccgggggaagcccaagggcctcttcaacgccaacctgagctccaagccgaagcccaacagcaacgaaaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgatcgcatcaactaccggaaggacaagctgaacttcctgctcgagaaggggtacaaggacatcgagctgatcatcgagctgccaaagtacagcctcttcgagctgagtgacggctcccgccgcatgctggcgagcatcctctccacgaacaacaagcgcggggagatccacaagggcaaccagatcttcctgagccagaagttcgtgaagctgctctaccacgccaagcggatctccaacaccataaacgagaaccaccggaaatacgttgagaaccacaagaaggagttcgaggagctgttctactacatcctggagttcaacgagaactacgtcggggccaagaagaacgggaagctcctgaacagcgcctttcagtcctggcagaaccacagcatcgacgagctgtgctctagcttcatcggccccacagggtccgagcgcaagggcctcttcgaactgaccagccgggggtccgccgcggacttcgagttcctgggcgtgaagatcccccgctaccgggactacacgcccagctccctcctcaaggacgctaccctgatccaccagagcgtcacggggctctacgagacccgcatcgacctggccaagttgggagagggcaagcggccggccgccacgaagaaggcgggtcaggccaagaagaagaagtga

SEQ ID NO: 8120 - RNA, 3345 nt, synthetic construct
  misc_feature 1..3345: note = Cas9 variant mRNA product
  source 1..3345: mol_type = other RNA
atggcaccgaaaaagaaacgcaaagtgggcatccacggagtaccagccgctgccgccttcaaaccaaacagcataaattatatcctcggcctagatatcggtatcgcctccgtagggtgggccatggtcgagattgatgaagaagaaaacccaatcaggctcatagacctaggcgtacgagtcttcgaacgcgccgaagtcccaaaaacaggagattccctcgctatggcacgaagactagcaagaagcgtgagacgacttacccgccgacgcgcccaccgcctcctccgaactcgtcgcctcctaaagcgcgaaggagtcctccaagccgccaatttcgacgaaaacggtctaatcaaaagcctccccaacacgccatggcaactccgagcagcggccctagaccggaaactaacacccctagaatggtccgctgtcctactgcacctcatcaaacaccgcggatacctaagccagaggaaaaacgaaggagagaccgccgacaaagaactaggcgcgctactgaaaggtgtagcaggcaacgcacatgccctacagacgggtgactttcgaacaccggcagagctcgcacttaacaaattcgaaaaagaatctggacatatccgaaatcaaagatccgactacagccacacattcagccgaaaagatctacaagccgaactcatccttctattcgaaaaacaaaaagagttcggaaatccccacgtatcgggcggactgaaggaagggatcgaaaccctactcatgacacaacggcccgccctatcaggcgatgccgttcagaaaatgctaggccactgcacattcgaaccagccgaaccaaaggcggccaaaaacacctacacagcggaacgcttcatctggttaactaaactgaataacttacgcatactcgaacaaggctctgaacgacccctcacggatacagaacgcgcaaccctaatggacgagccctaccgcaaaagcaaactgacctatgcacaagcgagaaaactcctaggactcgaagacacagccttcttcaaaggtctcaggtacggaaaagataacgccgaggccagcacactcatggaaatgaaagcctaccatgccatcagccgagccctggaaaaagagggcctcaaagataagaaaagccctctcaaccttagccccgaacttcaagatgaaatcggaaccgcatttagcctcttcaaaacagacgaagacatcaccggacgactgaaagaccgcatccaaccagagatactcgaggcgctgctaaaacacatatccttcgacaaattcgtacaaatcagcttaaaggcactacgccggatagtacccctaatggaacaagggaaacgatacgacgaagcatgtgccgaaatatacggtgatcactacggaaagaaaaacactgaagaaaagatctacctcccaccaatacccgccgacgaaataaggaaccccgtagtactacgtgccctctcacaagcacgcaaagtcattaacggagtagtcagaagatatggcagccccgcgcggatccacatcgaaacagcccgcgaagtaggcaaatctttcaaagatcgcaaagaaatcgagaaaagacaagaagagaatagaaaagatcgagagaaagccgccgcaaaattccgagaatatttccccaacttcgtcggtgaaccaaaaagtaaagacatcctcaaactccgcctctatgagcaacagcacggaaaatgcctatacagcggaaaagaaatcaacctcggccggctaaacgagaagggatacgtagaaatagaccacgccctcccattctcgcgaacatgggacgactcttttaataacaaagtcttagtcctcggatcagagaaccaaaacaaaggaaatcaaacgccatacgagtacttcaacggcaaggacaacagcagagaatggcaagagttcaaagcacgagtggaaacctcccgattcccacgctccaagaaacaaagaatcctactccagaaattcgacgaagacgggttcaaagaacgcaacctgaacgatacacggtacgtcaaccgcttcttatgccaattcgtggcggaccgcatgcgcctcacgggaaaaggtaagaaacgggtattcgccagcaacggacagataacgaacctcctccggggattctggggcctccgaaaagtccgggcagaaaacgaccgacaccacgcgctagacgcggttgtcgttgcttgcagcaccgtcgccatgcagcagaaaataaccagatttgtcagatacaaagagatgaacgcctttgacggaaaaactatcgacaaagagacaggcgaagtactacaccaaaagacacacttcccgcaaccatgggagttcttcgcccaagaagtcatgataagggtattcgggaaaccagacggcaaaccagagttcgaagaagcagacaccctagaaaagctccgcaccctactggcagaaaagttgagcagccgccccgaagccgtacacgaatacgtaacaccactcttcgtctcccgagcacccaaccgaaaaatgagcggccaaggccacatggaaaccgtaaaatccgccaagcgcctggacgaaggcgtctccgtactaagagtacccctcacccaactcaagctaaaagacctggagaaaatggttaacagagaaagagaaccaaagctatatgaggccctcaaggcgcgcctcgaggcacacaaagacgacccagcaaaagcattcgctgaacccttctataaatacgataaagccgggaacagaacacaacaggtaaaggccgtccgggtagaacaggtacagaagaccggagtctgggtccgaaaccataatggcatcgcagacaacgcaacaatggtacgcgtcgatgtgttcgaaaaaggcgacaagtactacctagtacccatatacagctggcaggtcgcgaaaggcatcctaccggacagggccgtagtccagggcaaagatgaagaagactggcagctaatcgatgattccttcaactttaaattcagcctacacccaaatgacctcgtagaagtaatcaccaaaaaggcaagaatgttcggatacttcgccagctgccacagaggaaccggaaacatcaacattcggatacacgacctcgatcacaaaataggcaagaatggcatactcgagggcataggggtcaaaaccgcactatccttccagaagtaccaaatcgacgagcttggaaaagaaatccggccctgtcgactgaagaaaaggccaccagttcggaagagaccggccgccaccaaaaaggcaggtcaagccaaaaagaagaaatga

SEQ ID NO: 8121 - RNA, 4101 nt, synthetic construct
  misc_feature 1..4101: note = Cas9 variant mRNA product
  source 1..4101: mol_type = other RNA
atggcccccaagaagaagcgcaaggtgggcatccacggggtcccggccgcgaagaagccatacaccatcggcctggacatcgggaccaacagcgtgggctgggccgtgctcaccgaccagtacgacctggtcaagcggaagatgaagatcgccggggactccgagaagaagcagatcaagaagaacttctggggcgtgcgcctgttcgacgagggccagaccgccgctgaccggcgcatggcgcggaccgcccgccggcgcattgagcggcgccggaaccgcatcagctacctccagggaatcttcgccgaggagatgtccaagaccgatgccaacttcttctgccggctgagcgactccttctacgttgacaacgagaagcgcaacagccggcaccccttcttcgcgacgatagaggaggaggtcgagtatcacaagaactaccccacaatctaccacctccgcgaggaactcgtgaactccagcgaaaaggccgacctgcgtctagtgtacctcgccctggcccacatcatcaagtaccgcggcaacttcctgatcgagggggccctcgacacccagaacacctccgtcgacggcatctacaagcagttcatccagacgtacaaccaggtgttcgcgtccgggatcgaggacggctcccttaagaagctggaggacaataaggacgtggccaagatcctcgtcgagaaggtgacccggaaggagaagctggagcgcatcttaaagctctacccgggcgagaagtccgccgggatgttcgcccagttcatcagcctaatcgtgggcagcaaggggaacttccagaagcccttcgacctgatcgagaagtccgacatcgagtgcgccaaggactcgtacgaggaggacctcgagtccctgctggcgctcatcggggacgagtacgccgagctgttcgtcgccgccaagaatgcctacagcgcggtggtgctgagtagcatcatcaccgtcgccgagaccgagacgaacgccaagctcagcgcctccatgatcgagcggttcgacacccacgaggaggacctgggcgagctgaaggcattcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaagagaacttcctgcgcaagcagcgcacattcgacaacggggcgattccccaccaactgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgattttggcaagtccgccgtagacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcgtatttcagcggccaggagaaggagcagatcttcaacgacctgttcaagcagaagcggaaggtcaagaagaaggacctcgagctgttcctgcgtaacatgtcccacgtggagagccccacgatcgaggggctggaggactccttcaacagctcctacagcacctaccacgacctcctgaaggtgggcatcaagcaggagatcctggacaaccccgtcaacacagagatgctcgagaatatcgtgaagatcctgacagtgttcgaggacaagcggatgatcaaggagcagctgcagcagttctccgacgttctcgacggcgtggtgctgaagaagctggagcgccggcactacacggggtggggccgcctcagcgccaagctgctgatggggatccgggacaaacagtcccacctcaccatcctggactacctgatgaacgacgacggcctcaatcgcaacctgatgcagctgatcaacgacagcaacctttcattcaagagcatcatcgagaaggagcaggtcaccaccgccgacaaggatatccagagcatcgtggccgacctggcgggatccccggccatcaagaagggcatcctgcagagcctcaagatcgtggacgaactggtctccgtgatgggctacccgccccagacgatcgtggtcgagatggcccgggagaaccagactaccgggaagggcaagaataacagccgcccccggtacaagtccctggagaaggccatcaaggagttcgggagccagatccttaaggagcaccccaccgataatcaggagctgcgcaacaaccgactgtacctctactacctgcagaacggcaaggacatgtacacgggccaggaccttgacatccacaacctctccaactacgacatcgaccatatcgtgccccagagcttcatcaccgacaactccatcgacaacctggtgctgaccagctccgccgggaaccgcgaaaagggcgacgacgtcccgcccctcgagatcgtgcgcaagcgcaaggtgttctgggagaagctgtaccaggggaacctgatgagcaagcgcaagttcgactacctgaccaaggcggagcggggcgggctgaccgaagccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccaactctacaaggtgcgcgacgtcaacgactaccaccacgcccacgacgcctacctgaacggcgttgtggcgaacactctgctcaaggtctacccccagctggagcccgagttcgtgtacggggactaccaccagttcgactggttcaaggccaacaaggcgaccgccaagaagcagttctacaccaacatcatgttgttcttcgcccagaaggaccggatcatcgacgaaaacggtgagatcctctgggataagaagtacctggacaccgtgaagaaggtcatgtcctaccgccagatgaacatcgtgaagaagacggagatccagaagggggagttctcgaaggccaccatcaagcccaagggcaactccagcaagttaatcccccggaagaccaactgggacccgatgaagtacgggggcctcgacagccccaacatggcctacgcggttgtcatcgaatacgccaagggcaagaacaagctggtgttcgagaagaagatcatccgcgtgaccatcatggagcggaaggccttcgagaaggacgagaaggccttcctggaggagcaggggtaccgccagccgaaggtcctcgccaagctgccgaagtacacgctgtacgagtgcgaggagggccggcgccggatgctcgcgtccgcaaacgaggcccagaaggggaaccagcaggtcctgcccaaccacctggtgaccctcctgcaccacgccgcgaactgcgaggtgagcgacggcaagtccctggactacatcgagagcaaccgcgagatgttcgcggaactcctggcccatgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaaattcttcgagaccacgatcgagcgcaagcggtacaacaacctcaaggagctgctgaacagcaccatcatctaccaatccatcaccggcctctacgagtctcgcaagcgcctcgacgacaagcggcccgccgccaccaagaaggcagggcaggcgaagaagaagaagtga

SEQ ID NO: 8122 - RNA, 4134 nt, synthetic construct
  misc_feature 1..4134: note = Cas9 variant mRNA product
  source 1..4134: mol_type = other RNA
atggctcccaagaagaaacgcaaggtgggcatccacggggtcccggcagcgaagaagccctacagcatcggcctggacatcggcaccaattccgtgggttgggccgtggtaaccgacgactacaaggtgcccgccaagaagatgaaggtgctcgggaacacggacaagagccacatcgagaagaacctgctgggcgccctactgttcgactccggcaataccgccgaggatcggcgcctaaagcggaccgcgcgcagacgatacacccggcgccggaaccgcatcctctaccttcaggaaatcttctcagaggagatgggaaaggtcgacgactccttcttccaccggctggaggacagcttcctcgtgacggaagacaagcgaggcgagcggcaccccatcttcgggaacctggaggaggaagtgaagtaccatgagaacttcccgaccatctaccacctccgccagtacctggccgacaatcccgagaaggttgacctgcggctggtgtacctcgccctggcccacatcatcaagttccgcgggcacttcctgattgaggggaagttcgacacgcggaacaacgacgtgcaacgcctctttcaggagttcctggcggtctatgataacacgttcgagaactccagccttcaggagcagaacgtccaggtggaggagatcctcaccgacaagatctctaaaagcgccaagaaggaccgggtgctgaagctgttccccaacgaaaagtccaacggccgcttcgccgagttcctcaagctgatcgtgggcaaccaggccgacttcaagaagcatttcgagctggaggaaaaggccccgctacagttcagtaaggacacctacgaggaggagctggaggtgctgctcgcgcagataggtgataattacgccgagctgttcctgtccgccaaaaagctgtacgacagcatcctgctgtccggcattctaacagtcaccgacgtgggaacgaaggccccgcttagtgcttcaatgatccagcggtataacgaacaccagatggacctggcgcagctaaagcagttcataagacagaagctgagcgacaagtacaacgaagtgttctccgacgtcagcaaggacggctatgccggctacatcgacgggaagaccaaccaggaggccttctacaagtacctgaaggggctcctgaacaagatagaggggagcggctacttcctggacaagatagagcgcgaggacttcctacggaagcagcgtactttcgacaacgggtccataccccaccagatccacctccaggagatgcgggccatcatccgccgtcaggcagagttctaccccttcctcgcggacaaccaggaccgcatcgagaagctgctgaccttcagaatcccctactacgtggggccgctggcccgcggcaagagcgactttgcctggctgtcccgtaagagcgccgacaagataacgccctggaacttcgacgagatcgttgacaaggagagcagcgccgaggcgttcatcaacagaatgaccaactatgacctctacctccccaaccagaaggtcctgcccaagcactccctcctatacgagaagttcaccgtctacaatgagctgaccaaggtgaagtacaaaacggagcaagggaagaccgcgttcttcgacgctaacatgaagcaagagatcttcgacggcgttttcaaagtgtaccggaaggtcactaaagataagctcatggacttcctggagaaggagttcgacgagttccgcatcgtggacctgaccggtctggacaaggaaaacaaggtgtttaacgccagctacggcacgtaccacgacctgtgcaagatactcgataaggacttcttagataactccaagaacgagaagatcctggaggacatcgtcctgaccctcactctgttcgaggaccgggagatgatccgcaagcggctggagaactatagcgacctcctgacaaaggagcaggtcaagaagctggagcgccggcactacactgggtggggtcgcttgtccgcggagctaatccacggcatccggaacaaggagagcaggaagaccatcctagactacttaatcgacgacgggaactccaacaggaacttcatgcagctgatcaacgacgacgccttgtcttttaaggaggaaatcgccaaggcccaggtgatcggcgagaccgacaacctcaaccaagtggtgtccgacatcgccgggtctccggcgatcaagaagggcatcctgcagtccctgaaaatcgtggacgagctcgtcaagatcatgggccaccaacccgagaacatcgtggtggaaatggcccgtgaaaaccagttcaccaatcagggtcgccggaacagccagcagcgactgaagggcctgacggactccatcaaggagttcgggagccagatcctcaaagaacacccagtcgagaacagccaactgcagaatgaccgactgttcctctactacctgcaaaacgggcgcgacatgtacaccggggaggagctggacatcgactacctctcccagtacgatatcgaccacataatcccccaagccttcatcaaagacaacagcatcgataaccgggtgctgacctccagcaaagagaacaggggcaagtccgatgacgtacccagcaaggacgtcgtgcggaagatgaagtcctactggagcaagctgctctccgccaagctgatcacccagcgcaagttcgacaacttgacgaaggctgagcggggcgggctcaccgacgacgacaaggcgggcttcatcaagcgccagcttgtggagacccggcagatcaccaagcacgttgcccggatcctggacgagcggttcaacaccgagacggacgagaacaataagaaaatccgccaggtgaagatcgtgaccctcaagagcaacctggtctccaacttccggaaggagttcgaactgtacaaggtccgagagataaatgactaccaccacgcccacgacgcctacctcaacgccgtgatcgggaaggcgctgctgggcgtctacccccagctcgagcccgagttcgtttacggggactacccccacttccacggccacaaggagaacaaggccaccgccaagaagttcttctacagcaacatcatgaactttttcaagaaggacgatgtgcggactgacaagaacggcgagatcatctggaagaaagacgaacacataagtaacatcaagaaggtcctgagctacccccaggtgaacatcgttaaaaaggtcgaggagcagaccggaggcttctccaaagagtcgatcctccccaaggggaactccgacaaacttatcccccgcaagacgaagaagttctactgggacaccaagaagtacggcgggttcgacagccccatagtggcctacagcatcctggtgatcgcagacatcgagaagggcaagtccaagaaactgaagaccgtcaaggcactcgtgggcgtaacgataatggaaaagatgaccttcgagcgggacccggtcgccttcttggagcgcaaggggtatcgcaatgtgcaggaggagaacatcatcaagctgcccaagtatagcctcttcaagctcgagaacgggcggaagcgcctgctagcctccgccagggagctgcagaaggggaacgaaatcgtgctgcccaaccaccttggaaccctgttataccacgcgaagaacatccacaaggtcgatgagccgaagcatctcgactacgtggacaaacacaaggatgagtttaaggaactgctggacgtggtctcaaacttctccaagaagtacaccctcgccgagggtaatctagagaagatcaaggagctgtatgcccagaacaacggcgaggacctcaaggagctcgctagcagtttcatcaaccttctcactttcacggccatcggggcgcccgccaccttcaagttcttcgataagaacatcgaccgcaagcggtacaccagcacgaccgagatcctgaacgccacgcttatccaccagtccataaccggactctacgagacgcgcatcgacctgaacaagctgggcggggacaagcggcccgccgccaccaagaaggcgggccaagccaaaaagaagaagtga

SEQ ID NO: 8123 - RNA, 3267 nt, synthetic construct
  misc_feature 1..3267: note = Cas9 variant mRNA product
  source 1..3267: mol_type = other RNA
atggcacctaaaaagaaacggaaagtgggcatacacggcgttccagccgcacaaacaaccaacctcagttacatactaggtctagacctcggtatcgcatcagtcggctgggccgtcgtcgaaatcaacgaaaacgaagaccccatcggactaatagacgtcggcgtaaggatattcgaacgcgccgaagtcccaaaaaccggagaaagcctagcactgtccaggagactcgcgcggagtacccgccgcctaatacgccgccgagcccaccgcctactcctcgcgaaacgcttcctcaagagagaaggcatactgagcaccatagacctcgagaaaggcctgccaaaccaggcctgggagctaagagtcgccggcctcgaaaggcgactatcggccatcgaatggggagccgttctcctgcacctaataaaacacagggggtacctatcgaaaagaaagaacgagagtcaaacgaacaacaaggagctgggcgccctgctaagcggagtggcgcaaaaccaccagctcctacaatccgacgactaccgaacacccgcagaattagccctcaagaaatttgcaaaagaagaggggcacataagaaaccaacgcggcgcttacacacacaccttcaatagattagacctcttagcagaactgaacctgctattcgcacaacagcatcaattcggaaacccacactgtaaagagcacatccagcaatacatgactgaactcctaatgtggcagaaacccgcactcagtggcgaggccatcctaaaaatgctcggaaaatgcacacacgagaaaaacgagttcaaagccgcgaaacatacctacagcgccgaacgttttgtttggctcaccaaactcaataaccttcgaatactcgaagacggggccgaacgggcactaaacgaagaagaaagacaactactaatcaaccacccgtacgaaaagagcaaactaacatacgcgcaggtacgaaaattactaggcctctccgaacaagctattttcaagcacctacgctacagtaaagaaaacgcagagtcagccaccttcatggagctcaaagcctggcacgccatacgaaaagcactcgaaaaccagggcctgaaggacacctggcaggacctcgccaagaaacccgatctcctcgacgaaatcggaaccgccttctcactctacaaaacagatgaagacatccaacaatacctaacgaacaaagtacccaacagcgtaataaacgcactactcgtatccctgaacttcgataagttcatcgaactcagcctgaaaagcctgagaaaaatacttcctctaatggaacaaggcaaacgctacgatcaggcctgccgcgagatctacggacatcactacggggaggccaaccaaaagacgtcacaactcctgcccgccattccagcccaagaaatacgcaaccccgtagtcctgcgaacgctgtcccaagcaagaaaagtaataaacgccatcatacgacaatacggctcccccgcccgagtccacatagaaacgggtcgagaactagggaaatccttcaaagaacgacgcgaaatccaaaaacagcaggaggataatcgaaccaaacgcgagtcagcggttcaaaagttcaaggaactcttctccgacttcagcagcgaaccaaaatctaaagacatactcaagttccgcctttacgagcaacaacacggtaaatgcctatactcgggcaaagaaatcaacatacacaggctgaacgaaaaaggatacgtcgagatcgaccacgcactacccttcagtcggacctgggacgactcattcaacaataaagtacttgtcctagcaagcgagaaccaaaacaaaggcaaccagacaccatacgagtggctacaagggaaaataaactccgaacgctggaaaaacttcgtcgcactggtactcggcagccagtgctcagccgcgaagaaacaacgcctcttgacccaggtcattgacgacaacaaatttatcgaccgcaaccttaacgacactcgatacatcgcacgcttcctatcaaactacatccaggaaaacctcctactcgtcggcaaaaacaaaaagaacgtattcacgccaaacggccaaatcacagccctgctccggtcgcgatggggactaatcaaagctcgagaaaacaacaaccgacaccatgccctagatgcgatcgtggtcgcttgcgcgaccccctcaatgcaacagaaaataacccgcttcatccgatttaaagaagtccacccctacaaaatagaaaaccgatacgaaatggtcgaccaagagagtggagaaattataagcccccacttccccgagccatgggcatacttcaggcaagaggtaaacatccgagtattcgacaaccaccccgacacggtgctaaaagagatgctcccggaccggccacaggcaaaccaccaattcgtacaacctctattcgtctcccgagcgcccaccagaaaaatgtccggccaaggccacatggaaaccatcaagtccgccaaacggctggcagaaggcatctccgtactccgaatacccctaactcaactcaaacccaatctcctggaaaacatggtaaataaggagcgcgaacccgccctgtacgcaggccttaaagcccgactcgccgagttcaaccaggaccccgcaaaagccttcgccacaccattctacaaacaaggcggccagcaggtaaaagcaatccgagtagagcaagtacaaaaatcaggagtcctagtacgcgaaaacaacggagtcgccgacaatgcctcaatcgtacgaaccgacgtattcatcaaaaacaacaaattctttctcgtccccatctacacgtggcaagtagcaaagggaatcctaccaaacaaggcaatcgtcgcacacaaaaatgaagacgaatgggaagaaatggacgaaggtgccaaattcaagttctctctcttccccaacgaccttgtcgaactaaaaaccaagaaagaatacttcttcggctactacatcggactggaccgggcaacagggaacataagcctaaaagagcacgacggcgaaatctccaaaggcaaagacggagtctacagggtaggcgtcaaacttgcactgagctttgaaaaataccaagtagatgagcttgggaaaaaccgacaaatctgccgaccccaacaaagacaacctgtcagaaagagaccagccgcaactaaaaaggcaggacaagccaagaaaaagaaatga

SEQ ID NO: 8124 - RNA, 3345 nt, synthetic construct
  misc_feature 1..3345: note = Cas9 variant mRNA product
  source 1..3345: mol_type = other RNA
atggcacccaaaaagaaacgcaaagtcggaatccacggagtaccagcagcagccgcctttaaaccaaacccaatcaactacatactcggattagacatagggatagcatcagtcggatgggccatggtcgagatcgacgaggacgaaaaccccatatgcctcatagacctgggggttagggttttcgagcgtgcagaggttccaaaaacaggcgacagcctagcaatggcacgtagactagcgcgctctgtccgcagactcacgagacgacgggcccacagactgctaagagcccgccgcctgctcaaaagagaaggagtcctacaagccgccgactttgacgaaaacggactcataaaaagcctccccaacacaccctggcaacttcgggcggccgccttagaccgaaaactcacacccctcgagtggtccgccgtgctactgcacctgatcaaacatcgaggatacctcagccaacgcaaaaacgagggagaaacggcagacaaagagctcggcgcactgcttaaaggcgtagcggacaacgcacacgcactacagacgggggacttccgcacgccagccgagctcgcactcaacaaattcgagaaagaaagcggtcacatccgaaaccagcgcggagactactcccacacattctcccgaaaagacctgcaagccgaactcatcctactattcgaaaaacagaaagagttcggcaacccacacgtatcaggcggtctaaaagaaggtatagaaacactcctcatgacccaaagaccggccctgtcaggagacgcagtccagaaaatgctcgggcattgcacattcgaaccagcagagcccaaggcagctaaaaacacatacaccgcagaacgattcatctggctgaccaagctcaacaacctcagaatattagaacaagggtctgaacgccccctgactgacacggaacgcgcaacactcatggacgaaccgtaccgcaaaagcaaactcacctacgcacaagcccgtaaactactgggcctcgaagacacagctttcttcaagggtctgcgatacggaaaagacaacgcagaagcatcaacattaatggaaatgaaggcttaccatgccatcagccgagccctagaaaaggaaggcctaaaagataagaaaagtcccctaaacctgtcgcccgagctacaagatgaaatcggcacagccttctcgctttttaaaaccgacgaggacatcacagggcgactcaaagaccgaatacaacccgagattctggaggcgctcctcaaacacatatcattcgacaaattcgtccaaatatccctcaaagcactacgcagaatcgttcctctcatggaacaaggcaaacgctacgatgaagcctgcgcagaaatatatggagaccattacgggaaaaagaacaccgaagagaaaatctatctgcccccgatcccagcggacgaaatacggaatcccgtcgttctgcgagcgctatcccaagcgagaaaagtaatcaacggggtcgtcagacgctacggcagtcccgcaagaatacacatagaaaccgcccgagaggtcggcaaatccttcaaagaccgcaaagagatcgaaaaacgccaagaagaaaatcgcaaggaccgagaaaaagcggcagcgaaattcagagaatacttcccaaacttcgtcggggaacccaaatccaaagatatcctaaaactccgcctatatgaacaacagcatggcaaatgcctctacagcggtaaggaaatcaacttaggaagactgaacgaaaaaggctacgtggaaatagaccacgcgctcccattcagccgcacttgggacgactcattcaacaacaaagtgctggtcctcggctcagagaaccagaataaagggaatcaaaccccctacgaatacttcaacggcaaagacaacagccgcgaatggcaagagttcaaggcacgagtggagacctcgcgcttccccagaagcaagaaacagcgaatactcctacagaaattcgacgaagatggcttcaaagaaaggaacctaaatgacacacgctacgtaaaccgctttctttgccaattcgtagcagaccggatgcggctcactggaaagggcaaaaagagagtcttcgcatccaacggacaaatcactaacctgctgaggggattctggggattacgcaaagtccgggcagagaacgaccgacaccatgcgctcgacgccgtagtcgtagcatgcagcaccgtagccatgcaacagaaaatcacgcgcttcgtgagatacaaggaaatgaacgcattcgacggaaagaccatcgacaaagagaccggagaagtcctacaccagaagacccatttcccccaaccctgggagttcttcgcccaggaagtcatgatacgcgtcttcggcaaacccgacggaaagccagagttcgaagaagcggacacgccagaaaaactaagaacgctgctcgccgagaaacttagctccagacctgaagcagtacatgaatatgtaaccccactcttcgtaagccgagccccgaaccgcaaaatgtccggccaggggcacatggaaacagtaaaatcagccaaacgcctagacgagggcgtgagcgtactaagggtaccgcttacacaactcaagctaaaagacctagagaaaatggtcaaccgcgagcgcgaaccaaagctctacgaggcccttaaggctcggctagaggcacacaaagacgacccagccaaagccttcgcggaaccgttttacaaatacgacaaggccggcaatcggactcaacaagtcaaagccgtaagagtagagcaggtccagaaaacaggcgtctgggtacgtaaccacaacggcatagcagacaacgccactatggtacgcgtcgacgtgttcgaaaaaggcgacaaatattatctagtgcccatatacagctggcaagtcgcaaaaggaatcctaccagaccgcgcggtggtccaaggaaaggacgaagaagactggcaactcatcgacgacagcttcaacttcaaattcagcctacaccccaacgacctagtcgaagtcatcacaaagaaggcccggatgttcgggtacttcgcctcctgccaccgcggcaccggtaacataaacataaggatccatgacctcgaccacaaaataggcaaaaacggaatattagaaggcatcggggtaaaaacagcccttagcttccaaaaataccaaatagacgagctaggaaaagaaataaggccctgccgactcaaaaagagaccaccagtgcgcaaaaggcccgcagcaacgaagaaagccggccaagccaaaaagaagaaatga

SEQ ID NO: 8125 - RNA, 3351 nt, synthetic construct
  misc_feature 1..3351: note = Cas9 variant mRNA product
  source 1..3351: mol_type = other RNA
atggcaccgaagaagaaaaggaaagtcggcattcacggagtcccagccgcaaaataccatgtaggcatagacgtaggaacattcagcgtagggctcgcggcaatagaggtagacgacgcaggtatgcccatcaaaaccctaagccttgtgtcacacatccacgacagcggcctcgatccagatgaaatcaaatcggcggtcacgcgactagcaagcagcggtatcgccagacgaacgcgcagactgtaccgaaggaaaaggagaagactccagcaactggacaaattcatacaacggcaaggatggccagtgatagaattagaggactacagcgacccactatacccctggaaagtaagagccgagctcgcagcaagttacattgcggatgagaaagaacgaggcgagaaattgagcgtggcactgagacatatcgccagacacagaggatggcgcaacccatacgcaaaagtaagcagcctatacctcccagacgggccgtccgacgcattcaaagcgatcagagaagagataaagagggcgagtgggcaaccagtgccagaaacagccacggtgggacaaatggtgaccctatgcgaactaggcacgctgaagctaagaggagaaggcggagtcctgagtgcacggttgcagcaaagcgactacgcccgcgaaatacaagaaatatgccgcatgcaagaaatagggcaagaactctacagaaaaataatcgacgtagtattcgcagctgaaagcccaaaggggagcgccagcagccgagtaggaaaagaccccttacaacccgggaaaaaccgcgcgctaaaggccagcgacgcattccaacgatacaggatagcagccttaataggaaacctaagagtccgagtagatggagagaaacgcatcctcagcgtagaggagaagaacctcgtgttcgaccatctggtcaatctaaccccaaagaaagaaccagaatgggtaacgatcgcagaaatactgggcatagacagagggcagctaataggaaccgccacgatgacggacgacggagaacgcgcgggagcccgaccacctacgcacgacacgaacagatccatcgtgaacagccgaatagccccgctagtcgactggtggaaaacagcgagcgccctcgaacaacatgcaatggtcaaggctctaagcaacgcggaagtagacgacttcgactcaccagagggagcaaaagtccaagcattcttcgccgacctagacgacgacgtccacgcaaaactcgactcccttcatctgccagtcggacgagcggcgtacagcgaagacaccctagtacgattaacacgacgcatgctaagcgacggagtagatctgtacaccgcaagactacaggagttcggcattgaaccaagctggacgccaccaacccccaggatcggagaaccagttggtaacccagctgtagaccgagtactaaaaacagtcagtcgatggcttgaaagtgcgaccaagacttggggagcaccagaacgggtcataatagaacacgtaagggagggatttgtaacagaaaaacgggcgcgagaaatggacggggacatgcgtagacgagcagcaaggaacgcaaaactgttccaggaaatgcaggagaaactaaacgtacaaggaaaaccctctagagcagatctctggcggtaccagagcgtccaaagacaaaactgccaatgcgcatactgcggcagcccaatcacgttcagcaactcagaaatggaccacatcgtgccaagggctgggcagggatccaccaacacgcgcgagaacctagtggcggtgtgccacaggtgtaaccaaagcaaaggaaacaccccgttcgcgatatgggcgaaaaacacctccatagagggcgtaagcgtaaaggaagctgtggaaagaacacgacactgggtcacggacacaggaatgcgctcaaccgactttaagaaatttacaaaggctgtcgtcgagaggttccaaagagcaacgatggacgaagagatagacgcaaggagcatggaatcggtcgcatggatggcaaacgaattgcgcagtcgggtagcacagcacttcgctagccacggaacaacggtacgagtctaccgcggaagcctcacagcggaagcacggagggccagcggcataagcggcaaactaaagttcttcgacggagtcgggaaatctcgcctagaccgcagacaccatgccatagacgcggccgtgatcgcattcacaagtgactacgtggccgagaccctagcagtacgaagcaatttgaagcaaagccaagcgcacagacaggaagccccgcaatggcgagagttcacaggaaaagacgcagaacacagagcggcatggagggtatggtgccagaaaatggaaaaactaagcgcattgctcaccgaagacctcagggacgacagagtcgtcgttatgagcaacgtgcggctacgcctcggcaacggctcggcccacaaagaaacaataggaaaactcagcaaggtcaaactaagctcacaactgtccgtatccgacatagacaaagcgtcgagcgaagcactctggtgcgcgctaacgcgagaacccggatttgaccccaaggaaggcctccctgcaaacccagaacggcacatacgagtaaacggtacacacgtgtatgctggtgacaacatcggattattcccagtctcagcaggaagtattgcgctgcggggaggatacgcagaactcggctcaagttttcaccacgcaagggtatataaaataacaagcgggaagaaaccagcattcgctatgttgagagtatacacgatagacctgctcccctaccgcaaccaagacctattcagcgttgaactaaaaccacaaacaatgtcaatgaggcaagccgaaaagaaactgcgagacgccctcgccaccgggaacgccgaatacctcggctggttagtcgtcgacgacgagctcgtagtagacaccagcaaaatagcaacggaccaagtaaaagcagtcgaagcggagctaggaacgataagacgatggagggtagatggatttttcagcccaagcaaactacgcctaagaccgcttcaaatgtcaaaagaaggcatcaaaaaggaaagcgcaccagagctgagcaagataatcgacagacccggctggctaccagcagttaataaactcttcagcgacggcaacgtcacagtcgtgcgaagggactcgttggggcgggtacggctagaaagcacagcgcacctacccgtcacatggaaggtacaaaagagaccagccgcgacgaagaaggcaggccaggcgaagaaaaagaaatga

SEQ ID NO: 8126 - RNA, 3051 nt, synthetic construct
  misc_feature 1..3051: note = Cas9 variant mRNA product
  source 1..3051: mol_type = other RNA
atggcccccaagaagaaacgcaaggtgggcatccacggggtcccggccgcggcccggatactggccttcgacatcggcatcagctccatagggtgggccttcagcgagaacgacgagctcaaggactgcggcgtgcgcatcttcactaaggtggagaaccccaagacaggagagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgatgagagcctcgccaaggcctacaaaggctccctgatcagcccctacgagctgcggttccgcgcactcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacttgtacaaggagtacttccagaaattcaaggagaacagcaaggagttcacgaacgtgcgcaacaagaaggagtcctacgagcggtgcatcgcccagagcttcctgaaggacgagctgaagctcatctttaaaaagcagcgcgagttcgggttctccttcagcaagaagttcgaagaggaggtcctttccgtggcgttctacaagcgggctctgaaggacttcagccacctcgtgggcaactgctccttcttcaccgacgagaagcgcgccccgaagaacagccccctggccttcatgtttgtcgccctgacccggatcatcaatctcctgaacaacctgaagaacaccgagggcatcctctacacgaaggacgacctgaacgcgctgcttaacgaggtgctgaagaacggcaccctgacctacaagcagaccaagaagctcctggggctgagcgacgactacgagttcaaaggggaaaagggcacgtacttcatcgagttcaagaagtacaaggagttcattaaggccctcggggagcacaacctgtcccaggacgacctgaacgagatcgccaaagacatcaccctcatcaaggacgagatcaagctgaagaaggccctggccaagtacgacctcaaccagaaccagatcgacagcttatccaaacttgagttcaaggaccacctcaacatcagcttcaaggcgctaaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgtgcgatcaaggagtaccgcaaggtgctgaacgccctcctgaagaagtacggcaaggtgcacaaaatcaacatcgagctggcgcgggaggtcgggaagaaccactcccagcgcgccaagatcgagaaggagcagaacgagaactacaaggccaagaaagacgcggagctcgagtgtgagaagctgggcctgaagatcaacagcaagaacatcctcaagctgcggctgttcaaggagcagaaggagttctgtgcctactccggggagaaaatcaagatcagcgacctccaggacgagaagatgttagagatcgaccacatctacccatactcccgcagcttcgacgactcctacatgaacaaggtgctggtgttcaccaagcagaaccaggagaagctcaaccagacccccttcgaggccttcggcaacgacagcgcgaagtggcagaagatcgaggtcctggcaaagaacctacccaccaagaagcagaagcggatcctcgacaagaactacaaggacaaggagcagaagaacttcaaggaccgcaacctgaacgacacacggtacatagctcgcctggtgctcaactacaccaaggactacctggacttcctgccgctctccgacgacgagaacaccaagctgaacgacacccagaaggggagcaaggtgcacgtcgaggccaagtccggcatgctgacgagcgctctccggcacacctggggcttctccgccaaggaccgcaacaaccacctccaccacgccatcgatgcggtgataatcgcctacgccaacaacagcatcgtcaaggccttctccgacttcaaaaaggagcaggagagcaacagcgcggagctgtacgccaagaagatctccgagctggactacaagaacaagcggaagttcttcgagcccttcagcggtttccgccagaaggtgctggacaagatcgacgagatcttcgtgtccaaacccgagcggaagaagcccagcggtgccctgcacgaggagaccttccgtaaagaggaggagttctaccagtcctacgggggcaaggagggggtcctcaaggcgctggagctgggcaagatccggaaggtgaacgggaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttttgcttctccctctacaaggacagcctgatcctgatccagaccaaggacatgcaagagcccgagttcgtgtactacaacgccttcacctcctcaaccgtgtccctcatagttagcaagcacgacaacaagttcgagacgctgtccaagaaccagaagatcctgttcaaaaacgcaaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtga

SEQ ID NO: 8127 - RNA, 3462 nt, synthetic construct
  misc_feature 1..3462: note = Cas9 variant mRNA product
  source 1..3462: mol_type = other RNA
atggcccccaagaagaagcgcaaggtgggcatccacggggtcccggccgcgtcggacctagttctcggcctggacatcgggattggctccgtgggggtcgggatcctgaacaaggtgaccggcgagatcatccacaagaacagccggatcttccccgccgcccaggccgagaacaacctagtgcgccggacgaaccgccagggccggcgcctggcccggcgcaagaagcaccggcgcgtccggctgaaccgcctcttcgaggagtccggcctgatcacggacttcaccaagatcagcataaacctgaacccctaccagttacgggtgaaggggctgaccgacgaactgtccaacgaggagctgttcatcgcgctgaagaatatggtgaagcaccgcggcatcagctacctggatgacgcctccgacgacgggaacagctccgtcggcgattacgcccagatcgtgaaggagaatagcaagcagctcgagaccaagacgcccggacagatccagctggagcggtaccagacctacgggcagctgcgcggcgatttcaccgtggagaaagacgggaagaagcaccgactcatcaacgtcttcccgacctccgcctaccgaagcgaggcgctgcggatcctgcaaactcagcaggagttcaacccccagatcaccgatgagttcatcaaccgctacctcgagatcctgaccggcaagcggaagtactaccacggccccgggaacgagaagtcccgcaccgactacggccgctatcggacgagcggggagaccctggacaacatcttcggcatcctcatcgggaagtgcaccttctaccccgacgagttccgcgccgccaaggcctcctacaccgcccaggagttcaaccttttaaatgacctcaacaacctgacggtgccgaccgaaaccaagaagctcagcaaggagcagaagaaccagatcatcaactacgtgaagaacgagaaggctatgggccccgccaagctgttcaagtacatcgccaagctcctgtcctgcgacgtcgccgacatcaagggctaccggatcgacaagagcgggaaggccgagatccataccttcgaggcgtaccgcaagatgaagacgctcgagaccctggacatcgagcagatggacagagagaccctggacaagctcgcctacgtactgaccctgaacacggagcgcgagggcatccaggaggccctcgagcacgagttcgccgacgggtccttcagccagaagcaggtcgacgagctggtgcagttccggaaggccaacagctccatcttcggcaaagggtggcacaactttagcgtgaagctgatgatggagctcatccccgagctgtacgagaccagcgaggagcagatgaccatcctgacccgcctcggcaagcagaagacaaccagctccagcaacaagactaagtacattgacgagaagctgctgaccgaggaaatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgcctcacagcgtgttccacggccacaagcagctggccaccaagatccggctgtggcaccagcagggcgagcgctgcctctataccggcaagaccatctccatccacgacctgatcaacaacagcaaccagttcgaggtcgaccacatcctgcccctctccatcacgttcgacgacagcctggccaacaaagtgctggtgtacgcgaccgccaaccaggagaaggggcagcggacgccctaccaggccctggactccatggacgacgcctggtcgttccgcgagctgaaggccttcgtccgggagtccaagaccctgagcaacaagaagaaggagtacctcttgaccgaggaggacatctccaagttcgacgtgcgcaagaagttcatcgagcggaacctcgtggacacgcgctacgcgagccgggtcgtgctcaacgccctgcaggagcacttccgcgcccataaaatcgacaccaaggtgtccgtggtgcgcggccagttcaccagccagttaagacgccactggggcatcgagaagacccgggacacgtaccaccaccatgcagtggacgccctcatcatcgcggcctcctcccagctgaacctgtggaagaagcagaagaacaccctcgtcagctactccgaggaccagctgctggacatcgagaccggggagctcatcagcgacgacgagtacaaggagtccgtgttcaaggccccctaccaacatttcgtggacaccttaaagagcaaggagttcgaggattccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctcgagaactaccccaacaagcagatcaacgagaagggcaaggaggttccctgcaacccgttcctcaagtacaaggaggagcacgggtacatccggaaatacagcaagaagggcaacgggcccgagatcaagtccctgaagtactacgacagcaagctgggcaaccacatcgacattacccccaaagactccaacaacaaggtggtcctccagagtgtgtccccctggcgcgccgacgtgtacttcaacaagaccaccgggaagtacgagatcttgggcctgaaatacgcggacctccagttcgagaagggcacggggacctacaagatcagccaggagaagtacaacgacatcaagaagaaagagggcgtcgacagcgactccgagttcaagttcaccctgtacaagaacgacctgctcctggtgaaggacaccgagacgaaggagcagcagctgttccggttcctcagccgcaccatgccaaagcagaagcactacgtggagctaaagccctacgacaagcagaagttcgagggcggagaggccctgatcaaggtcctcgggaacgtggccaactccggccagtgcaagaagggactgggcaagagcaacatctccatctacaaggtgcggaccgacgtcctggggaaccaacacatcattaagaacgagggggacaaacccaagctcgacttcaagcgccccgccgccaccaagaaggcgggccaggccaagaagaagaagtga

SEQ ID NO: 8128 - RNA, 4020 nt, synthetic construct
  misc_feature 1..4020: note = Cpf1 variant mRNA product
  source 1..4020: mol_type = other RNA
atggcccccaagaagaagcgcaaggtgggaatccacggcgtcccggccgcgacccagttcgagggcttcaccaacctgtaccaggtgagcaagacgctccggttcgagctgatcccccaggggaagaccctgaaacacatccaggagcagggcttcatcgaggaggacaaggcccgcaacgaccactacaaggaactcaaacccatcatcgaccggatctataagacctacgccgaccagtgcttgcagctggtgcagctcgactgggagaatctgtccgccgccatcgacagctaccgcaaggagaagaccgaggagacccgtaacgcgcttatcgaggagcaggccacctaccgcaacgctattcatgactacttcatcgggcggaccgataacctcaccgacgccataaacaagcgccacgctgaaatctacaagggcctcttcaaggccgagctattcaacggcaaggtactaaagcagttagggacggtgaccaccaccgagcacgagaatgccctactccggtccttcgacaaattcacgacctacttctcaggcttctacgaaaaccgcaagaacgtgttcagcgcagaggacatcagcaccgcaatcccccaccggatcgtccaggacaatttcccgaagtttaaggagaactgccatatcttcacccgtctgatcacggcggtgccgtccctgcgggaacacttcgaaaacgtgaagaaggccatcggaatttttgtcagcacctccatcgaggaggtgttcagtttccccttctacaaccagttgctgacccagacccagatcgacctgtacaaccagctcttgggcgggatctctcgcgaggccggcacggagaagataaagggcttaaatgaggtgctcaacctggccatacagaagaacgacgagacagcccacatcatagcgagcctgccccaccggttcatcccgttattcaaacagatcctgtctgaccgtaacacccttagcttcatcctcgaggagttcaagagtgacgaagaggtcatccagtcgttctgcaaatacaagacccttctgcggaacgagaatgtgctcgagacggccgaggcccttttcaacgaactgaactccatcgacctcacccacatcttcatcagccacaagaaactcgagaccatcagcagcgccctgtgcgaccactgggacaccctccgcaacgccctgtacgagcggcgcatcagtgagctgacgggcaagatcaccaagtccgcgaaggagaaggtgcagcggagcctcaagcatgaagacatcaacctgcaggagatcatctccgccgccggcaaggagctgagtgaggccttcaagcaaaagacctcagaaatcctatcccacgctcatgcggccctggaccagccgttgcccaccacgctcaagaagcaagaagagaaggagatcctgaaatcccagttagacagcctgctcgggctgtaccacctcctcgactggttcgcagtcgacgaatccaacgaggtggaccccgagtttagcgcccgcctgaccggcattaaactggagatggagccgtccctcagcttctacaacaaggcgcgcaactacgccaccaagaagccctactccgtggagaagttcaagctgaacttccagatgcccacgctggccagcggctgggatgtaaacaaggagaagaacaatggggccatactcttcgtgaagaacggcctgtactacctggggatcatgcctaagcaaaagggccggtacaaggccttatccttcgagcccacggagaagaccagcgaagggttcgacaagatgtactacgactacttccccgacgcggccaaaatgatccccaagtgctccacacagctgaaagcagtgaccgcccacttccagacccacacgaccccgattctgttgagtaacaacttcatcgagccgctggagatcaccaaagagatctacgatctgaacaaccccgagaaggagcccaaaaagttccagaccgcctatgcgaaaaagacgggagaccagaaaggctaccgcgaggccctgtgcaagtggatcgacttcacccgggatttcctatccaagtacaccaagaccacgagcatcgacctgagttcactccggccaagctcccagtacaaagatctgggggagtactacgccgagctgaatccgctcctgtatcacatctcattccaacggatcgccgagaaagagatcatggacgccgtagagacgggcaagctctacctcttccagatctacaacaaggacttcgcgaagggacaccacggcaagcctaacctgcacacattgtactggaccggcctcttctcccccgagaacctcgccaagacgagcatcaagctgaacgggcaggccgagctgttctacaggcccaagagccggatgaagcgcatggcccacaggctgggtgagaagatgctgaacaagaagctaaaggaccagaagaccccgatccccgacaccctgtaccaagagctgtatgactacgtgaaccatcgcttaagccacgacctctccgacgaggcgcgtgccttactccccaacgtgatcaccaaggaggtcagccatgagatcatcaaggaccgcagattcacgtccgacaagttcttcttccacgtgccgatcacactgaactaccaggccgctaacagcccctccaagttcaaccagcgcgtcaacgcctacctaaaggagcaccccgagacgcccatcattgggatagaccggggcgagcgcaacctgatctatatcaccgtgatcgacagcacggggaagatcctggagcaacgatccctgaacaccatccagcagttcgactaccagaagaaactcgacaaccgcgaaaaagagcgggtggcggcacgccaggcctggagcgtcgtgggcaccatcaaggacctgaagcaggggtacctgagccaggtgatccacgagatcgtcgacctcatgattcactaccaggccgtcgtggtcctggagaacttaaacttcggcttcaaatcgaaacgcaccggcatcgccgagaaagcggtgtaccagcagttcgagaagatgctcattgacaagttaaactgcctggtgctaaaagattacccggccgagaaggtcggaggcgtgctgaacccctaccagttgacggaccagttcaccagcttcgccaagatgggcacccagtctggcttcctcttctacgtgcccgccccctacaccagcaagatcgacccgctgacggggttcgtagaccccttcgtttggaagaccatcaagaaccatgagagtcggaagcacttccttgaggggtttgacttcctccactatgatgtgaagactggcgatttcatcctgcacttcaagatgaaccgcaacctgagcttccagcgggggctccccggtttcatgcccgcctgggacatcgtcttcgagaagaatgagacccagttcgacgcgaaggggacgcccttcatcgccggcaagcgcatagtccctgtgatcgagaaccaccggttcaccggccgctaccgggatctgtaccccgcaaacgagctgatcgccctcctggaggagaaggggatcgtctttcgagacggctccaacatcctgcccaagttgttagagaatgacgacagccacgcaatcgacaccatggtggccctgattcggtccgtgctccagatgcgcaacagcaacgcggccaccggggaggactacatcaactccccggtccgggacctgaacggcgtgtgctttgatagccgcttccagaaccccgagtggcccatggacgccgacgcgaacggggcctaccatatcgccctgaagggacaactcttgctgaaccacctcaaggagtctaaggacctcaagctgcaaaacggtatcagcaaccaggactggctcgcctatatacaagagctgcggaacaagcgccccgccgcgactaaaaaggctgggcaggccaagaagaagaagtga

SEQ ID NO: 8129 - RNA, 3999 nt, synthetic construct
  misc_feature 1..3999: note = Cpf1 variant mRNA product
  source 1..3999: mol_type = other RNA
atggcccccaagaagaagcgcaaggtgggcatccacggggtcccggccgcgagcatctaccaggagttcgtgaacaagtactccctgagcaagaccctccggttcgagctgatcccccagggcaagaccctggagaacatcaaggcccgcgggctcatcctggacgacgagaagcgggccaaggactacaagaaggccaagcagatcatcgacaagtaccaccagttcttcatcgaggagatcctgtccagcgtgtgcatctccgaggacctcctgcagaactacagcgacgtctacttcaagctgaagaagtccgacgacgacaacctccagaaggacttcaagagcgccaaggacacgatcaagaagcagatctccgagtacatcaaggacagcgagaagttcaagaacctgttcaaccagaacctgatcgacgcgaagaagggccaggagtccgacctcatcctgtggctgaagcagagcaaggacaacgggatcgagctgttcaaggccaactccgacatcaccgacatcgacgaggccctcgagatcatcaagagcttcaagggctggaccacctacttcaagggcttccacgagaaccgcaagaacgtgtactccagcaacgacatccccacgtccatcatctaccggatcgtggacgacaacctgcccaagttcctcgagaacaaggccaagtacgagagcctgaaggacaaggcgccggaggccatcaactacgagcagatcaagaaggacctggccgaggagctcaccttcgacatcgactacaagacctccgaggtcaaccagcgcgtgttcagcctggacgaggtgttcgagatcgccaacttcaacaactacctgaaccagagcgggatcaccaagttcaacacgatcatcggcgggaagttcgtcaacggcgagaacaccaagcggaaggggatcaacgagtacatcaacctctactcccagcagatcaacgacaagaccctgaagaagtacaagatgagcgtgctgttcaagcagatcctctccgacaccgagagcaagtccttcgtgatcgacaagctggaggacgacagcgacgtcgtgacgaccatgcagtccttctacgagcagatcgccgcgttcaagaccgtggaggagaagtccatcaaggagaccctgtccctcctgttcgacgacctgaaggcccagaagctcgacctgagcaagatctacttcaagaacgacaagtccctgacggacctcagccagcaggtcttcgacgactactccgtgatcggcaccgccgtgctggagtacatcacccagcagatcgcccccaagaacctggacaaccccagcaagaaggagcaggagctcatcgccaagaagaccgagaaggcgaagtacctgtccctggagacgatcaagctcgccctggaggagttcaacaagcaccgcgacatcgacaagcagtgccggttcgaggagatcctggccaacttcgccgccatccccatgatcttcgacgagatcgcgcagaacaaggacaacctcgcccagatcagcatcaagtaccagaaccagggcaagaaggacctgctgcaggcctccgccgaggacgacgtcaaggccatcaaggacctcctggaccagaccaacaacctgctgcacaagctcaagatcttccacatcagccagtccgaggacaaggcgaacatcctggacaaggacgagcacttctacctggtgttcgaggagtgctacttcgagctcgccaacatcgtgccgctgtacaacaagatccgcaactacatcacccagaagccctacagcgacgagaagttcaagctgaacttcgagaacagcaccctcgccaacgggtgggacaagaacaaggagcccgacaacacggccatcctgttcatcaaggacgacaagtactacctgggcgtcatgaacaagaagaacaacaagatcttcgacgacaaggcgatcaaggagaacaagggggagggctacaagaagatcgtgtacaagctcctgcccggcgccaacaagatgctgccgaaggtgttcttctccgccaagagcatcaagttctacaacccctccgaggacatcctccggatccgcaaccacagcacccacaccaagaacgggagcccccagaagggctacgagaagttcgagttcaacatcgaggactgccggaagttcatcgacttctacaagcagagcatctccaagcaccccgagtggaaggacttcgggttccgcttcagcgacacccagcggtacaactccatcgacgagttctaccgcgaggtcgagaaccagggctacaagctgacgttcgagaacatcagcgagtcctacatcgacagcgtggtcaaccaggggaagctgtacctcttccagatctacaacaaggacttctccgcctacagcaagggccggccgaacctgcacaccctgtactggaaggccctcttcgacgagcgcaacctgcaggacgtggtgtacaagctgaacggcgaggcggagctgttctaccggaagcagtccatccccaagaagatcacccaccccgccaaggaggccatcgccaacaagaacaaggacaaccccaagaaggagagcgtcttcgagtacgacctcatcaaggacaagcgcttcaccgaggacaagttcttcttccactgcccgatcacgatcaacttcaagtccagcggggccaacaagttcaacgacgagatcaacctgctcctgaaggagaaggcgaacgacgtgcacatcctgagcatcgaccggggcgagcgccacctcgcctactacaccctggtggacgggaagggcaacatcatcaagcaggacaccttcaacatcatcgggaacgaccgcatgaagaccaactaccacgacaagctggccgccatcgagaaggaccgggactccgcccgcaaggactggaagaagatcaacaacatcaaggagatgaaggagggctacctcagccaggtcgtgcacgagatcgcgaagctggtgatcgagtacaacgccatcgtcgtgttcgaggacctgaacttcggcttcaagcgggggcgcttcaaggtggagaagcaggtctaccagaagctcgagaagatgctgatcgagaagctgaactacctcgtgttcaaggacaacgagttcgacaagacgggcggggtgctgcgggcctaccagctgaccgcccccttcgagaccttcaagaagatgggcaagcagaccgggatcatctactacgtccccgcgggcttcacctccaagatctgccccgtgacgggcttcgtgaaccagctctacccgaagtacgagagcgtctccaagagccaggagttcttctccaagttcgacaagatctgctacaacctggacaaggggtacttcgagttcagcttcgactacaagaacttcggcgacaaggccgccaaggggaagtggaccatcgcctccttcggcagccgcctgatcaacttccggaactccgacaagaaccacaactgggacacccgcgaggtgtaccccaccaaggagctcgagaagctgctgaaggactacagcatcgagtacggccacggggagtgcatcaaggccgcgatctgcggcgagtccgacaagaagttcttcgccaagctcacgagcgtgctgaacaccatcctgcagatgcggaactccaagaccgggaccgagctcgactacctgatcagccccgtcgccgacgtgaacggcaacttcttcgactcccgccaggcccccaagaacatgccgcaggacgccgacgcgaacggggcctaccacatcggcctgaagggcctcatgctgctggggcggatcaagaacaaccaggagggcaagaagctcaacctggtgatcaagaacgaggagtacttcgagttcgtccagaaccgcaacaacaagcggcccgccgccacgaagaaggccgggcaggcgaagaagaagaagtga

SEQ ID NO: 8130 - RNA, 4716 nt, synthetic construct
  misc_feature 1..4716: note = Cas9 variant mRNA product
  source 1..4716: mol_type = other RNA
gggagagtcccgcagtcggcgtccagcggctctgcttgttcgtgtgtgtgtcgttgcaggccttattcaagcttaccatggcccccaagaagaagcgcaaagtgggaatccacggggtgccggcggcggacaagaagtacagcatcggcctggacatcgggaccaactcagtgggctgggccgtaatcaccgacgaatacaaagtccccagcaagaagttcaaggtgctggggaacacggaccggcattccatcaagaagaacctgatcggtgccctgctgttcgactcgggcgagaccgccgaggccacccgcctgaagcgaaccgcgcgccggcgctacacgcggcgcaagaaccggatctgttacctgcaggagatcttctccaacgagatggccaaggtggacgacagcttcttccaccgcctcgaggagtccttcctggtcgaggaggacaagaagcacgagcggcaccccattttcgggaacattgtggacgaagtggcctaccacgagaagtaccccaccatctaccaccttcgcaagaagctcgtcgacagcaccgacaaggccgacctgcggctgatttacctcgcgctggcccacatgatcaagttccgcggccacttcctgatcgagggggacctcaacccggacaactccgacgtggacaagctgttcatccaactggtgcagacctacaaccagctgttcgaggagaaccccatcaacgccagcggcgtcgacgccaaagccatcctgtccgcgagacttagcaagagtcgcaggctcgagaacctgatcgcccagcttcccggggagaagaagaacggcctattcggcaacctgattgccctgagcctcggactgacacccaacttcaagtccaacttcgatctggccgaggatgccaaactccagttgagtaaggacacctacgacgacgacctggacaacctcctggcgcagatcggcgaccagtacgccgacctgttcctcgccgccaagaacctgtctgacgccatcctgctcagcgacatcctgcgcgtgaacaccgaaatcaccaaggcgccgctgtccgcctcaatgatcaagcggtacgacgagcaccaccaggatctcacgctgctgaaggcgctagtgcgccagcagttgcccgagaaatacaaggagatcttcttcgaccagagcaaaaacgggtacgctggctacatcgacggcggggcctcccaggaggagttctataagttcatcaagcccatactggagaagatggacggcaccgaggagttactggtcaagctgaaccgggaggacctgctccgcaagcagcgcaccttcgacaatgggagcatcccccaccagatccacctgggcgagctgcacgcgatcctccggcgccaggaggacttctacccgttcctgaaggacaaccgggagaagatcgagaagatcctcacctttcgcatcccctactacgtggggcccttggcccggggcaactcccgcttcgcctggatgacgcgcaagagcgaggagaccatcactccctggaatttcgaggaggtggtcgacaagggcgccagtgcgcagagcttcattgagaggatgaccaactttgacaagaacctgccgaacgagaaggtgctgcccaagcactccctcctgtacgagtacttcacggtgtataacgaactcaccaaggtcaagtacgtgaccgaggggatgcggaagcccgctttcctcagcggcgagcagaagaaggccatcgtggacttgctgttcaagaccaaccgcaaggtcacggtgaagcagctcaaggaggattacttcaagaagatcgagtgcttcgactccgtcgagatcagcggggttgaggaccggttcaacgcctccctgggcacctaccacgacctgctcaaaatcatcaaggacaaggactttctggacaacgaggagaacgaggacatcctggaggacattgtgctcaccctgaccctgttcgaggaccgcgagatgatagaggagcggctcaagacgtatgcccacctgttcgacgacaaggtcatgaagcaactgaagcgtcggcgctacaccgggtggggccggctcagccgcaagttgatcaacggaatccgagataaacagagtgggaagacaatcctggacttcctaaagagcgacggctttgcaaaccgcaacttcatgcagctgatccacgacgactccttgaccttcaaggaggacatccagaaggcccaagtatctgggcagggagactccctccacgagcacatcgccaacctggccgggtcccccgccatcaagaagggcatcctgcagacggtgaaggtcgtggacgagctagtcaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaagagcaccccgtggagaacacccagctccagaacgagaagctctacctgtactaccttcagaacggccgggatatgtacgtcgaccaggagctggacattaacaggctgagcgactatgacgtggaccacatcgtgccccagtccttcctcaaagacgacagcatcgacaacaaggtcctgacacggtccgacaagaaccggggcaagagcgacaacgtgccctccgaggaggtagtcaagaaaatgaaaaactattggagacagctgctcaacgctaagctgatcacccagcgcaaattcgacaacttgaccaaagccgaacgcgggggcctcagcgagctagacaaggccgggttcatcaagcggcagctggtggagacccggcagatcaccaagcacgtagcccagatcctcgactccaggatgaacacgaagtacgacgagaacgacaaactgatccgggaggtcaaggtgatcaccctcaagagcaaacttgtgtccgacttcagaaaggacttccagttctataaggttagggagatcaacaactaccaccacgcgcacgacgcatacctgaacgccgtggtgggcaccgccctgatcaagaagtacccgaaacttgagagcgagttcgtctacggggactacaaggtgtacgacgtgcgcaagatgatcgcgaagtccgagcaggagatcggaaaggctaccgccaagtacttcttctacagcaacatcatgaacttcttcaagacggagatcaccctggcaaacggcgaaatccggaagcgccccctaatcgaaacgaacggagagaccggcgaaatcgtctgggacaaggggcgggacttcgccacggtgcgcaaggtgctctccatgccccaggtcaatatcgtaaagaagaccgaggtgcagaccggcgggttcagcaaggagtccatcctgcccaagcgcaacagcgataagttaatcgcgcgtaagaaggactgggacccgaagaagtacggcggcttcgactcccccaccgtcgcgtacagcgtgctggtggtcgccaaggtggagaagggcaagagcaagaagttaaagtccgtgaaggagctgctcggtatcacgatcatggagcgcagttccttcgagaagaaccccatcgatttcctggaggccaagggatacaaggaggtcaagaaggacctgatcatcaagctccccaagtacagcctgttcgagctggagaacggccggaaacgcatgctcgcctccgcgggggagctgcagaagggcaacgaactggccctccccagcaagtacgtgaacttcctgtacctggcctcccactatgagaagttaaaaggcagccccgaggacaacgaacagaagcagctgttcgtggagcagcacaagcattatctggacgagatcatcgagcagatatccgagttcagcaaacgggtgatcctcgccgacgccaacctcgacaaggtgctctccgcgtacaacaagcaccgtgacaagcccatccgggagcaggccgagaacatcatccacctcttcaccctgaccaaccttggggcccctgccgcgttcaagtacttcgacaccacgatcgaccggaagcggtacaccagcaccaaggaggtgttagacgcgaccctgatacaccagagtatcacgggcctgtacgagacccgcatcgatctcagccagctcgggggcgataagcggcccgccgccaccaagaaggccgggcaggcgaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 8131 - RNA, 5499 nt, synthetic construct; identical to SEQ ID NO: 2331
  misc_feature 1..5499: note = Cas9 variant mRNA product
  source 1..5499: mol_type = other RNA

SEQ ID NO: 8132 - RNA, 3771 nt, synthetic construct
  misc_feature 1..3771: note = Cas9 variant mRNA product
  source 1..3771: mol_type = other RNA
gggagagtcccgcagtcggcgtccagcggctctgcttgttcgtgtgtgtgtcgttgcaggccttattcaagcttaccatggcccccaagaagaagcgcaaagtgggcatccacggggtcccggccgcgaagcggaactacatcctgggcctcgacatcgggatcaccagcgtgggctacgggatcatcgactacgaaacccgcgatgttatcgacgccggcgtccggctgttcaaggaggccaacgtggagaacaacgaaggccgccggtccaagcgcggggcccggcgcctgaagcggcgccggcgccaccggatccagcgcgtgaagaagctcctgttcgactacaacctgctcacggaccacagcgagctgtcgggcatcaacccctacgaggcccgggtcaagggtctcagccagaagctctccgaggaggagttcagcgcggccctgctgcacctcgccaagcgcaggggcgtgcacaacgtgaacgaggtcgaggaggacaccgggaacgagctctccaccaaggagcagatcagccgcaactccaaggccctggaggagaagtacgtggcggagctccagctcgagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaagacatcaaggagtggtacgagatgctgatgggccattgcacctacttcccggaggagctccgaagcgtgaagtacgcctacaacgccgacctgtacaacgcgctcaacgacctcaacaacctggtcatcacgcgcgacgagaacgagaagctggagtactacgagaagttccagatcatcgagaacgtgttcaagcagaagaagaagcccaccctcaagcagatagccaaggagatcttggtgaacgaggaggacatcaaggggtaccgggtcacctccaccggcaagcccgagttcacgaacctaaaggtgtaccacgacatcaaggacatcaccgcccgcaaggagatcatcgagaacgccgagctcctggaccagatcgccaaaatcctgaccatctaccagagctccgaggacatccaggaggagctcaccaacctgaacagcgagctgacacaggaggagatcgagcagatctccaacctcaaggggtacaccggcacccacaacctgagcctgaaggcgatcaacctcatcctggacgagctgtggcacaccaacgacaatcagatcgccatctttaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctacccaacgacataatcatcgagctggcccgggagaagaacagcaaggacgcccagaagatgatcaacgagatgcagaagcgcaaccggcagaccaacgagcgcatcgaggaaatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtggaccacatcatcccccgcagcgtgtccttcgataacagcttcaacaacaaggtgctggtcaagcaagaggagaactccaagaaggggaaccggacccccttccagtacctgagctccagcgactccaagatcagctacgagaccttcaagaagcacatcctcaacctggccaagggcaaagggcgcatctccaagaccaagaaggagtacctgctcgaggaacgggacattaaccgcttcagcgtgcagaaggacttcatcaaccggaacctggtggacacgcgctacgccacccggggcctgatgaacctcctgcgctcctactttcgcgtcaacaacctggacgtgaaggtcaagagcatcaacgggggcttcacctccttcctcaggcgcaaatggaagttcaagaaggagcggaacaagggctacaagcatcacgccgaggacgcgctgatcattgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcatatcaaggacttcaaggactacaagtacagccatcgcgtggacaagaagcccaatcgggagctcatcaacgacacactgtactccacccgcaaggacgacaaggggaacaccctgatcgtgaacaacctcaacggcctgtacgacaaggacaacgacaagctgaagaagctcatcaacaagagccccgagaagctcctgatgtaccaccacgacccccagacttaccagaagctcaagctgatcatggagcagtacggggacgagaagaacccgctgtacaaatactacgaggagaccggcaactacctcaccaagtactccaagaaggacaacgggcccgtcatcaagaagatcaagtactacggcaacaagctgaacgcccacttggacatcaccgacgactaccccaacagccggaacaaggtggtgaagctctccctgaagccctaccgcttcgacgtctacctggacaacggcgtgtacaagttcgtcaccgtcaagaacctcgacgtgatcaagaaggagaactactacgaggtgaacagcaagtgctacgaggaggctaagaagctgaagaagatctccaaccaggccgagttcatcgccagcttctacaacaacgacctgatcaagatcaatggtgagctctaccgggtcatcggcgtgaacaacgacctgctgaaccgcatcgaggtgaacatgatcgacatcacgtatcgggagtacttagagaacatgaacgacaagcgcccgcccagaatcatcaagaccatcgcgtccaagacccagagcatcaagaagtactcaaccgacatcctggggaacctgtacgaggtaaagagcaagaagcacccccagatcatcaagaagggcaagcgccccgccgccacgaagaaggccggtcaagccaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 8133 - RNA, 4839 nt, synthetic construct
  misc_feature 1..4839: note = Cas9 variant mRNA product
  source 1..4839: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgctgttcaacaagtgcattatcatcagcatcaacctggacttctccaacaaggagaaatgcatgaccaagccctacagcataggcctggacatcgggacgaactccgtgggctgggccgtgatcacggacaactataaggtccccagcaagaagatgaaggtgctggggaacacttccaagaagtacattaagaagaacttactgggcgtgctgctgttcgacagcggcatcaccgccgaggggcggcgcctgaagcggaccgcgcgccggcgctacacgcggcgccggaaccgcatcctgtacctccaggagatcttctctaccgagatggccaccctggacgacgcgttcttccagcggctggacgacagcttcctcgtgcccgacgacaagcgcgactccaagtacccgatcttcggcaacctggtggaggagaaggtgtaccacgacgagttccccaccatctaccacctccggaagtacctcgccgacagcacgaagaaggccgacctgcgcctcgtctacctcgccttagcgcacatgattaagtaccggggccacttcctgatcgagggcgagtttaactccaagaacaacgacatccaaaagaacttccaggacttcctcgacacctacaacgccatcttcgagagcgacctgtccctggagaacagcaagcagctcgaggagatcgtgaaggacaagatttccaagctggagaagaaggaccgcatcctgaagctgttccccggggagaagaacagcggcatcttctctgagttcctgaagctgatcgtgggcaaccaggctgacttccggaagtgcttcaacctcgatgagaaggcaagccttcacttctccaaggagagctacgacgaggacctggagaccctcctgggatacatcggcgacgactatagcgatgtcttcctgaaggctaagaagctctacgacgcgatcctgctgtccgggtttctcaccgtgacggacaacgagaccgaggcgcccctgagctccgccatgatcaagcgctacaacgagcacaaggaggacctcgccctcctgaaggagtacatccggaacatcagcctgaagacctacaacgaggtgttcaaagacgacaccaagaacggatacgccggctacattgacgggaagacgaaccaggaggacttctacgtatacctcaagaacctgctggccgagttcgagggcgccgactatttcctcgagaaaatcgaccgcgaggacttcctgcgcaagcagcgcaccttcgacaacgggtccatcccgtaccagatccaccttcaggagatgcgcgccatcctggacaagcaggccaagttctaccctttcctagccaagaacaaggagcggatcgagaagatcctgaccttccgcatcccctactatgtgggcccgctggcgcgggggaacagcgacttcgcttggtccatccgcaagcggaacgagaagatcaccccgtggaacttcgaggacgtgatcgacaaggagagctccgctgaggccttcatcaaccgcatgacgagcttcgacctctacctgcccgaggagaaggtcctgcctaagcactccctcctgtacgagaccttcaacgtgtacaatgagctgaccaaggtgcggttcatcgccgagagcatgcgcgactaccaattccttgactccaagcagaagaaggacatcgtccggctttacttcaaggacaagcgcaaggtgaccgacaaggacatcatcgagtacctgcacgcgatctacggctacgacggcatcgaactcaaggggatcgagaagcagttcaacagcagcctgagcacgtaccacgacctgctcaacatcattaacgacaaagagttcctggacgactccagcaacgaggctatcatcgaggagatcatccacaccttaaccatcttcgaggaccgggagatgatcaagcaacgcctctccaagttcgagaacatcttcgacaagagcgtgctgaagaagctgagccgtcgccactataccggctgggggaagctctccgccaaacttatcaacggcatccgggacgagaagtccgggaatacaatcctggactacctcatcgatgacggcatcagcaatcgcaacttcatgcagctgatccacgacgacgccctgagcttcaagaagaagatccagaaggcgcagattatcggcgacgaggacaagggtaacatcaaggaagtcgtgaagtccctccccggcagcccggccatcaagaagggaatcctgcagtccatcaagatcgtagacgagctggtgaaggtgatgggcgggcggaagcccgagagcatcgtcgtggagatggcccgagagaaccagtacaccaaccagggcaagtccaacagccagcagaggctcaagcgcctggagaagtcactgaaggagctcggcagcaagatcctgaaggagaacatccccgccaagctgagtaagatcgacaacaacgccctacagaacgaccgcctgtatctgtactacctccagaacgggaaggacatgtataccggagacgacctggacatcgaccggctgagcaactacgacatcgaccacataatcccccaggcgttcctcaaggacaactccatcgacaacaaggtgctggtcagctccgccagcaaccgcggaaagtccgacgacttcccgagcctggaggtggttaagaagcggaagactttctggtaccagttgctcaagagcaagctgatttcccagcgcaagttcgacaacctgacgaaggccgaacggggcggcctgctgcccgaagacaaggcaggcttcatccaacgccagctcgtcgaaacccggcaaatcaccaaacacgtggcccgcctgctggacgagaagttcaacaacaagaaggacgagaacaaccgggcggtgaggaccgtaaagatcatcacgctcaagagcaccctggtgtcccaattccggaaagacttcgagttgtacaaggtgcgcgagatcaacgacttccaccatgcccacgacgcctacctcaacgccgtcatcgccagcgcgctgctgaagaagtaccccaagctcgagcctgagtttgtgtacggcgactacccgaaatacaactccttccgtgagcgcaagagcgccaccgagaaggtgtacttctattccaatatcatgaacatcttcaagaagtccatctccctggctgacgggcgggtgatcgagcgccccctgatcgaagtgaacgaggagacgggcgagagcgtgtggaacaaggagtccgacctcgccaccgtccggcgcgtgctgagctacccccaggtgaacgtcgtaaagaaggtggaggaacagaaccacgggctggaccggggcaagcccaagggcctcttcaacgcgaacctgtccagcaagccgaagcccaactccaacgagaacctggtcggggccaaggaatacctcgaccccaagaagtacggcgggtacgccggcatcagcaactccttcgccgtgctggtcaaggggacgatcgaaaagggagccaagaagaagatcaccaacgtcctggagttccagggcatcagcatcctcgaccgcatcaactaccggaaagacaagctgaacttcctgttagagaaggggtacaaggacatcgagctgatcatcgaactgccgaagtactcactcttcgagctgtccgacggcagccgccggatgctcgcgtcgatcctcagcaccaacaataagcgtggggagatacataagggcaaccagattttcctgtcccagaagttcgtgaagctgctctaccacgccaagcggatcagcaacaccatcaacgagaaccaccgaaaatacgtggagaaccacaagaaggagttcgaggagctgttctactacatcctggagttcaacgagaactacgtcggtgccaagaagaacggaaagctcctgaacagtgccttccagagctggcagaaccattcgatcgacgagctatgcagctccttcatcggccccacggggagcgagcgcaagggcctcttcgagctaacatcccgggggagcgccgcagactttgagttcctgggcgtgaagataccccgctaccgggactacaccccctccagcctcctgaaagacgccaccctgatccaccagtccgtgacggggctgtacgagacccgcatcgacctcgccaagctgggcgagggcaagaggccggccgccaccaagaaggcagggcaggccaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 8134 - RNA, 3915 nt, synthetic construct
  misc_feature 1..3915: note = Cas9 variant mRNA product
  source 1..3915: mol_type = other RNA
gggagagtcccgcagtcggcgtccagcggctctgcttgttcgtgtgtgtgtcgttgcaggccttattcaagcttaccatggcacccaaaaagaaacgcaaagtaggaatacacggagtgccggcagcatggtacgcgagccttatgagcgcccaccatctacgcgttggaatcgacgtaggcacccacagcgtaggactagccacactccgagtagacgaccacggaaccccaattgaattactatcggcactgagccacatccacgatagtggagtcgggaaagaaggaaagaaagaccacgacacacgaaagaaactgtcaggaatagcaagacgcgctcgaagactattacaccaccgacgaacacagctccaacaactagacgaagtcctacgagatctaggcttcccaatcccaacaccgggagagttcctagacttaaacgaacaaaccgacccataccgcgtgtggcgagtccgagcacgactcgtggaagagaaactcccagaggaattacgcggaccagccataagcatggcagtgaggcacatcgcccgacaccgagggtggaggaacccgtatagtaaagtagaatccctactaagccccgccgaggaaagcccattcatgaaagcactccgcgaacgaatcctcgcaaccaccggcgaagtactagacgatggcataacgccgggccaagctatggcccaagtcgcactgacccataacatctcaatgcgcggaccagaaggcatactaggaaaactacaccaatccgataacgcaaacgaaatccggaaaatatgtgcccgccagggggtcagccccgacgtttgcaaacagctactccgggccgtattcaaagccgactcacctagaggcagcgccgtgagtagagtagcacccgatccccttcccggtcaggggagcttccgcagagccccaaaatgcgacccagagttccagcgcttccgaataatatccatagtggcaaacctgcgaatatctgaaacgaaaggcgaaaacagaccactaaccgccgacgaacgcagacacgtcgtcaccttcctaacggaagacagtcaagccgatcttacttgggtggacgtcgcagaaaaactcggagttcaccgccgggacttaaggggaacagccgtacacaccgacgacggagaaagaagtgccgcccggcccccaatcgacgcaacggatagaatcatgagacagaccaaaatcagttccctcaaaacgtggtgggaagaagccgacagcgaacagagaggcgcaatgatcaggtacctgtacgaagacccaaccgattctgaatgcgcagaaatcatagctgaactcccagaagaagatcaagccaaactagactccctacacttacccgcaggacgcgccgcatacagcagagagagtctaacagccttaagcgaccacatgctcgcgacaaccgacgacctccacgaggcacgaaaacgccttttcggcgttgacgacagctgggccccacccgccgaagcaatcaacgcccccgtcgggaacccctcggtggaccgcacattaaaaatagtagggcgatacctctcagcagtcgaatctatgtggggcacgccagaagtcattcacgtagagcacgtccgagacgggttcacgagcgagcgcatggccgacgaacgagacaaggcaaaccgacgaagatataacgacaaccaagaagcaatgaagaaaatccagagagactacggaaaagaaggctacatatccagaggggacatagtaaggctggacgccctcgaactccagggatgtgcctgtctctactgcgggacaacaattggataccacacgtgccaactagaccacatcgtaccccaggcaggaccaggaagcaacaaccgccgagggaacctagtcgctgtatgcgaaagatgcaaccgctcgaaatcaaacaccccctttgcagtttgggcccaaaaatgcggcatcccccacgtcggagtaaaggaagcgatcggcagagtcaggggctggagaaagcaaacaccaaacacatcaagcgaagatcttacaaggctaaagaaggaggtcatcgcacgactaagacgaacacaggaggacccagaaatcgacgaaaggtccatggagagcgtagcctggatggcaaacgaactccaccacagaatcgcggccgcatacccagagacaaccgttatggtctatagaggtagtatcacagcggctgcacggaaagccgccggaatagactcccgcatcaatcttataggagagaagggacgaaaagacagaatcgaccgccggcaccacgccgtggatgcctccgtcgtcgcgctaatggaggcaagcgtcgcaaaaacactagccgaacgcagcagcctgcgcggcgaacagcgcctaaccggaaaagaacagacctggaaacaatatacaggcagtaccgtaggagccagagaacacttcgaaatgtggagaggccacatgctccacctcacggaactgttcaatgaaagactagccgaagacaaagtttacgtaacacagaacatacgcctgcgactcagcgacggcaatgcacacaccgtcaaccccagcaaactcgtatcacaccgactcggcgacggactcacagtacaacaaatcgaccgcgcgtgcactccagccctgtggtgtgccctaacccgagaaaaagacttcgacgagaaaaacggcctaccggcacgagaagaccgggccatccgagtgcatgggcacgaaataaaatcgtcagactacatacaagtgttctccaaaagaaagaaaaccgactcagaccgagatgagacaccgttcggagcaatagcggtacgtggagggttcgtcgagatcggacccagcatccaccacgccagaatatacagagtagaaggaaagaaaccagtctacgcaatgctcagggtgttcacacatgacctcttaagccagcgacatggcgacctatttagcgcggtgataccaccacaaagtatcagcatgagatgcgcggaacccaaactccgcaaagcgataacaacgggaaacgccacatatctagggtgggtcgtagtgggcgacgagcttgaaataaacgtagacagtttcaccaaatacgctattggacgcttcctcgaagacttcccaaacacaacacgatggcgcatctgcggttacgatacaaactcaaaactcacgctgaagccaatcgtcctggccgccgaaggactcgaaaacccgtcctcagccgtcaacgagatcgttgaactgaagggatggagagtagcgatcaacgtcctcacaaaagtccacccaacagtagtccgacgcgacgcactaggacgaccgcgctatagttcgagatcaaacctaccaacaagctggacgatcgagaaacgcccagccgcaacaaagaaagccggacaagcgaagaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 8135 - RNA, 4776 nt, synthetic construct
  misc_feature 1..4776: note = Cas9 variant mRNA product
  source 1..4776: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtccctgccgcgaccaagccctacagcatcggcctggacatcgggaccaactccgtgggctgggccgtgacgaccgacaactacaaggttcccagcaagaagatgaaggtgctcgggaacactagcaagaagtacatcaagaagaacctattaggcgtgctcctgttcgacagcggcatcacggccgaggggcggcgcctgaagcggacggcccgcagacgctacacccggcgccggaatcgcatcctctatctgcaagagatcttctccaccgagatggccaccctagacgacgccttcttccaacggctagacgacagcttcctggtccccgacgacaagcgcgactccaaatacccgatcttcggcaacctggtggaggagaaggcctaccacgacgagttccccaccatctaccacctccggaagtacttggccgacagcaccaagaaggccgacctgcgcctcgtgtacctggcgctggcccacatgatcaagtaccgggggcactttctcatcgagggcgagttcaactccaagaacaacgacatccagaagaacttccaggacttccttgacacctacaacgccatcttcgaaagcgacctgtccttggagaatagcaagcagctggaggagatagtcaaggacaagatctccaagctggagaagaaggaccgcatcctcaagctgttccccggggagaagaacagcggcatcttctccgagttcctgaaactcatcgtgggcaaccaggccgacttccggaagtgcttcaacctggacgagaaggccagtctgcacttctccaaggagagctacgacgaggacctcgagaccctgctggggtacatcggcgacgactactccgacgtgttcctcaaggcgaagaagctgtacgacgccatcctgctcagtgggtttctgacggtcaccgacaacgagaccgaggcgcccctgagctccgccatgatcaagcgctacaacgagcacaaggaggacctcgcactgctgaaggagtacatccggaacatcagcctcaagacctacaacgaggtgttcaaggacgacacgaagaacggctacgccggctacatcgacggaaagaccaaccaggaggacttctacgtgtacctgaagaagctgctcgccgagttcgagggcgcagactacttccttgagaagatcgaccgcgaggacttcctgcggaagcagcgcaccttcgacaacggttccatcccgtaccaaatccacctccaggagatgcgcgccatcctggacaagcaggccaagttctaccccttcctggcgaagaacaaggaacggatcgaaaagatcctgaccttccgcatcccctactacgtcggccctctcgcccgggggaacagcgacttcgcctggtccatccgcaagagaaacgagaagatcacgccttggaacttcgaggacgtgatcgacaaggagagctccgccgaggccttcatcaatcgcatgaccagcttcgatctgtacctccccgaggagaaggttcttcccaagcactcgctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacattatcgagtacctccacgcaatctacggctacgacggcatcgagctgaaggggatcgagaagcagttcaacagctccctgagcacctaccacgacctcctgaacatcatcaacgacaaggagttcctggatgactccagcaacgaagccatcatcgaggagatcatccacaccctcaccatcttcgaggaccgggagatgatcaagcagcgcctgtcaaagttcgagaacatcttcgacaagagcgtgctgaagaagctctcccggcgccactacacgggctgggggaagctgagcgccaagctgatcaacggcatccgggacgagaagtccgggaacaccatcctcgattacctgatcgacgacggcatcagcaaccgcaacttcatgcagctgatccacgacgacgcgctcagcttcaagaagaagatccagaaagcacagatcatcggcgacgaggacaaggggaacatcaaggaggtggtcaagtccctgcccggcagcccggccatcaagaaagggatcctgcagtccatcaagatcgtggacgagctcgtcaaggtgatgggcgggcgaaagcccgagagcatcgtggtcgagatggcccgcgagaaccagtacaccaaccagggcaagtccaacagccagcagcggctgaagcgcctggagaagtccctcaaggagctgggcagcaagatactgaaggagaacatccccgccaagctctccaagatcgacaacaacgcgctgcagaacgaccgcctgtacttgtactacttgcagaacgggaaggacatgtacaccggcgacgacctggacatcgaccggctaagcaactacgacatcgaccacatcatcccccaggccttcctgaaggacaactccatcgacaacaaggtgctggtgagctccgcgagcaaccgcgggaagtccgacgacgtcccgagcctcgaggtggtgaagaaacggaagacgttctggtaccagctgctcaagagcaagctgatctcccagcgcaagtttgacaacctgaccaaagcagagcgtggcggcctgagccccgaggacaaggccgggttcatccaacgccagctcgtcgagacccggcagatcaccaagcacgtggcgcgcctgctggacgagaagttcaacaacaagaaggacgagaacaaccgggccgtgcgcacggtcaaaatcatcaccctcaagtccaccctggtgagccagttccgaaaggacttcgagctgtacaaggtgcgcgagatcaacgacttccaccacgcccacgacgcctacctcaacgccgtggtggcgtccgccctgctgaagaagtaccccaagctcgagcccgagttcgtgtacggcgactacccgaagtacaatagcttccgggaacgcaagtccgccaccgagaaggtctacttctacagcaatatcatgaacatattcaagaagtccatcagcctggccgacgggcgggtgatcgagcgccccctgatcgaggtgaacgaggagaccggcgaatccgtctggaacaaggagagcgacctcgcgacggtgcggcgcgtcctgtcctacccccaggtcaacgtggtgaagaaggtcgaggagcagaaccacgggctggaccgggggaagcccaagggcctcttcaacgccaacctgagctccaagccgaagcccaacagcaacgaaaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgatcgcatcaactaccggaaggacaagctgaacttcctgctcgagaaggggtacaaggacatcgagctgatcatcgagctgccaaagtacagcctcttcgagctgagtgacggctcccgccgcatgctggcgagcatcctctccacgaacaacaagcgcggggagatccacaagggcaaccagatcttcctgagccagaagttcgtgaagctgctctaccacgccaagcggatctccaacaccataaacgagaaccaccggaaatacgttgagaaccacaagaaggagttcgaggagctgttctactacatcctggagttcaacgagaactacgtcggggccaagaagaacgggaagctcctgaacagcgcctttcagtcctggcagaaccacagcatcgacgagctgtgctctagcttcatcggccccacagggtccgagcgcaagggcctcttcgaactgaccagccgggggtccgccgcggacttcgagttcctgggcgtgaagatcccccgctaccgggactacacgcccagctccctcctcaaggacgctaccctgatccaccagagcgtcacggggctctacgagacccgcatcgacctggccaagttgggagagggcaagcggccggccgccacgaagaaggcgggtcaggccaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 8136 - RNA, 3858 nt, synthetic construct
  misc_feature 1..3858: note = Cas9 variant mRNA product
  source 1..3858: mol_type = other RNA
gggagagtcccgcagtcggcgtccagcggctctgcttgttcgtgtgtgtgtcgttgcaggccttattcaagcttaccatggcaccgaaaaagaaacgcaaagtgggcatccacggagtaccagccgctgccgccttcaaaccaaacagcataaattatatcctcggcctagatatcggtatcgcctccgtagggtgggccatggtcgagattgatgaagaagaaaacccaatcaggctcatagacctaggcgtacgagtcttcgaacgcgccgaagtcccaaaaacaggagattccctcgctatggcacgaagactagcaagaagcgtgagacgacttacccgccgacgcgcccaccgcctcctccgaactcgtcgcctcctaaagcgcgaaggagtcctccaagccgccaatttcgacgaaaacggtctaatcaaaagcctccccaacacgccatggcaactccgagcagcggccctagaccggaaactaacacccctagaatggtccgctgtcctactgcacctcatcaaacaccgcggatacctaagccagaggaaaaacgaaggagagaccgccgacaaagaactaggcgcgctactgaaaggtgtagcaggcaacgcacatgccctacagacgggtgactttcgaacaccggcagagctcgcacttaacaaattcgaaaaagaatctggacatatccgaaatcaaagatccgactacagccacacattcagccgaaaagatctacaagccgaactcatccttctattcgaaaaacaaaaagagttcggaaatccccacgtatcgggcggactgaaggaagggatcgaaaccctactcatgacacaacggcccgccctatcaggcgatgccgttcagaaaatgctaggccactgcacattcgaaccagccgaaccaaaggcggccaaaaacacctacacagcggaacgcttcatctggttaactaaactgaataacttacgcatactcgaacaaggctctgaacgacccctcacggatacagaacgcgcaaccctaatggacgagccctaccgcaaaagcaaactgacctatgcacaagcgagaaaactcctaggactcgaagacacagccttcttcaaaggtctcaggtacggaaaagataacgccgaggccagcacactcatggaaatgaaagcctaccatgccatcagccgagccctggaaaaagagggcctcaaagataagaaaagccctctcaaccttagccccgaacttcaagatgaaatcggaaccgcatttagcctcttcaaaacagacgaagacatcaccggacgactgaaagaccgcatccaaccagagatactcgaggcgctgctaaaacacatatccttcgacaaattcgtacaaatcagcttaaaggcactacgccggatagtacccctaatggaacaagggaaacgatacgacgaagcatgtgccgaaatatacggtgatcactacggaaagaaaaacactgaagaaaagatctacctcccaccaatacccgccgacgaaataaggaaccccgtagtactacgtgccctctcacaagcacgcaaagtcattaacggagtagtcagaagatatggcagccccgcgcggatccacatcgaaacagcccgcgaagtaggcaaatctttcaaagatcgcaaagaaatcgagaaaagacaagaagagaatagaaaagatcgagagaaagccgccgcaaaattccgagaatatttccccaacttcgtcggtgaaccaaaaagtaaagacatcctcaaactccgcctctatgagcaacagcacggaaaatgcctatacagcggaaaagaaatcaacctcggccggctaaacgagaagggatacgtagaaatagaccacgccctcccattctcgcgaacatgggacgactcttttaataacaaagtcttagtcctcggatcagagaaccaaaacaaaggaaatcaaacgccatacgagtacttcaacggcaaggacaacagcagagaatggcaagagttcaaagcacgagtggaaacctcccgattcccacgctccaagaaacaaagaatcctactccagaaattcgacgaagacgggttcaaagaacgcaacctgaacgatacacggtacgtcaaccgcttcttatgccaattcgtggcggaccgcatgcgcctcacgggaaaaggtaagaaacgggtattcgccagcaacggacagataacgaacctcctccggggattctggggcctccgaaaagtccgggcagaaaacgaccgacaccacgcgctagacgcggttgtcgttgcttgcagcaccgtcgccatgcagcagaaaataaccagatttgtcagatacaaagagatgaacgcctttgacggaaaaactatcgacaaagagacaggcgaagtactacaccaaaagacacacttcccgcaaccatgggagttcttcgcccaagaagtcatgataagggtattcgggaaaccagacggcaaaccagagttcgaagaagcagacaccctagaaaagctccgcaccctactggcagaaaagttgagcagccgccccgaagccgtacacgaatacgtaacaccactcttcgtctcccgagcacccaaccgaaaaatgagcggccaaggccacatggaaaccgtaaaatccgccaagcgcctggacgaaggcgtctccgtactaagagtacccctcacccaactcaagctaaaagacctggagaaaatggttaacagagaaagagaaccaaagctatatgaggccctcaaggcgcgcctcgaggcacacaaagacgacccagcaaaagcattcgctgaacccttctataaatacgataaagccgggaacagaacacaacaggtaaaggccgtccgggtagaacaggtacagaagaccggagtctgggtccgaaaccataatggcatcgcagacaacgcaacaatggtacgcgtcgatgtgttcgaaaaaggcgacaagtactacctagtacccatatacagctggcaggtcgcgaaaggcatcctaccggacagggccgtagtccagggcaaagatgaagaagactggcagctaatcgatgattccttcaactttaaattcagcctacacccaaatgacctcgtagaagtaatcaccaaaaaggcaagaatgttcggatacttcgccagctgccacagaggaaccggaaacatcaacattcggatacacgacctcgatcacaaaataggcaagaatggcatactcgagggcataggggtcaaaaccgcactatccttccagaagtaccaaatcgacgagcttggaaaagaaatccggccctgtcgactgaagaaaaggccaccagttcggaagagaccggccgccaccaaaaaggcaggtcaagccaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 8137 - RNA, 4614 nt, synthetic construct
  misc_feature 1..4614: note = Cas9 variant mRNA product
  source 1..4614: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgaagaagccatacaccatcggcctggacatcgggaccaacagcgtgggctgggccgtgctcaccgaccagtacgacctggtcaagcggaagatgaagatcgccggggactccgagaagaagcagatcaagaagaacttctggggcgtgcgcctgttcgacgagggccagaccgccgctgaccggcgcatggcgcggaccgcccgccggcgcattgagcggcgccggaaccgcatcagctacctccagggaatcttcgccgaggagatgtccaagaccgatgccaacttcttctgccggctgagcgactccttctacgttgacaacgagaagcgcaacagccggcaccccttcttcgcgacgatagaggaggaggtcgagtatcacaagaactaccccacaatctaccacctccgcgaggaactcgtgaactccagcgaaaaggccgacctgcgtctagtgtacctcgccctggcccacatcatcaagtaccgcggcaacttcctgatcgagggggccctcgacacccagaacacctccgtcgacggcatctacaagcagttcatccagacgtacaaccaggtgttcgcgtccgggatcgaggacggctcccttaagaagctggaggacaataaggacgtggccaagatcctcgtcgagaaggtgacccggaaggagaagctggagcgcatcttaaagctctacccgggcgagaagtccgccgggatgttcgcccagttcatcagcctaatcgtgggcagcaaggggaacttccagaagcccttcgacctgatcgagaagtccgacatcgagtgcgccaaggactcgtacgaggaggacctcgagtccctgctggcgctcatcggggacgagtacgccgagctgttcgtcgccgccaagaatgcctacagcgcggtggtgctgagtagcatcatcaccgtcgccgagaccgagacgaacgccaagctcagcgcctccatgatcgagcggttcgacacccacgaggaggacctgggcgagctgaaggcattcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaagagaacttcctgcgcaagcagcgcacattcgacaacggggcgattccccaccaactgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgattttggcaagtccgccgtagacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcgtatttcagcggccaggagaaggagcagatcttcaacgacctgttcaagcagaagcggaaggtcaagaagaaggacctcgagctgttcctgcgtaacatgtcccacgtggagagccccacgatcgaggggctggaggactccttcaacagctcctacagcacctaccacgacctcctgaaggtgggcatcaagcaggagatcctggacaaccccgtcaacacagagatgctcgagaatatcgtgaagatcctgacagtgttcgaggacaagcggatgatcaaggagcagctgcagcagttctccgacgttctcgacggcgtggtgctgaagaagctggagcgccggcactacacggggtggggccgcctcagcgccaagctgctgatggggatccgggacaaacagtcccacctcaccatcctggactacctgatgaacgacgacggcctcaatcgcaacctgatgcagctgatcaacgacagcaacctttcattcaagagcatcatcgagaaggagcaggtcaccaccgccgacaaggatatccagagcatcgtggccgacctggcgggatccccggccatcaagaagggcatcctgcagagcctcaagatcgtggacgaactggtctccgtgatgggctacccgccccagacgatcgtggtcgagatggcccgggagaaccagactaccgggaagggcaagaataacagccgcccccggtacaagtccctggagaaggccatcaaggagttcgggagccagatccttaaggagcaccccaccgataatcaggagctgcgcaacaaccgactgtacctctactacctgcagaacggcaaggacatgtacacgggccaggaccttgacatccacaacctctccaactacgacatcgaccatatcgtgccccagagcttcatcaccgacaactccatcgacaacctggtgctgaccagctccgccgggaaccgcgaaaagggcgacgacgtcccgcccctcgagatcgtgcgcaagcgcaaggtgttctgggagaagctgtaccaggggaacctgatgagcaagcgcaagttcgactacctgaccaaggcggagcggggcgggctgaccgaagccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccaactctacaaggtgcgcgacgtcaacgactaccaccacgcccacgacgcctacctgaacggcgttgtggcgaacactctgctcaaggtctacccccagctggagcccgagttcgtgtacggggactaccaccagttcgactggttcaaggccaacaaggcgaccgccaagaagcagttctacaccaacatcatgttgttcttcgcccagaaggaccggatcatcgacgaaaacggtgagatcctctgggataagaagtacctggacaccgtgaagaaggtcatgtcctaccgccagatgaacatcgtgaagaagacggagatccagaagggggagttctcgaaggccaccatcaagcccaagggcaactccagcaagttaatcccccggaagaccaactgggacccgatgaagtacgggggcctcgacagccccaacatggcctacgcggttgtcatcgaatacgccaagggcaagaacaagctggtgttcgagaagaagatcatccgcgtgaccatcatggagcggaaggccttcgagaaggacgagaaggccttcctggaggagcaggggtaccgccagccgaaggtcctcgccaagctgccgaagtacacgctgtacgagtgcgaggagggccggcgccggatgctcgcgtccgcaaacgaggcccagaaggggaaccagcaggtcctgcccaaccacctggtgaccctcctgcaccacgccgcgaactgcgaggtgagcgacggcaagtccctggactacatcgagagcaaccgcgagatgttcgcggaactcctggcccatgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaaattcttcgagaccacgatcgagcgcaagcggtacaacaacctcaaggagctgctgaacagcaccatcatctaccaatccatcaccggcctctacgagtctcgcaagcgcctcgacgacaagcggcccgccgccaccaagaaggcagggcaggcgaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 8138 - RNA, 4647 nt, synthetic construct
  misc_feature 1..4647: note = Cas9 variant mRNA product
  source 1..4647: mol_type = other RNA
gggagagtcccgcagtcggcgtccagcggctctgcttgttcgtgtgtgtgtcgttgcaggccttattcaagcttaccatggctcccaagaagaaacgcaaggtgggcatccacggggtcccggcagcgaagaagccctacagcatcggcctggacatcggcaccaattccgtgggttgggccgtggtaaccgacgactacaaggtgcccgccaagaagatgaaggtgctcgggaacacggacaagagccacatcgagaagaacctgctgggcgccctactgttcgactccggcaataccgccgaggatcggcgcctaaagcggaccgcgcgcagacgatacacccggcgccggaaccgcatcctctaccttcaggaaatcttctcagaggagatgggaaaggtcgacgactccttcttccaccggctggaggacagcttcctcgtgacggaagacaagcgaggcgagcggcaccccatcttcgggaacctggaggaggaagtgaagtaccatgagaacttcccgaccatctaccacctccgccagtacctggccgacaatcccgagaaggttgacctgcggctggtgtacctcgccctggcccacatcatcaagttccgcgggcacttcctgattgaggggaagttcgacacgcggaacaacgacgtgcaacgcctctttcaggagttcctggcggtctatgataacacgttcgagaactccagccttcaggagcagaacgtccaggtggaggagatcctcaccgacaagatctctaaaagcgccaagaaggaccgggtgctgaagctgttccccaacgaaaagtccaacggccgcttcgccgagttcctcaagctgatcgtgggcaaccaggccgacttcaagaagcatttcgagctggaggaaaaggccccgctacagttcagtaaggacacctacgaggaggagctggaggtgctgctcgcgcagataggtgataattacgccgagctgttcctgtccgccaaaaagctgtacgacagcatcctgctgtccggcattctaacagtcaccgacgtgggaacgaaggccccgcttagtgcttcaatgatccagcggtataacgaacaccagatggacctggcgcagctaaagcagttcataagacagaagctgagcgacaagtacaacgaagtgttctccgacgtcagcaaggacggctatgccggctacatcgacgggaagaccaaccaggaggccttctacaagtacctgaaggggctcctgaacaagatagaggggagcggctacttcctggacaagatagagcgcgaggacttcctacggaagcagcgtactttcgacaacgggtccataccccaccagatccacctccaggagatgcgggccatcatccgccgtcaggcagagttctaccccttcctcgcggacaaccaggaccgcatcgagaagctgctgaccttcagaatcccctactacgtggggccgctggcccgcggcaagagcgactttgcctggctgtcccgtaagagcgccgacaagataacgccctggaacttcgacgagatcgttgacaaggagagcagcgccgaggcgttcatcaacagaatgaccaactatgacctctacctccccaaccagaaggtcctgcccaagcactccctcctatacgagaagttcaccgtctacaatgagctgaccaaggtgaagtacaaaacggagcaagggaagaccgcgttcttcgacgctaacatgaagcaagagatcttcgacggcgttttcaaagtgtaccggaaggtcactaaagataagctcatggacttcctggagaaggagttcgacgagttccgcatcgtggacctgaccggtctggacaaggaaaacaaggtgtttaacgccagctacggcacgtaccacgacctgtgcaagatactcgataaggacttcttagataactccaagaacgagaagatcctggaggacatcgtcctgaccctcactctgttcgaggaccgggagatgatccgcaagcggctggagaactatagcgacctcctgacaaaggagcaggtcaagaagctggagcgccggcactacactgggtggggtcgcttgtccgcggagctaatccacggcatccggaacaaggagagcaggaagaccatcctagactacttaatcgacgacgggaactccaacaggaacttcatgcagctgatcaacgacgacgccttgtcttttaaggaggaaatcgccaaggcccaggtgatcggcgagaccgacaacctcaaccaagtggtgtccgacatcgccgggtctccggcgatcaagaagggcatcctgcagtccctgaaaatcgtggacgagctcgtcaagatcatgggccaccaacccgagaacatcgtggtggaaatggcccgtgaaaaccagttcaccaatcagggtcgccggaacagccagcagcgactgaagggcctgacggactccatcaaggagttcgggagccagatcctcaaagaacacccagtcgagaacagccaactgcagaatgaccgactgttcctctactacctgcaaaacgggcgcgacatgtacaccggggaggagctggacatcgactacctctcccagtacgatatcgaccacataatcccccaagccttcatcaaagacaacagcatcgataaccgggtgctgacctccagcaaagagaacaggggcaagtccgatgacgtacccagcaaggacgtcgtgcggaagatgaagtcctactggagcaagctgctctccgccaagctgatcacccagcgcaagttcgacaacttgacgaaggctgagcggggcgggctcaccgacgacgacaaggcgggcttcatcaagcgccagcttgtggagacccggcagatcaccaagcacgttgcccggatcctggacgagcggttcaacaccgagacggacgagaacaataagaaaatccgccaggtgaagatcgtgaccctcaagagcaacctggtctccaacttccggaaggagttcgaactgtacaaggtccgagagataaatgactaccaccacgcccacgacgcctacctcaacgccgtgatcgggaaggcgctgctgggcgtctacccccagctcgagcccgagttcgtttacggggactacccccacttccacggccacaaggagaacaaggccaccgccaagaagttcttctacagcaacatcatgaactttttcaagaaggacgatgtgcggactgacaagaacggcgagatcatctggaagaaagacgaacacataagtaacatcaagaaggtcctgagctacccccaggtgaacatcgttaaaaaggtcgaggagcagaccggaggcttctccaaagagtcgatcctccccaaggggaactccgacaaacttatcccccgcaagacgaagaagttctactgggacaccaagaagtacggcgggttcgacagccccatagtggcctacagcatcctggtgatcgcagacatcgagaagggcaagtccaagaaactgaagaccgtcaaggcactcgtgggcgtaacgataatggaaaagatgaccttcgagcgggacccggtcgccttcttggagcgcaaggggtatcgcaatgtgcaggaggagaacatcatcaagctgcccaagtatagcctcttcaagctcgagaacgggcggaagcgcctgctagcctccgccagggagctgcagaaggggaacgaaatcgtgctgcccaaccaccttggaaccctgttataccacgcgaagaacatccacaaggtcgatgagccgaagcatctcgactacgtggacaaacacaaggatgagtttaaggaactgctggacgtggtctcaaacttctccaagaagtacaccctcgccgagggtaatctagagaagatcaaggagctgtatgcccagaacaacggcgaggacctcaaggagctcgctagcagtttcatcaaccttctcactttcacggccatcggggcgcccgccaccttcaagttcttcgataagaacatcgaccgcaagcggtacaccagcacgaccgagatcctgaacgccacgcttatccaccagtccataaccggactctacgagacgcgcatcgacctgaacaagctgggcggggacaagcggcccgccgccaccaagaaggcgggccaagccaaaaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 8139 - RNA, 3780 nt, synthetic construct
  misc_feature 1..3780: note = Cas9 variant mRNA product
  source 1..3780: mol_type = other RNA
gggagagtcccgcagtcggcgtccagcggctctgcttgttcgtgtgtgtgtcgttgcaggccttattcaagcttaccatggcacctaaaaagaaacggaaagtgggcatacacggcgttccagccgcacaaacaaccaacctcagttacatactaggtctagacctcggtatcgcatcagtcggctgggccgtcgtcgaaatcaacgaaaacgaagaccccatcggactaatagacgtcggcgtaaggatattcgaacgcgccgaagtcccaaaaaccggagaaagcctagcactgtccaggagactcgcgcggagtacccgccgcctaatacgccgccgagcccaccgcctactcctcgcgaaacgcttcctcaagagagaaggcatactgagcaccatagacctcgagaaaggcctgccaaaccaggcctgggagctaagagtcgccggcctcgaaaggcgactatcggccatcgaatggggagccgttctcctgcacctaataaaacacagggggtacctatcgaaaagaaagaacgagagtcaaacgaacaacaaggagctgggcgccctgctaagcggagtggcgcaaaaccaccagctcctacaatccgacgactaccgaacacccgcagaattagccctcaagaaatttgcaaaagaagaggggcacataagaaaccaacgcggcgcttacacacacaccttcaatagattagacctcttagcagaactgaacctgctattcgcacaacagcatcaattcggaaacccacactgtaaagagcacatccagcaatacatgactgaactcctaatgtggcagaaacccgcactcagtggcgaggccatcctaaaaatgctcggaaaatgcacacacgagaaaaacgagttcaaagccgcgaaacatacctacagcgccgaacgttttgtttggctcaccaaactcaataaccttcgaatactcgaagacggggccgaacgggcactaaacgaagaagaaagacaactactaatcaaccacccgtacgaaaagagcaaactaacatacgcgcaggtacgaaaattactaggcctctccgaacaagctattttcaagcacctacgctacagtaaagaaaacgcagagtcagccaccttcatggagctcaaagcctggcacgccatacgaaaagcactcgaaaaccagggcctgaaggacacctggcaggacctcgccaagaaacccgatctcctcgacgaaatcggaaccgccttctcactctacaaaacagatgaagacatccaacaatacctaacgaacaaagtacccaacagcgtaataaacgcactactcgtatccctgaacttcgataagttcatcgaactcagcctgaaaagcctgagaaaaatacttcctctaatggaacaaggcaaacgctacgatcaggcctgccgcgagatctacggacatcactacggggaggccaaccaaaagacgtcacaactcctgcccgccattccagcccaagaaatacgcaaccccgtagtcctgcgaacgctgtcccaagcaagaaaagtaataaacgccatcatacgacaatacggctcccccgcccgagtccacatagaaacgggtcgagaactagggaaatccttcaaagaacgacgcgaaatccaaaaacagcaggaggataatcgaaccaaacgcgagtcagcggttcaaaagttcaaggaactcttctccgacttcagcagcgaaccaaaatctaaagacatactcaagttccgcctttacgagcaacaacacggtaaatgcctatactcgggcaaagaaatcaacatacacaggctgaacgaaaaaggatacgtcgagatcgaccacgcactacccttcagtcggacctgggacgactcattcaacaataaagtacttgtcctagcaagcgagaaccaaaacaaaggcaaccagacaccatacgagtggctacaagggaaaataaactccgaacgctggaaaaacttcgtcgcactggtactcggcagccagtgctcagccgcgaagaaacaacgcctcttgacccaggtcattgacgacaacaaatttatcgaccgcaaccttaacgacactcgatacatcgcacgcttcctatcaaactacatccaggaaaacctcctactcgtcggcaaaaacaaaaagaacgtattcacgccaaacggccaaatcacagccctgctccggtcgcgatggggactaatcaaagctcgagaaaacaacaaccgacaccatgccctagatgcgatcgtggtcgcttgcgcgaccccctcaatgcaacagaaaataacccgcttcatccgatttaaagaagtccacccctacaaaatagaaaaccgatacgaaatggtcgaccaagagagtggagaaattataagcccccacttccccgagccatgggcatacttcaggcaagaggtaaacatccgagtattcgacaaccaccccgacacggtgctaaaagagatgctcccggaccggccacaggcaaaccaccaattcgtacaacctctattcgtctcccgagcgcccaccagaaaaatgtccggccaaggccacatggaaaccatcaagtccgccaaacggctggcagaaggcatctccgtactccgaatacccctaactcaactcaaacccaatctcctggaaaacatggtaaataaggagcgcgaacccgccctgtacgcaggccttaaagcccgactcgccgagttcaaccaggaccccgcaaaagccttcgccacaccattctacaaacaaggcggccagcaggtaaaagcaatccgagtagagcaagtacaaaaatcaggagtcctagtacgcgaaaacaacggagtcgccgacaatgcctcaatcgtacgaaccgacgtattcatcaaaaacaacaaattctttctcgtccccatctacacgtggcaagtagcaaagggaatcctaccaaacaaggcaatcgtcgcacacaaaaatgaagacgaatgggaagaaatggacgaaggtgccaaattcaagttctctctcttccccaacgaccttgtcgaactaaaaaccaagaaagaatacttcttcggctactacatcggactggaccgggcaacagggaacataagcctaaaagagcacgacggcgaaatctccaaaggcaaagacggagtctacagggtaggcgtcaaacttgcactgagctttgaaaaataccaagtagatgagcttgggaaaaaccgacaaatctgccgaccccaacaaagacaacctgtcagaaagagaccagccgcaactaaaaaggcaggacaagccaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 8140 - RNA, 3858 nt, synthetic construct
  misc_feature 1..3858: note = Cas9 variant mRNA product
  source 1..3858: mol_type = other RNA
gggagagtcccgcagtcggcgtccagcggctctgcttgttcgtgtgtgtgtcgttgcaggccttattcaagcttaccatggcacccaaaaagaaacgcaaagtcggaatccacggagtaccagcagcagccgcctttaaaccaaacccaatcaactacatactcggattagacatagggatagcatcagtcggatgggccatggtcgagatcgacgaggacgaaaaccccatatgcctcatagacctgggggttagggttttcgagcgtgcagaggttccaaaaacaggcgacagcctagcaatggcacgtagactagcgcgctctgtccgcagactcacgagacgacgggcccacagactgctaagagcccgccgcctgctcaaaagagaaggagtcctacaagccgccgactttgacgaaaacggactcataaaaagcctccccaacacaccctggcaacttcgggcggccgccttagaccgaaaactcacacccctcgagtggtccgccgtgctactgcacctgatcaaacatcgaggatacctcagccaacgcaaaaacgagggagaaacggcagacaaagagctcggcgcactgcttaaaggcgtagcggacaacgcacacgcactacagacgggggacttccgcacgccagccgagctcgcactcaacaaattcgagaaagaaagcggtcacatccgaaaccagcgcggagactactcccacacattctcccgaaaagacctgcaagccgaactcatcctactattcgaaaaacagaaagagttcggcaacccacacgtatcaggcggtctaaaagaaggtatagaaacactcctcatgacccaaagaccggccctgtcaggagacgcagtccagaaaatgctcgggcattgcacattcgaaccagcagagcccaaggcagctaaaaacacatacaccgcagaacgattcatctggctgaccaagctcaacaacctcagaatattagaacaagggtctgaacgccccctgactgacacggaacgcgcaacactcatggacgaaccgtaccgcaaaagcaaactcacctacgcacaagcccgtaaactactgggcctcgaagacacagctttcttcaagggtctgcgatacggaaaagacaacgcagaagcatcaacattaatggaaatgaaggcttaccatgccatcagccgagccctagaaaaggaaggcctaaaagataagaaaagtcccctaaacctgtcgcccgagctacaagatgaaatcggcacagccttctcgctttttaaaaccgacgaggacatcacagggcgactcaaagaccgaatacaacccgagattctggaggcgctcctcaaacacatatcattcgacaaattcgtccaaatatccctcaaagcactacgcagaatcgttcctctcatggaacaaggcaaacgctacgatgaagcctgcgcagaaatatatggagaccattacgggaaaaagaacaccgaagagaaaatctatctgcccccgatcccagcggacgaaatacggaatcccgtcgttctgcgagcgctatcccaagcgagaaaagtaatcaacggggtcgtcagacgctacggcagtcccgcaagaatacacatagaaaccgcccgagaggtcggcaaatccttcaaagaccgcaaagagatcgaaaaacgccaagaagaaaatcgcaaggaccgagaaaaagcggcagcgaaattcagagaatacttcccaaacttcgtcggggaacccaaatccaaagatatcctaaaactccgcctatatgaacaacagcatggcaaatgcctctacagcggtaaggaaatcaacttaggaagactgaacgaaaaaggctacgtggaaatagaccacgcgctcccattcagccgcacttgggacgactcattcaacaacaaagtgctggtcctcggctcagagaaccagaataaagggaatcaaaccccctacgaatacttcaacggcaaagacaacagccgcgaatggcaagagttcaaggcacgagtggagacctcgcgcttccccagaagcaagaaacagcgaatactcctacagaaattcgacgaagatggcttcaaagaaaggaacctaaatgacacacgctacgtaaaccgctttctttgccaattcgtagcagaccggatgcggctcactggaaagggcaaaaagagagtcttcgcatccaacggacaaatcactaacctgctgaggggattctggggattacgcaaagtccgggcagagaacgaccgacaccatgcgctcgacgccgtagtcgtagcatgcagcaccgtagccatgcaacagaaaatcacgcgcttcgtgagatacaaggaaatgaacgcattcgacggaaagaccatcgacaaagagaccggagaagtcctacaccagaagacccatttcccccaaccctgggagttcttcgcccaggaagtcatgatacgcgtcttcggcaaacccgacggaaagccagagttcgaagaagcggacacgccagaaaaactaagaacgctgctcgccgagaaacttagctccagacctgaagcagtacatgaatatgtaaccccactcttcgtaagccgagccccgaaccgcaaaatgtccggccaggggcacatggaaacagtaaaatcagccaaacgcctagacgagggcgtgagcgtactaagggtaccgcttacacaactcaagctaaaagacctagagaaaatggtcaaccgcgagcgcgaaccaaagctctacgaggcccttaaggctcggctagaggcacacaaagacgacccagccaaagccttcgcggaaccgttttacaaatacgacaaggccggcaatcggactcaacaagtcaaagccgtaagagtagagcaggtccagaaaacaggcgtctgggtacgtaaccacaacggcatagcagacaacgccactatggtacgcgtcgacgtgttcgaaaaaggcgacaaatattatctagtgcccatatacagctggcaagtcgcaaaaggaatcctaccagaccgcgcggtggtccaaggaaaggacgaagaagactggcaactcatcgacgacagcttcaacttcaaattcagcctacaccccaacgacctagtcgaagtcatcacaaagaaggcccggatgttcgggtacttcgcctcctgccaccgcggcaccggtaacataaacataaggatccatgacctcgaccacaaaataggcaaaaacggaatattagaaggcatcggggtaaaaacagcccttagcttccaaaaataccaaatagacgagctaggaaaagaaataaggccctgccgactcaaaaagagaccaccagtgcgcaaaaggcccgcagcaacgaagaaagccggccaagccaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 8141 - RNA, 3864 nt, synthetic construct
  misc_feature 1..3864: note = Cas9 variant mRNA product
  source 1..3864: mol_type = other RNA
gggagagtcccgcagtcggcgtccagcggctctgcttgttcgtgtgtgtgtcgttgcaggccttattcaagcttaccatggcaccgaagaagaaaaggaaagtcggcattcacggagtcccagccgcaaaataccatgtaggcatagacgtaggaacattcagcgtagggctcgcggcaatagaggtagacgacgcaggtatgcccatcaaaaccctaagccttgtgtcacacatccacgacagcggcctcgatccagatgaaatcaaatcggcggtcacgcgactagcaagcagcggtatcgccagacgaacgcgcagactgtaccgaaggaaaaggagaagactccagcaactggacaaattcatacaacggcaaggatggccagtgatagaattagaggactacagcgacccactatacccctggaaagtaagagccgagctcgcagcaagttacattgcggatgagaaagaacgaggcgagaaattgagcgtggcactgagacatatcgccagacacagaggatggcgcaacccatacgcaaaagtaagcagcctatacctcccagacgggccgtccgacgcattcaaagcgatcagagaagagataaagagggcgagtgggcaaccagtgccagaaacagccacggtgggacaaatggtgaccctatgcgaactaggcacgctgaagctaagaggagaaggcggagtcctgagtgcacggttgcagcaaagcgactacgcccgcgaaatacaagaaatatgccgcatgcaagaaatagggcaagaactctacagaaaaataatcgacgtagtattcgcagctgaaagcccaaaggggagcgccagcagccgagtaggaaaagaccccttacaacccgggaaaaaccgcgcgctaaaggccagcgacgcattccaacgatacaggatagcagccttaataggaaacctaagagtccgagtagatggagagaaacgcatcctcagcgtagaggagaagaacctcgtgttcgaccatctggtcaatctaaccccaaagaaagaaccagaatgggtaacgatcgcagaaatactgggcatagacagagggcagctaataggaaccgccacgatgacggacgacggagaacgcgcgggagcccgaccacctacgcacgacacgaacagatccatcgtgaacagccgaatagccccgctagtcgactggtggaaaacagcgagcgccctcgaacaacatgcaatggtcaaggctctaagcaacgcggaagtagacgacttcgactcaccagagggagcaaaagtccaagcattcttcgccgacctagacgacgacgtccacgcaaaactcgactcccttcatctgccagtcggacgagcggcgtacagcgaagacaccctagtacgattaacacgacgcatgctaagcgacggagtagatctgtacaccgcaagactacaggagttcggcattgaaccaagctggacgccaccaacccccaggatcggagaaccagttggtaacccagctgtagaccgagtactaaaaacagtcagtcgatggcttgaaagtgcgaccaagacttggggagcaccagaacgggtcataatagaacacgtaagggagggatttgtaacagaaaaacgggcgcgagaaatggacggggacatgcgtagacgagcagcaaggaacgcaaaactgttccaggaaatgcaggagaaactaaacgtacaaggaaaaccctctagagcagatctctggcggtaccagagcgtccaaagacaaaactgccaatgcgcatactgcggcagcccaatcacgttcagcaactcagaaatggaccacatcgtgccaagggctgggcagggatccaccaacacgcgcgagaacctagtggcggtgtgccacaggtgtaaccaaagcaaaggaaacaccccgttcgcgatatgggcgaaaaacacctccatagagggcgtaagcgtaaaggaagctgtggaaagaacacgacactgggtcacggacacaggaatgcgctcaaccgactttaagaaatttacaaaggctgtcgtcgagaggttccaaagagcaacgatggacgaagagatagacgcaaggagcatggaatcggtcgcatggatggcaaacgaattgcgcagtcgggtagcacagcacttcgctagccacggaacaacggtacgagtctaccgcggaagcctcacagcggaagcacggagggccagcggcataagcggcaaactaaagttcttcgacggagtcgggaaatctcgcctagaccgcagacaccatgccatagacgcggccgtgatcgcattcacaagtgactacgtggccgagaccctagcagtacgaagcaatttgaagcaaagccaagcgcacagacaggaagccccgcaatggcgagagttcacaggaaaagacgcagaacacagagcggcatggagggtatggtgccagaaaatggaaaaactaagcgcattgctcaccgaagacctcagggacgacagagtcgtcgttatgagcaacgtgcggctacgcctcggcaacggctcggcccacaaagaaacaataggaaaactcagcaaggtcaaactaagctcacaactgtccgtatccgacatagacaaagcgtcgagcgaagcactctggtgcgcgctaacgcgagaacccggatttgaccccaaggaaggcctccctgcaaacccagaacggcacatacgagtaaacggtacacacgtgtatgctggtgacaacatcggattattcccagtctcagcaggaagtattgcgctgcggggaggatacgcagaactcggctcaagttttcaccacgcaagggtatataaaataacaagcgggaagaaaccagcattcgctatgttgagagtatacacgatagacctgctcccctaccgcaaccaagacctattcagcgttgaactaaaaccacaaacaatgtcaatgaggcaagccgaaaagaaactgcgagacgccctcgccaccgggaacgccgaatacctcggctggttagtcgtcgacgacgagctcgtagtagacaccagcaaaatagcaacggaccaagtaaaagcagtcgaagcggagctaggaacgataagacgatggagggtagatggatttttcagcccaagcaaactacgcctaagaccgcttcaaatgtcaaaagaaggcatcaaaaaggaaagcgcaccagagctgagcaagataatcgacagacccggctggctaccagcagttaataaactcttcagcgacggcaacgtcacagtcgtgcgaagggactcgttggggcgggtacggctagaaagcacagcgcacctacccgtcacatggaaggtacaaaagagaccagccgcgacgaagaaggcaggccaggcgaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 8142 - RNA, 3564 nt, synthetic construct
  misc_feature 1..3564: note = Cas9 variant mRNA product
  source 1..3564: mol_type = other RNA
gggagagtcccgcagtcggcgtccagcggctctgcttgttcgtgtgtgtgtcgttgcaggccttattcaagcttaccatggcccccaagaagaaacgcaaggtgggcatccacggggtcccggccgcggcccggatactggccttcgacatcggcatcagctccatagggtgggccttcagcgagaacgacgagctcaaggactgcggcgtgcgcatcttcactaaggtggagaaccccaagacaggagagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgatgagagcctcgccaaggcctacaaaggctccctgatcagcccctacgagctgcggttccgcgcactcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacttgtacaaggagtacttccagaaattcaaggagaacagcaaggagttcacgaacgtgcgcaacaagaaggagtcctacgagcggtgcatcgcccagagcttcctgaaggacgagctgaagctcatctttaaaaagcagcgcgagttcgggttctccttcagcaagaagttcgaagaggaggtcctttccgtggcgttctacaagcgggctctgaaggacttcagccacctcgtgggcaactgctccttcttcaccgacgagaagcgcgccccgaagaacagccccctggccttcatgtttgtcgccctgacccggatcatcaatctcctgaacaacctgaagaacaccgagggcatcctctacacgaaggacgacctgaacgcgctgcttaacgaggtgctgaagaacggcaccctgacctacaagcagaccaagaagctcctggggctgagcgacgactacgagttcaaaggggaaaagggcacgtacttcatcgagttcaagaagtacaaggagttcattaaggccctcggggagcacaacctgtcccaggacgacctgaacgagatcgccaaagacatcaccctcatcaaggacgagatcaagctgaagaaggccctggccaagtacgacctcaaccagaaccagatcgacagcttatccaaacttgagttcaaggaccacctcaacatcagcttcaaggcgctaaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgtgcgatcaaggagtaccgcaaggtgctgaacgccctcctgaagaagtacggcaaggtgcacaaaatcaacatcgagctggcgcgggaggtcgggaagaaccactcccagcgcgccaagatcgagaaggagcagaacgagaactacaaggccaagaaagacgcggagctcgagtgtgagaagctgggcctgaagatcaacagcaagaacatcctcaagctgcggctgttcaaggagcagaaggagttctgtgcctactccggggagaaaatcaagatcagcgacctccaggacgagaagatgttagagatcgaccacatctacccatactcccgcagcttcgacgactcctacatgaacaaggtgctggtgttcaccaagcagaaccaggagaagctcaaccagacccccttcgaggccttcggcaacgacagcgcgaagtggcagaagatcgaggtcctggcaaagaacctacccaccaagaagcagaagcggatcctcgacaagaactacaaggacaaggagcagaagaacttcaaggaccgcaacctgaacgacacacggtacatagctcgcctggtgctcaactacaccaaggactacctggacttcctgccgctctccgacgacgagaacaccaagctgaacgacacccagaaggggagcaaggtgcacgtcgaggccaagtccggcatgctgacgagcgctctccggcacacctggggcttctccgccaaggaccgcaacaaccacctccaccacgccatcgatgcggtgataatcgcctacgccaacaacagcatcgtcaaggccttctccgacttcaaaaaggagcaggagagcaacagcgcggagctgtacgccaagaagatctccgagctggactacaagaacaagcggaagttcttcgagcccttcagcggtttccgccagaaggtgctggacaagatcgacgagatcttcgtgtccaaacccgagcggaagaagcccagcggtgccctgcacgaggagaccttccgtaaagaggaggagttctaccagtcctacgggggcaaggagggggtcctcaaggcgctggagctgggcaagatccggaaggtgaacgggaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttttgcttctccctctacaaggacagcctgatcctgatccagaccaaggacatgcaagagcccgagttcgtgtactacaacgccttcacctcctcaaccgtgtccctcatagttagcaagcacgacaacaagttcgagacgctgtccaagaaccagaagatcctgttcaaaaacgcaaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 8143 - RNA, 3975 nt, synthetic construct
  misc_feature 1..3975: note = Cas9 variant mRNA product
  source 1..3975: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgtcggacctagttctcggcctggacatcgggattggctccgtgggggtcgggatcctgaacaaggtgaccggcgagatcatccacaagaacagccggatcttccccgccgcccaggccgagaacaacctagtgcgccggacgaaccgccagggccggcgcctggcccggcgcaagaagcaccggcgcgtccggctgaaccgcctcttcgaggagtccggcctgatcacggacttcaccaagatcagcataaacctgaacccctaccagttacgggtgaaggggctgaccgacgaactgtccaacgaggagctgttcatcgcgctgaagaatatggtgaagcaccgcggcatcagctacctggatgacgcctccgacgacgggaacagctccgtcggcgattacgcccagatcgtgaaggagaatagcaagcagctcgagaccaagacgcccggacagatccagctggagcggtaccagacctacgggcagctgcgcggcgatttcaccgtggagaaagacgggaagaagcaccgactcatcaacgtcttcccgacctccgcctaccgaagcgaggcgctgcggatcctgcaaactcagcaggagttcaacccccagatcaccgatgagttcatcaaccgctacctcgagatcctgaccggcaagcggaagtactaccacggccccgggaacgagaagtcccgcaccgactacggccgctatcggacgagcggggagaccctggacaacatcttcggcatcctcatcgggaagtgcaccttctaccccgacgagttccgcgccgccaaggcctcctacaccgcccaggagttcaaccttttaaatgacctcaacaacctgacggtgccgaccgaaaccaagaagctcagcaaggagcagaagaaccagatcatcaactacgtgaagaacgagaaggctatgggccccgccaagctgttcaagtacatcgccaagctcctgtcctgcgacgtcgccgacatcaagggctaccggatcgacaagagcgggaaggccgagatccataccttcgaggcgtaccgcaagatgaagacgctcgagaccctggacatcgagcagatggacagagagaccctggacaagctcgcctacgtactgaccctgaacacggagcgcgagggcatccaggaggccctcgagcacgagttcgccgacgggtccttcagccagaagcaggtcgacgagctggtgcagttccggaaggccaacagctccatcttcggcaaagggtggcacaactttagcgtgaagctgatgatggagctcatccccgagctgtacgagaccagcgaggagcagatgaccatcctgacccgcctcggcaagcagaagacaaccagctccagcaacaagactaagtacattgacgagaagctgctgaccgaggaaatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgcctcacagcgtgttccacggccacaagcagctggccaccaagatccggctgtggcaccagcagggcgagcgctgcctctataccggcaagaccatctccatccacgacctgatcaacaacagcaaccagttcgaggtcgaccacatcctgcccctctccatcacgttcgacgacagcctggccaacaaagtgctggtgtacgcgaccgccaaccaggagaaggggcagcggacgccctaccaggccctggactccatggacgacgcctggtcgttccgcgagctgaaggccttcgtccgggagtccaagaccctgagcaacaagaagaaggagtacctcttgaccgaggaggacatctccaagttcgacgtgcgcaagaagttcatcgagcggaacctcgtggacacgcgctacgcgagccgggtcgtgctcaacgccctgcaggagcacttccgcgcccataaaatcgacaccaaggtgtccgtggtgcgcggccagttcaccagccagttaagacgccactggggcatcgagaagacccgggacacgtaccaccaccatgcagtggacgccctcatcatcgcggcctcctcccagctgaacctgtggaagaagcagaagaacaccctcgtcagctactccgaggaccagctgctggacatcgagaccggggagctcatcagcgacgacgagtacaaggagtccgtgttcaaggccccctaccaacatttcgtggacaccttaaagagcaaggagttcgaggattccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctcgagaactaccccaacaagcagatcaacgagaagggcaaggaggttccctgcaacccgttcctcaagtacaaggaggagcacgggtacatccggaaatacagcaagaagggcaacgggcccgagatcaagtccctgaagtactacgacagcaagctgggcaaccacatcgacattacccccaaagactccaacaacaaggtggtcctccagagtgtgtccccctggcgcgccgacgtgtacttcaacaagaccaccgggaagtacgagatcttgggcctgaaatacgcggacctccagttcgagaagggcacggggacctacaagatcagccaggagaagtacaacgacatcaagaagaaagagggcgtcgacagcgactccgagttcaagttcaccctgtacaagaacgacctgctcctggtgaaggacaccgagacgaaggagcagcagctgttccggttcctcagccgcaccatgccaaagcagaagcactacgtggagctaaagccctacgacaagcagaagttcgagggcggagaggccctgatcaaggtcctcgggaacgtggccaactccggccagtgcaagaagggactgggcaagagcaacatctccatctacaaggtgcggaccgacgtcctggggaaccaacacatcattaagaacgagggggacaaacccaagctcgacttcaagcgccccgccgccaccaagaaggcgggccaggccaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 8144 - RNA, 4533 nt, synthetic construct
  misc_feature 1..4533: note = Cpf1 variant mRNA product
  source 1..4533: mol_type = other RNA
gggagagtcccgcagtcggcgtccagcggctctgcttgttcgtgtgtgtgtcgttgcaggccttattcaagcttaccatggcccccaagaagaagcgcaaggtgggaatccacggcgtcccggccgcgacccagttcgagggcttcaccaacctgtaccaggtgagcaagacgctccggttcgagctgatcccccaggggaagaccctgaaacacatccaggagcagggcttcatcgaggaggacaaggcccgcaacgaccactacaaggaactcaaacccatcatcgaccggatctataagacctacgccgaccagtgcttgcagctggtgcagctcgactgggagaatctgtccgccgccatcgacagctaccgcaaggagaagaccgaggagacccgtaacgcgcttatcgaggagcaggccacctaccgcaacgctattcatgactacttcatcgggcggaccgataacctcaccgacgccataaacaagcgccacgctgaaatctacaagggcctcttcaaggccgagctattcaacggcaaggtactaaagcagttagggacggtgaccaccaccgagcacgagaatgccctactccggtccttcgacaaattcacgacctacttctcaggcttctacgaaaaccgcaagaacgtgttcagcgcagaggacatcagcaccgcaatcccccaccggatcgtccaggacaatttcccgaagtttaaggagaactgccatatcttcacccgtctgatcacggcggtgccgtccctgcgggaacacttcgaaaacgtgaagaaggccatcggaatttttgtcagcacctccatcgaggaggtgttcagtttccccttctacaaccagttgctgacccagacccagatcgacctgtacaaccagctcttgggcgggatctctcgcgaggccggcacggagaagataaagggcttaaatgaggtgctcaacctggccatacagaagaacgacgagacagcccacatcatagcgagcctgccccaccggttcatcccgttattcaaacagatcctgtctgaccgtaacacccttagcttcatcctcgaggagttcaagagtgacgaagaggtcatccagtcgttctgcaaatacaagacccttctgcggaacgagaatgtgctcgagacggccgaggcccttttcaacgaactgaactccatcgacctcacccacatcttcatcagccacaagaaactcgagaccatcagcagcgccctgtgcgaccactgggacaccctccgcaacgccctgtacgagcggcgcatcagtgagctgacgggcaagatcaccaagtccgcgaaggagaaggtgcagcggagcctcaagcatgaagacatcaacctgcaggagatcatctccgccgccggcaaggagctgagtgaggccttcaagcaaaagacctcagaaatcctatcccacgctcatgcggccctggaccagccgttgcccaccacgctcaagaagcaagaagagaaggagatcctgaaatcccagttagacagcctgctcgggctgtaccacctcctcgactggttcgcagtcgacgaatccaacgaggtggaccccgagtttagcgcccgcctgaccggcattaaactggagatggagccgtccctcagcttctacaacaaggcgcgcaactacgccaccaagaagccctactccgtggagaagttcaagctgaacttccagatgcccacgctggccagcggctgggatgtaaacaaggagaagaacaatggggccatactcttcgtgaagaacggcctgtactacctggggatcatgcctaagcaaaagggccggtacaaggccttatccttcgagcccacggagaagaccagcgaagggttcgacaagatgtactacgactacttccccgacgcggccaaaatgatccccaagtgctccacacagctgaaagcagtgaccgcccacttccagacccacacgaccccgattctgttgagtaacaacttcatcgagccgctggagatcaccaaagagatctacgatctgaacaaccccgagaaggagcccaaaaagttccagaccgcctatgcgaaaaagacgggagaccagaaaggctaccgcgaggccctgtgcaagtggatcgacttcacccgggatttcctatccaagtacaccaagaccacgagcatcgacctgagttcactccggccaagctcccagtacaaagatctgggggagtactacgccgagctgaatccgctcctgtatcacatctcattccaacggatcgccgagaaagagatcatggacgccgtagagacgggcaagctctacctcttccagatctacaacaaggacttcgcgaagggacaccacggcaagcctaacctgcacacattgtactggaccggcctcttctcccccgagaacctcgccaagacgagcatcaagctgaacgggcaggccgagctgttctacaggcccaagagccggatgaagcgcatggcccacaggctgggtgagaagatgctgaacaagaagctaaaggaccagaagaccccgatccccgacaccctgtaccaagagctgtatgactacgtgaaccatcgcttaagccacgacctctccgacgaggcgcgtgccttactccccaacgtgatcaccaaggaggtcagccatgagatcatcaaggaccgcagattcacgtccgacaagttcttcttccacgtgccgatcacactgaactaccaggccgctaacagcccctccaagttcaaccagcgcgtcaacgcctacctaaaggagcaccccgagacgcccatcattgggatagaccggggcgagcgcaacctgatctatatcaccgtgatcgacagcacggggaagatcctggagcaacgatccctgaacaccatccagcagttcgactaccagaagaaactcgacaaccgcgaaaaagagcgggtggcggcacgccaggcctggagcgtcgtgggcaccatcaaggacctgaagcaggggtacctgagccaggtgatccacgagatcgtcgacctcatgattcactaccaggccgtcgtggtcctggagaacttaaacttcggcttcaaatcgaaacgcaccggcatcgccgagaaagcggtgtaccagcagttcgagaagatgctcattgacaagttaaactgcctggtgctaaaagattacccggccgagaaggtcggaggcgtgctgaacccctaccagttgacggaccagttcaccagcttcgccaagatgggcacccagtctggcttcctcttctacgtgcccgccccctacaccagcaagatcgacccgctgacggggttcgtagaccccttcgtttggaagaccatcaagaaccatgagagtcggaagcacttccttgaggggtttgacttcctccactatgatgtgaagactggcgatttcatcctgcacttcaagatgaaccgcaacctgagcttccagcgggggctccccggtttcatgcccgcctgggacatcgtcttcgagaagaatgagacccagttcgacgcgaaggggacgcccttcatcgccggcaagcgcatagtccctgtgatcgagaaccaccggttcaccggccgctaccgggatctgtaccccgcaaacgagctgatcgccctcctggaggagaaggggatcgtctttcgagacggctccaacatcctgcccaagttgttagagaatgacgacagccacgcaatcgacaccatggtggccctgattcggtccgtgctccagatgcgcaacagcaacgcggccaccggggaggactacatcaactccccggtccgggacctgaacggcgtgtgctttgatagccgcttccagaaccccgagtggcccatggacgccgacgcgaacggggcctaccatatcgccctgaagggacaactcttgctgaaccacctcaaggagtctaaggacctcaagctgcaaaacggtatcagcaaccaggactggctcgcctatatacaagagctgcggaacaagcgccccgccgcgactaaaaaggctgggcaggccaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 8145 - RNA, 4512 nt, synthetic construct; identical to SEQ ID NO: 2345
  misc_feature 1..4512: note = Cpf1 variant mRNA product
  source 1..4512: mol_type = other RNA

SEQ ID NO: 8146 - RNA, 4813 nt, synthetic construct
  misc_feature 1..4813: note = Cas9 variant mRNA product
  source 1..4813: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaagtgggaatccacggggtgccggcggcggacaagaagtacagcatcggcctggacatcgggaccaactcagtgggctgggccgtaatcaccgacgaatacaaagtccccagcaagaagttcaaggtgctggggaacacggaccggcattccatcaagaagaacctgatcggtgccctgctgttcgactcgggcgagaccgccgaggccacccgcctgaagcgaaccgcgcgccggcgctacacgcggcgcaagaaccggatctgttacctgcaggagatcttctccaacgagatggccaaggtggacgacagcttcttccaccgcctcgaggagtccttcctggtcgaggaggacaagaagcacgagcggcaccccattttcgggaacattgtggacgaagtggcctaccacgagaagtaccccaccatctaccaccttcgcaagaagctcgtcgacagcaccgacaaggccgacctgcggctgatttacctcgcgctggcccacatgatcaagttccgcggccacttcctgatcgagggggacctcaacccggacaactccgacgtggacaagctgttcatccaactggtgcagacctacaaccagctgttcgaggagaaccccatcaacgccagcggcgtcgacgccaaagccatcctgtccgcgagacttagcaagagtcgcaggctcgagaacctgatcgcccagcttcccggggagaagaagaacggcctattcggcaacctgattgccctgagcctcggactgacacccaacttcaagtccaacttcgatctggccgaggatgccaaactccagttgagtaaggacacctacgacgacgacctggacaacctcctggcgcagatcggcgaccagtacgccgacctgttcctcgccgccaagaacctgtctgacgccatcctgctcagcgacatcctgcgcgtgaacaccgaaatcaccaaggcgccgctgtccgcctcaatgatcaagcggtacgacgagcaccaccaggatctcacgctgctgaaggcgctagtgcgccagcagttgcccgagaaatacaaggagatcttcttcgaccagagcaaaaacgggtacgctggctacatcgacggcggggcctcccaggaggagttctataagttcatcaagcccatactggagaagatggacggcaccgaggagttactggtcaagctgaaccgggaggacctgctccgcaagcagcgcaccttcgacaatgggagcatcccccaccagatccacctgggcgagctgcacgcgatcctccggcgccaggaggacttctacccgttcctgaaggacaaccgggagaagatcgagaagatcctcacctttcgcatcccctactacgtggggcccttggcccggggcaactcccgcttcgcctggatgacgcgcaagagcgaggagaccatcactccctggaatttcgaggaggtggtcgacaagggcgccagtgcgcagagcttcattgagaggatgaccaactttgacaagaacctgccgaacgagaaggtgctgcccaagcactccctcctgtacgagtacttcacggtgtataacgaactcaccaaggtcaagtacgtgaccgaggggatgcggaagcccgctttcctcagcggcgagcagaagaaggccatcgtggacttgctgttcaagaccaaccgcaaggtcacggtgaagcagctcaaggaggattacttcaagaagatcgagtgcttcgactccgtcgagatcagcggggttgaggaccggttcaacgcctccctgggcacctaccacgacctgctcaaaatcatcaaggacaaggactttctggacaacgaggagaacgaggacatcctggaggacattgtgctcaccctgaccctgttcgaggaccgcgagatgatagaggagcggctcaagacgtatgcccacctgttcgacgacaaggtcatgaagcaactgaagcgtcggcgctacaccgggtggggccggctcagccgcaagttgatcaacggaatccgagataaacagagtgggaagacaatcctggacttcctaaagagcgacggctttgcaaaccgcaacttcatgcagctgatccacgacgactccttgaccttcaaggaggacatccagaaggcccaagtatctgggcagggagactccctccacgagcacatcgccaacctggccgggtcccccgccatcaagaagggcatcctgcagacggtgaaggtcgtggacgagctagtcaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaagagcaccccgtggagaacacccagctccagaacgagaagctctacctgtactaccttcagaacggccgggatatgtacgtcgaccaggagctggacattaacaggctgagcgactatgacgtggaccacatcgtgccccagtccttcctcaaagacgacagcatcgacaacaaggtcctgacacggtccgacaagaaccggggcaagagcgacaacgtgccctccgaggaggtagtcaagaaaatgaaaaactattggagacagctgctcaacgctaagctgatcacccagcgcaaattcgacaacttgaccaaagccgaacgcgggggcctcagcgagctagacaaggccgggttcatcaagcggcagctggtggagacccggcagatcaccaagcacgtagcccagatcctcgactccaggatgaacacgaagtacgacgagaacgacaaactgatccgggaggtcaaggtgatcaccctcaagagcaaacttgtgtccgacttcagaaaggacttccagttctataaggttagggagatcaacaactaccaccacgcgcacgacgcatacctgaacgccgtggtgggcaccgccctgatcaagaagtacccgaaacttgagagcgagttcgtctacggggactacaaggtgtacgacgtgcgcaagatgatcgcgaagtccgagcaggagatcggaaaggctaccgccaagtacttcttctacagcaacatcatgaacttcttcaagacggagatcaccctggcaaacggcgaaatccggaagcgccccctaatcgaaacgaacggagagaccggcgaaatcgtctgggacaaggggcgggacttcgccacggtgcgcaaggtgctctccatgccccaggtcaatatcgtaaagaagaccgaggtgcagaccggcgggttcagcaaggagtccatcctgcccaagcgcaacagcgataagttaatcgcgcgtaagaaggactgggacccgaagaagtacggcggcttcgactcccccaccgtcgcgtacagcgtgctggtggtcgccaaggtggagaagggcaagagcaagaagttaaagtccgtgaaggagctgctcggtatcacgatcatggagcgcagttccttcgagaagaaccccatcgatttcctggaggccaagggatacaaggaggtcaagaaggacctgatcatcaagctccccaagtacagcctgttcgagctggagaacggccggaaacgcatgctcgcctccgcgggggagctgcagaagggcaacgaactggccctccccagcaagtacgtgaacttcctgtacctggcctcccactatgagaagttaaaaggcagccccgaggacaacgaacagaagcagctgttcgtggagcagcacaagcattatctggacgagatcatcgagcagatatccgagttcagcaaacgggtgatcctcgccgacgccaacctcgacaaggtgctctccgcgtacaacaagcaccgtgacaagcccatccgggagcaggccgagaacatcatccacctcttcaccctgaccaaccttggggcccctgccgcgttcaagtacttcgacaccacgatcgaccggaagcggtacaccagcaccaaggaggtgttagacgcgaccctgatacaccagagtatcacgggcctgtacgagacccgcatcgatctcagccagctcgggggcgataagcggcccgccgccaccaagaaggccgggcaggcgaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 8147 - RNA, 5596 nt, synthetic construct; identical to SEQ ID NO: 2347
  misc_feature 1..5596: note = Cas9 variant mRNA product
  source 1..5596: mol_type = other RNA

SEQ ID NO: 8148 - RNA, 3868 nt, synthetic construct
  misc_feature 1..3868: note = Cas9 variant mRNA product
  source 1..3868: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaagtgggcatccacggggtcccggccgcgaagcggaactacatcctgggcctcgacatcgggatcaccagcgtgggctacgggatcatcgactacgaaacccgcgatgttatcgacgccggcgtccggctgttcaaggaggccaacgtggagaacaacgaaggccgccggtccaagcgcggggcccggcgcctgaagcggcgccggcgccaccggatccagcgcgtgaagaagctcctgttcgactacaacctgctcacggaccacagcgagctgtcgggcatcaacccctacgaggcccgggtcaagggtctcagccagaagctctccgaggaggagttcagcgcggccctgctgcacctcgccaagcgcaggggcgtgcacaacgtgaacgaggtcgaggaggacaccgggaacgagctctccaccaaggagcagatcagccgcaactccaaggccctggaggagaagtacgtggcggagctccagctcgagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaagacatcaaggagtggtacgagatgctgatgggccattgcacctacttcccggaggagctccgaagcgtgaagtacgcctacaacgccgacctgtacaacgcgctcaacgacctcaacaacctggtcatcacgcgcgacgagaacgagaagctggagtactacgagaagttccagatcatcgagaacgtgttcaagcagaagaagaagcccaccctcaagcagatagccaaggagatcttggtgaacgaggaggacatcaaggggtaccgggtcacctccaccggcaagcccgagttcacgaacctaaaggtgtaccacgacatcaaggacatcaccgcccgcaaggagatcatcgagaacgccgagctcctggaccagatcgccaaaatcctgaccatctaccagagctccgaggacatccaggaggagctcaccaacctgaacagcgagctgacacaggaggagatcgagcagatctccaacctcaaggggtacaccggcacccacaacctgagcctgaaggcgatcaacctcatcctggacgagctgtggcacaccaacgacaatcagatcgccatctttaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctacccaacgacataatcatcgagctggcccgggagaagaacagcaaggacgcccagaagatgatcaacgagatgcagaagcgcaaccggcagaccaacgagcgcatcgaggaaatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtggaccacatcatcccccgcagcgtgtccttcgataacagcttcaacaacaaggtgctggtcaagcaagaggagaactccaagaaggggaaccggacccccttccagtacctgagctccagcgactccaagatcagctacgagaccttcaagaagcacatcctcaacctggccaagggcaaagggcgcatctccaagaccaagaaggagtacctgctcgaggaacgggacattaaccgcttcagcgtgcagaaggacttcatcaaccggaacctggtggacacgcgctacgccacccggggcctgatgaacctcctgcgctcctactttcgcgtcaacaacctggacgtgaaggtcaagagcatcaacgggggcttcacctccttcctcaggcgcaaatggaagttcaagaaggagcggaacaagggctacaagcatcacgccgaggacgcgctgatcattgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcatatcaaggacttcaaggactacaagtacagccatcgcgtggacaagaagcccaatcgggagctcatcaacgacacactgtactccacccgcaaggacgacaaggggaacaccctgatcgtgaacaacctcaacggcctgtacgacaaggacaacgacaagctgaagaagctcatcaacaagagccccgagaagctcctgatgtaccaccacgacccccagacttaccagaagctcaagctgatcatggagcagtacggggacgagaagaacccgctgtacaaatactacgaggagaccggcaactacctcaccaagtactccaagaaggacaacgggcccgtcatcaagaagatcaagtactacggcaacaagctgaacgcccacttggacatcaccgacgactaccccaacagccggaacaaggtggtgaagctctccctgaagccctaccgcttcgacgtctacctggacaacggcgtgtacaagttcgtcaccgtcaagaacctcgacgtgatcaagaaggagaactactacgaggtgaacagcaagtgctacgaggaggctaagaagctgaagaagatctccaaccaggccgagttcatcgccagcttctacaacaacgacctgatcaagatcaatggtgagctctaccgggtcatcggcgtgaacaacgacctgctgaaccgcatcgaggtgaacatgatcgacatcacgtatcgggagtacttagagaacatgaacgacaagcgcccgcccagaatcatcaagaccatcgcgtccaagacccagagcatcaagaagtactcaaccgacatcctggggaacctgtacgaggtaaagagcaagaagcacccccagatcatcaagaagggcaagcgccccgccgccacgaagaaggccggtcaagccaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 8149 - RNA, 4936 nt, synthetic construct
  misc_feature 1..4936: note = Cas9 variant mRNA product
  source 1..4936: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgctgttcaacaagtgcattatcatcagcatcaacctggacttctccaacaaggagaaatgcatgaccaagccctacagcataggcctggacatcgggacgaactccgtgggctgggccgtgatcacggacaactataaggtccccagcaagaagatgaaggtgctggggaacacttccaagaagtacattaagaagaacttactgggcgtgctgctgttcgacagcggcatcaccgccgaggggcggcgcctgaagcggaccgcgcgccggcgctacacgcggcgccggaaccgcatcctgtacctccaggagatcttctctaccgagatggccaccctggacgacgcgttcttccagcggctggacgacagcttcctcgtgcccgacgacaagcgcgactccaagtacccgatcttcggcaacctggtggaggagaaggtgtaccacgacgagttccccaccatctaccacctccggaagtacctcgccgacagcacgaagaaggccgacctgcgcctcgtctacctcgccttagcgcacatgattaagtaccggggccacttcctgatcgagggcgagtttaactccaagaacaacgacatccaaaagaacttccaggacttcctcgacacctacaacgccatcttcgagagcgacctgtccctggagaacagcaagcagctcgaggagatcgtgaaggacaagatttccaagctggagaagaaggaccgcatcctgaagctgttccccggggagaagaacagcggcatcttctctgagttcctgaagctgatcgtgggcaaccaggctgacttccggaagtgcttcaacctcgatgagaaggcaagccttcacttctccaaggagagctacgacgaggacctggagaccctcctgggatacatcggcgacgactatagcgatgtcttcctgaaggctaagaagctctacgacgcgatcctgctgtccgggtttctcaccgtgacggacaacgagaccgaggcgcccctgagctccgccatgatcaagcgctacaacgagcacaaggaggacctcgccctcctgaaggagtacatccggaacatcagcctgaagacctacaacgaggtgttcaaagacgacaccaagaacggatacgccggctacattgacgggaagacgaaccaggaggacttctacgtatacctcaagaacctgctggccgagttcgagggcgccgactatttcctcgagaaaatcgaccgcgaggacttcctgcgcaagcagcgcaccttcgacaacgggtccatcccgtaccagatccaccttcaggagatgcgcgccatcctggacaagcaggccaagttctaccctttcctagccaagaacaaggagcggatcgagaagatcctgaccttccgcatcccctactatgtgggcccgctggcgcgggggaacagcgacttcgcttggtccatccgcaagcggaacgagaagatcaccccgtggaacttcgaggacgtgatcgacaaggagagctccgctgaggccttcatcaaccgcatgacgagcttcgacctctacctgcccgaggagaaggtcctgcctaagcactccctcctgtacgagaccttcaacgtgtacaatgagctgaccaaggtgcggttcatcgccgagagcatgcgcgactaccaattccttgactccaagcagaagaaggacatcgtccggctttacttcaaggacaagcgcaaggtgaccgacaaggacatcatcgagtacctgcacgcgatctacggctacgacggcatcgaactcaaggggatcgagaagcagttcaacagcagcctgagcacgtaccacgacctgctcaacatcattaacgacaaagagttcctggacgactccagcaacgaggctatcatcgaggagatcatccacaccttaaccatcttcgaggaccgggagatgatcaagcaacgcctctccaagttcgagaacatcttcgacaagagcgtgctgaagaagctgagccgtcgccactataccggctgggggaagctctccgccaaacttatcaacggcatccgggacgagaagtccgggaatacaatcctggactacctcatcgatgacggcatcagcaatcgcaacttcatgcagctgatccacgacgacgccctgagcttcaagaagaagatccagaaggcgcagattatcggcgacgaggacaagggtaacatcaaggaagtcgtgaagtccctccccggcagcccggccatcaagaagggaatcctgcagtccatcaagatcgtagacgagctggtgaaggtgatgggcgggcggaagcccgagagcatcgtcgtggagatggcccgagagaaccagtacaccaaccagggcaagtccaacagccagcagaggctcaagcgcctggagaagtcactgaaggagctcggcagcaagatcctgaaggagaacatccccgccaagctgagtaagatcgacaacaacgccctacagaacgaccgcctgtatctgtactacctccagaacgggaaggacatgtataccggagacgacctggacatcgaccggctgagcaactacgacatcgaccacataatcccccaggcgttcctcaaggacaactccatcgacaacaaggtgctggtcagctccgccagcaaccgcggaaagtccgacgacttcccgagcctggaggtggttaagaagcggaagactttctggtaccagttgctcaagagcaagctgatttcccagcgcaagttcgacaacctgacgaaggccgaacggggcggcctgctgcccgaagacaaggcaggcttcatccaacgccagctcgtcgaaacccggcaaatcaccaaacacgtggcccgcctgctggacgagaagttcaacaacaagaaggacgagaacaaccgggcggtgaggaccgtaaagatcatcacgctcaagagcaccctggtgtcccaattccggaaagacttcgagttgtacaaggtgcgcgagatcaacgacttccaccatgcccacgacgcctacctcaacgccgtcatcgccagcgcgctgctgaagaagtaccccaagctcgagcctgagtttgtgtacggcgactacccgaaatacaactccttccgtgagcgcaagagcgccaccgagaaggtgtacttctattccaatatcatgaacatcttcaagaagtccatctccctggctgacgggcgggtgatcgagcgccccctgatcgaagtgaacgaggagacgggcgagagcgtgtggaacaaggagtccgacctcgccaccgtccggcgcgtgctgagctacccccaggtgaacgtcgtaaagaaggtggaggaacagaaccacgggctggaccggggcaagcccaagggcctcttcaacgcgaacctgtccagcaagccgaagcccaactccaacgagaacctggtcggggccaaggaatacctcgaccccaagaagtacggcgggtacgccggcatcagcaactccttcgccgtgctggtcaaggggacgatcgaaaagggagccaagaagaagatcaccaacgtcctggagttccagggcatcagcatcctcgaccgcatcaactaccggaaagacaagctgaacttcctgttagagaaggggtacaaggacatcgagctgatcatcgaactgccgaagtactcactcttcgagctgtccgacggcagccgccggatgctcgcgtcgatcctcagcaccaacaataagcgtggggagatacataagggcaaccagattttcctgtcccagaagttcgtgaagctgctctaccacgccaagcggatcagcaacaccatcaacgagaaccaccgaaaatacgtggagaaccacaagaaggagttcgaggagctgttctactacatcctggagttcaacgagaactacgtcggtgccaagaagaacggaaagctcctgaacagtgccttccagagctggcagaaccattcgatcgacgagctatgcagctccttcatcggccccacggggagcgagcgcaagggcctcttcgagctaacatcccgggggagcgccgcagactttgagttcctgggcgtgaagataccccgctaccgggactacaccccctccagcctcctgaaagacgccaccctgatccaccagtccgtgacggggctgtacgagacccgcatcgacctcgccaagctgggcgagggcaagaggccggccgccaccaagaaggcagggcaggccaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 8150 - RNA, 4012 nt, synthetic construct
  misc_feature 1..4012: note = Cas9 variant mRNA product
  source 1..4012: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacccaaaaagaaacgcaaagtaggaatacacggagtgccggcagcatggtacgcgagccttatgagcgcccaccatctacgcgttggaatcgacgtaggcacccacagcgtaggactagccacactccgagtagacgaccacggaaccccaattgaattactatcggcactgagccacatccacgatagtggagtcgggaaagaaggaaagaaagaccacgacacacgaaagaaactgtcaggaatagcaagacgcgctcgaagactattacaccaccgacgaacacagctccaacaactagacgaagtcctacgagatctaggcttcccaatcccaacaccgggagagttcctagacttaaacgaacaaaccgacccataccgcgtgtggcgagtccgagcacgactcgtggaagagaaactcccagaggaattacgcggaccagccataagcatggcagtgaggcacatcgcccgacaccgagggtggaggaacccgtatagtaaagtagaatccctactaagccccgccgaggaaagcccattcatgaaagcactccgcgaacgaatcctcgcaaccaccggcgaagtactagacgatggcataacgccgggccaagctatggcccaagtcgcactgacccataacatctcaatgcgcggaccagaaggcatactaggaaaactacaccaatccgataacgcaaacgaaatccggaaaatatgtgcccgccagggggtcagccccgacgtttgcaaacagctactccgggccgtattcaaagccgactcacctagaggcagcgccgtgagtagagtagcacccgatccccttcccggtcaggggagcttccgcagagccccaaaatgcgacccagagttccagcgcttccgaataatatccatagtggcaaacctgcgaatatctgaaacgaaaggcgaaaacagaccactaaccgccgacgaacgcagacacgtcgtcaccttcctaacggaagacagtcaagccgatcttacttgggtggacgtcgcagaaaaactcggagttcaccgccgggacttaaggggaacagccgtacacaccgacgacggagaaagaagtgccgcccggcccccaatcgacgcaacggatagaatcatgagacagaccaaaatcagttccctcaaaacgtggtgggaagaagccgacagcgaacagagaggcgcaatgatcaggtacctgtacgaagacccaaccgattctgaatgcgcagaaatcatagctgaactcccagaagaagatcaagccaaactagactccctacacttacccgcaggacgcgccgcatacagcagagagagtctaacagccttaagcgaccacatgctcgcgacaaccgacgacctccacgaggcacgaaaacgccttttcggcgttgacgacagctgggccccacccgccgaagcaatcaacgcccccgtcgggaacccctcggtggaccgcacattaaaaatagtagggcgatacctctcagcagtcgaatctatgtggggcacgccagaagtcattcacgtagagcacgtccgagacgggttcacgagcgagcgcatggccgacgaacgagacaaggcaaaccgacgaagatataacgacaaccaagaagcaatgaagaaaatccagagagactacggaaaagaaggctacatatccagaggggacatagtaaggctggacgccctcgaactccagggatgtgcctgtctctactgcgggacaacaattggataccacacgtgccaactagaccacatcgtaccccaggcaggaccaggaagcaacaaccgccgagggaacctagtcgctgtatgcgaaagatgcaaccgctcgaaatcaaacaccccctttgcagtttgggcccaaaaatgcggcatcccccacgtcggagtaaaggaagcgatcggcagagtcaggggctggagaaagcaaacaccaaacacatcaagcgaagatcttacaaggctaaagaaggaggtcatcgcacgactaagacgaacacaggaggacccagaaatcgacgaaaggtccatggagagcgtagcctggatggcaaacgaactccaccacagaatcgcggccgcatacccagagacaaccgttatggtctatagaggtagtatcacagcggctgcacggaaagccgccggaatagactcccgcatcaatcttataggagagaagggacgaaaagacagaatcgaccgccggcaccacgccgtggatgcctccgtcgtcgcgctaatggaggcaagcgtcgcaaaaacactagccgaacgcagcagcctgcgcggcgaacagcgcctaaccggaaaagaacagacctggaaacaatatacaggcagtaccgtaggagccagagaacacttcgaaatgtggagaggccacatgctccacctcacggaactgttcaatgaaagactagccgaagacaaagtttacgtaacacagaacatacgcctgcgactcagcgacggcaatgcacacaccgtcaaccccagcaaactcgtatcacaccgactcggcgacggactcacagtacaacaaatcgaccgcgcgtgcactccagccctgtggtgtgccctaacccgagaaaaagacttcgacgagaaaaacggcctaccggcacgagaagaccgggccatccgagtgcatgggcacgaaataaaatcgtcagactacatacaagtgttctccaaaagaaagaaaaccgactcagaccgagatgagacaccgttcggagcaatagcggtacgtggagggttcgtcgagatcggacccagcatccaccacgccagaatatacagagtagaaggaaagaaaccagtctacgcaatgctcagggtgttcacacatgacctcttaagccagcgacatggcgacctatttagcgcggtgataccaccacaaagtatcagcatgagatgcgcggaacccaaactccgcaaagcgataacaacgggaaacgccacatatctagggtgggtcgtagtgggcgacgagcttgaaataaacgtagacagtttcaccaaatacgctattggacgcttcctcgaagacttcccaaacacaacacgatggcgcatctgcggttacgatacaaactcaaaactcacgctgaagccaatcgtcctggccgccgaaggactcgaaaacccgtcctcagccgtcaacgagatcgttgaactgaagggatggagagtagcgatcaacgtcctcacaaaagtccacccaacagtagtccgacgcgacgcactaggacgaccgcgctatagttcgagatcaaacctaccaacaagctggacgatcgagaaacgcccagccgcaacaaagaaagccggacaagcgaagaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 8151 - RNA, 4873 nt, synthetic construct
  misc_feature 1..4873: note = Cas9 variant mRNA product
  source 1..4873: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtccctgccgcgaccaagccctacagcatcggcctggacatcgggaccaactccgtgggctgggccgtgacgaccgacaactacaaggttcccagcaagaagatgaaggtgctcgggaacactagcaagaagtacatcaagaagaacctattaggcgtgctcctgttcgacagcggcatcacggccgaggggcggcgcctgaagcggacggcccgcagacgctacacccggcgccggaatcgcatcctctatctgcaagagatcttctccaccgagatggccaccctagacgacgccttcttccaacggctagacgacagcttcctggtccccgacgacaagcgcgactccaaatacccgatcttcggcaacctggtggaggagaaggcctaccacgacgagttccccaccatctaccacctccggaagtacttggccgacagcaccaagaaggccgacctgcgcctcgtgtacctggcgctggcccacatgatcaagtaccgggggcactttctcatcgagggcgagttcaactccaagaacaacgacatccagaagaacttccaggacttccttgacacctacaacgccatcttcgaaagcgacctgtccttggagaatagcaagcagctggaggagatagtcaaggacaagatctccaagctggagaagaaggaccgcatcctcaagctgttccccggggagaagaacagcggcatcttctccgagttcctgaaactcatcgtgggcaaccaggccgacttccggaagtgcttcaacctggacgagaaggccagtctgcacttctccaaggagagctacgacgaggacctcgagaccctgctggggtacatcggcgacgactactccgacgtgttcctcaaggcgaagaagctgtacgacgccatcctgctcagtgggtttctgacggtcaccgacaacgagaccgaggcgcccctgagctccgccatgatcaagcgctacaacgagcacaaggaggacctcgcactgctgaaggagtacatccggaacatcagcctcaagacctacaacgaggtgttcaaggacgacacgaagaacggctacgccggctacatcgacggaaagaccaaccaggaggacttctacgtgtacctgaagaagctgctcgccgagttcgagggcgcagactacttccttgagaagatcgaccgcgaggacttcctgcggaagcagcgcaccttcgacaacggttccatcccgtaccaaatccacctccaggagatgcgcgccatcctggacaagcaggccaagttctaccccttcctggcgaagaacaaggaacggatcgaaaagatcctgaccttccgcatcccctactacgtcggccctctcgcccgggggaacagcgacttcgcctggtccatccgcaagagaaacgagaagatcacgccttggaacttcgaggacgtgatcgacaaggagagctccgccgaggccttcatcaatcgcatgaccagcttcgatctgtacctccccgaggagaaggttcttcccaagcactcgctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacattatcgagtacctccacgcaatctacggctacgacggcatcgagctgaaggggatcgagaagcagttcaacagctccctgagcacctaccacgacctcctgaacatcatcaacgacaaggagttcctggatgactccagcaacgaagccatcatcgaggagatcatccacaccctcaccatcttcgaggaccgggagatgatcaagcagcgcctgtcaaagttcgagaacatcttcgacaagagcgtgctgaagaagctctcccggcgccactacacgggctgggggaagctgagcgccaagctgatcaacggcatccgggacgagaagtccgggaacaccatcctcgattacctgatcgacgacggcatcagcaaccgcaacttcatgcagctgatccacgacgacgcgctcagcttcaagaagaagatccagaaagcacagatcatcggcgacgaggacaaggggaacatcaaggaggtggtcaagtccctgcccggcagcccggccatcaagaaagggatcctgcagtccatcaagatcgtggacgagctcgtcaaggtgatgggcgggcgaaagcccgagagcatcgtggtcgagatggcccgcgagaaccagtacaccaaccagggcaagtccaacagccagcagcggctgaagcgcctggagaagtccctcaaggagctgggcagcaagatactgaaggagaacatccccgccaagctctccaagatcgacaacaacgcgctgcagaacgaccgcctgtacttgtactacttgcagaacgggaaggacatgtacaccggcgacgacctggacatcgaccggctaagcaactacgacatcgaccacatcatcccccaggccttcctgaaggacaactccatcgacaacaaggtgctggtgagctccgcgagcaaccgcgggaagtccgacgacgtcccgagcctcgaggtggtgaagaaacggaagacgttctggtaccagctgctcaagagcaagctgatctcccagcgcaagtttgacaacctgaccaaagcagagcgtggcggcctgagccccgaggacaaggccgggttcatccaacgccagctcgtcgagacccggcagatcaccaagcacgtggcgcgcctgctggacgagaagttcaacaacaagaaggacgagaacaaccgggccgtgcgcacggtcaaaatcatcaccctcaagtccaccctggtgagccagttccgaaaggacttcgagctgtacaaggtgcgcgagatcaacgacttccaccacgcccacgacgcctacctcaacgccgtggtggcgtccgccctgctgaagaagtaccccaagctcgagcccgagttcgtgtacggcgactacccgaagtacaatagcttccgggaacgcaagtccgccaccgagaaggtctacttctacagcaatatcatgaacatattcaagaagtccatcagcctggccgacgggcgggtgatcgagcgccccctgatcgaggtgaacgaggagaccggcgaatccgtctggaacaaggagagcgacctcgcgacggtgcggcgcgtcctgtcctacccccaggtcaacgtggtgaagaaggtcgaggagcagaaccacgggctggaccgggggaagcccaagggcctcttcaacgccaacctgagctccaagccgaagcccaacagcaacgaaaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgatcgcatcaactaccggaaggacaagctgaacttcctgctcgagaaggggtacaaggacatcgagctgatcatcgagctgccaaagtacagcctcttcgagctgagtgacggctcccgccgcatgctggcgagcatcctctccacgaacaacaagcgcggggagatccacaagggcaaccagatcttcctgagccagaagttcgtgaagctgctctaccacgccaagcggatctccaacaccataaacgagaaccaccggaaatacgttgagaaccacaagaaggagttcgaggagctgttctactacatcctggagttcaacgagaactacgtcggggccaagaagaacgggaagctcctgaacagcgcctttcagtcctggcagaaccacagcatcgacgagctgtgctctagcttcatcggccccacagggtccgagcgcaagggcctcttcgaactgaccagccgggggtccgccgcggacttcgagttcctgggcgtgaagatcccccgctaccgggactacacgcccagctccctcctcaaggacgctaccctgatccaccagagcgtcacggggctctacgagacccgcatcgacctggccaagttgggagagggcaagcggccggccgccacgaagaaggcgggtcaggccaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 8152 - RNA, 3955 nt, synthetic construct
  misc_feature 1..3955: note = Cas9 variant mRNA product
  source 1..3955: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccgaaaaagaaacgcaaagtgggcatccacggagtaccagccgctgccgccttcaaaccaaacagcataaattatatcctcggcctagatatcggtatcgcctccgtagggtgggccatggtcgagattgatgaagaagaaaacccaatcaggctcatagacctaggcgtacgagtcttcgaacgcgccgaagtcccaaaaacaggagattccctcgctatggcacgaagactagcaagaagcgtgagacgacttacccgccgacgcgcccaccgcctcctccgaactcgtcgcctcctaaagcgcgaaggagtcctccaagccgccaatttcgacgaaaacggtctaatcaaaagcctccccaacacgccatggcaactccgagcagcggccctagaccggaaactaacacccctagaatggtccgctgtcctactgcacctcatcaaacaccgcggatacctaagccagaggaaaaacgaaggagagaccgccgacaaagaactaggcgcgctactgaaaggtgtagcaggcaacgcacatgccctacagacgggtgactttcgaacaccggcagagctcgcacttaacaaattcgaaaaagaatctggacatatccgaaatcaaagatccgactacagccacacattcagccgaaaagatctacaagccgaactcatccttctattcgaaaaacaaaaagagttcggaaatccccacgtatcgggcggactgaaggaagggatcgaaaccctactcatgacacaacggcccgccctatcaggcgatgccgttcagaaaatgctaggccactgcacattcgaaccagccgaaccaaaggcggccaaaaacacctacacagcggaacgcttcatctggttaactaaactgaataacttacgcatactcgaacaaggctctgaacgacccctcacggatacagaacgcgcaaccctaatggacgagccctaccgcaaaagcaaactgacctatgcacaagcgagaaaactcctaggactcgaagacacagccttcttcaaaggtctcaggtacggaaaagataacgccgaggccagcacactcatggaaatgaaagcctaccatgccatcagccgagccctggaaaaagagggcctcaaagataagaaaagccctctcaaccttagccccgaacttcaagatgaaatcggaaccgcatttagcctcttcaaaacagacgaagacatcaccggacgactgaaagaccgcatccaaccagagatactcgaggcgctgctaaaacacatatccttcgacaaattcgtacaaatcagcttaaaggcactacgccggatagtacccctaatggaacaagggaaacgatacgacgaagcatgtgccgaaatatacggtgatcactacggaaagaaaaacactgaagaaaagatctacctcccaccaatacccgccgacgaaataaggaaccccgtagtactacgtgccctctcacaagcacgcaaagtcattaacggagtagtcagaagatatggcagccccgcgcggatccacatcgaaacagcccgcgaagtaggcaaatctttcaaagatcgcaaagaaatcgagaaaagacaagaagagaatagaaaagatcgagagaaagccgccgcaaaattccgagaatatttccccaacttcgtcggtgaaccaaaaagtaaagacatcctcaaactccgcctctatgagcaacagcacggaaaatgcctatacagcggaaaagaaatcaacctcggccggctaaacgagaagggatacgtagaaatagaccacgccctcccattctcgcgaacatgggacgactcttttaataacaaagtcttagtcctcggatcagagaaccaaaacaaaggaaatcaaacgccatacgagtacttcaacggcaaggacaacagcagagaatggcaagagttcaaagcacgagtggaaacctcccgattcccacgctccaagaaacaaagaatcctactccagaaattcgacgaagacgggttcaaagaacgcaacctgaacgatacacggtacgtcaaccgcttcttatgccaattcgtggcggaccgcatgcgcctcacgggaaaaggtaagaaacgggtattcgccagcaacggacagataacgaacctcctccggggattctggggcctccgaaaagtccgggcagaaaacgaccgacaccacgcgctagacgcggttgtcgttgcttgcagcaccgtcgccatgcagcagaaaataaccagatttgtcagatacaaagagatgaacgcctttgacggaaaaactatcgacaaagagacaggcgaagtactacaccaaaagacacacttcccgcaaccatgggagttcttcgcccaagaagtcatgataagggtattcgggaaaccagacggcaaaccagagttcgaagaagcagacaccctagaaaagctccgcaccctactggcagaaaagttgagcagccgccccgaagccgtacacgaatacgtaacaccactcttcgtctcccgagcacccaaccgaaaaatgagcggccaaggccacatggaaaccgtaaaatccgccaagcgcctggacgaaggcgtctccgtactaagagtacccctcacccaactcaagctaaaagacctggagaaaatggttaacagagaaagagaaccaaagctatatgaggccctcaaggcgcgcctcgaggcacacaaagacgacccagcaaaagcattcgctgaacccttctataaatacgataaagccgggaacagaacacaacaggtaaaggccgtccgggtagaacaggtacagaagaccggagtctgggtccgaaaccataatggcatcgcagacaacgcaacaatggtacgcgtcgatgtgttcgaaaaaggcgacaagtactacctagtacccatatacagctggcaggtcgcgaaaggcatcctaccggacagggccgtagtccagggcaaagatgaagaagactggcagctaatcgatgattccttcaactttaaattcagcctacacccaaatgacctcgtagaagtaatcaccaaaaaggcaagaatgttcggatacttcgccagctgccacagaggaaccggaaacatcaacattcggatacacgacctcgatcacaaaataggcaagaatggcatactcgagggcataggggtcaaaaccgcactatccttccagaagtaccaaatcgacgagcttggaaaagaaatccggccctgtcgactgaagaaaaggccaccagttcggaagagaccggccgccaccaaaaaggcaggtcaagccaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 8153 - RNA, 4711 nt, synthetic construct
  misc_feature 1..4711: note = Cas9 variant mRNA product
  source 1..4711: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgaagaagccatacaccatcggcctggacatcgggaccaacagcgtgggctgggccgtgctcaccgaccagtacgacctggtcaagcggaagatgaagatcgccggggactccgagaagaagcagatcaagaagaacttctggggcgtgcgcctgttcgacgagggccagaccgccgctgaccggcgcatggcgcggaccgcccgccggcgcattgagcggcgccggaaccgcatcagctacctccagggaatcttcgccgaggagatgtccaagaccgatgccaacttcttctgccggctgagcgactccttctacgttgacaacgagaagcgcaacagccggcaccccttcttcgcgacgatagaggaggaggtcgagtatcacaagaactaccccacaatctaccacctccgcgaggaactcgtgaactccagcgaaaaggccgacctgcgtctagtgtacctcgccctggcccacatcatcaagtaccgcggcaacttcctgatcgagggggccctcgacacccagaacacctccgtcgacggcatctacaagcagttcatccagacgtacaaccaggtgttcgcgtccgggatcgaggacggctcccttaagaagctggaggacaataaggacgtggccaagatcctcgtcgagaaggtgacccggaaggagaagctggagcgcatcttaaagctctacccgggcgagaagtccgccgggatgttcgcccagttcatcagcctaatcgtgggcagcaaggggaacttccagaagcccttcgacctgatcgagaagtccgacatcgagtgcgccaaggactcgtacgaggaggacctcgagtccctgctggcgctcatcggggacgagtacgccgagctgttcgtcgccgccaagaatgcctacagcgcggtggtgctgagtagcatcatcaccgtcgccgagaccgagacgaacgccaagctcagcgcctccatgatcgagcggttcgacacccacgaggaggacctgggcgagctgaaggcattcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaagagaacttcctgcgcaagcagcgcacattcgacaacggggcgattccccaccaactgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgattttggcaagtccgccgtagacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcgtatttcagcggccaggagaaggagcagatcttcaacgacctgttcaagcagaagcggaaggtcaagaagaaggacctcgagctgttcctgcgtaacatgtcccacgtggagagccccacgatcgaggggctggaggactccttcaacagctcctacagcacctaccacgacctcctgaaggtgggcatcaagcaggagatcctggacaaccccgtcaacacagagatgctcgagaatatcgtgaagatcctgacagtgttcgaggacaagcggatgatcaaggagcagctgcagcagttctccgacgttctcgacggcgtggtgctgaagaagctggagcgccggcactacacggggtggggccgcctcagcgccaagctgctgatggggatccgggacaaacagtcccacctcaccatcctggactacctgatgaacgacgacggcctcaatcgcaacctgatgcagctgatcaacgacagcaacctttcattcaagagcatcatcgagaaggagcaggtcaccaccgccgacaaggatatccagagcatcgtggccgacctggcgggatccccggccatcaagaagggcatcctgcagagcctcaagatcgtggacgaactggtctccgtgatgggctacccgccccagacgatcgtggtcgagatggcccgggagaaccagactaccgggaagggcaagaataacagccgcccccggtacaagtccctggagaaggccatcaaggagttcgggagccagatccttaaggagcaccccaccgataatcaggagctgcgcaacaaccgactgtacctctactacctgcagaacggcaaggacatgtacacgggccaggaccttgacatccacaacctctccaactacgacatcgaccatatcgtgccccagagcttcatcaccgacaactccatcgacaacctggtgctgaccagctccgccgggaaccgcgaaaagggcgacgacgtcccgcccctcgagatcgtgcgcaagcgcaaggtgttctgggagaagctgtaccaggggaacctgatgagcaagcgcaagttcgactacctgaccaaggcggagcggggcgggctgaccgaagccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccaactctacaaggtgcgcgacgtcaacgactaccaccacgcccacgacgcctacctgaacggcgttgtggcgaacactctgctcaaggtctacccccagctggagcccgagttcgtgtacggggactaccaccagttcgactggttcaaggccaacaaggcgaccgccaagaagcagttctacaccaacatcatgttgttcttcgcccagaaggaccggatcatcgacgaaaacggtgagatcctctgggataagaagtacctggacaccgtgaagaaggtcatgtcctaccgccagatgaacatcgtgaagaagacggagatccagaagggggagttctcgaaggccaccatcaagcccaagggcaactccagcaagttaatcccccggaagaccaactgggacccgatgaagtacgggggcctcgacagccccaacatggcctacgcggttgtcatcgaatacgccaagggcaagaacaagctggtgttcgagaagaagatcatccgcgtgaccatcatggagcggaaggccttcgagaaggacgagaaggccttcctggaggagcaggggtaccgccagccgaaggtcctcgccaagctgccgaagtacacgctgtacgagtgcgaggagggccggcgccggatgctcgcgtccgcaaacgaggcccagaaggggaaccagcaggtcctgcccaaccacctggtgaccctcctgcaccacgccgcgaactgcgaggtgagcgacggcaagtccctggactacatcgagagcaaccgcgagatgttcgcggaactcctggcccatgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaaattcttcgagaccacgatcgagcgcaagcggtacaacaacctcaaggagctgctgaacagcaccatcatctaccaatccatcaccggcctctacgagtctcgcaagcgcctcgacgacaagcggcccgccgccaccaagaaggcagggcaggcgaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 8154 - RNA, 4744 nt, synthetic construct
  misc_feature 1..4744: note = Cas9 variant mRNA product
  source 1..4744: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggctcccaagaagaaacgcaaggtgggcatccacggggtcccggcagcgaagaagccctacagcatcggcctggacatcggcaccaattccgtgggttgggccgtggtaaccgacgactacaaggtgcccgccaagaagatgaaggtgctcgggaacacggacaagagccacatcgagaagaacctgctgggcgccctactgttcgactccggcaataccgccgaggatcggcgcctaaagcggaccgcgcgcagacgatacacccggcgccggaaccgcatcctctaccttcaggaaatcttctcagaggagatgggaaaggtcgacgactccttcttccaccggctggaggacagcttcctcgtgacggaagacaagcgaggcgagcggcaccccatcttcgggaacctggaggaggaagtgaagtaccatgagaacttcccgaccatctaccacctccgccagtacctggccgacaatcccgagaaggttgacctgcggctggtgtacctcgccctggcccacatcatcaagttccgcgggcacttcctgattgaggggaagttcgacacgcggaacaacgacgtgcaacgcctctttcaggagttcctggcggtctatgataacacgttcgagaactccagccttcaggagcagaacgtccaggtggaggagatcctcaccgacaagatctctaaaagcgccaagaaggaccgggtgctgaagctgttccccaacgaaaagtccaacggccgcttcgccgagttcctcaagctgatcgtgggcaaccaggccgacttcaagaagcatttcgagctggaggaaaaggccccgctacagttcagtaaggacacctacgaggaggagctggaggtgctgctcgcgcagataggtgataattacgccgagctgttcctgtccgccaaaaagctgtacgacagcatcctgctgtccggcattctaacagtcaccgacgtgggaacgaaggccccgcttagtgcttcaatgatccagcggtataacgaacaccagatggacctggcgcagctaaagcagttcataagacagaagctgagcgacaagtacaacgaagtgttctccgacgtcagcaaggacggctatgccggctacatcgacgggaagaccaaccaggaggccttctacaagtacctgaaggggctcctgaacaagatagaggggagcggctacttcctggacaagatagagcgcgaggacttcctacggaagcagcgtactttcgacaacgggtccataccccaccagatccacctccaggagatgcgggccatcatccgccgtcaggcagagttctaccccttcctcgcggacaaccaggaccgcatcgagaagctgctgaccttcagaatcccctactacgtggggccgctggcccgcggcaagagcgactttgcctggctgtcccgtaagagcgccgacaagataacgccctggaacttcgacgagatcgttgacaaggagagcagcgccgaggcgttcatcaacagaatgaccaactatgacctctacctccccaaccagaaggtcctgcccaagcactccctcctatacgagaagttcaccgtctacaatgagctgaccaaggtgaagtacaaaacggagcaagggaagaccgcgttcttcgacgctaacatgaagcaagagatcttcgacggcgttttcaaagtgtaccggaaggtcactaaagataagctcatggacttcctggagaaggagttcgacgagttccgcatcgtggacctgaccggtctggacaaggaaaacaaggtgtttaacgccagctacggcacgtaccacgacctgtgcaagatactcgataaggacttcttagataactccaagaacgagaagatcctggaggacatcgtcctgaccctcactctgttcgaggaccgggagatgatccgcaagcggctggagaactatagcgacctcctgacaaaggagcaggtcaagaagctggagcgccggcactacactgggtggggtcgcttgtccgcggagctaatccacggcatccggaacaaggagagcaggaagaccatcctagactacttaatcgacgacgggaactccaacaggaacttcatgcagctgatcaacgacgacgccttgtcttttaaggaggaaatcgccaaggcccaggtgatcggcgagaccgacaacctcaaccaagtggtgtccgacatcgccgggtctccggcgatcaagaagggcatcctgcagtccctgaaaatcgtggacgagctcgtcaagatcatgggccaccaacccgagaacatcgtggtggaaatggcccgtgaaaaccagttcaccaatcagggtcgccggaacagccagcagcgactgaagggcctgacggactccatcaaggagttcgggagccagatcctcaaagaacacccagtcgagaacagccaactgcagaatgaccgactgttcctctactacctgcaaaacgggcgcgacatgtacaccggggaggagctggacatcgactacctctcccagtacgatatcgaccacataatcccccaagccttcatcaaagacaacagcatcgataaccgggtgctgacctccagcaaagagaacaggggcaagtccgatgacgtacccagcaaggacgtcgtgcggaagatgaagtcctactggagcaagctgctctccgccaagctgatcacccagcgcaagttcgacaacttgacgaaggctgagcggggcgggctcaccgacgacgacaaggcgggcttcatcaagcgccagcttgtggagacccggcagatcaccaagcacgttgcccggatcctggacgagcggttcaacaccgagacggacgagaacaataagaaaatccgccaggtgaagatcgtgaccctcaagagcaacctggtctccaacttccggaaggagttcgaactgtacaaggtccgagagataaatgactaccaccacgcccacgacgcctacctcaacgccgtgatcgggaaggcgctgctgggcgtctacccccagctcgagcccgagttcgtttacggggactacccccacttccacggccacaaggagaacaaggccaccgccaagaagttcttctacagcaacatcatgaactttttcaagaaggacgatgtgcggactgacaagaacggcgagatcatctggaagaaagacgaacacataagtaacatcaagaaggtcctgagctacccccaggtgaacatcgttaaaaaggtcgaggagcagaccggaggcttctccaaagagtcgatcctccccaaggggaactccgacaaacttatcccccgcaagacgaagaagttctactgggacaccaagaagtacggcgggttcgacagccccatagtggcctacagcatcctggtgatcgcagacatcgagaagggcaagtccaagaaactgaagaccgtcaaggcactcgtgggcgtaacgataatggaaaagatgaccttcgagcgggacccggtcgccttcttggagcgcaaggggtatcgcaatgtgcaggaggagaacatcatcaagctgcccaagtatagcctcttcaagctcgagaacgggcggaagcgcctgctagcctccgccagggagctgcagaaggggaacgaaatcgtgctgcccaaccaccttggaaccctgttataccacgcgaagaacatccacaaggtcgatgagccgaagcatctcgactacgtggacaaacacaaggatgagtttaaggaactgctggacgtggtctcaaacttctccaagaagtacaccctcgccgagggtaatctagagaagatcaaggagctgtatgcccagaacaacggcgaggacctcaaggagctcgctagcagtttcatcaaccttctcactttcacggccatcggggcgcccgccaccttcaagttcttcgataagaacatcgaccgcaagcggtacaccagcacgaccgagatcctgaacgccacgcttatccaccagtccataaccggactctacgagacgcgcatcgacctgaacaagctgggcggggacaagcggcccgccgccaccaagaaggcgggccaagccaaaaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 8155 - RNA, 3877 nt, synthetic construct
  misc_feature 1..3877: note = Cas9 variant mRNA product
  source 1..3877: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacctaaaaagaaacggaaagtgggcatacacggcgttccagccgcacaaacaaccaacctcagttacatactaggtctagacctcggtatcgcatcagtcggctgggccgtcgtcgaaatcaacgaaaacgaagaccccatcggactaatagacgtcggcgtaaggatattcgaacgcgccgaagtcccaaaaaccggagaaagcctagcactgtccaggagactcgcgcggagtacccgccgcctaatacgccgccgagcccaccgcctactcctcgcgaaacgcttcctcaagagagaaggcatactgagcaccatagacctcgagaaaggcctgccaaaccaggcctgggagctaagagtcgccggcctcgaaaggcgactatcggccatcgaatggggagccgttctcctgcacctaataaaacacagggggtacctatcgaaaagaaagaacgagagtcaaacgaacaacaaggagctgggcgccctgctaagcggagtggcgcaaaaccaccagctcctacaatccgacgactaccgaacacccgcagaattagccctcaagaaatttgcaaaagaagaggggcacataagaaaccaacgcggcgcttacacacacaccttcaatagattagacctcttagcagaactgaacctgctattcgcacaacagcatcaattcggaaacccacactgtaaagagcacatccagcaatacatgactgaactcctaatgtggcagaaacccgcactcagtggcgaggccatcctaaaaatgctcggaaaatgcacacacgagaaaaacgagttcaaagccgcgaaacatacctacagcgccgaacgttttgtttggctcaccaaactcaataaccttcgaatactcgaagacggggccgaacgggcactaaacgaagaagaaagacaactactaatcaaccacccgtacgaaaagagcaaactaacatacgcgcaggtacgaaaattactaggcctctccgaacaagctattttcaagcacctacgctacagtaaagaaaacgcagagtcagccaccttcatggagctcaaagcctggcacgccatacgaaaagcactcgaaaaccagggcctgaaggacacctggcaggacctcgccaagaaacccgatctcctcgacgaaatcggaaccgccttctcactctacaaaacagatgaagacatccaacaatacctaacgaacaaagtacccaacagcgtaataaacgcactactcgtatccctgaacttcgataagttcatcgaactcagcctgaaaagcctgagaaaaatacttcctctaatggaacaaggcaaacgctacgatcaggcctgccgcgagatctacggacatcactacggggaggccaaccaaaagacgtcacaactcctgcccgccattccagcccaagaaatacgcaaccccgtagtcctgcgaacgctgtcccaagcaagaaaagtaataaacgccatcatacgacaatacggctcccccgcccgagtccacatagaaacgggtcgagaactagggaaatccttcaaagaacgacgcgaaatccaaaaacagcaggaggataatcgaaccaaacgcgagtcagcggttcaaaagttcaaggaactcttctccgacttcagcagcgaaccaaaatctaaagacatactcaagttccgcctttacgagcaacaacacggtaaatgcctatactcgggcaaagaaatcaacatacacaggctgaacgaaaaaggatacgtcgagatcgaccacgcactacccttcagtcggacctgggacgactcattcaacaataaagtacttgtcctagcaagcgagaaccaaaacaaaggcaaccagacaccatacgagtggctacaagggaaaataaactccgaacgctggaaaaacttcgtcgcactggtactcggcagccagtgctcagccgcgaagaaacaacgcctcttgacccaggtcattgacgacaacaaatttatcgaccgcaaccttaacgacactcgatacatcgcacgcttcctatcaaactacatccaggaaaacctcctactcgtcggcaaaaacaaaaagaacgtattcacgccaaacggccaaatcacagccctgctccggtcgcgatggggactaatcaaagctcgagaaaacaacaaccgacaccatgccctagatgcgatcgtggtcgcttgcgcgaccccctcaatgcaacagaaaataacccgcttcatccgatttaaagaagtccacccctacaaaatagaaaaccgatacgaaatggtcgaccaagagagtggagaaattataagcccccacttccccgagccatgggcatacttcaggcaagaggtaaacatccgagtattcgacaaccaccccgacacggtgctaaaagagatgctcccggaccggccacaggcaaaccaccaattcgtacaacctctattcgtctcccgagcgcccaccagaaaaatgtccggccaaggccacatggaaaccatcaagtccgccaaacggctggcagaaggcatctccgtactccgaatacccctaactcaactcaaacccaatctcctggaaaacatggtaaataaggagcgcgaacccgccctgtacgcaggccttaaagcccgactcgccgagttcaaccaggaccccgcaaaagccttcgccacaccattctacaaacaaggcggccagcaggtaaaagcaatccgagtagagcaagtacaaaaatcaggagtcctagtacgcgaaaacaacggagtcgccgacaatgcctcaatcgtacgaaccgacgtattcatcaaaaacaacaaattctttctcgtccccatctacacgtggcaagtagcaaagggaatcctaccaaacaaggcaatcgtcgcacacaaaaatgaagacgaatgggaagaaatggacgaaggtgccaaattcaagttctctctcttccccaacgaccttgtcgaactaaaaaccaagaaagaatacttcttcggctactacatcggactggaccgggcaacagggaacataagcctaaaagagcacgacggcgaaatctccaaaggcaaagacggagtctacagggtaggcgtcaaacttgcactgagctttgaaaaataccaagtagatgagcttgggaaaaaccgacaaatctgccgaccccaacaaagacaacctgtcagaaagagaccagccgcaactaaaaaggcaggacaagccaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 8156 - RNA, 3955 nt, synthetic construct
  misc_feature 1..3955: note = Cas9 variant mRNA product
  source 1..3955: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacccaaaaagaaacgcaaagtcggaatccacggagtaccagcagcagccgcctttaaaccaaacccaatcaactacatactcggattagacatagggatagcatcagtcggatgggccatggtcgagatcgacgaggacgaaaaccccatatgcctcatagacctgggggttagggttttcgagcgtgcagaggttccaaaaacaggcgacagcctagcaatggcacgtagactagcgcgctctgtccgcagactcacgagacgacgggcccacagactgctaagagcccgccgcctgctcaaaagagaaggagtcctacaagccgccgactttgacgaaaacggactcataaaaagcctccccaacacaccctggcaacttcgggcggccgccttagaccgaaaactcacacccctcgagtggtccgccgtgctactgcacctgatcaaacatcgaggatacctcagccaacgcaaaaacgagggagaaacggcagacaaagagctcggcgcactgcttaaaggcgtagcggacaacgcacacgcactacagacgggggacttccgcacgccagccgagctcgcactcaacaaattcgagaaagaaagcggtcacatccgaaaccagcgcggagactactcccacacattctcccgaaaagacctgcaagccgaactcatcctactattcgaaaaacagaaagagttcggcaacccacacgtatcaggcggtctaaaagaaggtatagaaacactcctcatgacccaaagaccggccctgtcaggagacgcagtccagaaaatgctcgggcattgcacattcgaaccagcagagcccaaggcagctaaaaacacatacaccgcagaacgattcatctggctgaccaagctcaacaacctcagaatattagaacaagggtctgaacgccccctgactgacacggaacgcgcaacactcatggacgaaccgtaccgcaaaagcaaactcacctacgcacaagcccgtaaactactgggcctcgaagacacagctttcttcaagggtctgcgatacggaaaagacaacgcagaagcatcaacattaatggaaatgaaggcttaccatgccatcagccgagccctagaaaaggaaggcctaaaagataagaaaagtcccctaaacctgtcgcccgagctacaagatgaaatcggcacagccttctcgctttttaaaaccgacgaggacatcacagggcgactcaaagaccgaatacaacccgagattctggaggcgctcctcaaacacatatcattcgacaaattcgtccaaatatccctcaaagcactacgcagaatcgttcctctcatggaacaaggcaaacgctacgatgaagcctgcgcagaaatatatggagaccattacgggaaaaagaacaccgaagagaaaatctatctgcccccgatcccagcggacgaaatacggaatcccgtcgttctgcgagcgctatcccaagcgagaaaagtaatcaacggggtcgtcagacgctacggcagtcccgcaagaatacacatagaaaccgcccgagaggtcggcaaatccttcaaagaccgcaaagagatcgaaaaacgccaagaagaaaatcgcaaggaccgagaaaaagcggcagcgaaattcagagaatacttcccaaacttcgtcggggaacccaaatccaaagatatcctaaaactccgcctatatgaacaacagcatggcaaatgcctctacagcggtaaggaaatcaacttaggaagactgaacgaaaaaggctacgtggaaatagaccacgcgctcccattcagccgcacttgggacgactcattcaacaacaaagtgctggtcctcggctcagagaaccagaataaagggaatcaaaccccctacgaatacttcaacggcaaagacaacagccgcgaatggcaagagttcaaggcacgagtggagacctcgcgcttccccagaagcaagaaacagcgaatactcctacagaaattcgacgaagatggcttcaaagaaaggaacctaaatgacacacgctacgtaaaccgctttctttgccaattcgtagcagaccggatgcggctcactggaaagggcaaaaagagagtcttcgcatccaacggacaaatcactaacctgctgaggggattctggggattacgcaaagtccgggcagagaacgaccgacaccatgcgctcgacgccgtagtcgtagcatgcagcaccgtagccatgcaacagaaaatcacgcgcttcgtgagatacaaggaaatgaacgcattcgacggaaagaccatcgacaaagagaccggagaagtcctacaccagaagacccatttcccccaaccctgggagttcttcgcccaggaagtcatgatacgcgtcttcggcaaacccgacggaaagccagagttcgaagaagcggacacgccagaaaaactaagaacgctgctcgccgagaaacttagctccagacctgaagcagtacatgaatatgtaaccccactcttcgtaagccgagccccgaaccgcaaaatgtccggccaggggcacatggaaacagtaaaatcagccaaacgcctagacgagggcgtgagcgtactaagggtaccgcttacacaactcaagctaaaagacctagagaaaatggtcaaccgcgagcgcgaaccaaagctctacgaggcccttaaggctcggctagaggcacacaaagacgacccagccaaagccttcgcggaaccgttttacaaatacgacaaggccggcaatcggactcaacaagtcaaagccgtaagagtagagcaggtccagaaaacaggcgtctgggtacgtaaccacaacggcatagcagacaacgccactatggtacgcgtcgacgtgttcgaaaaaggcgacaaatattatctagtgcccatatacagctggcaagtcgcaaaaggaatcctaccagaccgcgcggtggtccaaggaaaggacgaagaagactggcaactcatcgacgacagcttcaacttcaaattcagcctacaccccaacgacctagtcgaagtcatcacaaagaaggcccggatgttcgggtacttcgcctcctgccaccgcggcaccggtaacataaacataaggatccatgacctcgaccacaaaataggcaaaaacggaatattagaaggcatcggggtaaaaacagcccttagcttccaaaaataccaaatagacgagctaggaaaagaaataaggccctgccgactcaaaaagagaccaccagtgcgcaaaaggcccgcagcaacgaagaaagccggccaagccaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 8157 - RNA, 3961 nt, synthetic construct
  misc_feature 1..3961: note = Cas9 variant mRNA product
  source 1..3961: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccgaagaagaaaaggaaagtcggcattcacggagtcccagccgcaaaataccatgtaggcatagacgtaggaacattcagcgtagggctcgcggcaatagaggtagacgacgcaggtatgcccatcaaaaccctaagccttgtgtcacacatccacgacagcggcctcgatccagatgaaatcaaatcggcggtcacgcgactagcaagcagcggtatcgccagacgaacgcgcagactgtaccgaaggaaaaggagaagactccagcaactggacaaattcatacaacggcaaggatggccagtgatagaattagaggactacagcgacccactatacccctggaaagtaagagccgagctcgcagcaagttacattgcggatgagaaagaacgaggcgagaaattgagcgtggcactgagacatatcgccagacacagaggatggcgcaacccatacgcaaaagtaagcagcctatacctcccagacgggccgtccgacgcattcaaagcgatcagagaagagataaagagggcgagtgggcaaccagtgccagaaacagccacggtgggacaaatggtgaccctatgcgaactaggcacgctgaagctaagaggagaaggcggagtcctgagtgcacggttgcagcaaagcgactacgcccgcgaaatacaagaaatatgccgcatgcaagaaatagggcaagaactctacagaaaaataatcgacgtagtattcgcagctgaaagcccaaaggggagcgccagcagccgagtaggaaaagaccccttacaacccgggaaaaaccgcgcgctaaaggccagcgacgcattccaacgatacaggatagcagccttaataggaaacctaagagtccgagtagatggagagaaacgcatcctcagcgtagaggagaagaacctcgtgttcgaccatctggtcaatctaaccccaaagaaagaaccagaatgggtaacgatcgcagaaatactgggcatagacagagggcagctaataggaaccgccacgatgacggacgacggagaacgcgcgggagcccgaccacctacgcacgacacgaacagatccatcgtgaacagccgaatagccccgctagtcgactggtggaaaacagcgagcgccctcgaacaacatgcaatggtcaaggctctaagcaacgcggaagtagacgacttcgactcaccagagggagcaaaagtccaagcattcttcgccgacctagacgacgacgtccacgcaaaactcgactcccttcatctgccagtcggacgagcggcgtacagcgaagacaccctagtacgattaacacgacgcatgctaagcgacggagtagatctgtacaccgcaagactacaggagttcggcattgaaccaagctggacgccaccaacccccaggatcggagaaccagttggtaacccagctgtagaccgagtactaaaaacagtcagtcgatggcttgaaagtgcgaccaagacttggggagcaccagaacgggtcataatagaacacgtaagggagggatttgtaacagaaaaacgggcgcgagaaatggacggggacatgcgtagacgagcagcaaggaacgcaaaactgttccaggaaatgcaggagaaactaaacgtacaaggaaaaccctctagagcagatctctggcggtaccagagcgtccaaagacaaaactgccaatgcgcatactgcggcagcccaatcacgttcagcaactcagaaatggaccacatcgtgccaagggctgggcagggatccaccaacacgcgcgagaacctagtggcggtgtgccacaggtgtaaccaaagcaaaggaaacaccccgttcgcgatatgggcgaaaaacacctccatagagggcgtaagcgtaaaggaagctgtggaaagaacacgacactgggtcacggacacaggaatgcgctcaaccgactttaagaaatttacaaaggctgtcgtcgagaggttccaaagagcaacgatggacgaagagatagacgcaaggagcatggaatcggtcgcatggatggcaaacgaattgcgcagtcgggtagcacagcacttcgctagccacggaacaacggtacgagtctaccgcggaagcctcacagcggaagcacggagggccagcggcataagcggcaaactaaagttcttcgacggagtcgggaaatctcgcctagaccgcagacaccatgccatagacgcggccgtgatcgcattcacaagtgactacgtggccgagaccctagcagtacgaagcaatttgaagcaaagccaagcgcacagacaggaagccccgcaatggcgagagttcacaggaaaagacgcagaacacagagcggcatggagggtatggtgccagaaaatggaaaaactaagcgcattgctcaccgaagacctcagggacgacagagtcgtcgttatgagcaacgtgcggctacgcctcggcaacggctcggcccacaaagaaacaataggaaaactcagcaaggtcaaactaagctcacaactgtccgtatccgacatagacaaagcgtcgagcgaagcactctggtgcgcgctaacgcgagaacccggatttgaccccaaggaaggcctccctgcaaacccagaacggcacatacgagtaaacggtacacacgtgtatgctggtgacaacatcggattattcccagtctcagcaggaagtattgcgctgcggggaggatacgcagaactcggctcaagttttcaccacgcaagggtatataaaataacaagcgggaagaaaccagcattcgctatgttgagagtatacacgatagacctgctcccctaccgcaaccaagacctattcagcgttgaactaaaaccacaaacaatgtcaatgaggcaagccgaaaagaaactgcgagacgccctcgccaccgggaacgccgaatacctcggctggttagtcgtcgacgacgagctcgtagtagacaccagcaaaatagcaacggaccaagtaaaagcagtcgaagcggagctaggaacgataagacgatggagggtagatggatttttcagcccaagcaaactacgcctaagaccgcttcaaatgtcaaaagaaggcatcaaaaaggaaagcgcaccagagctgagcaagataatcgacagacccggctggctaccagcagttaataaactcttcagcgacggcaacgtcacagtcgtgcgaagggactcgttggggcgggtacggctagaaagcacagcgcacctacccgtcacatggaaggtacaaaagagaccagccgcgacgaagaaggcaggccaggcgaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 8158 - RNA, 3661 nt, synthetic construct
  misc_feature 1..3661: note = Cas9 variant mRNA product
  source 1..3661: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaaacgcaaggtgggcatccacggggtcccggccgcggcccggatactggccttcgacatcggcatcagctccatagggtgggccttcagcgagaacgacgagctcaaggactgcggcgtgcgcatcttcactaaggtggagaaccccaagacaggagagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgatgagagcctcgccaaggcctacaaaggctccctgatcagcccctacgagctgcggttccgcgcactcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacttgtacaaggagtacttccagaaattcaaggagaacagcaaggagttcacgaacgtgcgcaacaagaaggagtcctacgagcggtgcatcgcccagagcttcctgaaggacgagctgaagctcatctttaaaaagcagcgcgagttcgggttctccttcagcaagaagttcgaagaggaggtcctttccgtggcgttctacaagcgggctctgaaggacttcagccacctcgtgggcaactgctccttcttcaccgacgagaagcgcgccccgaagaacagccccctggccttcatgtttgtcgccctgacccggatcatcaatctcctgaacaacctgaagaacaccgagggcatcctctacacgaaggacgacctgaacgcgctgcttaacgaggtgctgaagaacggcaccctgacctacaagcagaccaagaagctcctggggctgagcgacgactacgagttcaaaggggaaaagggcacgtacttcatcgagttcaagaagtacaaggagttcattaaggccctcggggagcacaacctgtcccaggacgacctgaacgagatcgccaaagacatcaccctcatcaaggacgagatcaagctgaagaaggccctggccaagtacgacctcaaccagaaccagatcgacagcttatccaaacttgagttcaaggaccacctcaacatcagcttcaaggcgctaaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgtgcgatcaaggagtaccgcaaggtgctgaacgccctcctgaagaagtacggcaaggtgcacaaaatcaacatcgagctggcgcgggaggtcgggaagaaccactcccagcgcgccaagatcgagaaggagcagaacgagaactacaaggccaagaaagacgcggagctcgagtgtgagaagctgggcctgaagatcaacagcaagaacatcctcaagctgcggctgttcaaggagcagaaggagttctgtgcctactccggggagaaaatcaagatcagcgacctccaggacgagaagatgttagagatcgaccacatctacccatactcccgcagcttcgacgactcctacatgaacaaggtgctggtgttcaccaagcagaaccaggagaagctcaaccagacccccttcgaggccttcggcaacgacagcgcgaagtggcagaagatcgaggtcctggcaaagaacctacccaccaagaagcagaagcggatcctcgacaagaactacaaggacaaggagcagaagaacttcaaggaccgcaacctgaacgacacacggtacatagctcgcctggtgctcaactacaccaaggactacctggacttcctgccgctctccgacgacgagaacaccaagctgaacgacacccagaaggggagcaaggtgcacgtcgaggccaagtccggcatgctgacgagcgctctccggcacacctggggcttctccgccaaggaccgcaacaaccacctccaccacgccatcgatgcggtgataatcgcctacgccaacaacagcatcgtcaaggccttctccgacttcaaaaaggagcaggagagcaacagcgcggagctgtacgccaagaagatctccgagctggactacaagaacaagcggaagttcttcgagcccttcagcggtttccgccagaaggtgctggacaagatcgacgagatcttcgtgtccaaacccgagcggaagaagcccagcggtgccctgcacgaggagaccttccgtaaagaggaggagttctaccagtcctacgggggcaaggagggggtcctcaaggcgctggagctgggcaagatccggaaggtgaacgggaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttttgcttctccctctacaaggacagcctgatcctgatccagaccaaggacatgcaagagcccgagttcgtgtactacaacgccttcacctcctcaaccgtgtccctcatagttagcaagcacgacaacaagttcgagacgctgtccaagaaccagaagatcctgttcaaaaacgcaaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 8159 - RNA, 4072 nt, synthetic construct
  misc_feature 1..4072: note = Cas9 variant mRNA product
  source 1..4072: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgtcggacctagttctcggcctggacatcgggattggctccgtgggggtcgggatcctgaacaaggtgaccggcgagatcatccacaagaacagccggatcttccccgccgcccaggccgagaacaacctagtgcgccggacgaaccgccagggccggcgcctggcccggcgcaagaagcaccggcgcgtccggctgaaccgcctcttcgaggagtccggcctgatcacggacttcaccaagatcagcataaacctgaacccctaccagttacgggtgaaggggctgaccgacgaactgtccaacgaggagctgttcatcgcgctgaagaatatggtgaagcaccgcggcatcagctacctggatgacgcctccgacgacgggaacagctccgtcggcgattacgcccagatcgtgaaggagaatagcaagcagctcgagaccaagacgcccggacagatccagctggagcggtaccagacctacgggcagctgcgcggcgatttcaccgtggagaaagacgggaagaagcaccgactcatcaacgtcttcccgacctccgcctaccgaagcgaggcgctgcggatcctgcaaactcagcaggagttcaacccccagatcaccgatgagttcatcaaccgctacctcgagatcctgaccggcaagcggaagtactaccacggccccgggaacgagaagtcccgcaccgactacggccgctatcggacgagcggggagaccctggacaacatcttcggcatcctcatcgggaagtgcaccttctaccccgacgagttccgcgccgccaaggcctcctacaccgcccaggagttcaaccttttaaatgacctcaacaacctgacggtgccgaccgaaaccaagaagctcagcaaggagcagaagaaccagatcatcaactacgtgaagaacgagaaggctatgggccccgccaagctgttcaagtacatcgccaagctcctgtcctgcgacgtcgccgacatcaagggctaccggatcgacaagagcgggaaggccgagatccataccttcgaggcgtaccgcaagatgaagacgctcgagaccctggacatcgagcagatggacagagagaccctggacaagctcgcctacgtactgaccctgaacacggagcgcgagggcatccaggaggccctcgagcacgagttcgccgacgggtccttcagccagaagcaggtcgacgagctggtgcagttccggaaggccaacagctccatcttcggcaaagggtggcacaactttagcgtgaagctgatgatggagctcatccccgagctgtacgagaccagcgaggagcagatgaccatcctgacccgcctcggcaagcagaagacaaccagctccagcaacaagactaagtacattgacgagaagctgctgaccgaggaaatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgcctcacagcgtgttccacggccacaagcagctggccaccaagatccggctgtggcaccagcagggcgagcgctgcctctataccggcaagaccatctccatccacgacctgatcaacaacagcaaccagttcgaggtcgaccacatcctgcccctctccatcacgttcgacgacagcctggccaacaaagtgctggtgtacgcgaccgccaaccaggagaaggggcagcggacgccctaccaggccctggactccatggacgacgcctggtcgttccgcgagctgaaggccttcgtccgggagtccaagaccctgagcaacaagaagaaggagtacctcttgaccgaggaggacatctccaagttcgacgtgcgcaagaagttcatcgagcggaacctcgtggacacgcgctacgcgagccgggtcgtgctcaacgccctgcaggagcacttccgcgcccataaaatcgacaccaaggtgtccgtggtgcgcggccagttcaccagccagttaagacgccactggggcatcgagaagacccgggacacgtaccaccaccatgcagtggacgccctcatcatcgcggcctcctcccagctgaacctgtggaagaagcagaagaacaccctcgtcagctactccgaggaccagctgctggacatcgagaccggggagctcatcagcgacgacgagtacaaggagtccgtgttcaaggccccctaccaacatttcgtggacaccttaaagagcaaggagttcgaggattccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctcgagaactaccccaacaagcagatcaacgagaagggcaaggaggttccctgcaacccgttcctcaagtacaaggaggagcacgggtacatccggaaatacagcaagaagggcaacgggcccgagatcaagtccctgaagtactacgacagcaagctgggcaaccacatcgacattacccccaaagactccaacaacaaggtggtcctccagagtgtgtccccctggcgcgccgacgtgtacttcaacaagaccaccgggaagtacgagatcttgggcctgaaatacgcggacctccagttcgagaagggcacggggacctacaagatcagccaggagaagtacaacgacatcaagaagaaagagggcgtcgacagcgactccgagttcaagttcaccctgtacaagaacgacctgctcctggtgaaggacaccgagacgaaggagcagcagctgttccggttcctcagccgcaccatgccaaagcagaagcactacgtggagctaaagccctacgacaagcagaagttcgagggcggagaggccctgatcaaggtcctcgggaacgtggccaactccggccagtgcaagaagggactgggcaagagcaacatctccatctacaaggtgcggaccgacgtcctggggaaccaacacatcattaagaacgagggggacaaacccaagctcgacttcaagcgccccgccgccaccaagaaggcgggccaggccaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 8160 - RNA, 4630 nt, synthetic construct
  misc_feature 1..4630: note = Cpf1 variant mRNA product
  source 1..4630: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggaatccacggcgtcccggccgcgacccagttcgagggcttcaccaacctgtaccaggtgagcaagacgctccggttcgagctgatcccccaggggaagaccctgaaacacatccaggagcagggcttcatcgaggaggacaaggcccgcaacgaccactacaaggaactcaaacccatcatcgaccggatctataagacctacgccgaccagtgcttgcagctggtgcagctcgactgggagaatctgtccgccgccatcgacagctaccgcaaggagaagaccgaggagacccgtaacgcgcttatcgaggagcaggccacctaccgcaacgctattcatgactacttcatcgggcggaccgataacctcaccgacgccataaacaagcgccacgctgaaatctacaagggcctcttcaaggccgagctattcaacggcaaggtactaaagcagttagggacggtgaccaccaccgagcacgagaatgccctactccggtccttcgacaaattcacgacctacttctcaggcttctacgaaaaccgcaagaacgtgttcagcgcagaggacatcagcaccgcaatcccccaccggatcgtccaggacaatttcccgaagtttaaggagaactgccatatcttcacccgtctgatcacggcggtgccgtccctgcgggaacacttcgaaaacgtgaagaaggccatcggaatttttgtcagcacctccatcgaggaggtgttcagtttccccttctacaaccagttgctgacccagacccagatcgacctgtacaaccagctcttgggcgggatctctcgcgaggccggcacggagaagataaagggcttaaatgaggtgctcaacctggccatacagaagaacgacgagacagcccacatcatagcgagcctgccccaccggttcatcccgttattcaaacagatcctgtctgaccgtaacacccttagcttcatcctcgaggagttcaagagtgacgaagaggtcatccagtcgttctgcaaatacaagacccttctgcggaacgagaatgtgctcgagacggccgaggcccttttcaacgaactgaactccatcgacctcacccacatcttcatcagccacaagaaactcgagaccatcagcagcgccctgtgcgaccactgggacaccctccgcaacgccctgtacgagcggcgcatcagtgagctgacgggcaagatcaccaagtccgcgaaggagaaggtgcagcggagcctcaagcatgaagacatcaacctgcaggagatcatctccgccgccggcaaggagctgagtgaggccttcaagcaaaagacctcagaaatcctatcccacgctcatgcggccctggaccagccgttgcccaccacgctcaagaagcaagaagagaaggagatcctgaaatcccagttagacagcctgctcgggctgtaccacctcctcgactggttcgcagtcgacgaatccaacgaggtggaccccgagtttagcgcccgcctgaccggcattaaactggagatggagccgtccctcagcttctacaacaaggcgcgcaactacgccaccaagaagccctactccgtggagaagttcaagctgaacttccagatgcccacgctggccagcggctgggatgtaaacaaggagaagaacaatggggccatactcttcgtgaagaacggcctgtactacctggggatcatgcctaagcaaaagggccggtacaaggccttatccttcgagcccacggagaagaccagcgaagggttcgacaagatgtactacgactacttccccgacgcggccaaaatgatccccaagtgctccacacagctgaaagcagtgaccgcccacttccagacccacacgaccccgattctgttgagtaacaacttcatcgagccgctggagatcaccaaagagatctacgatctgaacaaccccgagaaggagcccaaaaagttccagaccgcctatgcgaaaaagacgggagaccagaaaggctaccgcgaggccctgtgcaagtggatcgacttcacccgggatttcctatccaagtacaccaagaccacgagcatcgacctgagttcactccggccaagctcccagtacaaagatctgggggagtactacgccgagctgaatccgctcctgtatcacatctcattccaacggatcgccgagaaagagatcatggacgccgtagagacgggcaagctctacctcttccagatctacaacaaggacttcgcgaagggacaccacggcaagcctaacctgcacacattgtactggaccggcctcttctcccccgagaacctcgccaagacgagcatcaagctgaacgggcaggccgagctgttctacaggcccaagagccggatgaagcgcatggcccacaggctgggtgagaagatgctgaacaagaagctaaaggaccagaagaccccgatccccgacaccctgtaccaagagctgtatgactacgtgaaccatcgcttaagccacgacctctccgacgaggcgcgtgccttactccccaacgtgatcaccaaggaggtcagccatgagatcatcaaggaccgcagattcacgtccgacaagttcttcttccacgtgccgatcacactgaactaccaggccgctaacagcccctccaagttcaaccagcgcgtcaacgcctacctaaaggagcaccccgagacgcccatcattgggatagaccggggcgagcgcaacctgatctatatcaccgtgatcgacagcacggggaagatcctggagcaacgatccctgaacaccatccagcagttcgactaccagaagaaactcgacaaccgcgaaaaagagcgggtggcggcacgccaggcctggagcgtcgtgggcaccatcaaggacctgaagcaggggtacctgagccaggtgatccacgagatcgtcgacctcatgattcactaccaggccgtcgtggtcctggagaacttaaacttcggcttcaaatcgaaacgcaccggcatcgccgagaaagcggtgtaccagcagttcgagaagatgctcattgacaagttaaactgcctggtgctaaaagattacccggccgagaaggtcggaggcgtgctgaacccctaccagttgacggaccagttcaccagcttcgccaagatgggcacccagtctggcttcctcttctacgtgcccgccccctacaccagcaagatcgacccgctgacggggttcgtagaccccttcgtttggaagaccatcaagaaccatgagagtcggaagcacttccttgaggggtttgacttcctccactatgatgtgaagactggcgatttcatcctgcacttcaagatgaaccgcaacctgagcttccagcgggggctccccggtttcatgcccgcctgggacatcgtcttcgagaagaatgagacccagttcgacgcgaaggggacgcccttcatcgccggcaagcgcatagtccctgtgatcgagaaccaccggttcaccggccgctaccgggatctgtaccccgcaaacgagctgatcgccctcctggaggagaaggggatcgtctttcgagacggctccaacatcctgcccaagttgttagagaatgacgacagccacgcaatcgacaccatggtggccctgattcggtccgtgctccagatgcgcaacagcaacgcggccaccggggaggactacatcaactccccggtccgggacctgaacggcgtgtgctttgatagccgcttccagaaccccgagtggcccatggacgccgacgcgaacggggcctaccatatcgccctgaagggacaactcttgctgaaccacctcaaggagtctaaggacctcaagctgcaaaacggtatcagcaaccaggactggctcgcctatatacaagagctgcggaacaagcgccccgccgcgactaaaaaggctgggcaggccaagaagaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 8161 - RNA, 4609 nt, synthetic construct; identical to SEQ ID NO: 2361
  misc_feature 1..4609: note = Cpf1 variant mRNA product
  source 1..4609: mol_type = other RNA

SEQ ID NO: 8162 - RNA, 4497 nt, synthetic construct
  misc_feature 1..4497: note = Cas9 variant mRNA product
  source 1..4497: mol_type = other RNA
gggagagcggctcggccattttgtcccagtcagtccggaggctgcggctgcagaagtaccgcctgcggagtaactgcaaagaagcttaccatggcccccaagaagaagcgcaaagtgggaatccacggggtgccggcggcggacaagaagtacagcatcggcctggacatcgggaccaactcagtgggctgggccgtaatcaccgacgaatacaaagtccccagcaagaagttcaaggtgctggggaacacggaccggcattccatcaagaagaacctgatcggtgccctgctgttcgactcgggcgagaccgccgaggccacccgcctgaagcgaaccgcgcgccggcgctacacgcggcgcaagaaccggatctgttacctgcaggagatcttctccaacgagatggccaaggtggacgacagcttcttccaccgcctcgaggagtccttcctggtcgaggaggacaagaagcacgagcggcaccccattttcgggaacattgtggacgaagtggcctaccacgagaagtaccccaccatctaccaccttcgcaagaagctcgtcgacagcaccgacaaggccgacctgcggctgatttacctcgcgctggcccacatgatcaagttccgcggccacttcctgatcgagggggacctcaacccggacaactccgacgtggacaagctgttcatccaactggtgcagacctacaaccagctgttcgaggagaaccccatcaacgccagcggcgtcgacgccaaagccatcctgtccgcgagacttagcaagagtcgcaggctcgagaacctgatcgcccagcttcccggggagaagaagaacggcctattcggcaacctgattgccctgagcctcggactgacacccaacttcaagtccaacttcgatctggccgaggatgccaaactccagttgagtaaggacacctacgacgacgacctggacaacctcctggcgcagatcggcgaccagtacgccgacctgttcctcgccgccaagaacctgtctgacgccatcctgctcagcgacatcctgcgcgtgaacaccgaaatcaccaaggcgccgctgtccgcctcaatgatcaagcggtacgacgagcaccaccaggatctcacgctgctgaaggcgctagtgcgccagcagttgcccgagaaatacaaggagatcttcttcgaccagagcaaaaacgggtacgctggctacatcgacggcggggcctcccaggaggagttctataagttcatcaagcccatactggagaagatggacggcaccgaggagttactggtcaagctgaaccgggaggacctgctccgcaagcagcgcaccttcgacaatgggagcatcccccaccagatccacctgggcgagctgcacgcgatcctccggcgccaggaggacttctacccgttcctgaaggacaaccgggagaagatcgagaagatcctcacctttcgcatcccctactacgtggggcccttggcccggggcaactcccgcttcgcctggatgacgcgcaagagcgaggagaccatcactccctggaatttcgaggaggtggtcgacaagggcgccagtgcgcagagcttcattgagaggatgaccaactttgacaagaacctgccgaacgagaaggtgctgcccaagcactccctcctgtacgagtacttcacggtgtataacgaactcaccaaggtcaagtacgtgaccgaggggatgcggaagcccgctttcctcagcggcgagcagaagaaggccatcgtggacttgctgttcaagaccaaccgcaaggtcacggtgaagcagctcaaggaggattacttcaagaagatcgagtgcttcgactccgtcgagatcagcggggttgaggaccggttcaacgcctccctgggcacctaccacgacctgctcaaaatcatcaaggacaaggactttctggacaacgaggagaacgaggacatcctggaggacattgtgctcaccctgaccctgttcgaggaccgcgagatgatagaggagcggctcaagacgtatgcccacctgttcgacgacaaggtcatgaagcaactgaagcgtcggcgctacaccgggtggggccggctcagccgcaagttgatcaacggaatccgagataaacagagtgggaagacaatcctggacttcctaaagagcgacggctttgcaaaccgcaacttcatgcagctgatccacgacgactccttgaccttcaaggaggacatccagaaggcccaagtatctgggcagggagactccctccacgagcacatcgccaacctggccgggtcccccgccatcaagaagggcatcctgcagacggtgaaggtcgtggacgagctagtcaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaagagcaccccgtggagaacacccagctccagaacgagaagctctacctgtactaccttcagaacggccgggatatgtacgtcgaccaggagctggacattaacaggctgagcgactatgacgtggaccacatcgtgccccagtccttcctcaaagacgacagcatcgacaacaaggtcctgacacggtccgacaagaaccggggcaagagcgacaacgtgccctccgaggaggtagtcaagaaaatgaaaaactattggagacagctgctcaacgctaagctgatcacccagcgcaaattcgacaacttgaccaaagccgaacgcgggggcctcagcgagctagacaaggccgggttcatcaagcggcagctggtggagacccggcagatcaccaagcacgtagcccagatcctcgactccaggatgaacacgaagtacgacgagaacgacaaactgatccgggaggtcaaggtgatcaccctcaagagcaaacttgtgtccgacttcagaaaggacttccagttctataaggttagggagatcaacaactaccaccacgcgcacgacgcatacctgaacgccgtggtgggcaccgccctgatcaagaagtacccgaaacttgagagcgagttcgtctacggggactacaaggtgtacgacgtgcgcaagatgatcgcgaagtccgagcaggagatcggaaaggctaccgccaagtacttcttctacagcaacatcatgaacttcttcaagacggagatcaccctggcaaacggcgaaatccggaagcgccccctaatcgaaacgaacggagagaccggcgaaatcgtctgggacaaggggcgggacttcgccacggtgcgcaaggtgctctccatgccccaggtcaatatcgtaaagaagaccgaggtgcagaccggcgggttcagcaaggagtccatcctgcccaagcgcaacagcgataagttaatcgcgcgtaagaaggactgggacccgaagaagtacggcggcttcgactcccccaccgtcgcgtacagcgtgctggtggtcgccaaggtggagaagggcaagagcaagaagttaaagtccgtgaaggagctgctcggtatcacgatcatggagcgcagttccttcgagaagaaccccatcgatttcctggaggccaagggatacaaggaggtcaagaaggacctgatcatcaagctccccaagtacagcctgttcgagctggagaacggccggaaacgcatgctcgcctccgcgggggagctgcagaagggcaacgaactggccctccccagcaagtacgtgaacttcctgtacctggcctcccactatgagaagttaaaaggcagccccgaggacaacgaacagaagcagctgttcgtggagcagcacaagcattatctggacgagatcatcgagcagatatccgagttcagcaaacgggtgatcctcgccgacgccaacctcgacaaggtgctctccgcgtacaacaagcaccgtgacaagcccatccgggagcaggccgagaacatcatccacctcttcaccctgaccaaccttggggcccctgccgcgttcaagtacttcgacaccacgatcgaccggaagcggtacaccagcaccaaggaggtgttagacgcgaccctgatacaccagagtatcacgggcctgtacgagacccgcatcgatctcagccagctcgggggcgataagcggcccgccgccaccaagaaggccgggcaggcgaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8163 - RNA, 5280 nt, synthetic construct; identical to SEQ ID NO: 2363
  misc_feature 1..5280: note = Cas9 variant mRNA product
  source 1..5280: mol_type = other RNA

SEQ ID NO: 8164 - RNA, 3552 nt, synthetic construct
  misc_feature 1..3552: note = Cas9 variant mRNA product
  source 1..3552: mol_type = other RNA
gggagagcggctcggccattttgtcccagtcagtccggaggctgcggctgcagaagtaccgcctgcggagtaactgcaaagaagcttaccatggcccccaagaagaagcgcaaagtgggcatccacggggtcccggccgcgaagcggaactacatcctgggcctcgacatcgggatcaccagcgtgggctacgggatcatcgactacgaaacccgcgatgttatcgacgccggcgtccggctgttcaaggaggccaacgtggagaacaacgaaggccgccggtccaagcgcggggcccggcgcctgaagcggcgccggcgccaccggatccagcgcgtgaagaagctcctgttcgactacaacctgctcacggaccacagcgagctgtcgggcatcaacccctacgaggcccgggtcaagggtctcagccagaagctctccgaggaggagttcagcgcggccctgctgcacctcgccaagcgcaggggcgtgcacaacgtgaacgaggtcgaggaggacaccgggaacgagctctccaccaaggagcagatcagccgcaactccaaggccctggaggagaagtacgtggcggagctccagctcgagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaagacatcaaggagtggtacgagatgctgatgggccattgcacctacttcccggaggagctccgaagcgtgaagtacgcctacaacgccgacctgtacaacgcgctcaacgacctcaacaacctggtcatcacgcgcgacgagaacgagaagctggagtactacgagaagttccagatcatcgagaacgtgttcaagcagaagaagaagcccaccctcaagcagatagccaaggagatcttggtgaacgaggaggacatcaaggggtaccgggtcacctccaccggcaagcccgagttcacgaacctaaaggtgtaccacgacatcaaggacatcaccgcccgcaaggagatcatcgagaacgccgagctcctggaccagatcgccaaaatcctgaccatctaccagagctccgaggacatccaggaggagctcaccaacctgaacagcgagctgacacaggaggagatcgagcagatctccaacctcaaggggtacaccggcacccacaacctgagcctgaaggcgatcaacctcatcctggacgagctgtggcacaccaacgacaatcagatcgccatctttaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctacccaacgacataatcatcgagctggcccgggagaagaacagcaaggacgcccagaagatgatcaacgagatgcagaagcgcaaccggcagaccaacgagcgcatcgaggaaatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtggaccacatcatcccccgcagcgtgtccttcgataacagcttcaacaacaaggtgctggtcaagcaagaggagaactccaagaaggggaaccggacccccttccagtacctgagctccagcgactccaagatcagctacgagaccttcaagaagcacatcctcaacctggccaagggcaaagggcgcatctccaagaccaagaaggagtacctgctcgaggaacgggacattaaccgcttcagcgtgcagaaggacttcatcaaccggaacctggtggacacgcgctacgccacccggggcctgatgaacctcctgcgctcctactttcgcgtcaacaacctggacgtgaaggtcaagagcatcaacgggggcttcacctccttcctcaggcgcaaatggaagttcaagaaggagcggaacaagggctacaagcatcacgccgaggacgcgctgatcattgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcatatcaaggacttcaaggactacaagtacagccatcgcgtggacaagaagcccaatcgggagctcatcaacgacacactgtactccacccgcaaggacgacaaggggaacaccctgatcgtgaacaacctcaacggcctgtacgacaaggacaacgacaagctgaagaagctcatcaacaagagccccgagaagctcctgatgtaccaccacgacccccagacttaccagaagctcaagctgatcatggagcagtacggggacgagaagaacccgctgtacaaatactacgaggagaccggcaactacctcaccaagtactccaagaaggacaacgggcccgtcatcaagaagatcaagtactacggcaacaagctgaacgcccacttggacatcaccgacgactaccccaacagccggaacaaggtggtgaagctctccctgaagccctaccgcttcgacgtctacctggacaacggcgtgtacaagttcgtcaccgtcaagaacctcgacgtgatcaagaaggagaactactacgaggtgaacagcaagtgctacgaggaggctaagaagctgaagaagatctccaaccaggccgagttcatcgccagcttctacaacaacgacctgatcaagatcaatggtgagctctaccgggtcatcggcgtgaacaacgacctgctgaaccgcatcgaggtgaacatgatcgacatcacgtatcgggagtacttagagaacatgaacgacaagcgcccgcccagaatcatcaagaccatcgcgtccaagacccagagcatcaagaagtactcaaccgacatcctggggaacctgtacgaggtaaagagcaagaagcacccccagatcatcaagaagggcaagcgccccgccgccacgaagaaggccggtcaagccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8165 - RNA, 4620 nt, synthetic construct
  misc_feature 1..4620: note = Cas9 variant mRNA product
  source 1..4620: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcgctgttcaacaagtgcattatcatcagcatcaacctggacttctccaacaaggagaaatgcatgaccaagccctacagcataggcctggacatcgggacgaactccgtgggctgggccgtgatcacggacaactataaggtccccagcaagaagatgaaggtgctggggaacacttccaagaagtacattaagaagaacttactgggcgtgctgctgttcgacagcggcatcaccgccgaggggcggcgcctgaagcggaccgcgcgccggcgctacacgcggcgccggaaccgcatcctgtacctccaggagatcttctctaccgagatggccaccctggacgacgcgttcttccagcggctggacgacagcttcctcgtgcccgacgacaagcgcgactccaagtacccgatcttcggcaacctggtggaggagaaggtgtaccacgacgagttccccaccatctaccacctccggaagtacctcgccgacagcacgaagaaggccgacctgcgcctcgtctacctcgccttagcgcacatgattaagtaccggggccacttcctgatcgagggcgagtttaactccaagaacaacgacatccaaaagaacttccaggacttcctcgacacctacaacgccatcttcgagagcgacctgtccctggagaacagcaagcagctcgaggagatcgtgaaggacaagatttccaagctggagaagaaggaccgcatcctgaagctgttccccggggagaagaacagcggcatcttctctgagttcctgaagctgatcgtgggcaaccaggctgacttccggaagtgcttcaacctcgatgagaaggcaagccttcacttctccaaggagagctacgacgaggacctggagaccctcctgggatacatcggcgacgactatagcgatgtcttcctgaaggctaagaagctctacgacgcgatcctgctgtccgggtttctcaccgtgacggacaacgagaccgaggcgcccctgagctccgccatgatcaagcgctacaacgagcacaaggaggacctcgccctcctgaaggagtacatccggaacatcagcctgaagacctacaacgaggtgttcaaagacgacaccaagaacggatacgccggctacattgacgggaagacgaaccaggaggacttctacgtatacctcaagaacctgctggccgagttcgagggcgccgactatttcctcgagaaaatcgaccgcgaggacttcctgcgcaagcagcgcaccttcgacaacgggtccatcccgtaccagatccaccttcaggagatgcgcgccatcctggacaagcaggccaagttctaccctttcctagccaagaacaaggagcggatcgagaagatcctgaccttccgcatcccctactatgtgggcccgctggcgcgggggaacagcgacttcgcttggtccatccgcaagcggaacgagaagatcaccccgtggaacttcgaggacgtgatcgacaaggagagctccgctgaggccttcatcaaccgcatgacgagcttcgacctctacctgcccgaggagaaggtcctgcctaagcactccctcctgtacgagaccttcaacgtgtacaatgagctgaccaaggtgcggttcatcgccgagagcatgcgcgactaccaattccttgactccaagcagaagaaggacatcgtccggctttacttcaaggacaagcgcaaggtgaccgacaaggacatcatcgagtacctgcacgcgatctacggctacgacggcatcgaactcaaggggatcgagaagcagttcaacagcagcctgagcacgtaccacgacctgctcaacatcattaacgacaaagagttcctggacgactccagcaacgaggctatcatcgaggagatcatccacaccttaaccatcttcgaggaccgggagatgatcaagcaacgcctctccaagttcgagaacatcttcgacaagagcgtgctgaagaagctgagccgtcgccactataccggctgggggaagctctccgccaaacttatcaacggcatccgggacgagaagtccgggaatacaatcctggactacctcatcgatgacggcatcagcaatcgcaacttcatgcagctgatccacgacgacgccctgagcttcaagaagaagatccagaaggcgcagattatcggcgacgaggacaagggtaacatcaaggaagtcgtgaagtccctccccggcagcccggccatcaagaagggaatcctgcagtccatcaagatcgtagacgagctggtgaaggtgatgggcgggcggaagcccgagagcatcgtcgtggagatggcccgagagaaccagtacaccaaccagggcaagtccaacagccagcagaggctcaagcgcctggagaagtcactgaaggagctcggcagcaagatcctgaaggagaacatccccgccaagctgagtaagatcgacaacaacgccctacagaacgaccgcctgtatctgtactacctccagaacgggaaggacatgtataccggagacgacctggacatcgaccggctgagcaactacgacatcgaccacataatcccccaggcgttcctcaaggacaactccatcgacaacaaggtgctggtcagctccgccagcaaccgcggaaagtccgacgacttcccgagcctggaggtggttaagaagcggaagactttctggtaccagttgctcaagagcaagctgatttcccagcgcaagttcgacaacctgacgaaggccgaacggggcggcctgctgcccgaagacaaggcaggcttcatccaacgccagctcgtcgaaacccggcaaatcaccaaacacgtggcccgcctgctggacgagaagttcaacaacaagaaggacgagaacaaccgggcggtgaggaccgtaaagatcatcacgctcaagagcaccctggtgtcccaattccggaaagacttcgagttgtacaaggtgcgcgagatcaacgacttccaccatgcccacgacgcctacctcaacgccgtcatcgccagcgcgctgctgaagaagtaccccaagctcgagcctgagtttgtgtacggcgactacccgaaatacaactccttccgtgagcgcaagagcgccaccgagaaggtgtacttctattccaatatcatgaacatcttcaagaagtccatctccctggctgacgggcgggtgatcgagcgccccctgatcgaagtgaacgaggagacgggcgagagcgtgtggaacaaggagtccgacctcgccaccgtccggcgcgtgctgagctacccccaggtgaacgtcgtaaagaaggtggaggaacagaaccacgggctggaccggggcaagcccaagggcctcttcaacgcgaacctgtccagcaagccgaagcccaactccaacgagaacctggtcggggccaaggaatacctcgaccccaagaagtacggcgggtacgccggcatcagcaactccttcgccgtgctggtcaaggggacgatcgaaaagggagccaagaagaagatcaccaacgtcctggagttccagggcatcagcatcctcgaccgcatcaactaccggaaagacaagctgaacttcctgttagagaaggggtacaaggacatcgagctgatcatcgaactgccgaagtactcactcttcgagctgtccgacggcagccgccggatgctcgcgtcgatcctcagcaccaacaataagcgtggggagatacataagggcaaccagattttcctgtcccagaagttcgtgaagctgctctaccacgccaagcggatcagcaacaccatcaacgagaaccaccgaaaatacgtggagaaccacaagaaggagttcgaggagctgttctactacatcctggagttcaacgagaactacgtcggtgccaagaagaacggaaagctcctgaacagtgccttccagagctggcagaaccattcgatcgacgagctatgcagctccttcatcggccccacggggagcgagcgcaagggcctcttcgagctaacatcccgggggagcgccgcagactttgagttcctgggcgtgaagataccccgctaccgggactacaccccctccagcctcctgaaagacgccaccctgatccaccagtccgtgacggggctgtacgagacccgcatcgacctcgccaagctgggcgagggcaagaggccggccgccaccaagaaggcagggcaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8166 - RNA, 3696 nt, synthetic construct
  misc_feature 1..3696: note = Cas9 variant mRNA product
  source 1..3696: mol_type = other RNA
gggagagcggctcggccattttgtcccagtcagtccggaggctgcggctgcagaagtaccgcctgcggagtaactgcaaagaagcttaccatggcacccaaaaagaaacgcaaagtaggaatacacggagtgccggcagcatggtacgcgagccttatgagcgcccaccatctacgcgttggaatcgacgtaggcacccacagcgtaggactagccacactccgagtagacgaccacggaaccccaattgaattactatcggcactgagccacatccacgatagtggagtcgggaaagaaggaaagaaagaccacgacacacgaaagaaactgtcaggaatagcaagacgcgctcgaagactattacaccaccgacgaacacagctccaacaactagacgaagtcctacgagatctaggcttcccaatcccaacaccgggagagttcctagacttaaacgaacaaaccgacccataccgcgtgtggcgagtccgagcacgactcgtggaagagaaactcccagaggaattacgcggaccagccataagcatggcagtgaggcacatcgcccgacaccgagggtggaggaacccgtatagtaaagtagaatccctactaagccccgccgaggaaagcccattcatgaaagcactccgcgaacgaatcctcgcaaccaccggcgaagtactagacgatggcataacgccgggccaagctatggcccaagtcgcactgacccataacatctcaatgcgcggaccagaaggcatactaggaaaactacaccaatccgataacgcaaacgaaatccggaaaatatgtgcccgccagggggtcagccccgacgtttgcaaacagctactccgggccgtattcaaagccgactcacctagaggcagcgccgtgagtagagtagcacccgatccccttcccggtcaggggagcttccgcagagccccaaaatgcgacccagagttccagcgcttccgaataatatccatagtggcaaacctgcgaatatctgaaacgaaaggcgaaaacagaccactaaccgccgacgaacgcagacacgtcgtcaccttcctaacggaagacagtcaagccgatcttacttgggtggacgtcgcagaaaaactcggagttcaccgccgggacttaaggggaacagccgtacacaccgacgacggagaaagaagtgccgcccggcccccaatcgacgcaacggatagaatcatgagacagaccaaaatcagttccctcaaaacgtggtgggaagaagccgacagcgaacagagaggcgcaatgatcaggtacctgtacgaagacccaaccgattctgaatgcgcagaaatcatagctgaactcccagaagaagatcaagccaaactagactccctacacttacccgcaggacgcgccgcatacagcagagagagtctaacagccttaagcgaccacatgctcgcgacaaccgacgacctccacgaggcacgaaaacgccttttcggcgttgacgacagctgggccccacccgccgaagcaatcaacgcccccgtcgggaacccctcggtggaccgcacattaaaaatagtagggcgatacctctcagcagtcgaatctatgtggggcacgccagaagtcattcacgtagagcacgtccgagacgggttcacgagcgagcgcatggccgacgaacgagacaaggcaaaccgacgaagatataacgacaaccaagaagcaatgaagaaaatccagagagactacggaaaagaaggctacatatccagaggggacatagtaaggctggacgccctcgaactccagggatgtgcctgtctctactgcgggacaacaattggataccacacgtgccaactagaccacatcgtaccccaggcaggaccaggaagcaacaaccgccgagggaacctagtcgctgtatgcgaaagatgcaaccgctcgaaatcaaacaccccctttgcagtttgggcccaaaaatgcggcatcccccacgtcggagtaaaggaagcgatcggcagagtcaggggctggagaaagcaaacaccaaacacatcaagcgaagatcttacaaggctaaagaaggaggtcatcgcacgactaagacgaacacaggaggacccagaaatcgacgaaaggtccatggagagcgtagcctggatggcaaacgaactccaccacagaatcgcggccgcatacccagagacaaccgttatggtctatagaggtagtatcacagcggctgcacggaaagccgccggaatagactcccgcatcaatcttataggagagaagggacgaaaagacagaatcgaccgccggcaccacgccgtggatgcctccgtcgtcgcgctaatggaggcaagcgtcgcaaaaacactagccgaacgcagcagcctgcgcggcgaacagcgcctaaccggaaaagaacagacctggaaacaatatacaggcagtaccgtaggagccagagaacacttcgaaatgtggagaggccacatgctccacctcacggaactgttcaatgaaagactagccgaagacaaagtttacgtaacacagaacatacgcctgcgactcagcgacggcaatgcacacaccgtcaaccccagcaaactcgtatcacaccgactcggcgacggactcacagtacaacaaatcgaccgcgcgtgcactccagccctgtggtgtgccctaacccgagaaaaagacttcgacgagaaaaacggcctaccggcacgagaagaccgggccatccgagtgcatgggcacgaaataaaatcgtcagactacatacaagtgttctccaaaagaaagaaaaccgactcagaccgagatgagacaccgttcggagcaatagcggtacgtggagggttcgtcgagatcggacccagcatccaccacgccagaatatacagagtagaaggaaagaaaccagtctacgcaatgctcagggtgttcacacatgacctcttaagccagcgacatggcgacctatttagcgcggtgataccaccacaaagtatcagcatgagatgcgcggaacccaaactccgcaaagcgataacaacgggaaacgccacatatctagggtgggtcgtagtgggcgacgagcttgaaataaacgtagacagtttcaccaaatacgctattggacgcttcctcgaagacttcccaaacacaacacgatggcgcatctgcggttacgatacaaactcaaaactcacgctgaagccaatcgtcctggccgccgaaggactcgaaaacccgtcctcagccgtcaacgagatcgttgaactgaagggatggagagtagcgatcaacgtcctcacaaaagtccacccaacagtagtccgacgcgacgcactaggacgaccgcgctatagttcgagatcaaacctaccaacaagctggacgatcgagaaacgcccagccgcaacaaagaaagccggacaagcgaagaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8167 - RNA, 4557 nt, synthetic construct
  misc_feature 1..4557: note = Cas9 variant mRNA product
  source 1..4557: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtccctgccgcgaccaagccctacagcatcggcctggacatcgggaccaactccgtgggctgggccgtgacgaccgacaactacaaggttcccagcaagaagatgaaggtgctcgggaacactagcaagaagtacatcaagaagaacctattaggcgtgctcctgttcgacagcggcatcacggccgaggggcggcgcctgaagcggacggcccgcagacgctacacccggcgccggaatcgcatcctctatctgcaagagatcttctccaccgagatggccaccctagacgacgccttcttccaacggctagacgacagcttcctggtccccgacgacaagcgcgactccaaatacccgatcttcggcaacctggtggaggagaaggcctaccacgacgagttccccaccatctaccacctccggaagtacttggccgacagcaccaagaaggccgacctgcgcctcgtgtacctggcgctggcccacatgatcaagtaccgggggcactttctcatcgagggcgagttcaactccaagaacaacgacatccagaagaacttccaggacttccttgacacctacaacgccatcttcgaaagcgacctgtccttggagaatagcaagcagctggaggagatagtcaaggacaagatctccaagctggagaagaaggaccgcatcctcaagctgttccccggggagaagaacagcggcatcttctccgagttcctgaaactcatcgtgggcaaccaggccgacttccggaagtgcttcaacctggacgagaaggccagtctgcacttctccaaggagagctacgacgaggacctcgagaccctgctggggtacatcggcgacgactactccgacgtgttcctcaaggcgaagaagctgtacgacgccatcctgctcagtgggtttctgacggtcaccgacaacgagaccgaggcgcccctgagctccgccatgatcaagcgctacaacgagcacaaggaggacctcgcactgctgaaggagtacatccggaacatcagcctcaagacctacaacgaggtgttcaaggacgacacgaagaacggctacgccggctacatcgacggaaagaccaaccaggaggacttctacgtgtacctgaagaagctgctcgccgagttcgagggcgcagactacttccttgagaagatcgaccgcgaggacttcctgcggaagcagcgcaccttcgacaacggttccatcccgtaccaaatccacctccaggagatgcgcgccatcctggacaagcaggccaagttctaccccttcctggcgaagaacaaggaacggatcgaaaagatcctgaccttccgcatcccctactacgtcggccctctcgcccgggggaacagcgacttcgcctggtccatccgcaagagaaacgagaagatcacgccttggaacttcgaggacgtgatcgacaaggagagctccgccgaggccttcatcaatcgcatgaccagcttcgatctgtacctccccgaggagaaggttcttcccaagcactcgctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacattatcgagtacctccacgcaatctacggctacgacggcatcgagctgaaggggatcgagaagcagttcaacagctccctgagcacctaccacgacctcctgaacatcatcaacgacaaggagttcctggatgactccagcaacgaagccatcatcgaggagatcatccacaccctcaccatcttcgaggaccgggagatgatcaagcagcgcctgtcaaagttcgagaacatcttcgacaagagcgtgctgaagaagctctcccggcgccactacacgggctgggggaagctgagcgccaagctgatcaacggcatccgggacgagaagtccgggaacaccatcctcgattacctgatcgacgacggcatcagcaaccgcaacttcatgcagctgatccacgacgacgcgctcagcttcaagaagaagatccagaaagcacagatcatcggcgacgaggacaaggggaacatcaaggaggtggtcaagtccctgcccggcagcccggccatcaagaaagggatcctgcagtccatcaagatcgtggacgagctcgtcaaggtgatgggcgggcgaaagcccgagagcatcgtggtcgagatggcccgcgagaaccagtacaccaaccagggcaagtccaacagccagcagcggctgaagcgcctggagaagtccctcaaggagctgggcagcaagatactgaaggagaacatccccgccaagctctccaagatcgacaacaacgcgctgcagaacgaccgcctgtacttgtactacttgcagaacgggaaggacatgtacaccggcgacgacctggacatcgaccggctaagcaactacgacatcgaccacatcatcccccaggccttcctgaaggacaactccatcgacaacaaggtgctggtgagctccgcgagcaaccgcgggaagtccgacgacgtcccgagcctcgaggtggtgaagaaacggaagacgttctggtaccagctgctcaagagcaagctgatctcccagcgcaagtttgacaacctgaccaaagcagagcgtggcggcctgagccccgaggacaaggccgggttcatccaacgccagctcgtcgagacccggcagatcaccaagcacgtggcgcgcctgctggacgagaagttcaacaacaagaaggacgagaacaaccgggccgtgcgcacggtcaaaatcatcaccctcaagtccaccctggtgagccagttccgaaaggacttcgagctgtacaaggtgcgcgagatcaacgacttccaccacgcccacgacgcctacctcaacgccgtggtggcgtccgccctgctgaagaagtaccccaagctcgagcccgagttcgtgtacggcgactacccgaagtacaatagcttccgggaacgcaagtccgccaccgagaaggtctacttctacagcaatatcatgaacatattcaagaagtccatcagcctggccgacgggcgggtgatcgagcgccccctgatcgaggtgaacgaggagaccggcgaatccgtctggaacaaggagagcgacctcgcgacggtgcggcgcgtcctgtcctacccccaggtcaacgtggtgaagaaggtcgaggagcagaaccacgggctggaccgggggaagcccaagggcctcttcaacgccaacctgagctccaagccgaagcccaacagcaacgaaaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgatcgcatcaactaccggaaggacaagctgaacttcctgctcgagaaggggtacaaggacatcgagctgatcatcgagctgccaaagtacagcctcttcgagctgagtgacggctcccgccgcatgctggcgagcatcctctccacgaacaacaagcgcggggagatccacaagggcaaccagatcttcctgagccagaagttcgtgaagctgctctaccacgccaagcggatctccaacaccataaacgagaaccaccggaaatacgttgagaaccacaagaaggagttcgaggagctgttctactacatcctggagttcaacgagaactacgtcggggccaagaagaacgggaagctcctgaacagcgcctttcagtcctggcagaaccacagcatcgacgagctgtgctctagcttcatcggccccacagggtccgagcgcaagggcctcttcgaactgaccagccgggggtccgccgcggacttcgagttcctgggcgtgaagatcccccgctaccgggactacacgcccagctccctcctcaaggacgctaccctgatccaccagagcgtcacggggctctacgagacccgcatcgacctggccaagttgggagagggcaagcggccggccgccacgaagaaggcgggtcaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8168 - RNA, 3639 nt, synthetic construct
  misc_feature 1..3639: note = Cas9 variant mRNA product
  source 1..3639: mol_type = other RNA
gggagagcggctcggccattttgtcccagtcagtccggaggctgcggctgcagaagtaccgcctgcggagtaactgcaaagaagcttaccatggcaccgaaaaagaaacgcaaagtgggcatccacggagtaccagccgctgccgccttcaaaccaaacagcataaattatatcctcggcctagatatcggtatcgcctccgtagggtgggccatggtcgagattgatgaagaagaaaacccaatcaggctcatagacctaggcgtacgagtcttcgaacgcgccgaagtcccaaaaacaggagattccctcgctatggcacgaagactagcaagaagcgtgagacgacttacccgccgacgcgcccaccgcctcctccgaactcgtcgcctcctaaagcgcgaaggagtcctccaagccgccaatttcgacgaaaacggtctaatcaaaagcctccccaacacgccatggcaactccgagcagcggccctagaccggaaactaacacccctagaatggtccgctgtcctactgcacctcatcaaacaccgcggatacctaagccagaggaaaaacgaaggagagaccgccgacaaagaactaggcgcgctactgaaaggtgtagcaggcaacgcacatgccctacagacgggtgactttcgaacaccggcagagctcgcacttaacaaattcgaaaaagaatctggacatatccgaaatcaaagatccgactacagccacacattcagccgaaaagatctacaagccgaactcatccttctattcgaaaaacaaaaagagttcggaaatccccacgtatcgggcggactgaaggaagggatcgaaaccctactcatgacacaacggcccgccctatcaggcgatgccgttcagaaaatgctaggccactgcacattcgaaccagccgaaccaaaggcggccaaaaacacctacacagcggaacgcttcatctggttaactaaactgaataacttacgcatactcgaacaaggctctgaacgacccctcacggatacagaacgcgcaaccctaatggacgagccctaccgcaaaagcaaactgacctatgcacaagcgagaaaactcctaggactcgaagacacagccttcttcaaaggtctcaggtacggaaaagataacgccgaggccagcacactcatggaaatgaaagcctaccatgccatcagccgagccctggaaaaagagggcctcaaagataagaaaagccctctcaaccttagccccgaacttcaagatgaaatcggaaccgcatttagcctcttcaaaacagacgaagacatcaccggacgactgaaagaccgcatccaaccagagatactcgaggcgctgctaaaacacatatccttcgacaaattcgtacaaatcagcttaaaggcactacgccggatagtacccctaatggaacaagggaaacgatacgacgaagcatgtgccgaaatatacggtgatcactacggaaagaaaaacactgaagaaaagatctacctcccaccaatacccgccgacgaaataaggaaccccgtagtactacgtgccctctcacaagcacgcaaagtcattaacggagtagtcagaagatatggcagccccgcgcggatccacatcgaaacagcccgcgaagtaggcaaatctttcaaagatcgcaaagaaatcgagaaaagacaagaagagaatagaaaagatcgagagaaagccgccgcaaaattccgagaatatttccccaacttcgtcggtgaaccaaaaagtaaagacatcctcaaactccgcctctatgagcaacagcacggaaaatgcctatacagcggaaaagaaatcaacctcggccggctaaacgagaagggatacgtagaaatagaccacgccctcccattctcgcgaacatgggacgactcttttaataacaaagtcttagtcctcggatcagagaaccaaaacaaaggaaatcaaacgccatacgagtacttcaacggcaaggacaacagcagagaatggcaagagttcaaagcacgagtggaaacctcccgattcccacgctccaagaaacaaagaatcctactccagaaattcgacgaagacgggttcaaagaacgcaacctgaacgatacacggtacgtcaaccgcttcttatgccaattcgtggcggaccgcatgcgcctcacgggaaaaggtaagaaacgggtattcgccagcaacggacagataacgaacctcctccggggattctggggcctccgaaaagtccgggcagaaaacgaccgacaccacgcgctagacgcggttgtcgttgcttgcagcaccgtcgccatgcagcagaaaataaccagatttgtcagatacaaagagatgaacgcctttgacggaaaaactatcgacaaagagacaggcgaagtactacaccaaaagacacacttcccgcaaccatgggagttcttcgcccaagaagtcatgataagggtattcgggaaaccagacggcaaaccagagttcgaagaagcagacaccctagaaaagctccgcaccctactggcagaaaagttgagcagccgccccgaagccgtacacgaatacgtaacaccactcttcgtctcccgagcacccaaccgaaaaatgagcggccaaggccacatggaaaccgtaaaatccgccaagcgcctggacgaaggcgtctccgtactaagagtacccctcacccaactcaagctaaaagacctggagaaaatggttaacagagaaagagaaccaaagctatatgaggccctcaaggcgcgcctcgaggcacacaaagacgacccagcaaaagcattcgctgaacccttctataaatacgataaagccgggaacagaacacaacaggtaaaggccgtccgggtagaacaggtacagaagaccggagtctgggtccgaaaccataatggcatcgcagacaacgcaacaatggtacgcgtcgatgtgttcgaaaaaggcgacaagtactacctagtacccatatacagctggcaggtcgcgaaaggcatcctaccggacagggccgtagtccagggcaaagatgaagaagactggcagctaatcgatgattccttcaactttaaattcagcctacacccaaatgacctcgtagaagtaatcaccaaaaaggcaagaatgttcggatacttcgccagctgccacagaggaaccggaaacatcaacattcggatacacgacctcgatcacaaaataggcaagaatggcatactcgagggcataggggtcaaaaccgcactatccttccagaagtaccaaatcgacgagcttggaaaagaaatccggccctgtcgactgaagaaaaggccaccagttcggaagagaccggccgccaccaaaaaggcaggtcaagccaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8169 - RNA, 4395 nt, synthetic construct
  misc_feature 1..4395: note = Cas9 variant mRNA product
  source 1..4395: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcgaagaagccatacaccatcggcctggacatcgggaccaacagcgtgggctgggccgtgctcaccgaccagtacgacctggtcaagcggaagatgaagatcgccggggactccgagaagaagcagatcaagaagaacttctggggcgtgcgcctgttcgacgagggccagaccgccgctgaccggcgcatggcgcggaccgcccgccggcgcattgagcggcgccggaaccgcatcagctacctccagggaatcttcgccgaggagatgtccaagaccgatgccaacttcttctgccggctgagcgactccttctacgttgacaacgagaagcgcaacagccggcaccccttcttcgcgacgatagaggaggaggtcgagtatcacaagaactaccccacaatctaccacctccgcgaggaactcgtgaactccagcgaaaaggccgacctgcgtctagtgtacctcgccctggcccacatcatcaagtaccgcggcaacttcctgatcgagggggccctcgacacccagaacacctccgtcgacggcatctacaagcagttcatccagacgtacaaccaggtgttcgcgtccgggatcgaggacggctcccttaagaagctggaggacaataaggacgtggccaagatcctcgtcgagaaggtgacccggaaggagaagctggagcgcatcttaaagctctacccgggcgagaagtccgccgggatgttcgcccagttcatcagcctaatcgtgggcagcaaggggaacttccagaagcccttcgacctgatcgagaagtccgacatcgagtgcgccaaggactcgtacgaggaggacctcgagtccctgctggcgctcatcggggacgagtacgccgagctgttcgtcgccgccaagaatgcctacagcgcggtggtgctgagtagcatcatcaccgtcgccgagaccgagacgaacgccaagctcagcgcctccatgatcgagcggttcgacacccacgaggaggacctgggcgagctgaaggcattcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaagagaacttcctgcgcaagcagcgcacattcgacaacggggcgattccccaccaactgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgattttggcaagtccgccgtagacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcgtatttcagcggccaggagaaggagcagatcttcaacgacctgttcaagcagaagcggaaggtcaagaagaaggacctcgagctgttcctgcgtaacatgtcccacgtggagagccccacgatcgaggggctggaggactccttcaacagctcctacagcacctaccacgacctcctgaaggtgggcatcaagcaggagatcctggacaaccccgtcaacacagagatgctcgagaatatcgtgaagatcctgacagtgttcgaggacaagcggatgatcaaggagcagctgcagcagttctccgacgttctcgacggcgtggtgctgaagaagctggagcgccggcactacacggggtggggccgcctcagcgccaagctgctgatggggatccgggacaaacagtcccacctcaccatcctggactacctgatgaacgacgacggcctcaatcgcaacctgatgcagctgatcaacgacagcaacctttcattcaagagcatcatcgagaaggagcaggtcaccaccgccgacaaggatatccagagcatcgtggccgacctggcgggatccccggccatcaagaagggcatcctgcagagcctcaagatcgtggacgaactggtctccgtgatgggctacccgccccagacgatcgtggtcgagatggcccgggagaaccagactaccgggaagggcaagaataacagccgcccccggtacaagtccctggagaaggccatcaaggagttcgggagccagatccttaaggagcaccccaccgataatcaggagctgcgcaacaaccgactgtacctctactacctgcagaacggcaaggacatgtacacgggccaggaccttgacatccacaacctctccaactacgacatcgaccatatcgtgccccagagcttcatcaccgacaactccatcgacaacctggtgctgaccagctccgccgggaaccgcgaaaagggcgacgacgtcccgcccctcgagatcgtgcgcaagcgcaaggtgttctgggagaagctgtaccaggggaacctgatgagcaagcgcaagttcgactacctgaccaaggcggagcggggcgggctgaccgaagccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccaactctacaaggtgcgcgacgtcaacgactaccaccacgcccacgacgcctacctgaacggcgttgtggcgaacactctgctcaaggtctacccccagctggagcccgagttcgtgtacggggactaccaccagttcgactggttcaaggccaacaaggcgaccgccaagaagcagttctacaccaacatcatgttgttcttcgcccagaaggaccggatcatcgacgaaaacggtgagatcctctgggataagaagtacctggacaccgtgaagaaggtcatgtcctaccgccagatgaacatcgtgaagaagacggagatccagaagggggagttctcgaaggccaccatcaagcccaagggcaactccagcaagttaatcccccggaagaccaactgggacccgatgaagtacgggggcctcgacagccccaacatggcctacgcggttgtcatcgaatacgccaagggcaagaacaagctggtgttcgagaagaagatcatccgcgtgaccatcatggagcggaaggccttcgagaaggacgagaaggccttcctggaggagcaggggtaccgccagccgaaggtcctcgccaagctgccgaagtacacgctgtacgagtgcgaggagggccggcgccggatgctcgcgtccgcaaacgaggcccagaaggggaaccagcaggtcctgcccaaccacctggtgaccctcctgcaccacgccgcgaactgcgaggtgagcgacggcaagtccctggactacatcgagagcaaccgcgagatgttcgcggaactcctggcccatgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaaattcttcgagaccacgatcgagcgcaagcggtacaacaacctcaaggagctgctgaacagcaccatcatctaccaatccatcaccggcctctacgagtctcgcaagcgcctcgacgacaagcggcccgccgccaccaagaaggcagggcaggcgaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8170 - RNA, 4428 nt, synthetic construct
  misc_feature 1..4428: note = Cas9 variant mRNA product
  source 1..4428: mol_type = other RNA
gggagagcggctcggccattttgtcccagtcagtccggaggctgcggctgcagaagtaccgcctgcggagtaactgcaaagaagcttaccatggctcccaagaagaaacgcaaggtgggcatccacggggtcccggcagcgaagaagccctacagcatcggcctggacatcggcaccaattccgtgggttgggccgtggtaaccgacgactacaaggtgcccgccaagaagatgaaggtgctcgggaacacggacaagagccacatcgagaagaacctgctgggcgccctactgttcgactccggcaataccgccgaggatcggcgcctaaagcggaccgcgcgcagacgatacacccggcgccggaaccgcatcctctaccttcaggaaatcttctcagaggagatgggaaaggtcgacgactccttcttccaccggctggaggacagcttcctcgtgacggaagacaagcgaggcgagcggcaccccatcttcgggaacctggaggaggaagtgaagtaccatgagaacttcccgaccatctaccacctccgccagtacctggccgacaatcccgagaaggttgacctgcggctggtgtacctcgccctggcccacatcatcaagttccgcgggcacttcctgattgaggggaagttcgacacgcggaacaacgacgtgcaacgcctctttcaggagttcctggcggtctatgataacacgttcgagaactccagccttcaggagcagaacgtccaggtggaggagatcctcaccgacaagatctctaaaagcgccaagaaggaccgggtgctgaagctgttccccaacgaaaagtccaacggccgcttcgccgagttcctcaagctgatcgtgggcaaccaggccgacttcaagaagcatttcgagctggaggaaaaggccccgctacagttcagtaaggacacctacgaggaggagctggaggtgctgctcgcgcagataggtgataattacgccgagctgttcctgtccgccaaaaagctgtacgacagcatcctgctgtccggcattctaacagtcaccgacgtgggaacgaaggccccgcttagtgcttcaatgatccagcggtataacgaacaccagatggacctggcgcagctaaagcagttcataagacagaagctgagcgacaagtacaacgaagtgttctccgacgtcagcaaggacggctatgccggctacatcgacgggaagaccaaccaggaggccttctacaagtacctgaaggggctcctgaacaagatagaggggagcggctacttcctggacaagatagagcgcgaggacttcctacggaagcagcgtactttcgacaacgggtccataccccaccagatccacctccaggagatgcgggccatcatccgccgtcaggcagagttctaccccttcctcgcggacaaccaggaccgcatcgagaagctgctgaccttcagaatcccctactacgtggggccgctggcccgcggcaagagcgactttgcctggctgtcccgtaagagcgccgacaagataacgccctggaacttcgacgagatcgttgacaaggagagcagcgccgaggcgttcatcaacagaatgaccaactatgacctctacctccccaaccagaaggtcctgcccaagcactccctcctatacgagaagttcaccgtctacaatgagctgaccaaggtgaagtacaaaacggagcaagggaagaccgcgttcttcgacgctaacatgaagcaagagatcttcgacggcgttttcaaagtgtaccggaaggtcactaaagataagctcatggacttcctggagaaggagttcgacgagttccgcatcgtggacctgaccggtctggacaaggaaaacaaggtgtttaacgccagctacggcacgtaccacgacctgtgcaagatactcgataaggacttcttagataactccaagaacgagaagatcctggaggacatcgtcctgaccctcactctgttcgaggaccgggagatgatccgcaagcggctggagaactatagcgacctcctgacaaaggagcaggtcaagaagctggagcgccggcactacactgggtggggtcgcttgtccgcggagctaatccacggcatccggaacaaggagagcaggaagaccatcctagactacttaatcgacgacgggaactccaacaggaacttcatgcagctgatcaacgacgacgccttgtcttttaaggaggaaatcgccaaggcccaggtgatcggcgagaccgacaacctcaaccaagtggtgtccgacatcgccgggtctccggcgatcaagaagggcatcctgcagtccctgaaaatcgtggacgagctcgtcaagatcatgggccaccaacccgagaacatcgtggtggaaatggcccgtgaaaaccagttcaccaatcagggtcgccggaacagccagcagcgactgaagggcctgacggactccatcaaggagttcgggagccagatcctcaaagaacacccagtcgagaacagccaactgcagaatgaccgactgttcctctactacctgcaaaacgggcgcgacatgtacaccggggaggagctggacatcgactacctctcccagtacgatatcgaccacataatcccccaagccttcatcaaagacaacagcatcgataaccgggtgctgacctccagcaaagagaacaggggcaagtccgatgacgtacccagcaaggacgtcgtgcggaagatgaagtcctactggagcaagctgctctccgccaagctgatcacccagcgcaagttcgacaacttgacgaaggctgagcggggcgggctcaccgacgacgacaaggcgggcttcatcaagcgccagcttgtggagacccggcagatcaccaagcacgttgcccggatcctggacgagcggttcaacaccgagacggacgagaacaataagaaaatccgccaggtgaagatcgtgaccctcaagagcaacctggtctccaacttccggaaggagttcgaactgtacaaggtccgagagataaatgactaccaccacgcccacgacgcctacctcaacgccgtgatcgggaaggcgctgctgggcgtctacccccagctcgagcccgagttcgtttacggggactacccccacttccacggccacaaggagaacaaggccaccgccaagaagttcttctacagcaacatcatgaactttttcaagaaggacgatgtgcggactgacaagaacggcgagatcatctggaagaaagacgaacacataagtaacatcaagaaggtcctgagctacccccaggtgaacatcgttaaaaaggtcgaggagcagaccggaggcttctccaaagagtcgatcctccccaaggggaactccgacaaacttatcccccgcaagacgaagaagttctactgggacaccaagaagtacggcgggttcgacagccccatagtggcctacagcatcctggtgatcgcagacatcgagaagggcaagtccaagaaactgaagaccgtcaaggcactcgtgggcgtaacgataatggaaaagatgaccttcgagcgggacccggtcgccttcttggagcgcaaggggtatcgcaatgtgcaggaggagaacatcatcaagctgcccaagtatagcctcttcaagctcgagaacgggcggaagcgcctgctagcctccgccagggagctgcagaaggggaacgaaatcgtgctgcccaaccaccttggaaccctgttataccacgcgaagaacatccacaaggtcgatgagccgaagcatctcgactacgtggacaaacacaaggatgagtttaaggaactgctggacgtggtctcaaacttctccaagaagtacaccctcgccgagggtaatctagagaagatcaaggagctgtatgcccagaacaacggcgaggacctcaaggagctcgctagcagtttcatcaaccttctcactttcacggccatcggggcgcccgccaccttcaagttcttcgataagaacatcgaccgcaagcggtacaccagcacgaccgagatcctgaacgccacgcttatccaccagtccataaccggactctacgagacgcgcatcgacctgaacaagctgggcggggacaagcggcccgccgccaccaagaaggcgggccaagccaaaaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8171 - RNA, 3561 nt, synthetic construct
  misc_feature 1..3561: note = Cas9 variant mRNA product
  source 1..3561: mol_type = other RNA
gggagagcggctcggccattttgtcccagtcagtccggaggctgcggctgcagaagtaccgcctgcggagtaactgcaaagaagcttaccatggcacctaaaaagaaacggaaagtgggcatacacggcgttccagccgcacaaacaaccaacctcagttacatactaggtctagacctcggtatcgcatcagtcggctgggccgtcgtcgaaatcaacgaaaacgaagaccccatcggactaatagacgtcggcgtaaggatattcgaacgcgccgaagtcccaaaaaccggagaaagcctagcactgtccaggagactcgcgcggagtacccgccgcctaatacgccgccgagcccaccgcctactcctcgcgaaacgcttcctcaagagagaaggcatactgagcaccatagacctcgagaaaggcctgccaaaccaggcctgggagctaagagtcgccggcctcgaaaggcgactatcggccatcgaatggggagccgttctcctgcacctaataaaacacagggggtacctatcgaaaagaaagaacgagagtcaaacgaacaacaaggagctgggcgccctgctaagcggagtggcgcaaaaccaccagctcctacaatccgacgactaccgaacacccgcagaattagccctcaagaaatttgcaaaagaagaggggcacataagaaaccaacgcggcgcttacacacacaccttcaatagattagacctcttagcagaactgaacctgctattcgcacaacagcatcaattcggaaacccacactgtaaagagcacatccagcaatacatgactgaactcctaatgtggcagaaacccgcactcagtggcgaggccatcctaaaaatgctcggaaaatgcacacacgagaaaaacgagttcaaagccgcgaaacatacctacagcgccgaacgttttgtttggctcaccaaactcaataaccttcgaatactcgaagacggggccgaacgggcactaaacgaagaagaaagacaactactaatcaaccacccgtacgaaaagagcaaactaacatacgcgcaggtacgaaaattactaggcctctccgaacaagctattttcaagcacctacgctacagtaaagaaaacgcagagtcagccaccttcatggagctcaaagcctggcacgccatacgaaaagcactcgaaaaccagggcctgaaggacacctggcaggacctcgccaagaaacccgatctcctcgacgaaatcggaaccgccttctcactctacaaaacagatgaagacatccaacaatacctaacgaacaaagtacccaacagcgtaataaacgcactactcgtatccctgaacttcgataagttcatcgaactcagcctgaaaagcctgagaaaaatacttcctctaatggaacaaggcaaacgctacgatcaggcctgccgcgagatctacggacatcactacggggaggccaaccaaaagacgtcacaactcctgcccgccattccagcccaagaaatacgcaaccccgtagtcctgcgaacgctgtcccaagcaagaaaagtaataaacgccatcatacgacaatacggctcccccgcccgagtccacatagaaacgggtcgagaactagggaaatccttcaaagaacgacgcgaaatccaaaaacagcaggaggataatcgaaccaaacgcgagtcagcggttcaaaagttcaaggaactcttctccgacttcagcagcgaaccaaaatctaaagacatactcaagttccgcctttacgagcaacaacacggtaaatgcctatactcgggcaaagaaatcaacatacacaggctgaacgaaaaaggatacgtcgagatcgaccacgcactacccttcagtcggacctgggacgactcattcaacaataaagtacttgtcctagcaagcgagaaccaaaacaaaggcaaccagacaccatacgagtggctacaagggaaaataaactccgaacgctggaaaaacttcgtcgcactggtactcggcagccagtgctcagccgcgaagaaacaacgcctcttgacccaggtcattgacgacaacaaatttatcgaccgcaaccttaacgacactcgatacatcgcacgcttcctatcaaactacatccaggaaaacctcctactcgtcggcaaaaacaaaaagaacgtattcacgccaaacggccaaatcacagccctgctccggtcgcgatggggactaatcaaagctcgagaaaacaacaaccgacaccatgccctagatgcgatcgtggtcgcttgcgcgaccccctcaatgcaacagaaaataacccgcttcatccgatttaaagaagtccacccctacaaaatagaaaaccgatacgaaatggtcgaccaagagagtggagaaattataagcccccacttccccgagccatgggcatacttcaggcaagaggtaaacatccgagtattcgacaaccaccccgacacggtgctaaaagagatgctcccggaccggccacaggcaaaccaccaattcgtacaacctctattcgtctcccgagcgcccaccagaaaaatgtccggccaaggccacatggaaaccatcaagtccgccaaacggctggcagaaggcatctccgtactccgaatacccctaactcaactcaaacccaatctcctggaaaacatggtaaataaggagcgcgaacccgccctgtacgcaggccttaaagcccgactcgccgagttcaaccaggaccccgcaaaagccttcgccacaccattctacaaacaaggcggccagcaggtaaaagcaatccgagtagagcaagtacaaaaatcaggagtcctagtacgcgaaaacaacggagtcgccgacaatgcctcaatcgtacgaaccgacgtattcatcaaaaacaacaaattctttctcgtccccatctacacgtggcaagtagcaaagggaatcctaccaaacaaggcaatcgtcgcacacaaaaatgaagacgaatgggaagaaatggacgaaggtgccaaattcaagttctctctcttccccaacgaccttgtcgaactaaaaaccaagaaagaatacttcttcggctactacatcggactggaccgggcaacagggaacataagcctaaaagagcacgacggcgaaatctccaaaggcaaagacggagtctacagggtaggcgtcaaacttgcactgagctttgaaaaataccaagtagatgagcttgggaaaaaccgacaaatctgccgaccccaacaaagacaacctgtcagaaagagaccagccgcaactaaaaaggcaggacaagccaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8172 - RNA, 3639 nt, synthetic construct
  misc_feature 1..3639: note = Cas9 variant mRNA product
  source 1..3639: mol_type = other RNA
gggagagcggctcggccattttgtcccagtcagtccggaggctgcggctgcagaagtaccgcctgcggagtaactgcaaagaagcttaccatggcacccaaaaagaaacgcaaagtcggaatccacggagtaccagcagcagccgcctttaaaccaaacccaatcaactacatactcggattagacatagggatagcatcagtcggatgggccatggtcgagatcgacgaggacgaaaaccccatatgcctcatagacctgggggttagggttttcgagcgtgcagaggttccaaaaacaggcgacagcctagcaatggcacgtagactagcgcgctctgtccgcagactcacgagacgacgggcccacagactgctaagagcccgccgcctgctcaaaagagaaggagtcctacaagccgccgactttgacgaaaacggactcataaaaagcctccccaacacaccctggcaacttcgggcggccgccttagaccgaaaactcacacccctcgagtggtccgccgtgctactgcacctgatcaaacatcgaggatacctcagccaacgcaaaaacgagggagaaacggcagacaaagagctcggcgcactgcttaaaggcgtagcggacaacgcacacgcactacagacgggggacttccgcacgccagccgagctcgcactcaacaaattcgagaaagaaagcggtcacatccgaaaccagcgcggagactactcccacacattctcccgaaaagacctgcaagccgaactcatcctactattcgaaaaacagaaagagttcggcaacccacacgtatcaggcggtctaaaagaaggtatagaaacactcctcatgacccaaagaccggccctgtcaggagacgcagtccagaaaatgctcgggcattgcacattcgaaccagcagagcccaaggcagctaaaaacacatacaccgcagaacgattcatctggctgaccaagctcaacaacctcagaatattagaacaagggtctgaacgccccctgactgacacggaacgcgcaacactcatggacgaaccgtaccgcaaaagcaaactcacctacgcacaagcccgtaaactactgggcctcgaagacacagctttcttcaagggtctgcgatacggaaaagacaacgcagaagcatcaacattaatggaaatgaaggcttaccatgccatcagccgagccctagaaaaggaaggcctaaaagataagaaaagtcccctaaacctgtcgcccgagctacaagatgaaatcggcacagccttctcgctttttaaaaccgacgaggacatcacagggcgactcaaagaccgaatacaacccgagattctggaggcgctcctcaaacacatatcattcgacaaattcgtccaaatatccctcaaagcactacgcagaatcgttcctctcatggaacaaggcaaacgctacgatgaagcctgcgcagaaatatatggagaccattacgggaaaaagaacaccgaagagaaaatctatctgcccccgatcccagcggacgaaatacggaatcccgtcgttctgcgagcgctatcccaagcgagaaaagtaatcaacggggtcgtcagacgctacggcagtcccgcaagaatacacatagaaaccgcccgagaggtcggcaaatccttcaaagaccgcaaagagatcgaaaaacgccaagaagaaaatcgcaaggaccgagaaaaagcggcagcgaaattcagagaatacttcccaaacttcgtcggggaacccaaatccaaagatatcctaaaactccgcctatatgaacaacagcatggcaaatgcctctacagcggtaaggaaatcaacttaggaagactgaacgaaaaaggctacgtggaaatagaccacgcgctcccattcagccgcacttgggacgactcattcaacaacaaagtgctggtcctcggctcagagaaccagaataaagggaatcaaaccccctacgaatacttcaacggcaaagacaacagccgcgaatggcaagagttcaaggcacgagtggagacctcgcgcttccccagaagcaagaaacagcgaatactcctacagaaattcgacgaagatggcttcaaagaaaggaacctaaatgacacacgctacgtaaaccgctttctttgccaattcgtagcagaccggatgcggctcactggaaagggcaaaaagagagtcttcgcatccaacggacaaatcactaacctgctgaggggattctggggattacgcaaagtccgggcagagaacgaccgacaccatgcgctcgacgccgtagtcgtagcatgcagcaccgtagccatgcaacagaaaatcacgcgcttcgtgagatacaaggaaatgaacgcattcgacggaaagaccatcgacaaagagaccggagaagtcctacaccagaagacccatttcccccaaccctgggagttcttcgcccaggaagtcatgatacgcgtcttcggcaaacccgacggaaagccagagttcgaagaagcggacacgccagaaaaactaagaacgctgctcgccgagaaacttagctccagacctgaagcagtacatgaatatgtaaccccactcttcgtaagccgagccccgaaccgcaaaatgtccggccaggggcacatggaaacagtaaaatcagccaaacgcctagacgagggcgtgagcgtactaagggtaccgcttacacaactcaagctaaaagacctagagaaaatggtcaaccgcgagcgcgaaccaaagctctacgaggcccttaaggctcggctagaggcacacaaagacgacccagccaaagccttcgcggaaccgttttacaaatacgacaaggccggcaatcggactcaacaagtcaaagccgtaagagtagagcaggtccagaaaacaggcgtctgggtacgtaaccacaacggcatagcagacaacgccactatggtacgcgtcgacgtgttcgaaaaaggcgacaaatattatctagtgcccatatacagctggcaagtcgcaaaaggaatcctaccagaccgcgcggtggtccaaggaaaggacgaagaagactggcaactcatcgacgacagcttcaacttcaaattcagcctacaccccaacgacctagtcgaagtcatcacaaagaaggcccggatgttcgggtacttcgcctcctgccaccgcggcaccggtaacataaacataaggatccatgacctcgaccacaaaataggcaaaaacggaatattagaaggcatcggggtaaaaacagcccttagcttccaaaaataccaaatagacgagctaggaaaagaaataaggccctgccgactcaaaaagagaccaccagtgcgcaaaaggcccgcagcaacgaagaaagccggccaagccaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8173 - RNA, 3645 nt, synthetic construct
  misc_feature 1..3645: note = Cas9 variant mRNA product
  source 1..3645: mol_type = other RNA
gggagagcggctcggccattttgtcccagtcagtccggaggctgcggctgcagaagtaccgcctgcggagtaactgcaaagaagcttaccatggcaccgaagaagaaaaggaaagtcggcattcacggagtcccagccgcaaaataccatgtaggcatagacgtaggaacattcagcgtagggctcgcggcaatagaggtagacgacgcaggtatgcccatcaaaaccctaagccttgtgtcacacatccacgacagcggcctcgatccagatgaaatcaaatcggcggtcacgcgactagcaagcagcggtatcgccagacgaacgcgcagactgtaccgaaggaaaaggagaagactccagcaactggacaaattcatacaacggcaaggatggccagtgatagaattagaggactacagcgacccactatacccctggaaagtaagagccgagctcgcagcaagttacattgcggatgagaaagaacgaggcgagaaattgagcgtggcactgagacatatcgccagacacagaggatggcgcaacccatacgcaaaagtaagcagcctatacctcccagacgggccgtccgacgcattcaaagcgatcagagaagagataaagagggcgagtgggcaaccagtgccagaaacagccacggtgggacaaatggtgaccctatgcgaactaggcacgctgaagctaagaggagaaggcggagtcctgagtgcacggttgcagcaaagcgactacgcccgcgaaatacaagaaatatgccgcatgcaagaaatagggcaagaactctacagaaaaataatcgacgtagtattcgcagctgaaagcccaaaggggagcgccagcagccgagtaggaaaagaccccttacaacccgggaaaaaccgcgcgctaaaggccagcgacgcattccaacgatacaggatagcagccttaataggaaacctaagagtccgagtagatggagagaaacgcatcctcagcgtagaggagaagaacctcgtgttcgaccatctggtcaatctaaccccaaagaaagaaccagaatgggtaacgatcgcagaaatactgggcatagacagagggcagctaataggaaccgccacgatgacggacgacggagaacgcgcgggagcccgaccacctacgcacgacacgaacagatccatcgtgaacagccgaatagccccgctagtcgactggtggaaaacagcgagcgccctcgaacaacatgcaatggtcaaggctctaagcaacgcggaagtagacgacttcgactcaccagagggagcaaaagtccaagcattcttcgccgacctagacgacgacgtccacgcaaaactcgactcccttcatctgccagtcggacgagcggcgtacagcgaagacaccctagtacgattaacacgacgcatgctaagcgacggagtagatctgtacaccgcaagactacaggagttcggcattgaaccaagctggacgccaccaacccccaggatcggagaaccagttggtaacccagctgtagaccgagtactaaaaacagtcagtcgatggcttgaaagtgcgaccaagacttggggagcaccagaacgggtcataatagaacacgtaagggagggatttgtaacagaaaaacgggcgcgagaaatggacggggacatgcgtagacgagcagcaaggaacgcaaaactgttccaggaaatgcaggagaaactaaacgtacaaggaaaaccctctagagcagatctctggcggtaccagagcgtccaaagacaaaactgccaatgcgcatactgcggcagcccaatcacgttcagcaactcagaaatggaccacatcgtgccaagggctgggcagggatccaccaacacgcgcgagaacctagtggcggtgtgccacaggtgtaaccaaagcaaaggaaacaccccgttcgcgatatgggcgaaaaacacctccatagagggcgtaagcgtaaaggaagctgtggaaagaacacgacactgggtcacggacacaggaatgcgctcaaccgactttaagaaatttacaaaggctgtcgtcgagaggttccaaagagcaacgatggacgaagagatagacgcaaggagcatggaatcggtcgcatggatggcaaacgaattgcgcagtcgggtagcacagcacttcgctagccacggaacaacggtacgagtctaccgcggaagcctcacagcggaagcacggagggccagcggcataagcggcaaactaaagttcttcgacggagtcgggaaatctcgcctagaccgcagacaccatgccatagacgcggccgtgatcgcattcacaagtgactacgtggccgagaccctagcagtacgaagcaatttgaagcaaagccaagcgcacagacaggaagccccgcaatggcgagagttcacaggaaaagacgcagaacacagagcggcatggagggtatggtgccagaaaatggaaaaactaagcgcattgctcaccgaagacctcagggacgacagagtcgtcgttatgagcaacgtgcggctacgcctcggcaacggctcggcccacaaagaaacaataggaaaactcagcaaggtcaaactaagctcacaactgtccgtatccgacatagacaaagcgtcgagcgaagcactctggtgcgcgctaacgcgagaacccggatttgaccccaaggaaggcctccctgcaaacccagaacggcacatacgagtaaacggtacacacgtgtatgctggtgacaacatcggattattcccagtctcagcaggaagtattgcgctgcggggaggatacgcagaactcggctcaagttttcaccacgcaagggtatataaaataacaagcgggaagaaaccagcattcgctatgttgagagtatacacgatagacctgctcccctaccgcaaccaagacctattcagcgttgaactaaaaccacaaacaatgtcaatgaggcaagccgaaaagaaactgcgagacgccctcgccaccgggaacgccgaatacctcggctggttagtcgtcgacgacgagctcgtagtagacaccagcaaaatagcaacggaccaagtaaaagcagtcgaagcggagctaggaacgataagacgatggagggtagatggatttttcagcccaagcaaactacgcctaagaccgcttcaaatgtcaaaagaaggcatcaaaaaggaaagcgcaccagagctgagcaagataatcgacagacccggctggctaccagcagttaataaactcttcagcgacggcaacgtcacagtcgtgcgaagggactcgttggggcgggtacggctagaaagcacagcgcacctacccgtcacatggaaggtacaaaagagaccagccgcgacgaagaaggcaggccaggcgaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8174 - RNA, 3345 nt, synthetic construct
  misc_feature 1..3345: note = Cas9 variant mRNA product
  source 1..3345: mol_type = other RNA
gggagagcggctcggccattttgtcccagtcagtccggaggctgcggctgcagaagtaccgcctgcggagtaactgcaaagaagcttaccatggcccccaagaagaaacgcaaggtgggcatccacggggtcccggccgcggcccggatactggccttcgacatcggcatcagctccatagggtgggccttcagcgagaacgacgagctcaaggactgcggcgtgcgcatcttcactaaggtggagaaccccaagacaggagagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgatgagagcctcgccaaggcctacaaaggctccctgatcagcccctacgagctgcggttccgcgcactcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacttgtacaaggagtacttccagaaattcaaggagaacagcaaggagttcacgaacgtgcgcaacaagaaggagtcctacgagcggtgcatcgcccagagcttcctgaaggacgagctgaagctcatctttaaaaagcagcgcgagttcgggttctccttcagcaagaagttcgaagaggaggtcctttccgtggcgttctacaagcgggctctgaaggacttcagccacctcgtgggcaactgctccttcttcaccgacgagaagcgcgccccgaagaacagccccctggccttcatgtttgtcgccctgacccggatcatcaatctcctgaacaacctgaagaacaccgagggcatcctctacacgaaggacgacctgaacgcgctgcttaacgaggtgctgaagaacggcaccctgacctacaagcagaccaagaagctcctggggctgagcgacgactacgagttcaaaggggaaaagggcacgtacttcatcgagttcaagaagtacaaggagttcattaaggccctcggggagcacaacctgtcccaggacgacctgaacgagatcgccaaagacatcaccctcatcaaggacgagatcaagctgaagaaggccctggccaagtacgacctcaaccagaaccagatcgacagcttatccaaacttgagttcaaggaccacctcaacatcagcttcaaggcgctaaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgtgcgatcaaggagtaccgcaaggtgctgaacgccctcctgaagaagtacggcaaggtgcacaaaatcaacatcgagctggcgcgggaggtcgggaagaaccactcccagcgcgccaagatcgagaaggagcagaacgagaactacaaggccaagaaagacgcggagctcgagtgtgagaagctgggcctgaagatcaacagcaagaacatcctcaagctgcggctgttcaaggagcagaaggagttctgtgcctactccggggagaaaatcaagatcagcgacctccaggacgagaagatgttagagatcgaccacatctacccatactcccgcagcttcgacgactcctacatgaacaaggtgctggtgttcaccaagcagaaccaggagaagctcaaccagacccccttcgaggccttcggcaacgacagcgcgaagtggcagaagatcgaggtcctggcaaagaacctacccaccaagaagcagaagcggatcctcgacaagaactacaaggacaaggagcagaagaacttcaaggaccgcaacctgaacgacacacggtacatagctcgcctggtgctcaactacaccaaggactacctggacttcctgccgctctccgacgacgagaacaccaagctgaacgacacccagaaggggagcaaggtgcacgtcgaggccaagtccggcatgctgacgagcgctctccggcacacctggggcttctccgccaaggaccgcaacaaccacctccaccacgccatcgatgcggtgataatcgcctacgccaacaacagcatcgtcaaggccttctccgacttcaaaaaggagcaggagagcaacagcgcggagctgtacgccaagaagatctccgagctggactacaagaacaagcggaagttcttcgagcccttcagcggtttccgccagaaggtgctggacaagatcgacgagatcttcgtgtccaaacccgagcggaagaagcccagcggtgccctgcacgaggagaccttccgtaaagaggaggagttctaccagtcctacgggggcaaggagggggtcctcaaggcgctggagctgggcaagatccggaaggtgaacgggaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttttgcttctccctctacaaggacagcctgatcctgatccagaccaaggacatgcaagagcccgagttcgtgtactacaacgccttcacctcctcaaccgtgtccctcatagttagcaagcacgacaacaagttcgagacgctgtccaagaaccagaagatcctgttcaaaaacgcaaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8175 - RNA, 3756 nt, synthetic construct
  misc_feature 1..3756: note = Cas9 variant mRNA product
  source 1..3756: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggcatccacggggtcccggccgcgtcggacctagttctcggcctggacatcgggattggctccgtgggggtcgggatcctgaacaaggtgaccggcgagatcatccacaagaacagccggatcttccccgccgcccaggccgagaacaacctagtgcgccggacgaaccgccagggccggcgcctggcccggcgcaagaagcaccggcgcgtccggctgaaccgcctcttcgaggagtccggcctgatcacggacttcaccaagatcagcataaacctgaacccctaccagttacgggtgaaggggctgaccgacgaactgtccaacgaggagctgttcatcgcgctgaagaatatggtgaagcaccgcggcatcagctacctggatgacgcctccgacgacgggaacagctccgtcggcgattacgcccagatcgtgaaggagaatagcaagcagctcgagaccaagacgcccggacagatccagctggagcggtaccagacctacgggcagctgcgcggcgatttcaccgtggagaaagacgggaagaagcaccgactcatcaacgtcttcccgacctccgcctaccgaagcgaggcgctgcggatcctgcaaactcagcaggagttcaacccccagatcaccgatgagttcatcaaccgctacctcgagatcctgaccggcaagcggaagtactaccacggccccgggaacgagaagtcccgcaccgactacggccgctatcggacgagcggggagaccctggacaacatcttcggcatcctcatcgggaagtgcaccttctaccccgacgagttccgcgccgccaaggcctcctacaccgcccaggagttcaaccttttaaatgacctcaacaacctgacggtgccgaccgaaaccaagaagctcagcaaggagcagaagaaccagatcatcaactacgtgaagaacgagaaggctatgggccccgccaagctgttcaagtacatcgccaagctcctgtcctgcgacgtcgccgacatcaagggctaccggatcgacaagagcgggaaggccgagatccataccttcgaggcgtaccgcaagatgaagacgctcgagaccctggacatcgagcagatggacagagagaccctggacaagctcgcctacgtactgaccctgaacacggagcgcgagggcatccaggaggccctcgagcacgagttcgccgacgggtccttcagccagaagcaggtcgacgagctggtgcagttccggaaggccaacagctccatcttcggcaaagggtggcacaactttagcgtgaagctgatgatggagctcatccccgagctgtacgagaccagcgaggagcagatgaccatcctgacccgcctcggcaagcagaagacaaccagctccagcaacaagactaagtacattgacgagaagctgctgaccgaggaaatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgcctcacagcgtgttccacggccacaagcagctggccaccaagatccggctgtggcaccagcagggcgagcgctgcctctataccggcaagaccatctccatccacgacctgatcaacaacagcaaccagttcgaggtcgaccacatcctgcccctctccatcacgttcgacgacagcctggccaacaaagtgctggtgtacgcgaccgccaaccaggagaaggggcagcggacgccctaccaggccctggactccatggacgacgcctggtcgttccgcgagctgaaggccttcgtccgggagtccaagaccctgagcaacaagaagaaggagtacctcttgaccgaggaggacatctccaagttcgacgtgcgcaagaagttcatcgagcggaacctcgtggacacgcgctacgcgagccgggtcgtgctcaacgccctgcaggagcacttccgcgcccataaaatcgacaccaaggtgtccgtggtgcgcggccagttcaccagccagttaagacgccactggggcatcgagaagacccgggacacgtaccaccaccatgcagtggacgccctcatcatcgcggcctcctcccagctgaacctgtggaagaagcagaagaacaccctcgtcagctactccgaggaccagctgctggacatcgagaccggggagctcatcagcgacgacgagtacaaggagtccgtgttcaaggccccctaccaacatttcgtggacaccttaaagagcaaggagttcgaggattccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctcgagaactaccccaacaagcagatcaacgagaagggcaaggaggttccctgcaacccgttcctcaagtacaaggaggagcacgggtacatccggaaatacagcaagaagggcaacgggcccgagatcaagtccctgaagtactacgacagcaagctgggcaaccacatcgacattacccccaaagactccaacaacaaggtggtcctccagagtgtgtccccctggcgcgccgacgtgtacttcaacaagaccaccgggaagtacgagatcttgggcctgaaatacgcggacctccagttcgagaagggcacggggacctacaagatcagccaggagaagtacaacgacatcaagaagaaagagggcgtcgacagcgactccgagttcaagttcaccctgtacaagaacgacctgctcctggtgaaggacaccgagacgaaggagcagcagctgttccggttcctcagccgcaccatgccaaagcagaagcactacgtggagctaaagccctacgacaagcagaagttcgagggcggagaggccctgatcaaggtcctcgggaacgtggccaactccggccagtgcaagaagggactgggcaagagcaacatctccatctacaaggtgcggaccgacgtcctggggaaccaacacatcattaagaacgagggggacaaacccaagctcgacttcaagcgccccgccgccaccaagaaggcgggccaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8176 - RNA, 4314 nt, synthetic construct
  misc_feature 1..4314: note = Cpf1 variant mRNA product
  source 1..4314: mol_type = other RNA
gggagagcggctcggccattttgtcccagtcagtccggaggctgcggctgcagaagtaccgcctgcggagtaactgcaaagaagcttaccatggcccccaagaagaagcgcaaggtgggaatccacggcgtcccggccgcgacccagttcgagggcttcaccaacctgtaccaggtgagcaagacgctccggttcgagctgatcccccaggggaagaccctgaaacacatccaggagcagggcttcatcgaggaggacaaggcccgcaacgaccactacaaggaactcaaacccatcatcgaccggatctataagacctacgccgaccagtgcttgcagctggtgcagctcgactgggagaatctgtccgccgccatcgacagctaccgcaaggagaagaccgaggagacccgtaacgcgcttatcgaggagcaggccacctaccgcaacgctattcatgactacttcatcgggcggaccgataacctcaccgacgccataaacaagcgccacgctgaaatctacaagggcctcttcaaggccgagctattcaacggcaaggtactaaagcagttagggacggtgaccaccaccgagcacgagaatgccctactccggtccttcgacaaattcacgacctacttctcaggcttctacgaaaaccgcaagaacgtgttcagcgcagaggacatcagcaccgcaatcccccaccggatcgtccaggacaatttcccgaagtttaaggagaactgccatatcttcacccgtctgatcacggcggtgccgtccctgcgggaacacttcgaaaacgtgaagaaggccatcggaatttttgtcagcacctccatcgaggaggtgttcagtttccccttctacaaccagttgctgacccagacccagatcgacctgtacaaccagctcttgggcgggatctctcgcgaggccggcacggagaagataaagggcttaaatgaggtgctcaacctggccatacagaagaacgacgagacagcccacatcatagcgagcctgccccaccggttcatcccgttattcaaacagatcctgtctgaccgtaacacccttagcttcatcctcgaggagttcaagagtgacgaagaggtcatccagtcgttctgcaaatacaagacccttctgcggaacgagaatgtgctcgagacggccgaggcccttttcaacgaactgaactccatcgacctcacccacatcttcatcagccacaagaaactcgagaccatcagcagcgccctgtgcgaccactgggacaccctccgcaacgccctgtacgagcggcgcatcagtgagctgacgggcaagatcaccaagtccgcgaaggagaaggtgcagcggagcctcaagcatgaagacatcaacctgcaggagatcatctccgccgccggcaaggagctgagtgaggccttcaagcaaaagacctcagaaatcctatcccacgctcatgcggccctggaccagccgttgcccaccacgctcaagaagcaagaagagaaggagatcctgaaatcccagttagacagcctgctcgggctgtaccacctcctcgactggttcgcagtcgacgaatccaacgaggtggaccccgagtttagcgcccgcctgaccggcattaaactggagatggagccgtccctcagcttctacaacaaggcgcgcaactacgccaccaagaagccctactccgtggagaagttcaagctgaacttccagatgcccacgctggccagcggctgggatgtaaacaaggagaagaacaatggggccatactcttcgtgaagaacggcctgtactacctggggatcatgcctaagcaaaagggccggtacaaggccttatccttcgagcccacggagaagaccagcgaagggttcgacaagatgtactacgactacttccccgacgcggccaaaatgatccccaagtgctccacacagctgaaagcagtgaccgcccacttccagacccacacgaccccgattctgttgagtaacaacttcatcgagccgctggagatcaccaaagagatctacgatctgaacaaccccgagaaggagcccaaaaagttccagaccgcctatgcgaaaaagacgggagaccagaaaggctaccgcgaggccctgtgcaagtggatcgacttcacccgggatttcctatccaagtacaccaagaccacgagcatcgacctgagttcactccggccaagctcccagtacaaagatctgggggagtactacgccgagctgaatccgctcctgtatcacatctcattccaacggatcgccgagaaagagatcatggacgccgtagagacgggcaagctctacctcttccagatctacaacaaggacttcgcgaagggacaccacggcaagcctaacctgcacacattgtactggaccggcctcttctcccccgagaacctcgccaagacgagcatcaagctgaacgggcaggccgagctgttctacaggcccaagagccggatgaagcgcatggcccacaggctgggtgagaagatgctgaacaagaagctaaaggaccagaagaccccgatccccgacaccctgtaccaagagctgtatgactacgtgaaccatcgcttaagccacgacctctccgacgaggcgcgtgccttactccccaacgtgatcaccaaggaggtcagccatgagatcatcaaggaccgcagattcacgtccgacaagttcttcttccacgtgccgatcacactgaactaccaggccgctaacagcccctccaagttcaaccagcgcgtcaacgcctacctaaaggagcaccccgagacgcccatcattgggatagaccggggcgagcgcaacctgatctatatcaccgtgatcgacagcacggggaagatcctggagcaacgatccctgaacaccatccagcagttcgactaccagaagaaactcgacaaccgcgaaaaagagcgggtggcggcacgccaggcctggagcgtcgtgggcaccatcaaggacctgaagcaggggtacctgagccaggtgatccacgagatcgtcgacctcatgattcactaccaggccgtcgtggtcctggagaacttaaacttcggcttcaaatcgaaacgcaccggcatcgccgagaaagcggtgtaccagcagttcgagaagatgctcattgacaagttaaactgcctggtgctaaaagattacccggccgagaaggtcggaggcgtgctgaacccctaccagttgacggaccagttcaccagcttcgccaagatgggcacccagtctggcttcctcttctacgtgcccgccccctacaccagcaagatcgacccgctgacggggttcgtagaccccttcgtttggaagaccatcaagaaccatgagagtcggaagcacttccttgaggggtttgacttcctccactatgatgtgaagactggcgatttcatcctgcacttcaagatgaaccgcaacctgagcttccagcgggggctccccggtttcatgcccgcctgggacatcgtcttcgagaagaatgagacccagttcgacgcgaaggggacgcccttcatcgccggcaagcgcatagtccctgtgatcgagaaccaccggttcaccggccgctaccgggatctgtaccccgcaaacgagctgatcgccctcctggaggagaaggggatcgtctttcgagacggctccaacatcctgcccaagttgttagagaatgacgacagccacgcaatcgacaccatggtggccctgattcggtccgtgctccagatgcgcaacagcaacgcggccaccggggaggactacatcaactccccggtccgggacctgaacggcgtgtgctttgatagccgcttccagaaccccgagtggcccatggacgccgacgcgaacggggcctaccatatcgccctgaagggacaactcttgctgaaccacctcaaggagtctaaggacctcaagctgcaaaacggtatcagcaaccaggactggctcgcctatatacaagagctgcggaacaagcgccccgccgcgactaaaaaggctgggcaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8177 - RNA, 4293 nt, synthetic construct; identical to SEQ ID NO: 2377
  misc_feature 1..4293: note = Cpf1 variant mRNA product
  source 1..4293: mol_type = other RNA

SEQ ID NO: 8178 - RNA, 4439 nt, synthetic construct
  misc_feature 1..4439: note = Cas9 variant mRNA product
  source 1..4439: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaagtgggaatccacggggtgccggcggcggacaagaagtacagcatcggcctggacatcgggaccaactcagtgggctgggccgtaatcaccgacgaatacaaagtccccagcaagaagttcaaggtgctggggaacacggaccggcattccatcaagaagaacctgatcggtgccctgctgttcgactcgggcgagaccgccgaggccacccgcctgaagcgaaccgcgcgccggcgctacacgcggcgcaagaaccggatctgttacctgcaggagatcttctccaacgagatggccaaggtggacgacagcttcttccaccgcctcgaggagtccttcctggtcgaggaggacaagaagcacgagcggcaccccattttcgggaacattgtggacgaagtggcctaccacgagaagtaccccaccatctaccaccttcgcaagaagctcgtcgacagcaccgacaaggccgacctgcggctgatttacctcgcgctggcccacatgatcaagttccgcggccacttcctgatcgagggggacctcaacccggacaactccgacgtggacaagctgttcatccaactggtgcagacctacaaccagctgttcgaggagaaccccatcaacgccagcggcgtcgacgccaaagccatcctgtccgcgagacttagcaagagtcgcaggctcgagaacctgatcgcccagcttcccggggagaagaagaacggcctattcggcaacctgattgccctgagcctcggactgacacccaacttcaagtccaacttcgatctggccgaggatgccaaactccagttgagtaaggacacctacgacgacgacctggacaacctcctggcgcagatcggcgaccagtacgccgacctgttcctcgccgccaagaacctgtctgacgccatcctgctcagcgacatcctgcgcgtgaacaccgaaatcaccaaggcgccgctgtccgcctcaatgatcaagcggtacgacgagcaccaccaggatctcacgctgctgaaggcgctagtgcgccagcagttgcccgagaaatacaaggagatcttcttcgaccagagcaaaaacgggtacgctggctacatcgacggcggggcctcccaggaggagttctataagttcatcaagcccatactggagaagatggacggcaccgaggagttactggtcaagctgaaccgggaggacctgctccgcaagcagcgcaccttcgacaatgggagcatcccccaccagatccacctgggcgagctgcacgcgatcctccggcgccaggaggacttctacccgttcctgaaggacaaccgggagaagatcgagaagatcctcacctttcgcatcccctactacgtggggcccttggcccggggcaactcccgcttcgcctggatgacgcgcaagagcgaggagaccatcactccctggaatttcgaggaggtggtcgacaagggcgccagtgcgcagagcttcattgagaggatgaccaactttgacaagaacctgccgaacgagaaggtgctgcccaagcactccctcctgtacgagtacttcacggtgtataacgaactcaccaaggtcaagtacgtgaccgaggggatgcggaagcccgctttcctcagcggcgagcagaagaaggccatcgtggacttgctgttcaagaccaaccgcaaggtcacggtgaagcagctcaaggaggattacttcaagaagatcgagtgcttcgactccgtcgagatcagcggggttgaggaccggttcaacgcctccctgggcacctaccacgacctgctcaaaatcatcaaggacaaggactttctggacaacgaggagaacgaggacatcctggaggacattgtgctcaccctgaccctgttcgaggaccgcgagatgatagaggagcggctcaagacgtatgcccacctgttcgacgacaaggtcatgaagcaactgaagcgtcggcgctacaccgggtggggccggctcagccgcaagttgatcaacggaatccgagataaacagagtgggaagacaatcctggacttcctaaagagcgacggctttgcaaaccgcaacttcatgcagctgatccacgacgactccttgaccttcaaggaggacatccagaaggcccaagtatctgggcagggagactccctccacgagcacatcgccaacctggccgggtcccccgccatcaagaagggcatcctgcagacggtgaaggtcgtggacgagctagtcaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaagagcaccccgtggagaacacccagctccagaacgagaagctctacctgtactaccttcagaacggccgggatatgtacgtcgaccaggagctggacattaacaggctgagcgactatgacgtggaccacatcgtgccccagtccttcctcaaagacgacagcatcgacaacaaggtcctgacacggtccgacaagaaccggggcaagagcgacaacgtgccctccgaggaggtagtcaagaaaatgaaaaactattggagacagctgctcaacgctaagctgatcacccagcgcaaattcgacaacttgaccaaagccgaacgcgggggcctcagcgagctagacaaggccgggttcatcaagcggcagctggtggagacccggcagatcaccaagcacgtagcccagatcctcgactccaggatgaacacgaagtacgacgagaacgacaaactgatccgggaggtcaaggtgatcaccctcaagagcaaacttgtgtccgacttcagaaaggacttccagttctataaggttagggagatcaacaactaccaccacgcgcacgacgcatacctgaacgccgtggtgggcaccgccctgatcaagaagtacccgaaacttgagagcgagttcgtctacggggactacaaggtgtacgacgtgcgcaagatgatcgcgaagtccgagcaggagatcggaaaggctaccgccaagtacttcttctacagcaacatcatgaacttcttcaagacggagatcaccctggcaaacggcgaaatccggaagcgccccctaatcgaaacgaacggagagaccggcgaaatcgtctgggacaaggggcgggacttcgccacggtgcgcaaggtgctctccatgccccaggtcaatatcgtaaagaagaccgaggtgcagaccggcgggttcagcaaggagtccatcctgcccaagcgcaacagcgataagttaatcgcgcgtaagaaggactgggacccgaagaagtacggcggcttcgactcccccaccgtcgcgtacagcgtgctggtggtcgccaaggtggagaagggcaagagcaagaagttaaagtccgtgaaggagctgctcggtatcacgatcatggagcgcagttccttcgagaagaaccccatcgatttcctggaggccaagggatacaaggaggtcaagaaggacctgatcatcaagctccccaagtacagcctgttcgagctggagaacggccggaaacgcatgctcgcctccgcgggggagctgcagaagggcaacgaactggccctccccagcaagtacgtgaacttcctgtacctggcctcccactatgagaagttaaaaggcagccccgaggacaacgaacagaagcagctgttcgtggagcagcacaagcattatctggacgagatcatcgagcagatatccgagttcagcaaacgggtgatcctcgccgacgccaacctcgacaaggtgctctccgcgtacaacaagcaccgtgacaagcccatccgggagcaggccgagaacatcatccacctcttcaccctgaccaaccttggggcccctgccgcgttcaagtacttcgacaccacgatcgaccggaagcggtacaccagcaccaaggaggtgttagacgcgaccctgatacaccagagtatcacgggcctgtacgagacccgcatcgatctcagccagctcgggggcgataagcggcccgccgccaccaagaaggccgggcaggcgaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8179 - RNA, 5222 nt, synthetic construct; identical to SEQ ID NO: 2379
  misc_feature 1..5222: note = Cas9 variant mRNA product
  source 1..5222: mol_type = other RNA

SEQ ID NO: 8180 - RNA, 3494 nt, synthetic construct
  misc_feature 1..3494: note = Cas9 variant mRNA product
  source 1..3494: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaagtgggcatccacggggtcccggccgcgaagcggaactacatcctgggcctcgacatcgggatcaccagcgtgggctacgggatcatcgactacgaaacccgcgatgttatcgacgccggcgtccggctgttcaaggaggccaacgtggagaacaacgaaggccgccggtccaagcgcggggcccggcgcctgaagcggcgccggcgccaccggatccagcgcgtgaagaagctcctgttcgactacaacctgctcacggaccacagcgagctgtcgggcatcaacccctacgaggcccgggtcaagggtctcagccagaagctctccgaggaggagttcagcgcggccctgctgcacctcgccaagcgcaggggcgtgcacaacgtgaacgaggtcgaggaggacaccgggaacgagctctccaccaaggagcagatcagccgcaactccaaggccctggaggagaagtacgtggcggagctccagctcgagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaagacatcaaggagtggtacgagatgctgatgggccattgcacctacttcccggaggagctccgaagcgtgaagtacgcctacaacgccgacctgtacaacgcgctcaacgacctcaacaacctggtcatcacgcgcgacgagaacgagaagctggagtactacgagaagttccagatcatcgagaacgtgttcaagcagaagaagaagcccaccctcaagcagatagccaaggagatcttggtgaacgaggaggacatcaaggggtaccgggtcacctccaccggcaagcccgagttcacgaacctaaaggtgtaccacgacatcaaggacatcaccgcccgcaaggagatcatcgagaacgccgagctcctggaccagatcgccaaaatcctgaccatctaccagagctccgaggacatccaggaggagctcaccaacctgaacagcgagctgacacaggaggagatcgagcagatctccaacctcaaggggtacaccggcacccacaacctgagcctgaaggcgatcaacctcatcctggacgagctgtggcacaccaacgacaatcagatcgccatctttaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctacccaacgacataatcatcgagctggcccgggagaagaacagcaaggacgcccagaagatgatcaacgagatgcagaagcgcaaccggcagaccaacgagcgcatcgaggaaatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtggaccacatcatcccccgcagcgtgtccttcgataacagcttcaacaacaaggtgctggtcaagcaagaggagaactccaagaaggggaaccggacccccttccagtacctgagctccagcgactccaagatcagctacgagaccttcaagaagcacatcctcaacctggccaagggcaaagggcgcatctccaagaccaagaaggagtacctgctcgaggaacgggacattaaccgcttcagcgtgcagaaggacttcatcaaccggaacctggtggacacgcgctacgccacccggggcctgatgaacctcctgcgctcctactttcgcgtcaacaacctggacgtgaaggtcaagagcatcaacgggggcttcacctccttcctcaggcgcaaatggaagttcaagaaggagcggaacaagggctacaagcatcacgccgaggacgcgctgatcattgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcatatcaaggacttcaaggactacaagtacagccatcgcgtggacaagaagcccaatcgggagctcatcaacgacacactgtactccacccgcaaggacgacaaggggaacaccctgatcgtgaacaacctcaacggcctgtacgacaaggacaacgacaagctgaagaagctcatcaacaagagccccgagaagctcctgatgtaccaccacgacccccagacttaccagaagctcaagctgatcatggagcagtacggggacgagaagaacccgctgtacaaatactacgaggagaccggcaactacctcaccaagtactccaagaaggacaacgggcccgtcatcaagaagatcaagtactacggcaacaagctgaacgcccacttggacatcaccgacgactaccccaacagccggaacaaggtggtgaagctctccctgaagccctaccgcttcgacgtctacctggacaacggcgtgtacaagttcgtcaccgtcaagaacctcgacgtgatcaagaaggagaactactacgaggtgaacagcaagtgctacgaggaggctaagaagctgaagaagatctccaaccaggccgagttcatcgccagcttctacaacaacgacctgatcaagatcaatggtgagctctaccgggtcatcggcgtgaacaacgacctgctgaaccgcatcgaggtgaacatgatcgacatcacgtatcgggagtacttagagaacatgaacgacaagcgcccgcccagaatcatcaagaccatcgcgtccaagacccagagcatcaagaagtactcaaccgacatcctggggaacctgtacgaggtaaagagcaagaagcacccccagatcatcaagaagggcaagcgccccgccgccacgaagaaggccggtcaagccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8181 - RNA, 4562 nt, synthetic construct
  misc_feature 1..4562: note = Cas9 variant mRNA product
  source 1..4562: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgctgttcaacaagtgcattatcatcagcatcaacctggacttctccaacaaggagaaatgcatgaccaagccctacagcataggcctggacatcgggacgaactccgtgggctgggccgtgatcacggacaactataaggtccccagcaagaagatgaaggtgctggggaacacttccaagaagtacattaagaagaacttactgggcgtgctgctgttcgacagcggcatcaccgccgaggggcggcgcctgaagcggaccgcgcgccggcgctacacgcggcgccggaaccgcatcctgtacctccaggagatcttctctaccgagatggccaccctggacgacgcgttcttccagcggctggacgacagcttcctcgtgcccgacgacaagcgcgactccaagtacccgatcttcggcaacctggtggaggagaaggtgtaccacgacgagttccccaccatctaccacctccggaagtacctcgccgacagcacgaagaaggccgacctgcgcctcgtctacctcgccttagcgcacatgattaagtaccggggccacttcctgatcgagggcgagtttaactccaagaacaacgacatccaaaagaacttccaggacttcctcgacacctacaacgccatcttcgagagcgacctgtccctggagaacagcaagcagctcgaggagatcgtgaaggacaagatttccaagctggagaagaaggaccgcatcctgaagctgttccccggggagaagaacagcggcatcttctctgagttcctgaagctgatcgtgggcaaccaggctgacttccggaagtgcttcaacctcgatgagaaggcaagccttcacttctccaaggagagctacgacgaggacctggagaccctcctgggatacatcggcgacgactatagcgatgtcttcctgaaggctaagaagctctacgacgcgatcctgctgtccgggtttctcaccgtgacggacaacgagaccgaggcgcccctgagctccgccatgatcaagcgctacaacgagcacaaggaggacctcgccctcctgaaggagtacatccggaacatcagcctgaagacctacaacgaggtgttcaaagacgacaccaagaacggatacgccggctacattgacgggaagacgaaccaggaggacttctacgtatacctcaagaacctgctggccgagttcgagggcgccgactatttcctcgagaaaatcgaccgcgaggacttcctgcgcaagcagcgcaccttcgacaacgggtccatcccgtaccagatccaccttcaggagatgcgcgccatcctggacaagcaggccaagttctaccctttcctagccaagaacaaggagcggatcgagaagatcctgaccttccgcatcccctactatgtgggcccgctggcgcgggggaacagcgacttcgcttggtccatccgcaagcggaacgagaagatcaccccgtggaacttcgaggacgtgatcgacaaggagagctccgctgaggccttcatcaaccgcatgacgagcttcgacctctacctgcccgaggagaaggtcctgcctaagcactccctcctgtacgagaccttcaacgtgtacaatgagctgaccaaggtgcggttcatcgccgagagcatgcgcgactaccaattccttgactccaagcagaagaaggacatcgtccggctttacttcaaggacaagcgcaaggtgaccgacaaggacatcatcgagtacctgcacgcgatctacggctacgacggcatcgaactcaaggggatcgagaagcagttcaacagcagcctgagcacgtaccacgacctgctcaacatcattaacgacaaagagttcctggacgactccagcaacgaggctatcatcgaggagatcatccacaccttaaccatcttcgaggaccgggagatgatcaagcaacgcctctccaagttcgagaacatcttcgacaagagcgtgctgaagaagctgagccgtcgccactataccggctgggggaagctctccgccaaacttatcaacggcatccgggacgagaagtccgggaatacaatcctggactacctcatcgatgacggcatcagcaatcgcaacttcatgcagctgatccacgacgacgccctgagcttcaagaagaagatccagaaggcgcagattatcggcgacgaggacaagggtaacatcaaggaagtcgtgaagtccctccccggcagcccggccatcaagaagggaatcctgcagtccatcaagatcgtagacgagctggtgaaggtgatgggcgggcggaagcccgagagcatcgtcgtggagatggcccgagagaaccagtacaccaaccagggcaagtccaacagccagcagaggctcaagcgcctggagaagtcactgaaggagctcggcagcaagatcctgaaggagaacatccccgccaagctgagtaagatcgacaacaacgccctacagaacgaccgcctgtatctgtactacctccagaacgggaaggacatgtataccggagacgacctggacatcgaccggctgagcaactacgacatcgaccacataatcccccaggcgttcctcaaggacaactccatcgacaacaaggtgctggtcagctccgccagcaaccgcggaaagtccgacgacttcccgagcctggaggtggttaagaagcggaagactttctggtaccagttgctcaagagcaagctgatttcccagcgcaagttcgacaacctgacgaaggccgaacggggcggcctgctgcccgaagacaaggcaggcttcatccaacgccagctcgtcgaaacccggcaaatcaccaaacacgtggcccgcctgctggacgagaagttcaacaacaagaaggacgagaacaaccgggcggtgaggaccgtaaagatcatcacgctcaagagcaccctggtgtcccaattccggaaagacttcgagttgtacaaggtgcgcgagatcaacgacttccaccatgcccacgacgcctacctcaacgccgtcatcgccagcgcgctgctgaagaagtaccccaagctcgagcctgagtttgtgtacggcgactacccgaaatacaactccttccgtgagcgcaagagcgccaccgagaaggtgtacttctattccaatatcatgaacatcttcaagaagtccatctccctggctgacgggcgggtgatcgagcgccccctgatcgaagtgaacgaggagacgggcgagagcgtgtggaacaaggagtccgacctcgccaccgtccggcgcgtgctgagctacccccaggtgaacgtcgtaaagaaggtggaggaacagaaccacgggctggaccggggcaagcccaagggcctcttcaacgcgaacctgtccagcaagccgaagcccaactccaacgagaacctggtcggggccaaggaatacctcgaccccaagaagtacggcgggtacgccggcatcagcaactccttcgccgtgctggtcaaggggacgatcgaaaagggagccaagaagaagatcaccaacgtcctggagttccagggcatcagcatcctcgaccgcatcaactaccggaaagacaagctgaacttcctgttagagaaggggtacaaggacatcgagctgatcatcgaactgccgaagtactcactcttcgagctgtccgacggcagccgccggatgctcgcgtcgatcctcagcaccaacaataagcgtggggagatacataagggcaaccagattttcctgtcccagaagttcgtgaagctgctctaccacgccaagcggatcagcaacaccatcaacgagaaccaccgaaaatacgtggagaaccacaagaaggagttcgaggagctgttctactacatcctggagttcaacgagaactacgtcggtgccaagaagaacggaaagctcctgaacagtgccttccagagctggcagaaccattcgatcgacgagctatgcagctccttcatcggccccacggggagcgagcgcaagggcctcttcgagctaacatcccgggggagcgccgcagactttgagttcctgggcgtgaagataccccgctaccgggactacaccccctccagcctcctgaaagacgccaccctgatccaccagtccgtgacggggctgtacgagacccgcatcgacctcgccaagctgggcgagggcaagaggccggccgccaccaagaaggcagggcaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8182 - RNA, 3638 nt, synthetic construct
  misc_feature 1..3638: note = Cas9 variant mRNA product
  source 1..3638: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaacgcaaagtaggaatacacggagtgccggcagcatggtacgcgagccttatgagcgcccaccatctacgcgttggaatcgacgtaggcacccacagcgtaggactagccacactccgagtagacgaccacggaaccccaattgaattactatcggcactgagccacatccacgatagtggagtcgggaaagaaggaaagaaagaccacgacacacgaaagaaactgtcaggaatagcaagacgcgctcgaagactattacaccaccgacgaacacagctccaacaactagacgaagtcctacgagatctaggcttcccaatcccaacaccgggagagttcctagacttaaacgaacaaaccgacccataccgcgtgtggcgagtccgagcacgactcgtggaagagaaactcccagaggaattacgcggaccagccataagcatggcagtgaggcacatcgcccgacaccgagggtggaggaacccgtatagtaaagtagaatccctactaagccccgccgaggaaagcccattcatgaaagcactccgcgaacgaatcctcgcaaccaccggcgaagtactagacgatggcataacgccgggccaagctatggcccaagtcgcactgacccataacatctcaatgcgcggaccagaaggcatactaggaaaactacaccaatccgataacgcaaacgaaatccggaaaatatgtgcccgccagggggtcagccccgacgtttgcaaacagctactccgggccgtattcaaagccgactcacctagaggcagcgccgtgagtagagtagcacccgatccccttcccggtcaggggagcttccgcagagccccaaaatgcgacccagagttccagcgcttccgaataatatccatagtggcaaacctgcgaatatctgaaacgaaaggcgaaaacagaccactaaccgccgacgaacgcagacacgtcgtcaccttcctaacggaagacagtcaagccgatcttacttgggtggacgtcgcagaaaaactcggagttcaccgccgggacttaaggggaacagccgtacacaccgacgacggagaaagaagtgccgcccggcccccaatcgacgcaacggatagaatcatgagacagaccaaaatcagttccctcaaaacgtggtgggaagaagccgacagcgaacagagaggcgcaatgatcaggtacctgtacgaagacccaaccgattctgaatgcgcagaaatcatagctgaactcccagaagaagatcaagccaaactagactccctacacttacccgcaggacgcgccgcatacagcagagagagtctaacagccttaagcgaccacatgctcgcgacaaccgacgacctccacgaggcacgaaaacgccttttcggcgttgacgacagctgggccccacccgccgaagcaatcaacgcccccgtcgggaacccctcggtggaccgcacattaaaaatagtagggcgatacctctcagcagtcgaatctatgtggggcacgccagaagtcattcacgtagagcacgtccgagacgggttcacgagcgagcgcatggccgacgaacgagacaaggcaaaccgacgaagatataacgacaaccaagaagcaatgaagaaaatccagagagactacggaaaagaaggctacatatccagaggggacatagtaaggctggacgccctcgaactccagggatgtgcctgtctctactgcgggacaacaattggataccacacgtgccaactagaccacatcgtaccccaggcaggaccaggaagcaacaaccgccgagggaacctagtcgctgtatgcgaaagatgcaaccgctcgaaatcaaacaccccctttgcagtttgggcccaaaaatgcggcatcccccacgtcggagtaaaggaagcgatcggcagagtcaggggctggagaaagcaaacaccaaacacatcaagcgaagatcttacaaggctaaagaaggaggtcatcgcacgactaagacgaacacaggaggacccagaaatcgacgaaaggtccatggagagcgtagcctggatggcaaacgaactccaccacagaatcgcggccgcatacccagagacaaccgttatggtctatagaggtagtatcacagcggctgcacggaaagccgccggaatagactcccgcatcaatcttataggagagaagggacgaaaagacagaatcgaccgccggcaccacgccgtggatgcctccgtcgtcgcgctaatggaggcaagcgtcgcaaaaacactagccgaacgcagcagcctgcgcggcgaacagcgcctaaccggaaaagaacagacctggaaacaatatacaggcagtaccgtaggagccagagaacacttcgaaatgtggagaggccacatgctccacctcacggaactgttcaatgaaagactagccgaagacaaagtttacgtaacacagaacatacgcctgcgactcagcgacggcaatgcacacaccgtcaaccccagcaaactcgtatcacaccgactcggcgacggactcacagtacaacaaatcgaccgcgcgtgcactccagccctgtggtgtgccctaacccgagaaaaagacttcgacgagaaaaacggcctaccggcacgagaagaccgggccatccgagtgcatgggcacgaaataaaatcgtcagactacatacaagtgttctccaaaagaaagaaaaccgactcagaccgagatgagacaccgttcggagcaatagcggtacgtggagggttcgtcgagatcggacccagcatccaccacgccagaatatacagagtagaaggaaagaaaccagtctacgcaatgctcagggtgttcacacatgacctcttaagccagcgacatggcgacctatttagcgcggtgataccaccacaaagtatcagcatgagatgcgcggaacccaaactccgcaaagcgataacaacgggaaacgccacatatctagggtgggtcgtagtgggcgacgagcttgaaataaacgtagacagtttcaccaaatacgctattggacgcttcctcgaagacttcccaaacacaacacgatggcgcatctgcggttacgatacaaactcaaaactcacgctgaagccaatcgtcctggccgccgaaggactcgaaaacccgtcctcagccgtcaacgagatcgttgaactgaagggatggagagtagcgatcaacgtcctcacaaaagtccacccaacagtagtccgacgcgacgcactaggacgaccgcgctatagttcgagatcaaacctaccaacaagctggacgatcgagaaacgcccagccgcaacaaagaaagccggacaagcgaagaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8183 - RNA, 4499 nt, synthetic construct
  misc_feature 1..4499: note = Cas9 variant mRNA product
  source 1..4499: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtccctgccgcgaccaagccctacagcatcggcctggacatcgggaccaactccgtgggctgggccgtgacgaccgacaactacaaggttcccagcaagaagatgaaggtgctcgggaacactagcaagaagtacatcaagaagaacctattaggcgtgctcctgttcgacagcggcatcacggccgaggggcggcgcctgaagcggacggcccgcagacgctacacccggcgccggaatcgcatcctctatctgcaagagatcttctccaccgagatggccaccctagacgacgccttcttccaacggctagacgacagcttcctggtccccgacgacaagcgcgactccaaatacccgatcttcggcaacctggtggaggagaaggcctaccacgacgagttccccaccatctaccacctccggaagtacttggccgacagcaccaagaaggccgacctgcgcctcgtgtacctggcgctggcccacatgatcaagtaccgggggcactttctcatcgagggcgagttcaactccaagaacaacgacatccagaagaacttccaggacttccttgacacctacaacgccatcttcgaaagcgacctgtccttggagaatagcaagcagctggaggagatagtcaaggacaagatctccaagctggagaagaaggaccgcatcctcaagctgttccccggggagaagaacagcggcatcttctccgagttcctgaaactcatcgtgggcaaccaggccgacttccggaagtgcttcaacctggacgagaaggccagtctgcacttctccaaggagagctacgacgaggacctcgagaccctgctggggtacatcggcgacgactactccgacgtgttcctcaaggcgaagaagctgtacgacgccatcctgctcagtgggtttctgacggtcaccgacaacgagaccgaggcgcccctgagctccgccatgatcaagcgctacaacgagcacaaggaggacctcgcactgctgaaggagtacatccggaacatcagcctcaagacctacaacgaggtgttcaaggacgacacgaagaacggctacgccggctacatcgacggaaagaccaaccaggaggacttctacgtgtacctgaagaagctgctcgccgagttcgagggcgcagactacttccttgagaagatcgaccgcgaggacttcctgcggaagcagcgcaccttcgacaacggttccatcccgtaccaaatccacctccaggagatgcgcgccatcctggacaagcaggccaagttctaccccttcctggcgaagaacaaggaacggatcgaaaagatcctgaccttccgcatcccctactacgtcggccctctcgcccgggggaacagcgacttcgcctggtccatccgcaagagaaacgagaagatcacgccttggaacttcgaggacgtgatcgacaaggagagctccgccgaggccttcatcaatcgcatgaccagcttcgatctgtacctccccgaggagaaggttcttcccaagcactcgctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacattatcgagtacctccacgcaatctacggctacgacggcatcgagctgaaggggatcgagaagcagttcaacagctccctgagcacctaccacgacctcctgaacatcatcaacgacaaggagttcctggatgactccagcaacgaagccatcatcgaggagatcatccacaccctcaccatcttcgaggaccgggagatgatcaagcagcgcctgtcaaagttcgagaacatcttcgacaagagcgtgctgaagaagctctcccggcgccactacacgggctgggggaagctgagcgccaagctgatcaacggcatccgggacgagaagtccgggaacaccatcctcgattacctgatcgacgacggcatcagcaaccgcaacttcatgcagctgatccacgacgacgcgctcagcttcaagaagaagatccagaaagcacagatcatcggcgacgaggacaaggggaacatcaaggaggtggtcaagtccctgcccggcagcccggccatcaagaaagggatcctgcagtccatcaagatcgtggacgagctcgtcaaggtgatgggcgggcgaaagcccgagagcatcgtggtcgagatggcccgcgagaaccagtacaccaaccagggcaagtccaacagccagcagcggctgaagcgcctggagaagtccctcaaggagctgggcagcaagatactgaaggagaacatccccgccaagctctccaagatcgacaacaacgcgctgcagaacgaccgcctgtacttgtactacttgcagaacgggaaggacatgtacaccggcgacgacctggacatcgaccggctaagcaactacgacatcgaccacatcatcccccaggccttcctgaaggacaactccatcgacaacaaggtgctggtgagctccgcgagcaaccgcgggaagtccgacgacgtcccgagcctcgaggtggtgaagaaacggaagacgttctggtaccagctgctcaagagcaagctgatctcccagcgcaagtttgacaacctgaccaaagcagagcgtggcggcctgagccccgaggacaaggccgggttcatccaacgccagctcgtcgagacccggcagatcaccaagcacgtggcgcgcctgctggacgagaagttcaacaacaagaaggacgagaacaaccgggccgtgcgcacggtcaaaatcatcaccctcaagtccaccctggtgagccagttccgaaaggacttcgagctgtacaaggtgcgcgagatcaacgacttccaccacgcccacgacgcctacctcaacgccgtggtggcgtccgccctgctgaagaagtaccccaagctcgagcccgagttcgtgtacggcgactacccgaagtacaatagcttccgggaacgcaagtccgccaccgagaaggtctacttctacagcaatatcatgaacatattcaagaagtccatcagcctggccgacgggcgggtgatcgagcgccccctgatcgaggtgaacgaggagaccggcgaatccgtctggaacaaggagagcgacctcgcgacggtgcggcgcgtcctgtcctacccccaggtcaacgtggtgaagaaggtcgaggagcagaaccacgggctggaccgggggaagcccaagggcctcttcaacgccaacctgagctccaagccgaagcccaacagcaacgaaaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgatcgcatcaactaccggaaggacaagctgaacttcctgctcgagaaggggtacaaggacatcgagctgatcatcgagctgccaaagtacagcctcttcgagctgagtgacggctcccgccgcatgctggcgagcatcctctccacgaacaacaagcgcggggagatccacaagggcaaccagatcttcctgagccagaagttcgtgaagctgctctaccacgccaagcggatctccaacaccataaacgagaaccaccggaaatacgttgagaaccacaagaaggagttcgaggagctgttctactacatcctggagttcaacgagaactacgtcggggccaagaagaacgggaagctcctgaacagcgcctttcagtcctggcagaaccacagcatcgacgagctgtgctctagcttcatcggccccacagggtccgagcgcaagggcctcttcgaactgaccagccgggggtccgccgcggacttcgagttcctgggcgtgaagatcccccgctaccgggactacacgcccagctccctcctcaaggacgctaccctgatccaccagagcgtcacggggctctacgagacccgcatcgacctggccaagttgggagagggcaagcggccggccgccacgaagaaggcgggtcaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8184 - RNA, 3581 nt, synthetic construct
  misc_feature 1..3581: note = Cas9 variant mRNA product
  source 1..3581: mol_type = other RNA
gggagagtccgctcagccaggttgcagaagcggcttagcgtgtgtcctaatcttctctctgcgtgtaggtaggcctgtgccgcaaacaagcttaccatggcaccgaaaaagaaacgcaaagtgggcatccacggagtaccagccgctgccgccttcaaaccaaacagcataaattatatcctcggcctagatatcggtatcgcctccgtagggtgggccatggtcgagattgatgaagaagaaaacccaatcaggctcatagacctaggcgtacgagtcttcgaacgcgccgaagtcccaaaaacaggagattccctcgctatggcacgaagactagcaagaagcgtgagacgacttacccgccgacgcgcccaccgcctcctccgaactcgtcgcctcctaaagcgcgaaggagtcctccaagccgccaatttcgacgaaaacggtctaatcaaaagcctccccaacacgccatggcaactccgagcagcggccctagaccggaaactaacacccctagaatggtccgctgtcctactgcacctcatcaaacaccgcggatacctaagccagaggaaaaacgaaggagagaccgccgacaaagaactaggcgcgctactgaaaggtgtagcaggcaacgcacatgccctacagacgggtgactttcgaacaccggcagagctcgcacttaacaaattcgaaaaagaatctggacatatccgaaatcaaagatccgactacagccacacattcagccgaaaagatctacaagccgaactcatccttctattcgaaaaacaaaaagagttcggaaatccccacgtatcgggcggactgaaggaagggatcgaaaccctactcatgacacaacggcccgccctatcaggcgatgccgttcagaaaatgctaggccactgcacattcgaaccagccgaaccaaaggcggccaaaaacacctacacagcggaacgcttcatctggttaactaaactgaataacttacgcatactcgaacaaggctctgaacgacccctcacggatacagaacgcgcaaccctaatggacgagccctaccgcaaaagcaaactgacctatgcacaagcgagaaaactcctaggactcgaagacacagccttcttcaaaggtctcaggtacggaaaagataacgccgaggccagcacactcatggaaatgaaagcctaccatgccatcagccgagccctggaaaaagagggcctcaaagataagaaaagccctctcaaccttagccccgaacttcaagatgaaatcggaaccgcatttagcctcttcaaaacagacgaagacatcaccggacgactgaaagaccgcatccaaccagagatactcgaggcgctgctaaaacacatatccttcgacaaattcgtacaaatcagcttaaaggcactacgccggatagtacccctaatggaacaagggaaacgatacgacgaagcatgtgccgaaatatacggtgatcactacggaaagaaaaacactgaagaaaagatctacctcccaccaatacccgccgacgaaataaggaaccccgtagtactacgtgccctctcacaagcacgcaaagtcattaacggagtagtcagaagatatggcagccccgcgcggatccacatcgaaacagcccgcgaagtaggcaaatctttcaaagatcgcaaagaaatcgagaaaagacaagaagagaatagaaaagatcgagagaaagccgccgcaaaattccgagaatatttccccaacttcgtcggtgaaccaaaaagtaaagacatcctcaaactccgcctctatgagcaacagcacggaaaatgcctatacagcggaaaagaaatcaacctcggccggctaaacgagaagggatacgtagaaatagaccacgccctcccattctcgcgaacatgggacgactcttttaataacaaagtcttagtcctcggatcagagaaccaaaacaaaggaaatcaaacgccatacgagtacttcaacggcaaggacaacagcagagaatggcaagagttcaaagcacgagtggaaacctcccgattcccacgctccaagaaacaaagaatcctactccagaaattcgacgaagacgggttcaaagaacgcaacctgaacgatacacggtacgtcaaccgcttcttatgccaattcgtggcggaccgcatgcgcctcacgggaaaaggtaagaaacgggtattcgccagcaacggacagataacgaacctcctccggggattctggggcctccgaaaagtccgggcagaaaacgaccgacaccacgcgctagacgcggttgtcgttgcttgcagcaccgtcgccatgcagcagaaaataaccagatttgtcagatacaaagagatgaacgcctttgacggaaaaactatcgacaaagagacaggcgaagtactacaccaaaagacacacttcccgcaaccatgggagttcttcgcccaagaagtcatgataagggtattcgggaaaccagacggcaaaccagagttcgaagaagcagacaccctagaaaagctccgcaccctactggcagaaaagttgagcagccgccccgaagccgtacacgaatacgtaacaccactcttcgtctcccgagcacccaaccgaaaaatgagcggccaaggccacatggaaaccgtaaaatccgccaagcgcctggacgaaggcgtctccgtactaagagtacccctcacccaactcaagctaaaagacctggagaaaatggttaacagagaaagagaaccaaagctatatgaggccctcaaggcgcgcctcgaggcacacaaagacgacccagcaaaagcattcgctgaacccttctataaatacgataaagccgggaacagaacacaacaggtaaaggccgtccgggtagaacaggtacagaagaccggagtctgggtccgaaaccataatggcatcgcagacaacgcaacaatggtacgcgtcgatgtgttcgaaaaaggcgacaagtactacctagtacccatatacagctggcaggtcgcgaaaggcatcctaccggacagggccgtagtccagggcaaagatgaagaagactggcagctaatcgatgattccttcaactttaaattcagcctacacccaaatgacctcgtagaagtaatcaccaaaaaggcaagaatgttcggatacttcgccagctgccacagaggaaccggaaacatcaacattcggatacacgacctcgatcacaaaataggcaagaatggcatactcgagggcataggggtcaaaaccgcactatccttccagaagtaccaaatcgacgagcttggaaaagaaatccggccctgtcgactgaagaaaaggccaccagttcggaagagaccggccgccaccaaaaaggcaggtcaagccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8185 - RNA, 4337 nt, synthetic construct
  misc_feature 1..4337: note = Cas9 variant mRNA product
  source 1..4337: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaagaagccatacaccatcggcctggacatcgggaccaacagcgtgggctgggccgtgctcaccgaccagtacgacctggtcaagcggaagatgaagatcgccggggactccgagaagaagcagatcaagaagaacttctggggcgtgcgcctgttcgacgagggccagaccgccgctgaccggcgcatggcgcggaccgcccgccggcgcattgagcggcgccggaaccgcatcagctacctccagggaatcttcgccgaggagatgtccaagaccgatgccaacttcttctgccggctgagcgactccttctacgttgacaacgagaagcgcaacagccggcaccccttcttcgcgacgatagaggaggaggtcgagtatcacaagaactaccccacaatctaccacctccgcgaggaactcgtgaactccagcgaaaaggccgacctgcgtctagtgtacctcgccctggcccacatcatcaagtaccgcggcaacttcctgatcgagggggccctcgacacccagaacacctccgtcgacggcatctacaagcagttcatccagacgtacaaccaggtgttcgcgtccgggatcgaggacggctcccttaagaagctggaggacaataaggacgtggccaagatcctcgtcgagaaggtgacccggaaggagaagctggagcgcatcttaaagctctacccgggcgagaagtccgccgggatgttcgcccagttcatcagcctaatcgtgggcagcaaggggaacttccagaagcccttcgacctgatcgagaagtccgacatcgagtgcgccaaggactcgtacgaggaggacctcgagtccctgctggcgctcatcggggacgagtacgccgagctgttcgtcgccgccaagaatgcctacagcgcggtggtgctgagtagcatcatcaccgtcgccgagaccgagacgaacgccaagctcagcgcctccatgatcgagcggttcgacacccacgaggaggacctgggcgagctgaaggcattcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaagagaacttcctgcgcaagcagcgcacattcgacaacggggcgattccccaccaactgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgattttggcaagtccgccgtagacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcgtatttcagcggccaggagaaggagcagatcttcaacgacctgttcaagcagaagcggaaggtcaagaagaaggacctcgagctgttcctgcgtaacatgtcccacgtggagagccccacgatcgaggggctggaggactccttcaacagctcctacagcacctaccacgacctcctgaaggtgggcatcaagcaggagatcctggacaaccccgtcaacacagagatgctcgagaatatcgtgaagatcctgacagtgttcgaggacaagcggatgatcaaggagcagctgcagcagttctccgacgttctcgacggcgtggtgctgaagaagctggagcgccggcactacacggggtggggccgcctcagcgccaagctgctgatggggatccgggacaaacagtcccacctcaccatcctggactacctgatgaacgacgacggcctcaatcgcaacctgatgcagctgatcaacgacagcaacctttcattcaagagcatcatcgagaaggagcaggtcaccaccgccgacaaggatatccagagcatcgtggccgacctggcgggatccccggccatcaagaagggcatcctgcagagcctcaagatcgtggacgaactggtctccgtgatgggctacccgccccagacgatcgtggtcgagatggcccgggagaaccagactaccgggaagggcaagaataacagccgcccccggtacaagtccctggagaaggccatcaaggagttcgggagccagatccttaaggagcaccccaccgataatcaggagctgcgcaacaaccgactgtacctctactacctgcagaacggcaaggacatgtacacgggccaggaccttgacatccacaacctctccaactacgacatcgaccatatcgtgccccagagcttcatcaccgacaactccatcgacaacctggtgctgaccagctccgccgggaaccgcgaaaagggcgacgacgtcccgcccctcgagatcgtgcgcaagcgcaaggtgttctgggagaagctgtaccaggggaacctgatgagcaagcgcaagttcgactacctgaccaaggcggagcggggcgggctgaccgaagccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccaactctacaaggtgcgcgacgtcaacgactaccaccacgcccacgacgcctacctgaacggcgttgtggcgaacactctgctcaaggtctacccccagctggagcccgagttcgtgtacggggactaccaccagttcgactggttcaaggccaacaaggcgaccgccaagaagcagttctacaccaacatcatgttgttcttcgcccagaaggaccggatcatcgacgaaaacggtgagatcctctgggataagaagtacctggacaccgtgaagaaggtcatgtcctaccgccagatgaacatcgtgaagaagacggagatccagaagggggagttctcgaaggccaccatcaagcccaagggcaactccagcaagttaatcccccggaagaccaactgggacccgatgaagtacgggggcctcgacagccccaacatggcctacgcggttgtcatcgaatacgccaagggcaagaacaagctggtgttcgagaagaagatcatccgcgtgaccatcatggagcggaaggccttcgagaaggacgagaaggccttcctggaggagcaggggtaccgccagccgaaggtcctcgccaagctgccgaagtacacgctgtacgagtgcgaggagggccggcgccggatgctcgcgtccgcaaacgaggcccagaaggggaaccagcaggtcctgcccaaccacctggtgaccctcctgcaccacgccgcgaactgcgaggtgagcgacggcaagtccctggactacatcgagagcaaccgcgagatgttcgcggaactcctggcccatgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaaattcttcgagaccacgatcgagcgcaagcggtacaacaacctcaaggagctgctgaacagcaccatcatctaccaatccatcaccggcctctacgagtctcgcaagcgcctcgacgacaagcggcccgccgccaccaagaaggcagggcaggcgaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8186 - RNA, 4370 nt, synthetic construct
  misc_feature 1..4370: note = Cas9 variant mRNA product
  source 1..4370: mol_type = other RNA
gggagagtccgctcagccaggttgcagaagcggcttagcgtgtgtcctaatcttctctctgcgtgtaggtaggcctgtgccgcaaacaagcttaccatggctcccaagaagaaacgcaaggtgggcatccacggggtcccggcagcgaagaagccctacagcatcggcctggacatcggcaccaattccgtgggttgggccgtggtaaccgacgactacaaggtgcccgccaagaagatgaaggtgctcgggaacacggacaagagccacatcgagaagaacctgctgggcgccctactgttcgactccggcaataccgccgaggatcggcgcctaaagcggaccgcgcgcagacgatacacccggcgccggaaccgcatcctctaccttcaggaaatcttctcagaggagatgggaaaggtcgacgactccttcttccaccggctggaggacagcttcctcgtgacggaagacaagcgaggcgagcggcaccccatcttcgggaacctggaggaggaagtgaagtaccatgagaacttcccgaccatctaccacctccgccagtacctggccgacaatcccgagaaggttgacctgcggctggtgtacctcgccctggcccacatcatcaagttccgcgggcacttcctgattgaggggaagttcgacacgcggaacaacgacgtgcaacgcctctttcaggagttcctggcggtctatgataacacgttcgagaactccagccttcaggagcagaacgtccaggtggaggagatcctcaccgacaagatctctaaaagcgccaagaaggaccgggtgctgaagctgttccccaacgaaaagtccaacggccgcttcgccgagttcctcaagctgatcgtgggcaaccaggccgacttcaagaagcatttcgagctggaggaaaaggccccgctacagttcagtaaggacacctacgaggaggagctggaggtgctgctcgcgcagataggtgataattacgccgagctgttcctgtccgccaaaaagctgtacgacagcatcctgctgtccggcattctaacagtcaccgacgtgggaacgaaggccccgcttagtgcttcaatgatccagcggtataacgaacaccagatggacctggcgcagctaaagcagttcataagacagaagctgagcgacaagtacaacgaagtgttctccgacgtcagcaaggacggctatgccggctacatcgacgggaagaccaaccaggaggccttctacaagtacctgaaggggctcctgaacaagatagaggggagcggctacttcctggacaagatagagcgcgaggacttcctacggaagcagcgtactttcgacaacgggtccataccccaccagatccacctccaggagatgcgggccatcatccgccgtcaggcagagttctaccccttcctcgcggacaaccaggaccgcatcgagaagctgctgaccttcagaatcccctactacgtggggccgctggcccgcggcaagagcgactttgcctggctgtcccgtaagagcgccgacaagataacgccctggaacttcgacgagatcgttgacaaggagagcagcgccgaggcgttcatcaacagaatgaccaactatgacctctacctccccaaccagaaggtcctgcccaagcactccctcctatacgagaagttcaccgtctacaatgagctgaccaaggtgaagtacaaaacggagcaagggaagaccgcgttcttcgacgctaacatgaagcaagagatcttcgacggcgttttcaaagtgtaccggaaggtcactaaagataagctcatggacttcctggagaaggagttcgacgagttccgcatcgtggacctgaccggtctggacaaggaaaacaaggtgtttaacgccagctacggcacgtaccacgacctgtgcaagatactcgataaggacttcttagataactccaagaacgagaagatcctggaggacatcgtcctgaccctcactctgttcgaggaccgggagatgatccgcaagcggctggagaactatagcgacctcctgacaaaggagcaggtcaagaagctggagcgccggcactacactgggtggggtcgcttgtccgcggagctaatccacggcatccggaacaaggagagcaggaagaccatcctagactacttaatcgacgacgggaactccaacaggaacttcatgcagctgatcaacgacgacgccttgtcttttaaggaggaaatcgccaaggcccaggtgatcggcgagaccgacaacctcaaccaagtggtgtccgacatcgccgggtctccggcgatcaagaagggcatcctgcagtccctgaaaatcgtggacgagctcgtcaagatcatgggccaccaacccgagaacatcgtggtggaaatggcccgtgaaaaccagttcaccaatcagggtcgccggaacagccagcagcgactgaagggcctgacggactccatcaaggagttcgggagccagatcctcaaagaacacccagtcgagaacagccaactgcagaatgaccgactgttcctctactacctgcaaaacgggcgcgacatgtacaccggggaggagctggacatcgactacctctcccagtacgatatcgaccacataatcccccaagccttcatcaaagacaacagcatcgataaccgggtgctgacctccagcaaagagaacaggggcaagtccgatgacgtacccagcaaggacgtcgtgcggaagatgaagtcctactggagcaagctgctctccgccaagctgatcacccagcgcaagttcgacaacttgacgaaggctgagcggggcgggctcaccgacgacgacaaggcgggcttcatcaagcgccagcttgtggagacccggcagatcaccaagcacgttgcccggatcctggacgagcggttcaacaccgagacggacgagaacaataagaaaatccgccaggtgaagatcgtgaccctcaagagcaacctggtctccaacttccggaaggagttcgaactgtacaaggtccgagagataaatgactaccaccacgcccacgacgcctacctcaacgccgtgatcgggaaggcgctgctgggcgtctacccccagctcgagcccgagttcgtttacggggactacccccacttccacggccacaaggagaacaaggccaccgccaagaagttcttctacagcaacatcatgaactttttcaagaaggacgatgtgcggactgacaagaacggcgagatcatctggaagaaagacgaacacataagtaacatcaagaaggtcctgagctacccccaggtgaacatcgttaaaaaggtcgaggagcagaccggaggcttctccaaagagtcgatcctccccaaggggaactccgacaaacttatcccccgcaagacgaagaagttctactgggacaccaagaagtacggcgggttcgacagccccatagtggcctacagcatcctggtgatcgcagacatcgagaagggcaagtccaagaaactgaagaccgtcaaggcactcgtgggcgtaacgataatggaaaagatgaccttcgagcgggacccggtcgccttcttggagcgcaaggggtatcgcaatgtgcaggaggagaacatcatcaagctgcccaagtatagcctcttcaagctcgagaacgggcggaagcgcctgctagcctccgccagggagctgcagaaggggaacgaaatcgtgctgcccaaccaccttggaaccctgttataccacgcgaagaacatccacaaggtcgatgagccgaagcatctcgactacgtggacaaacacaaggatgagtttaaggaactgctggacgtggtctcaaacttctccaagaagtacaccctcgccgagggtaatctagagaagatcaaggagctgtatgcccagaacaacggcgaggacctcaaggagctcgctagcagtttcatcaaccttctcactttcacggccatcggggcgcccgccaccttcaagttcttcgataagaacatcgaccgcaagcggtacaccagcacgaccgagatcctgaacgccacgcttatccaccagtccataaccggactctacgagacgcgcatcgacctgaacaagctgggcggggacaagcggcccgccgccaccaagaaggcgggccaagccaaaaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8187 - RNA, 3503 nt, synthetic construct
  misc_feature 1..3503: note = Cas9 variant mRNA product
  source 1..3503: mol_type = other RNA
gggagagtccgctcagccaggttgcagaagcggcttagcgtgtgtcctaatcttctctctgcgtgtaggtaggcctgtgccgcaaacaagcttaccatggcacctaaaaagaaacggaaagtgggcatacacggcgttccagccgcacaaacaaccaacctcagttacatactaggtctagacctcggtatcgcatcagtcggctgggccgtcgtcgaaatcaacgaaaacgaagaccccatcggactaatagacgtcggcgtaaggatattcgaacgcgccgaagtcccaaaaaccggagaaagcctagcactgtccaggagactcgcgcggagtacccgccgcctaatacgccgccgagcccaccgcctactcctcgcgaaacgcttcctcaagagagaaggcatactgagcaccatagacctcgagaaaggcctgccaaaccaggcctgggagctaagagtcgccggcctcgaaaggcgactatcggccatcgaatggggagccgttctcctgcacctaataaaacacagggggtacctatcgaaaagaaagaacgagagtcaaacgaacaacaaggagctgggcgccctgctaagcggagtggcgcaaaaccaccagctcctacaatccgacgactaccgaacacccgcagaattagccctcaagaaatttgcaaaagaagaggggcacataagaaaccaacgcggcgcttacacacacaccttcaatagattagacctcttagcagaactgaacctgctattcgcacaacagcatcaattcggaaacccacactgtaaagagcacatccagcaatacatgactgaactcctaatgtggcagaaacccgcactcagtggcgaggccatcctaaaaatgctcggaaaatgcacacacgagaaaaacgagttcaaagccgcgaaacatacctacagcgccgaacgttttgtttggctcaccaaactcaataaccttcgaatactcgaagacggggccgaacgggcactaaacgaagaagaaagacaactactaatcaaccacccgtacgaaaagagcaaactaacatacgcgcaggtacgaaaattactaggcctctccgaacaagctattttcaagcacctacgctacagtaaagaaaacgcagagtcagccaccttcatggagctcaaagcctggcacgccatacgaaaagcactcgaaaaccagggcctgaaggacacctggcaggacctcgccaagaaacccgatctcctcgacgaaatcggaaccgccttctcactctacaaaacagatgaagacatccaacaatacctaacgaacaaagtacccaacagcgtaataaacgcactactcgtatccctgaacttcgataagttcatcgaactcagcctgaaaagcctgagaaaaatacttcctctaatggaacaaggcaaacgctacgatcaggcctgccgcgagatctacggacatcactacggggaggccaaccaaaagacgtcacaactcctgcccgccattccagcccaagaaatacgcaaccccgtagtcctgcgaacgctgtcccaagcaagaaaagtaataaacgccatcatacgacaatacggctcccccgcccgagtccacatagaaacgggtcgagaactagggaaatccttcaaagaacgacgcgaaatccaaaaacagcaggaggataatcgaaccaaacgcgagtcagcggttcaaaagttcaaggaactcttctccgacttcagcagcgaaccaaaatctaaagacatactcaagttccgcctttacgagcaacaacacggtaaatgcctatactcgggcaaagaaatcaacatacacaggctgaacgaaaaaggatacgtcgagatcgaccacgcactacccttcagtcggacctgggacgactcattcaacaataaagtacttgtcctagcaagcgagaaccaaaacaaaggcaaccagacaccatacgagtggctacaagggaaaataaactccgaacgctggaaaaacttcgtcgcactggtactcggcagccagtgctcagccgcgaagaaacaacgcctcttgacccaggtcattgacgacaacaaatttatcgaccgcaaccttaacgacactcgatacatcgcacgcttcctatcaaactacatccaggaaaacctcctactcgtcggcaaaaacaaaaagaacgtattcacgccaaacggccaaatcacagccctgctccggtcgcgatggggactaatcaaagctcgagaaaacaacaaccgacaccatgccctagatgcgatcgtggtcgcttgcgcgaccccctcaatgcaacagaaaataacccgcttcatccgatttaaagaagtccacccctacaaaatagaaaaccgatacgaaatggtcgaccaagagagtggagaaattataagcccccacttccccgagccatgggcatacttcaggcaagaggtaaacatccgagtattcgacaaccaccccgacacggtgctaaaagagatgctcccggaccggccacaggcaaaccaccaattcgtacaacctctattcgtctcccgagcgcccaccagaaaaatgtccggccaaggccacatggaaaccatcaagtccgccaaacggctggcagaaggcatctccgtactccgaatacccctaactcaactcaaacccaatctcctggaaaacatggtaaataaggagcgcgaacccgccctgtacgcaggccttaaagcccgactcgccgagttcaaccaggaccccgcaaaagccttcgccacaccattctacaaacaaggcggccagcaggtaaaagcaatccgagtagagcaagtacaaaaatcaggagtcctagtacgcgaaaacaacggagtcgccgacaatgcctcaatcgtacgaaccgacgtattcatcaaaaacaacaaattctttctcgtccccatctacacgtggcaagtagcaaagggaatcctaccaaacaaggcaatcgtcgcacacaaaaatgaagacgaatgggaagaaatggacgaaggtgccaaattcaagttctctctcttccccaacgaccttgtcgaactaaaaaccaagaaagaatacttcttcggctactacatcggactggaccgggcaacagggaacataagcctaaaagagcacgacggcgaaatctccaaaggcaaagacggagtctacagggtaggcgtcaaacttgcactgagctttgaaaaataccaagtagatgagcttgggaaaaaccgacaaatctgccgaccccaacaaagacaacctgtcagaaagagaccagccgcaactaaaaaggcaggacaagccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8188 - RNA, 3581 nt, synthetic construct
  misc_feature 1..3581: note = Cas9 variant mRNA product
  source 1..3581: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaacgcaaagtcggaatccacggagtaccagcagcagccgcctttaaaccaaacccaatcaactacatactcggattagacatagggatagcatcagtcggatgggccatggtcgagatcgacgaggacgaaaaccccatatgcctcatagacctgggggttagggttttcgagcgtgcagaggttccaaaaacaggcgacagcctagcaatggcacgtagactagcgcgctctgtccgcagactcacgagacgacgggcccacagactgctaagagcccgccgcctgctcaaaagagaaggagtcctacaagccgccgactttgacgaaaacggactcataaaaagcctccccaacacaccctggcaacttcgggcggccgccttagaccgaaaactcacacccctcgagtggtccgccgtgctactgcacctgatcaaacatcgaggatacctcagccaacgcaaaaacgagggagaaacggcagacaaagagctcggcgcactgcttaaaggcgtagcggacaacgcacacgcactacagacgggggacttccgcacgccagccgagctcgcactcaacaaattcgagaaagaaagcggtcacatccgaaaccagcgcggagactactcccacacattctcccgaaaagacctgcaagccgaactcatcctactattcgaaaaacagaaagagttcggcaacccacacgtatcaggcggtctaaaagaaggtatagaaacactcctcatgacccaaagaccggccctgtcaggagacgcagtccagaaaatgctcgggcattgcacattcgaaccagcagagcccaaggcagctaaaaacacatacaccgcagaacgattcatctggctgaccaagctcaacaacctcagaatattagaacaagggtctgaacgccccctgactgacacggaacgcgcaacactcatggacgaaccgtaccgcaaaagcaaactcacctacgcacaagcccgtaaactactgggcctcgaagacacagctttcttcaagggtctgcgatacggaaaagacaacgcagaagcatcaacattaatggaaatgaaggcttaccatgccatcagccgagccctagaaaaggaaggcctaaaagataagaaaagtcccctaaacctgtcgcccgagctacaagatgaaatcggcacagccttctcgctttttaaaaccgacgaggacatcacagggcgactcaaagaccgaatacaacccgagattctggaggcgctcctcaaacacatatcattcgacaaattcgtccaaatatccctcaaagcactacgcagaatcgttcctctcatggaacaaggcaaacgctacgatgaagcctgcgcagaaatatatggagaccattacgggaaaaagaacaccgaagagaaaatctatctgcccccgatcccagcggacgaaatacggaatcccgtcgttctgcgagcgctatcccaagcgagaaaagtaatcaacggggtcgtcagacgctacggcagtcccgcaagaatacacatagaaaccgcccgagaggtcggcaaatccttcaaagaccgcaaagagatcgaaaaacgccaagaagaaaatcgcaaggaccgagaaaaagcggcagcgaaattcagagaatacttcccaaacttcgtcggggaacccaaatccaaagatatcctaaaactccgcctatatgaacaacagcatggcaaatgcctctacagcggtaaggaaatcaacttaggaagactgaacgaaaaaggctacgtggaaatagaccacgcgctcccattcagccgcacttgggacgactcattcaacaacaaagtgctggtcctcggctcagagaaccagaataaagggaatcaaaccccctacgaatacttcaacggcaaagacaacagccgcgaatggcaagagttcaaggcacgagtggagacctcgcgcttccccagaagcaagaaacagcgaatactcctacagaaattcgacgaagatggcttcaaagaaaggaacctaaatgacacacgctacgtaaaccgctttctttgccaattcgtagcagaccggatgcggctcactggaaagggcaaaaagagagtcttcgcatccaacggacaaatcactaacctgctgaggggattctggggattacgcaaagtccgggcagagaacgaccgacaccatgcgctcgacgccgtagtcgtagcatgcagcaccgtagccatgcaacagaaaatcacgcgcttcgtgagatacaaggaaatgaacgcattcgacggaaagaccatcgacaaagagaccggagaagtcctacaccagaagacccatttcccccaaccctgggagttcttcgcccaggaagtcatgatacgcgtcttcggcaaacccgacggaaagccagagttcgaagaagcggacacgccagaaaaactaagaacgctgctcgccgagaaacttagctccagacctgaagcagtacatgaatatgtaaccccactcttcgtaagccgagccccgaaccgcaaaatgtccggccaggggcacatggaaacagtaaaatcagccaaacgcctagacgagggcgtgagcgtactaagggtaccgcttacacaactcaagctaaaagacctagagaaaatggtcaaccgcgagcgcgaaccaaagctctacgaggcccttaaggctcggctagaggcacacaaagacgacccagccaaagccttcgcggaaccgttttacaaatacgacaaggccggcaatcggactcaacaagtcaaagccgtaagagtagagcaggtccagaaaacaggcgtctgggtacgtaaccacaacggcatagcagacaacgccactatggtacgcgtcgacgtgttcgaaaaaggcgacaaatattatctagtgcccatatacagctggcaagtcgcaaaaggaatcctaccagaccgcgcggtggtccaaggaaaggacgaagaagactggcaactcatcgacgacagcttcaacttcaaattcagcctacaccccaacgacctagtcgaagtcatcacaaagaaggcccggatgttcgggtacttcgcctcctgccaccgcggcaccggtaacataaacataaggatccatgacctcgaccacaaaataggcaaaaacggaatattagaaggcatcggggtaaaaacagcccttagcttccaaaaataccaaatagacgagctaggaaaagaaataaggccctgccgactcaaaaagagaccaccagtgcgcaaaaggcccgcagcaacgaagaaagccggccaagccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8189 - RNA, 3587 nt, synthetic construct
  misc_feature 1..3587: note = Cas9 variant mRNA product
  source 1..3587: mol_type = other RNA
gggagagtccgctcagccaggttgcagaagcggcttagcgtgtgtcctaatcttctctctgcgtgtaggtaggcctgtgccgcaaacaagcttaccatggcaccgaagaagaaaaggaaagtcggcattcacggagtcccagccgcaaaataccatgtaggcatagacgtaggaacattcagcgtagggctcgcggcaatagaggtagacgacgcaggtatgcccatcaaaaccctaagccttgtgtcacacatccacgacagcggcctcgatccagatgaaatcaaatcggcggtcacgcgactagcaagcagcggtatcgccagacgaacgcgcagactgtaccgaaggaaaaggagaagactccagcaactggacaaattcatacaacggcaaggatggccagtgatagaattagaggactacagcgacccactatacccctggaaagtaagagccgagctcgcagcaagttacattgcggatgagaaagaacgaggcgagaaattgagcgtggcactgagacatatcgccagacacagaggatggcgcaacccatacgcaaaagtaagcagcctatacctcccagacgggccgtccgacgcattcaaagcgatcagagaagagataaagagggcgagtgggcaaccagtgccagaaacagccacggtgggacaaatggtgaccctatgcgaactaggcacgctgaagctaagaggagaaggcggagtcctgagtgcacggttgcagcaaagcgactacgcccgcgaaatacaagaaatatgccgcatgcaagaaatagggcaagaactctacagaaaaataatcgacgtagtattcgcagctgaaagcccaaaggggagcgccagcagccgagtaggaaaagaccccttacaacccgggaaaaaccgcgcgctaaaggccagcgacgcattccaacgatacaggatagcagccttaataggaaacctaagagtccgagtagatggagagaaacgcatcctcagcgtagaggagaagaacctcgtgttcgaccatctggtcaatctaaccccaaagaaagaaccagaatgggtaacgatcgcagaaatactgggcatagacagagggcagctaataggaaccgccacgatgacggacgacggagaacgcgcgggagcccgaccacctacgcacgacacgaacagatccatcgtgaacagccgaatagccccgctagtcgactggtggaaaacagcgagcgccctcgaacaacatgcaatggtcaaggctctaagcaacgcggaagtagacgacttcgactcaccagagggagcaaaagtccaagcattcttcgccgacctagacgacgacgtccacgcaaaactcgactcccttcatctgccagtcggacgagcggcgtacagcgaagacaccctagtacgattaacacgacgcatgctaagcgacggagtagatctgtacaccgcaagactacaggagttcggcattgaaccaagctggacgccaccaacccccaggatcggagaaccagttggtaacccagctgtagaccgagtactaaaaacagtcagtcgatggcttgaaagtgcgaccaagacttggggagcaccagaacgggtcataatagaacacgtaagggagggatttgtaacagaaaaacgggcgcgagaaatggacggggacatgcgtagacgagcagcaaggaacgcaaaactgttccaggaaatgcaggagaaactaaacgtacaaggaaaaccctctagagcagatctctggcggtaccagagcgtccaaagacaaaactgccaatgcgcatactgcggcagcccaatcacgttcagcaactcagaaatggaccacatcgtgccaagggctgggcagggatccaccaacacgcgcgagaacctagtggcggtgtgccacaggtgtaaccaaagcaaaggaaacaccccgttcgcgatatgggcgaaaaacacctccatagagggcgtaagcgtaaaggaagctgtggaaagaacacgacactgggtcacggacacaggaatgcgctcaaccgactttaagaaatttacaaaggctgtcgtcgagaggttccaaagagcaacgatggacgaagagatagacgcaaggagcatggaatcggtcgcatggatggcaaacgaattgcgcagtcgggtagcacagcacttcgctagccacggaacaacggtacgagtctaccgcggaagcctcacagcggaagcacggagggccagcggcataagcggcaaactaaagttcttcgacggagtcgggaaatctcgcctagaccgcagacaccatgccatagacgcggccgtgatcgcattcacaagtgactacgtggccgagaccctagcagtacgaagcaatttgaagcaaagccaagcgcacagacaggaagccccgcaatggcgagagttcacaggaaaagacgcagaacacagagcggcatggagggtatggtgccagaaaatggaaaaactaagcgcattgctcaccgaagacctcagggacgacagagtcgtcgttatgagcaacgtgcggctacgcctcggcaacggctcggcccacaaagaaacaataggaaaactcagcaaggtcaaactaagctcacaactgtccgtatccgacatagacaaagcgtcgagcgaagcactctggtgcgcgctaacgcgagaacccggatttgaccccaaggaaggcctccctgcaaacccagaacggcacatacgagtaaacggtacacacgtgtatgctggtgacaacatcggattattcccagtctcagcaggaagtattgcgctgcggggaggatacgcagaactcggctcaagttttcaccacgcaagggtatataaaataacaagcgggaagaaaccagcattcgctatgttgagagtatacacgatagacctgctcccctaccgcaaccaagacctattcagcgttgaactaaaaccacaaacaatgtcaatgaggcaagccgaaaagaaactgcgagacgccctcgccaccgggaacgccgaatacctcggctggttagtcgtcgacgacgagctcgtagtagacaccagcaaaatagcaacggaccaagtaaaagcagtcgaagcggagctaggaacgataagacgatggagggtagatggatttttcagcccaagcaaactacgcctaagaccgcttcaaatgtcaaaagaaggcatcaaaaaggaaagcgcaccagagctgagcaagataatcgacagacccggctggctaccagcagttaataaactcttcagcgacggcaacgtcacagtcgtgcgaagggactcgttggggcgggtacggctagaaagcacagcgcacctacccgtcacatggaaggtacaaaagagaccagccgcgacgaagaaggcaggccaggcgaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8190 - RNA, 3287 nt, synthetic construct
  misc_feature 1..3287: note = Cas9 variant mRNA product
  source 1..3287: mol_type = other RNA
gggagagtccgctcagccaggttgcagaagcggcttagcgtgtgtcctaatcttctctctgcgtgtaggtaggcctgtgccgcaaacaagcttaccatggcccccaagaagaaacgcaaggtgggcatccacggggtcccggccgcggcccggatactggccttcgacatcggcatcagctccatagggtgggccttcagcgagaacgacgagctcaaggactgcggcgtgcgcatcttcactaaggtggagaaccccaagacaggagagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgatgagagcctcgccaaggcctacaaaggctccctgatcagcccctacgagctgcggttccgcgcactcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacttgtacaaggagtacttccagaaattcaaggagaacagcaaggagttcacgaacgtgcgcaacaagaaggagtcctacgagcggtgcatcgcccagagcttcctgaaggacgagctgaagctcatctttaaaaagcagcgcgagttcgggttctccttcagcaagaagttcgaagaggaggtcctttccgtggcgttctacaagcgggctctgaaggacttcagccacctcgtgggcaactgctccttcttcaccgacgagaagcgcgccccgaagaacagccccctggccttcatgtttgtcgccctgacccggatcatcaatctcctgaacaacctgaagaacaccgagggcatcctctacacgaaggacgacctgaacgcgctgcttaacgaggtgctgaagaacggcaccctgacctacaagcagaccaagaagctcctggggctgagcgacgactacgagttcaaaggggaaaagggcacgtacttcatcgagttcaagaagtacaaggagttcattaaggccctcggggagcacaacctgtcccaggacgacctgaacgagatcgccaaagacatcaccctcatcaaggacgagatcaagctgaagaaggccctggccaagtacgacctcaaccagaaccagatcgacagcttatccaaacttgagttcaaggaccacctcaacatcagcttcaaggcgctaaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgtgcgatcaaggagtaccgcaaggtgctgaacgccctcctgaagaagtacggcaaggtgcacaaaatcaacatcgagctggcgcgggaggtcgggaagaaccactcccagcgcgccaagatcgagaaggagcagaacgagaactacaaggccaagaaagacgcggagctcgagtgtgagaagctgggcctgaagatcaacagcaagaacatcctcaagctgcggctgttcaaggagcagaaggagttctgtgcctactccggggagaaaatcaagatcagcgacctccaggacgagaagatgttagagatcgaccacatctacccatactcccgcagcttcgacgactcctacatgaacaaggtgctggtgttcaccaagcagaaccaggagaagctcaaccagacccccttcgaggccttcggcaacgacagcgcgaagtggcagaagatcgaggtcctggcaaagaacctacccaccaagaagcagaagcggatcctcgacaagaactacaaggacaaggagcagaagaacttcaaggaccgcaacctgaacgacacacggtacatagctcgcctggtgctcaactacaccaaggactacctggacttcctgccgctctccgacgacgagaacaccaagctgaacgacacccagaaggggagcaaggtgcacgtcgaggccaagtccggcatgctgacgagcgctctccggcacacctggggcttctccgccaaggaccgcaacaaccacctccaccacgccatcgatgcggtgataatcgcctacgccaacaacagcatcgtcaaggccttctccgacttcaaaaaggagcaggagagcaacagcgcggagctgtacgccaagaagatctccgagctggactacaagaacaagcggaagttcttcgagcccttcagcggtttccgccagaaggtgctggacaagatcgacgagatcttcgtgtccaaacccgagcggaagaagcccagcggtgccctgcacgaggagaccttccgtaaagaggaggagttctaccagtcctacgggggcaaggagggggtcctcaaggcgctggagctgggcaagatccggaaggtgaacgggaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttttgcttctccctctacaaggacagcctgatcctgatccagaccaaggacatgcaagagcccgagttcgtgtactacaacgccttcacctcctcaaccgtgtccctcatagttagcaagcacgacaacaagttcgagacgctgtccaagaaccagaagatcctgttcaaaaacgcaaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8191 - RNA, 3698 nt, synthetic construct
  misc_feature 1..3698: note = Cas9 variant mRNA product
  source 1..3698: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgtcggacctagttctcggcctggacatcgggattggctccgtgggggtcgggatcctgaacaaggtgaccggcgagatcatccacaagaacagccggatcttccccgccgcccaggccgagaacaacctagtgcgccggacgaaccgccagggccggcgcctggcccggcgcaagaagcaccggcgcgtccggctgaaccgcctcttcgaggagtccggcctgatcacggacttcaccaagatcagcataaacctgaacccctaccagttacgggtgaaggggctgaccgacgaactgtccaacgaggagctgttcatcgcgctgaagaatatggtgaagcaccgcggcatcagctacctggatgacgcctccgacgacgggaacagctccgtcggcgattacgcccagatcgtgaaggagaatagcaagcagctcgagaccaagacgcccggacagatccagctggagcggtaccagacctacgggcagctgcgcggcgatttcaccgtggagaaagacgggaagaagcaccgactcatcaacgtcttcccgacctccgcctaccgaagcgaggcgctgcggatcctgcaaactcagcaggagttcaacccccagatcaccgatgagttcatcaaccgctacctcgagatcctgaccggcaagcggaagtactaccacggccccgggaacgagaagtcccgcaccgactacggccgctatcggacgagcggggagaccctggacaacatcttcggcatcctcatcgggaagtgcaccttctaccccgacgagttccgcgccgccaaggcctcctacaccgcccaggagttcaaccttttaaatgacctcaacaacctgacggtgccgaccgaaaccaagaagctcagcaaggagcagaagaaccagatcatcaactacgtgaagaacgagaaggctatgggccccgccaagctgttcaagtacatcgccaagctcctgtcctgcgacgtcgccgacatcaagggctaccggatcgacaagagcgggaaggccgagatccataccttcgaggcgtaccgcaagatgaagacgctcgagaccctggacatcgagcagatggacagagagaccctggacaagctcgcctacgtactgaccctgaacacggagcgcgagggcatccaggaggccctcgagcacgagttcgccgacgggtccttcagccagaagcaggtcgacgagctggtgcagttccggaaggccaacagctccatcttcggcaaagggtggcacaactttagcgtgaagctgatgatggagctcatccccgagctgtacgagaccagcgaggagcagatgaccatcctgacccgcctcggcaagcagaagacaaccagctccagcaacaagactaagtacattgacgagaagctgctgaccgaggaaatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgcctcacagcgtgttccacggccacaagcagctggccaccaagatccggctgtggcaccagcagggcgagcgctgcctctataccggcaagaccatctccatccacgacctgatcaacaacagcaaccagttcgaggtcgaccacatcctgcccctctccatcacgttcgacgacagcctggccaacaaagtgctggtgtacgcgaccgccaaccaggagaaggggcagcggacgccctaccaggccctggactccatggacgacgcctggtcgttccgcgagctgaaggccttcgtccgggagtccaagaccctgagcaacaagaagaaggagtacctcttgaccgaggaggacatctccaagttcgacgtgcgcaagaagttcatcgagcggaacctcgtggacacgcgctacgcgagccgggtcgtgctcaacgccctgcaggagcacttccgcgcccataaaatcgacaccaaggtgtccgtggtgcgcggccagttcaccagccagttaagacgccactggggcatcgagaagacccgggacacgtaccaccaccatgcagtggacgccctcatcatcgcggcctcctcccagctgaacctgtggaagaagcagaagaacaccctcgtcagctactccgaggaccagctgctggacatcgagaccggggagctcatcagcgacgacgagtacaaggagtccgtgttcaaggccccctaccaacatttcgtggacaccttaaagagcaaggagttcgaggattccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctcgagaactaccccaacaagcagatcaacgagaagggcaaggaggttccctgcaacccgttcctcaagtacaaggaggagcacgggtacatccggaaatacagcaagaagggcaacgggcccgagatcaagtccctgaagtactacgacagcaagctgggcaaccacatcgacattacccccaaagactccaacaacaaggtggtcctccagagtgtgtccccctggcgcgccgacgtgtacttcaacaagaccaccgggaagtacgagatcttgggcctgaaatacgcggacctccagttcgagaagggcacggggacctacaagatcagccaggagaagtacaacgacatcaagaagaaagagggcgtcgacagcgactccgagttcaagttcaccctgtacaagaacgacctgctcctggtgaaggacaccgagacgaaggagcagcagctgttccggttcctcagccgcaccatgccaaagcagaagcactacgtggagctaaagccctacgacaagcagaagttcgagggcggagaggccctgatcaaggtcctcgggaacgtggccaactccggccagtgcaagaagggactgggcaagagcaacatctccatctacaaggtgcggaccgacgtcctggggaaccaacacatcattaagaacgagggggacaaacccaagctcgacttcaagcgccccgccgccaccaagaaggcgggccaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8192 - RNA, 4256 nt, synthetic construct
  misc_feature 1..4256: note = Cpf1 variant mRNA product
  source 1..4256: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggaatccacggcgtcccggccgcgacccagttcgagggcttcaccaacctgtaccaggtgagcaagacgctccggttcgagctgatcccccaggggaagaccctgaaacacatccaggagcagggcttcatcgaggaggacaaggcccgcaacgaccactacaaggaactcaaacccatcatcgaccggatctataagacctacgccgaccagtgcttgcagctggtgcagctcgactgggagaatctgtccgccgccatcgacagctaccgcaaggagaagaccgaggagacccgtaacgcgcttatcgaggagcaggccacctaccgcaacgctattcatgactacttcatcgggcggaccgataacctcaccgacgccataaacaagcgccacgctgaaatctacaagggcctcttcaaggccgagctattcaacggcaaggtactaaagcagttagggacggtgaccaccaccgagcacgagaatgccctactccggtccttcgacaaattcacgacctacttctcaggcttctacgaaaaccgcaagaacgtgttcagcgcagaggacatcagcaccgcaatcccccaccggatcgtccaggacaatttcccgaagtttaaggagaactgccatatcttcacccgtctgatcacggcggtgccgtccctgcgggaacacttcgaaaacgtgaagaaggccatcggaatttttgtcagcacctccatcgaggaggtgttcagtttccccttctacaaccagttgctgacccagacccagatcgacctgtacaaccagctcttgggcgggatctctcgcgaggccggcacggagaagataaagggcttaaatgaggtgctcaacctggccatacagaagaacgacgagacagcccacatcatagcgagcctgccccaccggttcatcccgttattcaaacagatcctgtctgaccgtaacacccttagcttcatcctcgaggagttcaagagtgacgaagaggtcatccagtcgttctgcaaatacaagacccttctgcggaacgagaatgtgctcgagacggccgaggcccttttcaacgaactgaactccatcgacctcacccacatcttcatcagccacaagaaactcgagaccatcagcagcgccctgtgcgaccactgggacaccctccgcaacgccctgtacgagcggcgcatcagtgagctgacgggcaagatcaccaagtccgcgaaggagaaggtgcagcggagcctcaagcatgaagacatcaacctgcaggagatcatctccgccgccggcaaggagctgagtgaggccttcaagcaaaagacctcagaaatcctatcccacgctcatgcggccctggaccagccgttgcccaccacgctcaagaagcaagaagagaaggagatcctgaaatcccagttagacagcctgctcgggctgtaccacctcctcgactggttcgcagtcgacgaatccaacgaggtggaccccgagtttagcgcccgcctgaccggcattaaactggagatggagccgtccctcagcttctacaacaaggcgcgcaactacgccaccaagaagccctactccgtggagaagttcaagctgaacttccagatgcccacgctggccagcggctgggatgtaaacaaggagaagaacaatggggccatactcttcgtgaagaacggcctgtactacctggggatcatgcctaagcaaaagggccggtacaaggccttatccttcgagcccacggagaagaccagcgaagggttcgacaagatgtactacgactacttccccgacgcggccaaaatgatccccaagtgctccacacagctgaaagcagtgaccgcccacttccagacccacacgaccccgattctgttgagtaacaacttcatcgagccgctggagatcaccaaagagatctacgatctgaacaaccccgagaaggagcccaaaaagttccagaccgcctatgcgaaaaagacgggagaccagaaaggctaccgcgaggccctgtgcaagtggatcgacttcacccgggatttcctatccaagtacaccaagaccacgagcatcgacctgagttcactccggccaagctcccagtacaaagatctgggggagtactacgccgagctgaatccgctcctgtatcacatctcattccaacggatcgccgagaaagagatcatggacgccgtagagacgggcaagctctacctcttccagatctacaacaaggacttcgcgaagggacaccacggcaagcctaacctgcacacattgtactggaccggcctcttctcccccgagaacctcgccaagacgagcatcaagctgaacgggcaggccgagctgttctacaggcccaagagccggatgaagcgcatggcccacaggctgggtgagaagatgctgaacaagaagctaaaggaccagaagaccccgatccccgacaccctgtaccaagagctgtatgactacgtgaaccatcgcttaagccacgacctctccgacgaggcgcgtgccttactccccaacgtgatcaccaaggaggtcagccatgagatcatcaaggaccgcagattcacgtccgacaagttcttcttccacgtgccgatcacactgaactaccaggccgctaacagcccctccaagttcaaccagcgcgtcaacgcctacctaaaggagcaccccgagacgcccatcattgggatagaccggggcgagcgcaacctgatctatatcaccgtgatcgacagcacggggaagatcctggagcaacgatccctgaacaccatccagcagttcgactaccagaagaaactcgacaaccgcgaaaaagagcgggtggcggcacgccaggcctggagcgtcgtgggcaccatcaaggacctgaagcaggggtacctgagccaggtgatccacgagatcgtcgacctcatgattcactaccaggccgtcgtggtcctggagaacttaaacttcggcttcaaatcgaaacgcaccggcatcgccgagaaagcggtgtaccagcagttcgagaagatgctcattgacaagttaaactgcctggtgctaaaagattacccggccgagaaggtcggaggcgtgctgaacccctaccagttgacggaccagttcaccagcttcgccaagatgggcacccagtctggcttcctcttctacgtgcccgccccctacaccagcaagatcgacccgctgacggggttcgtagaccccttcgtttggaagaccatcaagaaccatgagagtcggaagcacttccttgaggggtttgacttcctccactatgatgtgaagactggcgatttcatcctgcacttcaagatgaaccgcaacctgagcttccagcgggggctccccggtttcatgcccgcctgggacatcgtcttcgagaagaatgagacccagttcgacgcgaaggggacgcccttcatcgccggcaagcgcatagtccctgtgatcgagaaccaccggttcaccggccgctaccgggatctgtaccccgcaaacgagctgatcgccctcctggaggagaaggggatcgtctttcgagacggctccaacatcctgcccaagttgttagagaatgacgacagccacgcaatcgacaccatggtggccctgattcggtccgtgctccagatgcgcaacagcaacgcggccaccggggaggactacatcaactccccggtccgggacctgaacggcgtgtgctttgatagccgcttccagaaccccgagtggcccatggacgccgacgcgaacggggcctaccatatcgccctgaagggacaactcttgctgaaccacctcaaggagtctaaggacctcaagctgcaaaacggtatcagcaaccaggactggctcgcctatatacaagagctgcggaacaagcgccccgccgcgactaaaaaggctgggcaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8193 - RNA, 4235 nt, synthetic construct; identical to SEQ ID NO: 2393
  misc_feature 1..4235: note = Cpf1 variant mRNA product
  source 1..4235: mol_type = other RNA

SEQ ID NO: 8194 - RNA, 4420 nt, synthetic construct
  misc_feature 1..4420: note = Cas9 variant mRNA product
  source 1..4420: mol_type = other RNA
gggagagtcccgcagtcggcgtccagcggctctgcttgttcgtgtgtgtgtcgttgcaggccttattcaagcttaccatggcccccaagaagaagcgcaaagtgggaatccacggggtgccggcggcggacaagaagtacagcatcggcctggacatcgggaccaactcagtgggctgggccgtaatcaccgacgaatacaaagtccccagcaagaagttcaaggtgctggggaacacggaccggcattccatcaagaagaacctgatcggtgccctgctgttcgactcgggcgagaccgccgaggccacccgcctgaagcgaaccgcgcgccggcgctacacgcggcgcaagaaccggatctgttacctgcaggagatcttctccaacgagatggccaaggtggacgacagcttcttccaccgcctcgaggagtccttcctggtcgaggaggacaagaagcacgagcggcaccccattttcgggaacattgtggacgaagtggcctaccacgagaagtaccccaccatctaccaccttcgcaagaagctcgtcgacagcaccgacaaggccgacctgcggctgatttacctcgcgctggcccacatgatcaagttccgcggccacttcctgatcgagggggacctcaacccggacaactccgacgtggacaagctgttcatccaactggtgcagacctacaaccagctgttcgaggagaaccccatcaacgccagcggcgtcgacgccaaagccatcctgtccgcgagacttagcaagagtcgcaggctcgagaacctgatcgcccagcttcccggggagaagaagaacggcctattcggcaacctgattgccctgagcctcggactgacacccaacttcaagtccaacttcgatctggccgaggatgccaaactccagttgagtaaggacacctacgacgacgacctggacaacctcctggcgcagatcggcgaccagtacgccgacctgttcctcgccgccaagaacctgtctgacgccatcctgctcagcgacatcctgcgcgtgaacaccgaaatcaccaaggcgccgctgtccgcctcaatgatcaagcggtacgacgagcaccaccaggatctcacgctgctgaaggcgctagtgcgccagcagttgcccgagaaatacaaggagatcttcttcgaccagagcaaaaacgggtacgctggctacatcgacggcggggcctcccaggaggagttctataagttcatcaagcccatactggagaagatggacggcaccgaggagttactggtcaagctgaaccgggaggacctgctccgcaagcagcgcaccttcgacaatgggagcatcccccaccagatccacctgggcgagctgcacgcgatcctccggcgccaggaggacttctacccgttcctgaaggacaaccgggagaagatcgagaagatcctcacctttcgcatcccctactacgtggggcccttggcccggggcaactcccgcttcgcctggatgacgcgcaagagcgaggagaccatcactccctggaatttcgaggaggtggtcgacaagggcgccagtgcgcagagcttcattgagaggatgaccaactttgacaagaacctgccgaacgagaaggtgctgcccaagcactccctcctgtacgagtacttcacggtgtataacgaactcaccaaggtcaagtacgtgaccgaggggatgcggaagcccgctttcctcagcggcgagcagaagaaggccatcgtggacttgctgttcaagaccaaccgcaaggtcacggtgaagcagctcaaggaggattacttcaagaagatcgagtgcttcgactccgtcgagatcagcggggttgaggaccggttcaacgcctccctgggcacctaccacgacctgctcaaaatcatcaaggacaaggactttctggacaacgaggagaacgaggacatcctggaggacattgtgctcaccctgaccctgttcgaggaccgcgagatgatagaggagcggctcaagacgtatgcccacctgttcgacgacaaggtcatgaagcaactgaagcgtcggcgctacaccgggtggggccggctcagccgcaagttgatcaacggaatccgagataaacagagtgggaagacaatcctggacttcctaaagagcgacggctttgcaaaccgcaacttcatgcagctgatccacgacgactccttgaccttcaaggaggacatccagaaggcccaagtatctgggcagggagactccctccacgagcacatcgccaacctggccgggtcccccgccatcaagaagggcatcctgcagacggtgaaggtcgtggacgagctagtcaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaagagcaccccgtggagaacacccagctccagaacgagaagctctacctgtactaccttcagaacggccgggatatgtacgtcgaccaggagctggacattaacaggctgagcgactatgacgtggaccacatcgtgccccagtccttcctcaaagacgacagcatcgacaacaaggtcctgacacggtccgacaagaaccggggcaagagcgacaacgtgccctccgaggaggtagtcaagaaaatgaaaaactattggagacagctgctcaacgctaagctgatcacccagcgcaaattcgacaacttgaccaaagccgaacgcgggggcctcagcgagctagacaaggccgggttcatcaagcggcagctggtggagacccggcagatcaccaagcacgtagcccagatcctcgactccaggatgaacacgaagtacgacgagaacgacaaactgatccgggaggtcaaggtgatcaccctcaagagcaaacttgtgtccgacttcagaaaggacttccagttctataaggttagggagatcaacaactaccaccacgcgcacgacgcatacctgaacgccgtggtgggcaccgccctgatcaagaagtacccgaaacttgagagcgagttcgtctacggggactacaaggtgtacgacgtgcgcaagatgatcgcgaagtccgagcaggagatcggaaaggctaccgccaagtacttcttctacagcaacatcatgaacttcttcaagacggagatcaccctggcaaacggcgaaatccggaagcgccccctaatcgaaacgaacggagagaccggcgaaatcgtctgggacaaggggcgggacttcgccacggtgcgcaaggtgctctccatgccccaggtcaatatcgtaaagaagaccgaggtgcagaccggcgggttcagcaaggagtccatcctgcccaagcgcaacagcgataagttaatcgcgcgtaagaaggactgggacccgaagaagtacggcggcttcgactcccccaccgtcgcgtacagcgtgctggtggtcgccaaggtggagaagggcaagagcaagaagttaaagtccgtgaaggagctgctcggtatcacgatcatggagcgcagttccttcgagaagaaccccatcgatttcctggaggccaagggatacaaggaggtcaagaaggacctgatcatcaagctccccaagtacagcctgttcgagctggagaacggccggaaacgcatgctcgcctccgcgggggagctgcagaagggcaacgaactggccctccccagcaagtacgtgaacttcctgtacctggcctcccactatgagaagttaaaaggcagccccgaggacaacgaacagaagcagctgttcgtggagcagcacaagcattatctggacgagatcatcgagcagatatccgagttcagcaaacgggtgatcctcgccgacgccaacctcgacaaggtgctctccgcgtacaacaagcaccgtgacaagcccatccgggagcaggccgagaacatcatccacctcttcaccctgaccaaccttggggcccctgccgcgttcaagtacttcgacaccacgatcgaccggaagcggtacaccagcaccaaggaggtgttagacgcgaccctgatacaccagagtatcacgggcctgtacgagacccgcatcgatctcagccagctcgggggcgataagcggcccgccgccaccaagaaggccgggcaggcgaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8195 - RNA, 5203 nt, synthetic construct; identical to SEQ ID NO: 2395
  misc_feature 1..5203: note = Cas9 variant mRNA product
  source 1..5203: mol_type = other RNA

SEQ ID NO: 8196 - RNA, 3475 nt, synthetic construct
  misc_feature 1..3475: note = Cas9 variant mRNA product
  source 1..3475: mol_type = other RNA
gggagagtcccgcagtcggcgtccagcggctctgcttgttcgtgtgtgtgtcgttgcaggccttattcaagcttaccatggcccccaagaagaagcgcaaagtgggcatccacggggtcccggccgcgaagcggaactacatcctgggcctcgacatcgggatcaccagcgtgggctacgggatcatcgactacgaaacccgcgatgttatcgacgccggcgtccggctgttcaaggaggccaacgtggagaacaacgaaggccgccggtccaagcgcggggcccggcgcctgaagcggcgccggcgccaccggatccagcgcgtgaagaagctcctgttcgactacaacctgctcacggaccacagcgagctgtcgggcatcaacccctacgaggcccgggtcaagggtctcagccagaagctctccgaggaggagttcagcgcggccctgctgcacctcgccaagcgcaggggcgtgcacaacgtgaacgaggtcgaggaggacaccgggaacgagctctccaccaaggagcagatcagccgcaactccaaggccctggaggagaagtacgtggcggagctccagctcgagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaagacatcaaggagtggtacgagatgctgatgggccattgcacctacttcccggaggagctccgaagcgtgaagtacgcctacaacgccgacctgtacaacgcgctcaacgacctcaacaacctggtcatcacgcgcgacgagaacgagaagctggagtactacgagaagttccagatcatcgagaacgtgttcaagcagaagaagaagcccaccctcaagcagatagccaaggagatcttggtgaacgaggaggacatcaaggggtaccgggtcacctccaccggcaagcccgagttcacgaacctaaaggtgtaccacgacatcaaggacatcaccgcccgcaaggagatcatcgagaacgccgagctcctggaccagatcgccaaaatcctgaccatctaccagagctccgaggacatccaggaggagctcaccaacctgaacagcgagctgacacaggaggagatcgagcagatctccaacctcaaggggtacaccggcacccacaacctgagcctgaaggcgatcaacctcatcctggacgagctgtggcacaccaacgacaatcagatcgccatctttaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctacccaacgacataatcatcgagctggcccgggagaagaacagcaaggacgcccagaagatgatcaacgagatgcagaagcgcaaccggcagaccaacgagcgcatcgaggaaatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtggaccacatcatcccccgcagcgtgtccttcgataacagcttcaacaacaaggtgctggtcaagcaagaggagaactccaagaaggggaaccggacccccttccagtacctgagctccagcgactccaagatcagctacgagaccttcaagaagcacatcctcaacctggccaagggcaaagggcgcatctccaagaccaagaaggagtacctgctcgaggaacgggacattaaccgcttcagcgtgcagaaggacttcatcaaccggaacctggtggacacgcgctacgccacccggggcctgatgaacctcctgcgctcctactttcgcgtcaacaacctggacgtgaaggtcaagagcatcaacgggggcttcacctccttcctcaggcgcaaatggaagttcaagaaggagcggaacaagggctacaagcatcacgccgaggacgcgctgatcattgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcatatcaaggacttcaaggactacaagtacagccatcgcgtggacaagaagcccaatcgggagctcatcaacgacacactgtactccacccgcaaggacgacaaggggaacaccctgatcgtgaacaacctcaacggcctgtacgacaaggacaacgacaagctgaagaagctcatcaacaagagccccgagaagctcctgatgtaccaccacgacccccagacttaccagaagctcaagctgatcatggagcagtacggggacgagaagaacccgctgtacaaatactacgaggagaccggcaactacctcaccaagtactccaagaaggacaacgggcccgtcatcaagaagatcaagtactacggcaacaagctgaacgcccacttggacatcaccgacgactaccccaacagccggaacaaggtggtgaagctctccctgaagccctaccgcttcgacgtctacctggacaacggcgtgtacaagttcgtcaccgtcaagaacctcgacgtgatcaagaaggagaactactacgaggtgaacagcaagtgctacgaggaggctaagaagctgaagaagatctccaaccaggccgagttcatcgccagcttctacaacaacgacctgatcaagatcaatggtgagctctaccgggtcatcggcgtgaacaacgacctgctgaaccgcatcgaggtgaacatgatcgacatcacgtatcgggagtacttagagaacatgaacgacaagcgcccgcccagaatcatcaagaccatcgcgtccaagacccagagcatcaagaagtactcaaccgacatcctggggaacctgtacgaggtaaagagcaagaagcacccccagatcatcaagaagggcaagcgccccgccgccacgaagaaggccggtcaagccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8197 - RNA, 4543 nt, synthetic construct
  misc_feature 1..4543: note = Cas9 variant mRNA product
  source 1..4543: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgctgttcaacaagtgcattatcatcagcatcaacctggacttctccaacaaggagaaatgcatgaccaagccctacagcataggcctggacatcgggacgaactccgtgggctgggccgtgatcacggacaactataaggtccccagcaagaagatgaaggtgctggggaacacttccaagaagtacattaagaagaacttactgggcgtgctgctgttcgacagcggcatcaccgccgaggggcggcgcctgaagcggaccgcgcgccggcgctacacgcggcgccggaaccgcatcctgtacctccaggagatcttctctaccgagatggccaccctggacgacgcgttcttccagcggctggacgacagcttcctcgtgcccgacgacaagcgcgactccaagtacccgatcttcggcaacctggtggaggagaaggtgtaccacgacgagttccccaccatctaccacctccggaagtacctcgccgacagcacgaagaaggccgacctgcgcctcgtctacctcgccttagcgcacatgattaagtaccggggccacttcctgatcgagggcgagtttaactccaagaacaacgacatccaaaagaacttccaggacttcctcgacacctacaacgccatcttcgagagcgacctgtccctggagaacagcaagcagctcgaggagatcgtgaaggacaagatttccaagctggagaagaaggaccgcatcctgaagctgttccccggggagaagaacagcggcatcttctctgagttcctgaagctgatcgtgggcaaccaggctgacttccggaagtgcttcaacctcgatgagaaggcaagccttcacttctccaaggagagctacgacgaggacctggagaccctcctgggatacatcggcgacgactatagcgatgtcttcctgaaggctaagaagctctacgacgcgatcctgctgtccgggtttctcaccgtgacggacaacgagaccgaggcgcccctgagctccgccatgatcaagcgctacaacgagcacaaggaggacctcgccctcctgaaggagtacatccggaacatcagcctgaagacctacaacgaggtgttcaaagacgacaccaagaacggatacgccggctacattgacgggaagacgaaccaggaggacttctacgtatacctcaagaacctgctggccgagttcgagggcgccgactatttcctcgagaaaatcgaccgcgaggacttcctgcgcaagcagcgcaccttcgacaacgggtccatcccgtaccagatccaccttcaggagatgcgcgccatcctggacaagcaggccaagttctaccctttcctagccaagaacaaggagcggatcgagaagatcctgaccttccgcatcccctactatgtgggcccgctggcgcgggggaacagcgacttcgcttggtccatccgcaagcggaacgagaagatcaccccgtggaacttcgaggacgtgatcgacaaggagagctccgctgaggccttcatcaaccgcatgacgagcttcgacctctacctgcccgaggagaaggtcctgcctaagcactccctcctgtacgagaccttcaacgtgtacaatgagctgaccaaggtgcggttcatcgccgagagcatgcgcgactaccaattccttgactccaagcagaagaaggacatcgtccggctttacttcaaggacaagcgcaaggtgaccgacaaggacatcatcgagtacctgcacgcgatctacggctacgacggcatcgaactcaaggggatcgagaagcagttcaacagcagcctgagcacgtaccacgacctgctcaacatcattaacgacaaagagttcctggacgactccagcaacgaggctatcatcgaggagatcatccacaccttaaccatcttcgaggaccgggagatgatcaagcaacgcctctccaagttcgagaacatcttcgacaagagcgtgctgaagaagctgagccgtcgccactataccggctgggggaagctctccgccaaacttatcaacggcatccgggacgagaagtccgggaatacaatcctggactacctcatcgatgacggcatcagcaatcgcaacttcatgcagctgatccacgacgacgccctgagcttcaagaagaagatccagaaggcgcagattatcggcgacgaggacaagggtaacatcaaggaagtcgtgaagtccctccccggcagcccggccatcaagaagggaatcctgcagtccatcaagatcgtagacgagctggtgaaggtgatgggcgggcggaagcccgagagcatcgtcgtggagatggcccgagagaaccagtacaccaaccagggcaagtccaacagccagcagaggctcaagcgcctggagaagtcactgaaggagctcggcagcaagatcctgaaggagaacatccccgccaagctgagtaagatcgacaacaacgccctacagaacgaccgcctgtatctgtactacctccagaacgggaaggacatgtataccggagacgacctggacatcgaccggctgagcaactacgacatcgaccacataatcccccaggcgttcctcaaggacaactccatcgacaacaaggtgctggtcagctccgccagcaaccgcggaaagtccgacgacttcccgagcctggaggtggttaagaagcggaagactttctggtaccagttgctcaagagcaagctgatttcccagcgcaagttcgacaacctgacgaaggccgaacggggcggcctgctgcccgaagacaaggcaggcttcatccaacgccagctcgtcgaaacccggcaaatcaccaaacacgtggcccgcctgctggacgagaagttcaacaacaagaaggacgagaacaaccgggcggtgaggaccgtaaagatcatcacgctcaagagcaccctggtgtcccaattccggaaagacttcgagttgtacaaggtgcgcgagatcaacgacttccaccatgcccacgacgcctacctcaacgccgtcatcgccagcgcgctgctgaagaagtaccccaagctcgagcctgagtttgtgtacggcgactacccgaaatacaactccttccgtgagcgcaagagcgccaccgagaaggtgtacttctattccaatatcatgaacatcttcaagaagtccatctccctggctgacgggcgggtgatcgagcgccccctgatcgaagtgaacgaggagacgggcgagagcgtgtggaacaaggagtccgacctcgccaccgtccggcgcgtgctgagctacccccaggtgaacgtcgtaaagaaggtggaggaacagaaccacgggctggaccggggcaagcccaagggcctcttcaacgcgaacctgtccagcaagccgaagcccaactccaacgagaacctggtcggggccaaggaatacctcgaccccaagaagtacggcgggtacgccggcatcagcaactccttcgccgtgctggtcaaggggacgatcgaaaagggagccaagaagaagatcaccaacgtcctggagttccagggcatcagcatcctcgaccgcatcaactaccggaaagacaagctgaacttcctgttagagaaggggtacaaggacatcgagctgatcatcgaactgccgaagtactcactcttcgagctgtccgacggcagccgccggatgctcgcgtcgatcctcagcaccaacaataagcgtggggagatacataagggcaaccagattttcctgtcccagaagttcgtgaagctgctctaccacgccaagcggatcagcaacaccatcaacgagaaccaccgaaaatacgtggagaaccacaagaaggagttcgaggagctgttctactacatcctggagttcaacgagaactacgtcggtgccaagaagaacggaaagctcctgaacagtgccttccagagctggcagaaccattcgatcgacgagctatgcagctccttcatcggccccacggggagcgagcgcaagggcctcttcgagctaacatcccgggggagcgccgcagactttgagttcctgggcgtgaagataccccgctaccgggactacaccccctccagcctcctgaaagacgccaccctgatccaccagtccgtgacggggctgtacgagacccgcatcgacctcgccaagctgggcgagggcaagaggccggccgccaccaagaaggcagggcaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8198 - RNA, 3619 nt, synthetic construct
  misc_feature 1..3619: note = Cas9 variant mRNA product
  source 1..3619: mol_type = other RNA
gggagagtcccgcagtcggcgtccagcggctctgcttgttcgtgtgtgtgtcgttgcaggccttattcaagcttaccatggcacccaaaaagaaacgcaaagtaggaatacacggagtgccggcagcatggtacgcgagccttatgagcgcccaccatctacgcgttggaatcgacgtaggcacccacagcgtaggactagccacactccgagtagacgaccacggaaccccaattgaattactatcggcactgagccacatccacgatagtggagtcgggaaagaaggaaagaaagaccacgacacacgaaagaaactgtcaggaatagcaagacgcgctcgaagactattacaccaccgacgaacacagctccaacaactagacgaagtcctacgagatctaggcttcccaatcccaacaccgggagagttcctagacttaaacgaacaaaccgacccataccgcgtgtggcgagtccgagcacgactcgtggaagagaaactcccagaggaattacgcggaccagccataagcatggcagtgaggcacatcgcccgacaccgagggtggaggaacccgtatagtaaagtagaatccctactaagccccgccgaggaaagcccattcatgaaagcactccgcgaacgaatcctcgcaaccaccggcgaagtactagacgatggcataacgccgggccaagctatggcccaagtcgcactgacccataacatctcaatgcgcggaccagaaggcatactaggaaaactacaccaatccgataacgcaaacgaaatccggaaaatatgtgcccgccagggggtcagccccgacgtttgcaaacagctactccgggccgtattcaaagccgactcacctagaggcagcgccgtgagtagagtagcacccgatccccttcccggtcaggggagcttccgcagagccccaaaatgcgacccagagttccagcgcttccgaataatatccatagtggcaaacctgcgaatatctgaaacgaaaggcgaaaacagaccactaaccgccgacgaacgcagacacgtcgtcaccttcctaacggaagacagtcaagccgatcttacttgggtggacgtcgcagaaaaactcggagttcaccgccgggacttaaggggaacagccgtacacaccgacgacggagaaagaagtgccgcccggcccccaatcgacgcaacggatagaatcatgagacagaccaaaatcagttccctcaaaacgtggtgggaagaagccgacagcgaacagagaggcgcaatgatcaggtacctgtacgaagacccaaccgattctgaatgcgcagaaatcatagctgaactcccagaagaagatcaagccaaactagactccctacacttacccgcaggacgcgccgcatacagcagagagagtctaacagccttaagcgaccacatgctcgcgacaaccgacgacctccacgaggcacgaaaacgccttttcggcgttgacgacagctgggccccacccgccgaagcaatcaacgcccccgtcgggaacccctcggtggaccgcacattaaaaatagtagggcgatacctctcagcagtcgaatctatgtggggcacgccagaagtcattcacgtagagcacgtccgagacgggttcacgagcgagcgcatggccgacgaacgagacaaggcaaaccgacgaagatataacgacaaccaagaagcaatgaagaaaatccagagagactacggaaaagaaggctacatatccagaggggacatagtaaggctggacgccctcgaactccagggatgtgcctgtctctactgcgggacaacaattggataccacacgtgccaactagaccacatcgtaccccaggcaggaccaggaagcaacaaccgccgagggaacctagtcgctgtatgcgaaagatgcaaccgctcgaaatcaaacaccccctttgcagtttgggcccaaaaatgcggcatcccccacgtcggagtaaaggaagcgatcggcagagtcaggggctggagaaagcaaacaccaaacacatcaagcgaagatcttacaaggctaaagaaggaggtcatcgcacgactaagacgaacacaggaggacccagaaatcgacgaaaggtccatggagagcgtagcctggatggcaaacgaactccaccacagaatcgcggccgcatacccagagacaaccgttatggtctatagaggtagtatcacagcggctgcacggaaagccgccggaatagactcccgcatcaatcttataggagagaagggacgaaaagacagaatcgaccgccggcaccacgccgtggatgcctccgtcgtcgcgctaatggaggcaagcgtcgcaaaaacactagccgaacgcagcagcctgcgcggcgaacagcgcctaaccggaaaagaacagacctggaaacaatatacaggcagtaccgtaggagccagagaacacttcgaaatgtggagaggccacatgctccacctcacggaactgttcaatgaaagactagccgaagacaaagtttacgtaacacagaacatacgcctgcgactcagcgacggcaatgcacacaccgtcaaccccagcaaactcgtatcacaccgactcggcgacggactcacagtacaacaaatcgaccgcgcgtgcactccagccctgtggtgtgccctaacccgagaaaaagacttcgacgagaaaaacggcctaccggcacgagaagaccgggccatccgagtgcatgggcacgaaataaaatcgtcagactacatacaagtgttctccaaaagaaagaaaaccgactcagaccgagatgagacaccgttcggagcaatagcggtacgtggagggttcgtcgagatcggacccagcatccaccacgccagaatatacagagtagaaggaaagaaaccagtctacgcaatgctcagggtgttcacacatgacctcttaagccagcgacatggcgacctatttagcgcggtgataccaccacaaagtatcagcatgagatgcgcggaacccaaactccgcaaagcgataacaacgggaaacgccacatatctagggtgggtcgtagtgggcgacgagcttgaaataaacgtagacagtttcaccaaatacgctattggacgcttcctcgaagacttcccaaacacaacacgatggcgcatctgcggttacgatacaaactcaaaactcacgctgaagccaatcgtcctggccgccgaaggactcgaaaacccgtcctcagccgtcaacgagatcgttgaactgaagggatggagagtagcgatcaacgtcctcacaaaagtccacccaacagtagtccgacgcgacgcactaggacgaccgcgctatagttcgagatcaaacctaccaacaagctggacgatcgagaaacgcccagccgcaacaaagaaagccggacaagcgaagaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8199 - RNA, 4480 nt, synthetic construct
  misc_feature 1..4480: note = Cas9 variant mRNA product
  source 1..4480: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtccctgccgcgaccaagccctacagcatcggcctggacatcgggaccaactccgtgggctgggccgtgacgaccgacaactacaaggttcccagcaagaagatgaaggtgctcgggaacactagcaagaagtacatcaagaagaacctattaggcgtgctcctgttcgacagcggcatcacggccgaggggcggcgcctgaagcggacggcccgcagacgctacacccggcgccggaatcgcatcctctatctgcaagagatcttctccaccgagatggccaccctagacgacgccttcttccaacggctagacgacagcttcctggtccccgacgacaagcgcgactccaaatacccgatcttcggcaacctggtggaggagaaggcctaccacgacgagttccccaccatctaccacctccggaagtacttggccgacagcaccaagaaggccgacctgcgcctcgtgtacctggcgctggcccacatgatcaagtaccgggggcactttctcatcgagggcgagttcaactccaagaacaacgacatccagaagaacttccaggacttccttgacacctacaacgccatcttcgaaagcgacctgtccttggagaatagcaagcagctggaggagatagtcaaggacaagatctccaagctggagaagaaggaccgcatcctcaagctgttccccggggagaagaacagcggcatcttctccgagttcctgaaactcatcgtgggcaaccaggccgacttccggaagtgcttcaacctggacgagaaggccagtctgcacttctccaaggagagctacgacgaggacctcgagaccctgctggggtacatcggcgacgactactccgacgtgttcctcaaggcgaagaagctgtacgacgccatcctgctcagtgggtttctgacggtcaccgacaacgagaccgaggcgcccctgagctccgccatgatcaagcgctacaacgagcacaaggaggacctcgcactgctgaaggagtacatccggaacatcagcctcaagacctacaacgaggtgttcaaggacgacacgaagaacggctacgccggctacatcgacggaaagaccaaccaggaggacttctacgtgtacctgaagaagctgctcgccgagttcgagggcgcagactacttccttgagaagatcgaccgcgaggacttcctgcggaagcagcgcaccttcgacaacggttccatcccgtaccaaatccacctccaggagatgcgcgccatcctggacaagcaggccaagttctaccccttcctggcgaagaacaaggaacggatcgaaaagatcctgaccttccgcatcccctactacgtcggccctctcgcccgggggaacagcgacttcgcctggtccatccgcaagagaaacgagaagatcacgccttggaacttcgaggacgtgatcgacaaggagagctccgccgaggccttcatcaatcgcatgaccagcttcgatctgtacctccccgaggagaaggttcttcccaagcactcgctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacattatcgagtacctccacgcaatctacggctacgacggcatcgagctgaaggggatcgagaagcagttcaacagctccctgagcacctaccacgacctcctgaacatcatcaacgacaaggagttcctggatgactccagcaacgaagccatcatcgaggagatcatccacaccctcaccatcttcgaggaccgggagatgatcaagcagcgcctgtcaaagttcgagaacatcttcgacaagagcgtgctgaagaagctctcccggcgccactacacgggctgggggaagctgagcgccaagctgatcaacggcatccgggacgagaagtccgggaacaccatcctcgattacctgatcgacgacggcatcagcaaccgcaacttcatgcagctgatccacgacgacgcgctcagcttcaagaagaagatccagaaagcacagatcatcggcgacgaggacaaggggaacatcaaggaggtggtcaagtccctgcccggcagcccggccatcaagaaagggatcctgcagtccatcaagatcgtggacgagctcgtcaaggtgatgggcgggcgaaagcccgagagcatcgtggtcgagatggcccgcgagaaccagtacaccaaccagggcaagtccaacagccagcagcggctgaagcgcctggagaagtccctcaaggagctgggcagcaagatactgaaggagaacatccccgccaagctctccaagatcgacaacaacgcgctgcagaacgaccgcctgtacttgtactacttgcagaacgggaaggacatgtacaccggcgacgacctggacatcgaccggctaagcaactacgacatcgaccacatcatcccccaggccttcctgaaggacaactccatcgacaacaaggtgctggtgagctccgcgagcaaccgcgggaagtccgacgacgtcccgagcctcgaggtggtgaagaaacggaagacgttctggtaccagctgctcaagagcaagctgatctcccagcgcaagtttgacaacctgaccaaagcagagcgtggcggcctgagccccgaggacaaggccgggttcatccaacgccagctcgtcgagacccggcagatcaccaagcacgtggcgcgcctgctggacgagaagttcaacaacaagaaggacgagaacaaccgggccgtgcgcacggtcaaaatcatcaccctcaagtccaccctggtgagccagttccgaaaggacttcgagctgtacaaggtgcgcgagatcaacgacttccaccacgcccacgacgcctacctcaacgccgtggtggcgtccgccctgctgaagaagtaccccaagctcgagcccgagttcgtgtacggcgactacccgaagtacaatagcttccgggaacgcaagtccgccaccgagaaggtctacttctacagcaatatcatgaacatattcaagaagtccatcagcctggccgacgggcgggtgatcgagcgccccctgatcgaggtgaacgaggagaccggcgaatccgtctggaacaaggagagcgacctcgcgacggtgcggcgcgtcctgtcctacccccaggtcaacgtggtgaagaaggtcgaggagcagaaccacgggctggaccgggggaagcccaagggcctcttcaacgccaacctgagctccaagccgaagcccaacagcaacgaaaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgatcgcatcaactaccggaaggacaagctgaacttcctgctcgagaaggggtacaaggacatcgagctgatcatcgagctgccaaagtacagcctcttcgagctgagtgacggctcccgccgcatgctggcgagcatcctctccacgaacaacaagcgcggggagatccacaagggcaaccagatcttcctgagccagaagttcgtgaagctgctctaccacgccaagcggatctccaacaccataaacgagaaccaccggaaatacgttgagaaccacaagaaggagttcgaggagctgttctactacatcctggagttcaacgagaactacgtcggggccaagaagaacgggaagctcctgaacagcgcctttcagtcctggcagaaccacagcatcgacgagctgtgctctagcttcatcggccccacagggtccgagcgcaagggcctcttcgaactgaccagccgggggtccgccgcggacttcgagttcctgggcgtgaagatcccccgctaccgggactacacgcccagctccctcctcaaggacgctaccctgatccaccagagcgtcacggggctctacgagacccgcatcgacctggccaagttgggagagggcaagcggccggccgccacgaagaaggcgggtcaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8200 - RNA, 3562 nt, synthetic construct
  misc_feature 1..3562: note = Cas9 variant mRNA product
  source 1..3562: mol_type = other RNA
gggagagtcccgcagtcggcgtccagcggctctgcttgttcgtgtgtgtgtcgttgcaggccttattcaagcttaccatggcaccgaaaaagaaacgcaaagtgggcatccacggagtaccagccgctgccgccttcaaaccaaacagcataaattatatcctcggcctagatatcggtatcgcctccgtagggtgggccatggtcgagattgatgaagaagaaaacccaatcaggctcatagacctaggcgtacgagtcttcgaacgcgccgaagtcccaaaaacaggagattccctcgctatggcacgaagactagcaagaagcgtgagacgacttacccgccgacgcgcccaccgcctcctccgaactcgtcgcctcctaaagcgcgaaggagtcctccaagccgccaatttcgacgaaaacggtctaatcaaaagcctccccaacacgccatggcaactccgagcagcggccctagaccggaaactaacacccctagaatggtccgctgtcctactgcacctcatcaaacaccgcggatacctaagccagaggaaaaacgaaggagagaccgccgacaaagaactaggcgcgctactgaaaggtgtagcaggcaacgcacatgccctacagacgggtgactttcgaacaccggcagagctcgcacttaacaaattcgaaaaagaatctggacatatccgaaatcaaagatccgactacagccacacattcagccgaaaagatctacaagccgaactcatccttctattcgaaaaacaaaaagagttcggaaatccccacgtatcgggcggactgaaggaagggatcgaaaccctactcatgacacaacggcccgccctatcaggcgatgccgttcagaaaatgctaggccactgcacattcgaaccagccgaaccaaaggcggccaaaaacacctacacagcggaacgcttcatctggttaactaaactgaataacttacgcatactcgaacaaggctctgaacgacccctcacggatacagaacgcgcaaccctaatggacgagccctaccgcaaaagcaaactgacctatgcacaagcgagaaaactcctaggactcgaagacacagccttcttcaaaggtctcaggtacggaaaagataacgccgaggccagcacactcatggaaatgaaagcctaccatgccatcagccgagccctggaaaaagagggcctcaaagataagaaaagccctctcaaccttagccccgaacttcaagatgaaatcggaaccgcatttagcctcttcaaaacagacgaagacatcaccggacgactgaaagaccgcatccaaccagagatactcgaggcgctgctaaaacacatatccttcgacaaattcgtacaaatcagcttaaaggcactacgccggatagtacccctaatggaacaagggaaacgatacgacgaagcatgtgccgaaatatacggtgatcactacggaaagaaaaacactgaagaaaagatctacctcccaccaatacccgccgacgaaataaggaaccccgtagtactacgtgccctctcacaagcacgcaaagtcattaacggagtagtcagaagatatggcagccccgcgcggatccacatcgaaacagcccgcgaagtaggcaaatctttcaaagatcgcaaagaaatcgagaaaagacaagaagagaatagaaaagatcgagagaaagccgccgcaaaattccgagaatatttccccaacttcgtcggtgaaccaaaaagtaaagacatcctcaaactccgcctctatgagcaacagcacggaaaatgcctatacagcggaaaagaaatcaacctcggccggctaaacgagaagggatacgtagaaatagaccacgccctcccattctcgcgaacatgggacgactcttttaataacaaagtcttagtcctcggatcagagaaccaaaacaaaggaaatcaaacgccatacgagtacttcaacggcaaggacaacagcagagaatggcaagagttcaaagcacgagtggaaacctcccgattcccacgctccaagaaacaaagaatcctactccagaaattcgacgaagacgggttcaaagaacgcaacctgaacgatacacggtacgtcaaccgcttcttatgccaattcgtggcggaccgcatgcgcctcacgggaaaaggtaagaaacgggtattcgccagcaacggacagataacgaacctcctccggggattctggggcctccgaaaagtccgggcagaaaacgaccgacaccacgcgctagacgcggttgtcgttgcttgcagcaccgtcgccatgcagcagaaaataaccagatttgtcagatacaaagagatgaacgcctttgacggaaaaactatcgacaaagagacaggcgaagtactacaccaaaagacacacttcccgcaaccatgggagttcttcgcccaagaagtcatgataagggtattcgggaaaccagacggcaaaccagagttcgaagaagcagacaccctagaaaagctccgcaccctactggcagaaaagttgagcagccgccccgaagccgtacacgaatacgtaacaccactcttcgtctcccgagcacccaaccgaaaaatgagcggccaaggccacatggaaaccgtaaaatccgccaagcgcctggacgaaggcgtctccgtactaagagtacccctcacccaactcaagctaaaagacctggagaaaatggttaacagagaaagagaaccaaagctatatgaggccctcaaggcgcgcctcgaggcacacaaagacgacccagcaaaagcattcgctgaacccttctataaatacgataaagccgggaacagaacacaacaggtaaaggccgtccgggtagaacaggtacagaagaccggagtctgggtccgaaaccataatggcatcgcagacaacgcaacaatggtacgcgtcgatgtgttcgaaaaaggcgacaagtactacctagtacccatatacagctggcaggtcgcgaaaggcatcctaccggacagggccgtagtccagggcaaagatgaagaagactggcagctaatcgatgattccttcaactttaaattcagcctacacccaaatgacctcgtagaagtaatcaccaaaaaggcaagaatgttcggatacttcgccagctgccacagaggaaccggaaacatcaacattcggatacacgacctcgatcacaaaataggcaagaatggcatactcgagggcataggggtcaaaaccgcactatccttccagaagtaccaaatcgacgagcttggaaaagaaatccggccctgtcgactgaagaaaaggccaccagttcggaagagaccggccgccaccaaaaaggcaggtcaagccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8201 - RNA, 4318 nt, synthetic construct
  misc_feature 1..4318: note = Cas9 variant mRNA product
  source 1..4318: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgaagaagccatacaccatcggcctggacatcgggaccaacagcgtgggctgggccgtgctcaccgaccagtacgacctggtcaagcggaagatgaagatcgccggggactccgagaagaagcagatcaagaagaacttctggggcgtgcgcctgttcgacgagggccagaccgccgctgaccggcgcatggcgcggaccgcccgccggcgcattgagcggcgccggaaccgcatcagctacctccagggaatcttcgccgaggagatgtccaagaccgatgccaacttcttctgccggctgagcgactccttctacgttgacaacgagaagcgcaacagccggcaccccttcttcgcgacgatagaggaggaggtcgagtatcacaagaactaccccacaatctaccacctccgcgaggaactcgtgaactccagcgaaaaggccgacctgcgtctagtgtacctcgccctggcccacatcatcaagtaccgcggcaacttcctgatcgagggggccctcgacacccagaacacctccgtcgacggcatctacaagcagttcatccagacgtacaaccaggtgttcgcgtccgggatcgaggacggctcccttaagaagctggaggacaataaggacgtggccaagatcctcgtcgagaaggtgacccggaaggagaagctggagcgcatcttaaagctctacccgggcgagaagtccgccgggatgttcgcccagttcatcagcctaatcgtgggcagcaaggggaacttccagaagcccttcgacctgatcgagaagtccgacatcgagtgcgccaaggactcgtacgaggaggacctcgagtccctgctggcgctcatcggggacgagtacgccgagctgttcgtcgccgccaagaatgcctacagcgcggtggtgctgagtagcatcatcaccgtcgccgagaccgagacgaacgccaagctcagcgcctccatgatcgagcggttcgacacccacgaggaggacctgggcgagctgaaggcattcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaagagaacttcctgcgcaagcagcgcacattcgacaacggggcgattccccaccaactgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgattttggcaagtccgccgtagacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcgtatttcagcggccaggagaaggagcagatcttcaacgacctgttcaagcagaagcggaaggtcaagaagaaggacctcgagctgttcctgcgtaacatgtcccacgtggagagccccacgatcgaggggctggaggactccttcaacagctcctacagcacctaccacgacctcctgaaggtgggcatcaagcaggagatcctggacaaccccgtcaacacagagatgctcgagaatatcgtgaagatcctgacagtgttcgaggacaagcggatgatcaaggagcagctgcagcagttctccgacgttctcgacggcgtggtgctgaagaagctggagcgccggcactacacggggtggggccgcctcagcgccaagctgctgatggggatccgggacaaacagtcccacctcaccatcctggactacctgatgaacgacgacggcctcaatcgcaacctgatgcagctgatcaacgacagcaacctttcattcaagagcatcatcgagaaggagcaggtcaccaccgccgacaaggatatccagagcatcgtggccgacctggcgggatccccggccatcaagaagggcatcctgcagagcctcaagatcgtggacgaactggtctccgtgatgggctacccgccccagacgatcgtggtcgagatggcccgggagaaccagactaccgggaagggcaagaataacagccgcccccggtacaagtccctggagaaggccatcaaggagttcgggagccagatccttaaggagcaccccaccgataatcaggagctgcgcaacaaccgactgtacctctactacctgcagaacggcaaggacatgtacacgggccaggaccttgacatccacaacctctccaactacgacatcgaccatatcgtgccccagagcttcatcaccgacaactccatcgacaacctggtgctgaccagctccgccgggaaccgcgaaaagggcgacgacgtcccgcccctcgagatcgtgcgcaagcgcaaggtgttctgggagaagctgtaccaggggaacctgatgagcaagcgcaagttcgactacctgaccaaggcggagcggggcgggctgaccgaagccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccaactctacaaggtgcgcgacgtcaacgactaccaccacgcccacgacgcctacctgaacggcgttgtggcgaacactctgctcaaggtctacccccagctggagcccgagttcgtgtacggggactaccaccagttcgactggttcaaggccaacaaggcgaccgccaagaagcagttctacaccaacatcatgttgttcttcgcccagaaggaccggatcatcgacgaaaacggtgagatcctctgggataagaagtacctggacaccgtgaagaaggtcatgtcctaccgccagatgaacatcgtgaagaagacggagatccagaagggggagttctcgaaggccaccatcaagcccaagggcaactccagcaagttaatcccccggaagaccaactgggacccgatgaagtacgggggcctcgacagccccaacatggcctacgcggttgtcatcgaatacgccaagggcaagaacaagctggtgttcgagaagaagatcatccgcgtgaccatcatggagcggaaggccttcgagaaggacgagaaggccttcctggaggagcaggggtaccgccagccgaaggtcctcgccaagctgccgaagtacacgctgtacgagtgcgaggagggccggcgccggatgctcgcgtccgcaaacgaggcccagaaggggaaccagcaggtcctgcccaaccacctggtgaccctcctgcaccacgccgcgaactgcgaggtgagcgacggcaagtccctggactacatcgagagcaaccgcgagatgttcgcggaactcctggcccatgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaaattcttcgagaccacgatcgagcgcaagcggtacaacaacctcaaggagctgctgaacagcaccatcatctaccaatccatcaccggcctctacgagtctcgcaagcgcctcgacgacaagcggcccgccgccaccaagaaggcagggcaggcgaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8202 - RNA, 4351 nt, synthetic construct
  misc_feature 1..4351: note = Cas9 variant mRNA product
  source 1..4351: mol_type = other RNA
gggagagtcccgcagtcggcgtccagcggctctgcttgttcgtgtgtgtgtcgttgcaggccttattcaagcttaccatggctcccaagaagaaacgcaaggtgggcatccacggggtcccggcagcgaagaagccctacagcatcggcctggacatcggcaccaattccgtgggttgggccgtggtaaccgacgactacaaggtgcccgccaagaagatgaaggtgctcgggaacacggacaagagccacatcgagaagaacctgctgggcgccctactgttcgactccggcaataccgccgaggatcggcgcctaaagcggaccgcgcgcagacgatacacccggcgccggaaccgcatcctctaccttcaggaaatcttctcagaggagatgggaaaggtcgacgactccttcttccaccggctggaggacagcttcctcgtgacggaagacaagcgaggcgagcggcaccccatcttcgggaacctggaggaggaagtgaagtaccatgagaacttcccgaccatctaccacctccgccagtacctggccgacaatcccgagaaggttgacctgcggctggtgtacctcgccctggcccacatcatcaagttccgcgggcacttcctgattgaggggaagttcgacacgcggaacaacgacgtgcaacgcctctttcaggagttcctggcggtctatgataacacgttcgagaactccagccttcaggagcagaacgtccaggtggaggagatcctcaccgacaagatctctaaaagcgccaagaaggaccgggtgctgaagctgttccccaacgaaaagtccaacggccgcttcgccgagttcctcaagctgatcgtgggcaaccaggccgacttcaagaagcatttcgagctggaggaaaaggccccgctacagttcagtaaggacacctacgaggaggagctggaggtgctgctcgcgcagataggtgataattacgccgagctgttcctgtccgccaaaaagctgtacgacagcatcctgctgtccggcattctaacagtcaccgacgtgggaacgaaggccccgcttagtgcttcaatgatccagcggtataacgaacaccagatggacctggcgcagctaaagcagttcataagacagaagctgagcgacaagtacaacgaagtgttctccgacgtcagcaaggacggctatgccggctacatcgacgggaagaccaaccaggaggccttctacaagtacctgaaggggctcctgaacaagatagaggggagcggctacttcctggacaagatagagcgcgaggacttcctacggaagcagcgtactttcgacaacgggtccataccccaccagatccacctccaggagatgcgggccatcatccgccgtcaggcagagttctaccccttcctcgcggacaaccaggaccgcatcgagaagctgctgaccttcagaatcccctactacgtggggccgctggcccgcggcaagagcgactttgcctggctgtcccgtaagagcgccgacaagataacgccctggaacttcgacgagatcgttgacaaggagagcagcgccgaggcgttcatcaacagaatgaccaactatgacctctacctccccaaccagaaggtcctgcccaagcactccctcctatacgagaagttcaccgtctacaatgagctgaccaaggtgaagtacaaaacggagcaagggaagaccgcgttcttcgacgctaacatgaagcaagagatcttcgacggcgttttcaaagtgtaccggaaggtcactaaagataagctcatggacttcctggagaaggagttcgacgagttccgcatcgtggacctgaccggtctggacaaggaaaacaaggtgtttaacgccagctacggcacgtaccacgacctgtgcaagatactcgataaggacttcttagataactccaagaacgagaagatcctggaggacatcgtcctgaccctcactctgttcgaggaccgggagatgatccgcaagcggctggagaactatagcgacctcctgacaaaggagcaggtcaagaagctggagcgccggcactacactgggtggggtcgcttgtccgcggagctaatccacggcatccggaacaaggagagcaggaagaccatcctagactacttaatcgacgacgggaactccaacaggaacttcatgcagctgatcaacgacgacgccttgtcttttaaggaggaaatcgccaaggcccaggtgatcggcgagaccgacaacctcaaccaagtggtgtccgacatcgccgggtctccggcgatcaagaagggcatcctgcagtccctgaaaatcgtggacgagctcgtcaagatcatgggccaccaacccgagaacatcgtggtggaaatggcccgtgaaaaccagttcaccaatcagggtcgccggaacagccagcagcgactgaagggcctgacggactccatcaaggagttcgggagccagatcctcaaagaacacccagtcgagaacagccaactgcagaatgaccgactgttcctctactacctgcaaaacgggcgcgacatgtacaccggggaggagctggacatcgactacctctcccagtacgatatcgaccacataatcccccaagccttcatcaaagacaacagcatcgataaccgggtgctgacctccagcaaagagaacaggggcaagtccgatgacgtacccagcaaggacgtcgtgcggaagatgaagtcctactggagcaagctgctctccgccaagctgatcacccagcgcaagttcgacaacttgacgaaggctgagcggggcgggctcaccgacgacgacaaggcgggcttcatcaagcgccagcttgtggagacccggcagatcaccaagcacgttgcccggatcctggacgagcggttcaacaccgagacggacgagaacaataagaaaatccgccaggtgaagatcgtgaccctcaagagcaacctggtctccaacttccggaaggagttcgaactgtacaaggtccgagagataaatgactaccaccacgcccacgacgcctacctcaacgccgtgatcgggaaggcgctgctgggcgtctacccccagctcgagcccgagttcgtttacggggactacccccacttccacggccacaaggagaacaaggccaccgccaagaagttcttctacagcaacatcatgaactttttcaagaaggacgatgtgcggactgacaagaacggcgagatcatctggaagaaagacgaacacataagtaacatcaagaaggtcctgagctacccccaggtgaacatcgttaaaaaggtcgaggagcagaccggaggcttctccaaagagtcgatcctccccaaggggaactccgacaaacttatcccccgcaagacgaagaagttctactgggacaccaagaagtacggcgggttcgacagccccatagtggcctacagcatcctggtgatcgcagacatcgagaagggcaagtccaagaaactgaagaccgtcaaggcactcgtgggcgtaacgataatggaaaagatgaccttcgagcgggacccggtcgccttcttggagcgcaaggggtatcgcaatgtgcaggaggagaacatcatcaagctgcccaagtatagcctcttcaagctcgagaacgggcggaagcgcctgctagcctccgccagggagctgcagaaggggaacgaaatcgtgctgcccaaccaccttggaaccctgttataccacgcgaagaacatccacaaggtcgatgagccgaagcatctcgactacgtggacaaacacaaggatgagtttaaggaactgctggacgtggtctcaaacttctccaagaagtacaccctcgccgagggtaatctagagaagatcaaggagctgtatgcccagaacaacggcgaggacctcaaggagctcgctagcagtttcatcaaccttctcactttcacggccatcggggcgcccgccaccttcaagttcttcgataagaacatcgaccgcaagcggtacaccagcacgaccgagatcctgaacgccacgcttatccaccagtccataaccggactctacgagacgcgcatcgacctgaacaagctgggcggggacaagcggcccgccgccaccaagaaggcgggccaagccaaaaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8203 - RNA, 3484 nt, synthetic construct
  misc_feature 1..3484: note = Cas9 variant mRNA product
  source 1..3484: mol_type = other RNA
gggagagtcccgcagtcggcgtccagcggctctgcttgttcgtgtgtgtgtcgttgcaggccttattcaagcttaccatggcacctaaaaagaaacggaaagtgggcatacacggcgttccagccgcacaaacaaccaacctcagttacatactaggtctagacctcggtatcgcatcagtcggctgggccgtcgtcgaaatcaacgaaaacgaagaccccatcggactaatagacgtcggcgtaaggatattcgaacgcgccgaagtcccaaaaaccggagaaagcctagcactgtccaggagactcgcgcggagtacccgccgcctaatacgccgccgagcccaccgcctactcctcgcgaaacgcttcctcaagagagaaggcatactgagcaccatagacctcgagaaaggcctgccaaaccaggcctgggagctaagagtcgccggcctcgaaaggcgactatcggccatcgaatggggagccgttctcctgcacctaataaaacacagggggtacctatcgaaaagaaagaacgagagtcaaacgaacaacaaggagctgggcgccctgctaagcggagtggcgcaaaaccaccagctcctacaatccgacgactaccgaacacccgcagaattagccctcaagaaatttgcaaaagaagaggggcacataagaaaccaacgcggcgcttacacacacaccttcaatagattagacctcttagcagaactgaacctgctattcgcacaacagcatcaattcggaaacccacactgtaaagagcacatccagcaatacatgactgaactcctaatgtggcagaaacccgcactcagtggcgaggccatcctaaaaatgctcggaaaatgcacacacgagaaaaacgagttcaaagccgcgaaacatacctacagcgccgaacgttttgtttggctcaccaaactcaataaccttcgaatactcgaagacggggccgaacgggcactaaacgaagaagaaagacaactactaatcaaccacccgtacgaaaagagcaaactaacatacgcgcaggtacgaaaattactaggcctctccgaacaagctattttcaagcacctacgctacagtaaagaaaacgcagagtcagccaccttcatggagctcaaagcctggcacgccatacgaaaagcactcgaaaaccagggcctgaaggacacctggcaggacctcgccaagaaacccgatctcctcgacgaaatcggaaccgccttctcactctacaaaacagatgaagacatccaacaatacctaacgaacaaagtacccaacagcgtaataaacgcactactcgtatccctgaacttcgataagttcatcgaactcagcctgaaaagcctgagaaaaatacttcctctaatggaacaaggcaaacgctacgatcaggcctgccgcgagatctacggacatcactacggggaggccaaccaaaagacgtcacaactcctgcccgccattccagcccaagaaatacgcaaccccgtagtcctgcgaacgctgtcccaagcaagaaaagtaataaacgccatcatacgacaatacggctcccccgcccgagtccacatagaaacgggtcgagaactagggaaatccttcaaagaacgacgcgaaatccaaaaacagcaggaggataatcgaaccaaacgcgagtcagcggttcaaaagttcaaggaactcttctccgacttcagcagcgaaccaaaatctaaagacatactcaagttccgcctttacgagcaacaacacggtaaatgcctatactcgggcaaagaaatcaacatacacaggctgaacgaaaaaggatacgtcgagatcgaccacgcactacccttcagtcggacctgggacgactcattcaacaataaagtacttgtcctagcaagcgagaaccaaaacaaaggcaaccagacaccatacgagtggctacaagggaaaataaactccgaacgctggaaaaacttcgtcgcactggtactcggcagccagtgctcagccgcgaagaaacaacgcctcttgacccaggtcattgacgacaacaaatttatcgaccgcaaccttaacgacactcgatacatcgcacgcttcctatcaaactacatccaggaaaacctcctactcgtcggcaaaaacaaaaagaacgtattcacgccaaacggccaaatcacagccctgctccggtcgcgatggggactaatcaaagctcgagaaaacaacaaccgacaccatgccctagatgcgatcgtggtcgcttgcgcgaccccctcaatgcaacagaaaataacccgcttcatccgatttaaagaagtccacccctacaaaatagaaaaccgatacgaaatggtcgaccaagagagtggagaaattataagcccccacttccccgagccatgggcatacttcaggcaagaggtaaacatccgagtattcgacaaccaccccgacacggtgctaaaagagatgctcccggaccggccacaggcaaaccaccaattcgtacaacctctattcgtctcccgagcgcccaccagaaaaatgtccggccaaggccacatggaaaccatcaagtccgccaaacggctggcagaaggcatctccgtactccgaatacccctaactcaactcaaacccaatctcctggaaaacatggtaaataaggagcgcgaacccgccctgtacgcaggccttaaagcccgactcgccgagttcaaccaggaccccgcaaaagccttcgccacaccattctacaaacaaggcggccagcaggtaaaagcaatccgagtagagcaagtacaaaaatcaggagtcctagtacgcgaaaacaacggagtcgccgacaatgcctcaatcgtacgaaccgacgtattcatcaaaaacaacaaattctttctcgtccccatctacacgtggcaagtagcaaagggaatcctaccaaacaaggcaatcgtcgcacacaaaaatgaagacgaatgggaagaaatggacgaaggtgccaaattcaagttctctctcttccccaacgaccttgtcgaactaaaaaccaagaaagaatacttcttcggctactacatcggactggaccgggcaacagggaacataagcctaaaagagcacgacggcgaaatctccaaaggcaaagacggagtctacagggtaggcgtcaaacttgcactgagctttgaaaaataccaagtagatgagcttgggaaaaaccgacaaatctgccgaccccaacaaagacaacctgtcagaaagagaccagccgcaactaaaaaggcaggacaagccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8204 - RNA, 3562 nt, synthetic construct
  misc_feature 1..3562: note = Cas9 variant mRNA product
  source 1..3562: mol_type = other RNA
gggagagtcccgcagtcggcgtccagcggctctgcttgttcgtgtgtgtgtcgttgcaggccttattcaagcttaccatggcacccaaaaagaaacgcaaagtcggaatccacggagtaccagcagcagccgcctttaaaccaaacccaatcaactacatactcggattagacatagggatagcatcagtcggatgggccatggtcgagatcgacgaggacgaaaaccccatatgcctcatagacctgggggttagggttttcgagcgtgcagaggttccaaaaacaggcgacagcctagcaatggcacgtagactagcgcgctctgtccgcagactcacgagacgacgggcccacagactgctaagagcccgccgcctgctcaaaagagaaggagtcctacaagccgccgactttgacgaaaacggactcataaaaagcctccccaacacaccctggcaacttcgggcggccgccttagaccgaaaactcacacccctcgagtggtccgccgtgctactgcacctgatcaaacatcgaggatacctcagccaacgcaaaaacgagggagaaacggcagacaaagagctcggcgcactgcttaaaggcgtagcggacaacgcacacgcactacagacgggggacttccgcacgccagccgagctcgcactcaacaaattcgagaaagaaagcggtcacatccgaaaccagcgcggagactactcccacacattctcccgaaaagacctgcaagccgaactcatcctactattcgaaaaacagaaagagttcggcaacccacacgtatcaggcggtctaaaagaaggtatagaaacactcctcatgacccaaagaccggccctgtcaggagacgcagtccagaaaatgctcgggcattgcacattcgaaccagcagagcccaaggcagctaaaaacacatacaccgcagaacgattcatctggctgaccaagctcaacaacctcagaatattagaacaagggtctgaacgccccctgactgacacggaacgcgcaacactcatggacgaaccgtaccgcaaaagcaaactcacctacgcacaagcccgtaaactactgggcctcgaagacacagctttcttcaagggtctgcgatacggaaaagacaacgcagaagcatcaacattaatggaaatgaaggcttaccatgccatcagccgagccctagaaaaggaaggcctaaaagataagaaaagtcccctaaacctgtcgcccgagctacaagatgaaatcggcacagccttctcgctttttaaaaccgacgaggacatcacagggcgactcaaagaccgaatacaacccgagattctggaggcgctcctcaaacacatatcattcgacaaattcgtccaaatatccctcaaagcactacgcagaatcgttcctctcatggaacaaggcaaacgctacgatgaagcctgcgcagaaatatatggagaccattacgggaaaaagaacaccgaagagaaaatctatctgcccccgatcccagcggacgaaatacggaatcccgtcgttctgcgagcgctatcccaagcgagaaaagtaatcaacggggtcgtcagacgctacggcagtcccgcaagaatacacatagaaaccgcccgagaggtcggcaaatccttcaaagaccgcaaagagatcgaaaaacgccaagaagaaaatcgcaaggaccgagaaaaagcggcagcgaaattcagagaatacttcccaaacttcgtcggggaacccaaatccaaagatatcctaaaactccgcctatatgaacaacagcatggcaaatgcctctacagcggtaaggaaatcaacttaggaagactgaacgaaaaaggctacgtggaaatagaccacgcgctcccattcagccgcacttgggacgactcattcaacaacaaagtgctggtcctcggctcagagaaccagaataaagggaatcaaaccccctacgaatacttcaacggcaaagacaacagccgcgaatggcaagagttcaaggcacgagtggagacctcgcgcttccccagaagcaagaaacagcgaatactcctacagaaattcgacgaagatggcttcaaagaaaggaacctaaatgacacacgctacgtaaaccgctttctttgccaattcgtagcagaccggatgcggctcactggaaagggcaaaaagagagtcttcgcatccaacggacaaatcactaacctgctgaggggattctggggattacgcaaagtccgggcagagaacgaccgacaccatgcgctcgacgccgtagtcgtagcatgcagcaccgtagccatgcaacagaaaatcacgcgcttcgtgagatacaaggaaatgaacgcattcgacggaaagaccatcgacaaagagaccggagaagtcctacaccagaagacccatttcccccaaccctgggagttcttcgcccaggaagtcatgatacgcgtcttcggcaaacccgacggaaagccagagttcgaagaagcggacacgccagaaaaactaagaacgctgctcgccgagaaacttagctccagacctgaagcagtacatgaatatgtaaccccactcttcgtaagccgagccccgaaccgcaaaatgtccggccaggggcacatggaaacagtaaaatcagccaaacgcctagacgagggcgtgagcgtactaagggtaccgcttacacaactcaagctaaaagacctagagaaaatggtcaaccgcgagcgcgaaccaaagctctacgaggcccttaaggctcggctagaggcacacaaagacgacccagccaaagccttcgcggaaccgttttacaaatacgacaaggccggcaatcggactcaacaagtcaaagccgtaagagtagagcaggtccagaaaacaggcgtctgggtacgtaaccacaacggcatagcagacaacgccactatggtacgcgtcgacgtgttcgaaaaaggcgacaaatattatctagtgcccatatacagctggcaagtcgcaaaaggaatcctaccagaccgcgcggtggtccaaggaaaggacgaagaagactggcaactcatcgacgacagcttcaacttcaaattcagcctacaccccaacgacctagtcgaagtcatcacaaagaaggcccggatgttcgggtacttcgcctcctgccaccgcggcaccggtaacataaacataaggatccatgacctcgaccacaaaataggcaaaaacggaatattagaaggcatcggggtaaaaacagcccttagcttccaaaaataccaaatagacgagctaggaaaagaaataaggccctgccgactcaaaaagagaccaccagtgcgcaaaaggcccgcagcaacgaagaaagccggccaagccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8205 - RNA, 3568 nt, synthetic construct
  misc_feature 1..3568: note = Cas9 variant mRNA product
  source 1..3568: mol_type = other RNA
gggagagtcccgcagtcggcgtccagcggctctgcttgttcgtgtgtgtgtcgttgcaggccttattcaagcttaccatggcaccgaagaagaaaaggaaagtcggcattcacggagtcccagccgcaaaataccatgtaggcatagacgtaggaacattcagcgtagggctcgcggcaatagaggtagacgacgcaggtatgcccatcaaaaccctaagccttgtgtcacacatccacgacagcggcctcgatccagatgaaatcaaatcggcggtcacgcgactagcaagcagcggtatcgccagacgaacgcgcagactgtaccgaaggaaaaggagaagactccagcaactggacaaattcatacaacggcaaggatggccagtgatagaattagaggactacagcgacccactatacccctggaaagtaagagccgagctcgcagcaagttacattgcggatgagaaagaacgaggcgagaaattgagcgtggcactgagacatatcgccagacacagaggatggcgcaacccatacgcaaaagtaagcagcctatacctcccagacgggccgtccgacgcattcaaagcgatcagagaagagataaagagggcgagtgggcaaccagtgccagaaacagccacggtgggacaaatggtgaccctatgcgaactaggcacgctgaagctaagaggagaaggcggagtcctgagtgcacggttgcagcaaagcgactacgcccgcgaaatacaagaaatatgccgcatgcaagaaatagggcaagaactctacagaaaaataatcgacgtagtattcgcagctgaaagcccaaaggggagcgccagcagccgagtaggaaaagaccccttacaacccgggaaaaaccgcgcgctaaaggccagcgacgcattccaacgatacaggatagcagccttaataggaaacctaagagtccgagtagatggagagaaacgcatcctcagcgtagaggagaagaacctcgtgttcgaccatctggtcaatctaaccccaaagaaagaaccagaatgggtaacgatcgcagaaatactgggcatagacagagggcagctaataggaaccgccacgatgacggacgacggagaacgcgcgggagcccgaccacctacgcacgacacgaacagatccatcgtgaacagccgaatagccccgctagtcgactggtggaaaacagcgagcgccctcgaacaacatgcaatggtcaaggctctaagcaacgcggaagtagacgacttcgactcaccagagggagcaaaagtccaagcattcttcgccgacctagacgacgacgtccacgcaaaactcgactcccttcatctgccagtcggacgagcggcgtacagcgaagacaccctagtacgattaacacgacgcatgctaagcgacggagtagatctgtacaccgcaagactacaggagttcggcattgaaccaagctggacgccaccaacccccaggatcggagaaccagttggtaacccagctgtagaccgagtactaaaaacagtcagtcgatggcttgaaagtgcgaccaagacttggggagcaccagaacgggtcataatagaacacgtaagggagggatttgtaacagaaaaacgggcgcgagaaatggacggggacatgcgtagacgagcagcaaggaacgcaaaactgttccaggaaatgcaggagaaactaaacgtacaaggaaaaccctctagagcagatctctggcggtaccagagcgtccaaagacaaaactgccaatgcgcatactgcggcagcccaatcacgttcagcaactcagaaatggaccacatcgtgccaagggctgggcagggatccaccaacacgcgcgagaacctagtggcggtgtgccacaggtgtaaccaaagcaaaggaaacaccccgttcgcgatatgggcgaaaaacacctccatagagggcgtaagcgtaaaggaagctgtggaaagaacacgacactgggtcacggacacaggaatgcgctcaaccgactttaagaaatttacaaaggctgtcgtcgagaggttccaaagagcaacgatggacgaagagatagacgcaaggagcatggaatcggtcgcatggatggcaaacgaattgcgcagtcgggtagcacagcacttcgctagccacggaacaacggtacgagtctaccgcggaagcctcacagcggaagcacggagggccagcggcataagcggcaaactaaagttcttcgacggagtcgggaaatctcgcctagaccgcagacaccatgccatagacgcggccgtgatcgcattcacaagtgactacgtggccgagaccctagcagtacgaagcaatttgaagcaaagccaagcgcacagacaggaagccccgcaatggcgagagttcacaggaaaagacgcagaacacagagcggcatggagggtatggtgccagaaaatggaaaaactaagcgcattgctcaccgaagacctcagggacgacagagtcgtcgttatgagcaacgtgcggctacgcctcggcaacggctcggcccacaaagaaacaataggaaaactcagcaaggtcaaactaagctcacaactgtccgtatccgacatagacaaagcgtcgagcgaagcactctggtgcgcgctaacgcgagaacccggatttgaccccaaggaaggcctccctgcaaacccagaacggcacatacgagtaaacggtacacacgtgtatgctggtgacaacatcggattattcccagtctcagcaggaagtattgcgctgcggggaggatacgcagaactcggctcaagttttcaccacgcaagggtatataaaataacaagcgggaagaaaccagcattcgctatgttgagagtatacacgatagacctgctcccctaccgcaaccaagacctattcagcgttgaactaaaaccacaaacaatgtcaatgaggcaagccgaaaagaaactgcgagacgccctcgccaccgggaacgccgaatacctcggctggttagtcgtcgacgacgagctcgtagtagacaccagcaaaatagcaacggaccaagtaaaagcagtcgaagcggagctaggaacgataagacgatggagggtagatggatttttcagcccaagcaaactacgcctaagaccgcttcaaatgtcaaaagaaggcatcaaaaaggaaagcgcaccagagctgagcaagataatcgacagacccggctggctaccagcagttaataaactcttcagcgacggcaacgtcacagtcgtgcgaagggactcgttggggcgggtacggctagaaagcacagcgcacctacccgtcacatggaaggtacaaaagagaccagccgcgacgaagaaggcaggccaggcgaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8206 - RNA, 3268 nt, synthetic construct
  misc_feature 1..3268: note = Cas9 variant mRNA product
  source 1..3268: mol_type = other RNA
gggagagtcccgcagtcggcgtccagcggctctgcttgttcgtgtgtgtgtcgttgcaggccttattcaagcttaccatggcccccaagaagaaacgcaaggtgggcatccacggggtcccggccgcggcccggatactggccttcgacatcggcatcagctccatagggtgggccttcagcgagaacgacgagctcaaggactgcggcgtgcgcatcttcactaaggtggagaaccccaagacaggagagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgatgagagcctcgccaaggcctacaaaggctccctgatcagcccctacgagctgcggttccgcgcactcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacttgtacaaggagtacttccagaaattcaaggagaacagcaaggagttcacgaacgtgcgcaacaagaaggagtcctacgagcggtgcatcgcccagagcttcctgaaggacgagctgaagctcatctttaaaaagcagcgcgagttcgggttctccttcagcaagaagttcgaagaggaggtcctttccgtggcgttctacaagcgggctctgaaggacttcagccacctcgtgggcaactgctccttcttcaccgacgagaagcgcgccccgaagaacagccccctggccttcatgtttgtcgccctgacccggatcatcaatctcctgaacaacctgaagaacaccgagggcatcctctacacgaaggacgacctgaacgcgctgcttaacgaggtgctgaagaacggcaccctgacctacaagcagaccaagaagctcctggggctgagcgacgactacgagttcaaaggggaaaagggcacgtacttcatcgagttcaagaagtacaaggagttcattaaggccctcggggagcacaacctgtcccaggacgacctgaacgagatcgccaaagacatcaccctcatcaaggacgagatcaagctgaagaaggccctggccaagtacgacctcaaccagaaccagatcgacagcttatccaaacttgagttcaaggaccacctcaacatcagcttcaaggcgctaaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgtgcgatcaaggagtaccgcaaggtgctgaacgccctcctgaagaagtacggcaaggtgcacaaaatcaacatcgagctggcgcgggaggtcgggaagaaccactcccagcgcgccaagatcgagaaggagcagaacgagaactacaaggccaagaaagacgcggagctcgagtgtgagaagctgggcctgaagatcaacagcaagaacatcctcaagctgcggctgttcaaggagcagaaggagttctgtgcctactccggggagaaaatcaagatcagcgacctccaggacgagaagatgttagagatcgaccacatctacccatactcccgcagcttcgacgactcctacatgaacaaggtgctggtgttcaccaagcagaaccaggagaagctcaaccagacccccttcgaggccttcggcaacgacagcgcgaagtggcagaagatcgaggtcctggcaaagaacctacccaccaagaagcagaagcggatcctcgacaagaactacaaggacaaggagcagaagaacttcaaggaccgcaacctgaacgacacacggtacatagctcgcctggtgctcaactacaccaaggactacctggacttcctgccgctctccgacgacgagaacaccaagctgaacgacacccagaaggggagcaaggtgcacgtcgaggccaagtccggcatgctgacgagcgctctccggcacacctggggcttctccgccaaggaccgcaacaaccacctccaccacgccatcgatgcggtgataatcgcctacgccaacaacagcatcgtcaaggccttctccgacttcaaaaaggagcaggagagcaacagcgcggagctgtacgccaagaagatctccgagctggactacaagaacaagcggaagttcttcgagcccttcagcggtttccgccagaaggtgctggacaagatcgacgagatcttcgtgtccaaacccgagcggaagaagcccagcggtgccctgcacgaggagaccttccgtaaagaggaggagttctaccagtcctacgggggcaaggagggggtcctcaaggcgctggagctgggcaagatccggaaggtgaacgggaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttttgcttctccctctacaaggacagcctgatcctgatccagaccaaggacatgcaagagcccgagttcgtgtactacaacgccttcacctcctcaaccgtgtccctcatagttagcaagcacgacaacaagttcgagacgctgtccaagaaccagaagatcctgttcaaaaacgcaaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8207 - RNA, 3679 nt, synthetic construct
  misc_feature 1..3679: note = Cas9 variant mRNA product
  source 1..3679: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgtcggacctagttctcggcctggacatcgggattggctccgtgggggtcgggatcctgaacaaggtgaccggcgagatcatccacaagaacagccggatcttccccgccgcccaggccgagaacaacctagtgcgccggacgaaccgccagggccggcgcctggcccggcgcaagaagcaccggcgcgtccggctgaaccgcctcttcgaggagtccggcctgatcacggacttcaccaagatcagcataaacctgaacccctaccagttacgggtgaaggggctgaccgacgaactgtccaacgaggagctgttcatcgcgctgaagaatatggtgaagcaccgcggcatcagctacctggatgacgcctccgacgacgggaacagctccgtcggcgattacgcccagatcgtgaaggagaatagcaagcagctcgagaccaagacgcccggacagatccagctggagcggtaccagacctacgggcagctgcgcggcgatttcaccgtggagaaagacgggaagaagcaccgactcatcaacgtcttcccgacctccgcctaccgaagcgaggcgctgcggatcctgcaaactcagcaggagttcaacccccagatcaccgatgagttcatcaaccgctacctcgagatcctgaccggcaagcggaagtactaccacggccccgggaacgagaagtcccgcaccgactacggccgctatcggacgagcggggagaccctggacaacatcttcggcatcctcatcgggaagtgcaccttctaccccgacgagttccgcgccgccaaggcctcctacaccgcccaggagttcaaccttttaaatgacctcaacaacctgacggtgccgaccgaaaccaagaagctcagcaaggagcagaagaaccagatcatcaactacgtgaagaacgagaaggctatgggccccgccaagctgttcaagtacatcgccaagctcctgtcctgcgacgtcgccgacatcaagggctaccggatcgacaagagcgggaaggccgagatccataccttcgaggcgtaccgcaagatgaagacgctcgagaccctggacatcgagcagatggacagagagaccctggacaagctcgcctacgtactgaccctgaacacggagcgcgagggcatccaggaggccctcgagcacgagttcgccgacgggtccttcagccagaagcaggtcgacgagctggtgcagttccggaaggccaacagctccatcttcggcaaagggtggcacaactttagcgtgaagctgatgatggagctcatccccgagctgtacgagaccagcgaggagcagatgaccatcctgacccgcctcggcaagcagaagacaaccagctccagcaacaagactaagtacattgacgagaagctgctgaccgaggaaatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgcctcacagcgtgttccacggccacaagcagctggccaccaagatccggctgtggcaccagcagggcgagcgctgcctctataccggcaagaccatctccatccacgacctgatcaacaacagcaaccagttcgaggtcgaccacatcctgcccctctccatcacgttcgacgacagcctggccaacaaagtgctggtgtacgcgaccgccaaccaggagaaggggcagcggacgccctaccaggccctggactccatggacgacgcctggtcgttccgcgagctgaaggccttcgtccgggagtccaagaccctgagcaacaagaagaaggagtacctcttgaccgaggaggacatctccaagttcgacgtgcgcaagaagttcatcgagcggaacctcgtggacacgcgctacgcgagccgggtcgtgctcaacgccctgcaggagcacttccgcgcccataaaatcgacaccaaggtgtccgtggtgcgcggccagttcaccagccagttaagacgccactggggcatcgagaagacccgggacacgtaccaccaccatgcagtggacgccctcatcatcgcggcctcctcccagctgaacctgtggaagaagcagaagaacaccctcgtcagctactccgaggaccagctgctggacatcgagaccggggagctcatcagcgacgacgagtacaaggagtccgtgttcaaggccccctaccaacatttcgtggacaccttaaagagcaaggagttcgaggattccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctcgagaactaccccaacaagcagatcaacgagaagggcaaggaggttccctgcaacccgttcctcaagtacaaggaggagcacgggtacatccggaaatacagcaagaagggcaacgggcccgagatcaagtccctgaagtactacgacagcaagctgggcaaccacatcgacattacccccaaagactccaacaacaaggtggtcctccagagtgtgtccccctggcgcgccgacgtgtacttcaacaagaccaccgggaagtacgagatcttgggcctgaaatacgcggacctccagttcgagaagggcacggggacctacaagatcagccaggagaagtacaacgacatcaagaagaaagagggcgtcgacagcgactccgagttcaagttcaccctgtacaagaacgacctgctcctggtgaaggacaccgagacgaaggagcagcagctgttccggttcctcagccgcaccatgccaaagcagaagcactacgtggagctaaagccctacgacaagcagaagttcgagggcggagaggccctgatcaaggtcctcgggaacgtggccaactccggccagtgcaagaagggactgggcaagagcaacatctccatctacaaggtgcggaccgacgtcctggggaaccaacacatcattaagaacgagggggacaaacccaagctcgacttcaagcgccccgccgccaccaagaaggcgggccaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8208 - RNA, 4237 nt, synthetic construct
  misc_feature 1..4237: note = Cpf1 variant mRNA product
  source 1..4237: mol_type = other RNA
gggagagtcccgcagtcggcgtccagcggctctgcttgttcgtgtgtgtgtcgttgcaggccttattcaagcttaccatggcccccaagaagaagcgcaaggtgggaatccacggcgtcccggccgcgacccagttcgagggcttcaccaacctgtaccaggtgagcaagacgctccggttcgagctgatcccccaggggaagaccctgaaacacatccaggagcagggcttcatcgaggaggacaaggcccgcaacgaccactacaaggaactcaaacccatcatcgaccggatctataagacctacgccgaccagtgcttgcagctggtgcagctcgactgggagaatctgtccgccgccatcgacagctaccgcaaggagaagaccgaggagacccgtaacgcgcttatcgaggagcaggccacctaccgcaacgctattcatgactacttcatcgggcggaccgataacctcaccgacgccataaacaagcgccacgctgaaatctacaagggcctcttcaaggccgagctattcaacggcaaggtactaaagcagttagggacggtgaccaccaccgagcacgagaatgccctactccggtccttcgacaaattcacgacctacttctcaggcttctacgaaaaccgcaagaacgtgttcagcgcagaggacatcagcaccgcaatcccccaccggatcgtccaggacaatttcccgaagtttaaggagaactgccatatcttcacccgtctgatcacggcggtgccgtccctgcgggaacacttcgaaaacgtgaagaaggccatcggaatttttgtcagcacctccatcgaggaggtgttcagtttccccttctacaaccagttgctgacccagacccagatcgacctgtacaaccagctcttgggcgggatctctcgcgaggccggcacggagaagataaagggcttaaatgaggtgctcaacctggccatacagaagaacgacgagacagcccacatcatagcgagcctgccccaccggttcatcccgttattcaaacagatcctgtctgaccgtaacacccttagcttcatcctcgaggagttcaagagtgacgaagaggtcatccagtcgttctgcaaatacaagacccttctgcggaacgagaatgtgctcgagacggccgaggcccttttcaacgaactgaactccatcgacctcacccacatcttcatcagccacaagaaactcgagaccatcagcagcgccctgtgcgaccactgggacaccctccgcaacgccctgtacgagcggcgcatcagtgagctgacgggcaagatcaccaagtccgcgaaggagaaggtgcagcggagcctcaagcatgaagacatcaacctgcaggagatcatctccgccgccggcaaggagctgagtgaggccttcaagcaaaagacctcagaaatcctatcccacgctcatgcggccctggaccagccgttgcccaccacgctcaagaagcaagaagagaaggagatcctgaaatcccagttagacagcctgctcgggctgtaccacctcctcgactggttcgcagtcgacgaatccaacgaggtggaccccgagtttagcgcccgcctgaccggcattaaactggagatggagccgtccctcagcttctacaacaaggcgcgcaactacgccaccaagaagccctactccgtggagaagttcaagctgaacttccagatgcccacgctggccagcggctgggatgtaaacaaggagaagaacaatggggccatactcttcgtgaagaacggcctgtactacctggggatcatgcctaagcaaaagggccggtacaaggccttatccttcgagcccacggagaagaccagcgaagggttcgacaagatgtactacgactacttccccgacgcggccaaaatgatccccaagtgctccacacagctgaaagcagtgaccgcccacttccagacccacacgaccccgattctgttgagtaacaacttcatcgagccgctggagatcaccaaagagatctacgatctgaacaaccccgagaaggagcccaaaaagttccagaccgcctatgcgaaaaagacgggagaccagaaaggctaccgcgaggccctgtgcaagtggatcgacttcacccgggatttcctatccaagtacaccaagaccacgagcatcgacctgagttcactccggccaagctcccagtacaaagatctgggggagtactacgccgagctgaatccgctcctgtatcacatctcattccaacggatcgccgagaaagagatcatggacgccgtagagacgggcaagctctacctcttccagatctacaacaaggacttcgcgaagggacaccacggcaagcctaacctgcacacattgtactggaccggcctcttctcccccgagaacctcgccaagacgagcatcaagctgaacgggcaggccgagctgttctacaggcccaagagccggatgaagcgcatggcccacaggctgggtgagaagatgctgaacaagaagctaaaggaccagaagaccccgatccccgacaccctgtaccaagagctgtatgactacgtgaaccatcgcttaagccacgacctctccgacgaggcgcgtgccttactccccaacgtgatcaccaaggaggtcagccatgagatcatcaaggaccgcagattcacgtccgacaagttcttcttccacgtgccgatcacactgaactaccaggccgctaacagcccctccaagttcaaccagcgcgtcaacgcctacctaaaggagcaccccgagacgcccatcattgggatagaccggggcgagcgcaacctgatctatatcaccgtgatcgacagcacggggaagatcctggagcaacgatccctgaacaccatccagcagttcgactaccagaagaaactcgacaaccgcgaaaaagagcgggtggcggcacgccaggcctggagcgtcgtgggcaccatcaaggacctgaagcaggggtacctgagccaggtgatccacgagatcgtcgacctcatgattcactaccaggccgtcgtggtcctggagaacttaaacttcggcttcaaatcgaaacgcaccggcatcgccgagaaagcggtgtaccagcagttcgagaagatgctcattgacaagttaaactgcctggtgctaaaagattacccggccgagaaggtcggaggcgtgctgaacccctaccagttgacggaccagttcaccagcttcgccaagatgggcacccagtctggcttcctcttctacgtgcccgccccctacaccagcaagatcgacccgctgacggggttcgtagaccccttcgtttggaagaccatcaagaaccatgagagtcggaagcacttccttgaggggtttgacttcctccactatgatgtgaagactggcgatttcatcctgcacttcaagatgaaccgcaacctgagcttccagcgggggctccccggtttcatgcccgcctgggacatcgtcttcgagaagaatgagacccagttcgacgcgaaggggacgcccttcatcgccggcaagcgcatagtccctgtgatcgagaaccaccggttcaccggccgctaccgggatctgtaccccgcaaacgagctgatcgccctcctggaggagaaggggatcgtctttcgagacggctccaacatcctgcccaagttgttagagaatgacgacagccacgcaatcgacaccatggtggccctgattcggtccgtgctccagatgcgcaacagcaacgcggccaccggggaggactacatcaactccccggtccgggacctgaacggcgtgtgctttgatagccgcttccagaaccccgagtggcccatggacgccgacgcgaacggggcctaccatatcgccctgaagggacaactcttgctgaaccacctcaaggagtctaaggacctcaagctgcaaaacggtatcagcaaccaggactggctcgcctatatacaagagctgcggaacaagcgccccgccgcgactaaaaaggctgggcaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8209 - RNA, 4216 nt, synthetic construct; identical to SEQ ID NO: 2409
  misc_feature 1..4216: note = Cpf1 variant mRNA product
  source 1..4216: mol_type = other RNA

SEQ ID NO: 8210 - RNA, 4530 nt, synthetic construct
  misc_feature 1..4530: note = Cas9 variant mRNA product
  source 1..4530: mol_type = other RNA
gggagaggcgctgcctacggaggtggcagccatctccttctcggcatcaagcttaccatggcccccaagaagaagcgcaaagtgggaatccacggggtgccggcggcggacaagaagtacagcatcggcctggacatcgggaccaactcagtgggctgggccgtaatcaccgacgaatacaaagtccccagcaagaagttcaaggtgctggggaacacggaccggcattccatcaagaagaacctgatcggtgccctgctgttcgactcgggcgagaccgccgaggccacccgcctgaagcgaaccgcgcgccggcgctacacgcggcgcaagaaccggatctgttacctgcaggagatcttctccaacgagatggccaaggtggacgacagcttcttccaccgcctcgaggagtccttcctggtcgaggaggacaagaagcacgagcggcaccccattttcgggaacattgtggacgaagtggcctaccacgagaagtaccccaccatctaccaccttcgcaagaagctcgtcgacagcaccgacaaggccgacctgcggctgatttacctcgcgctggcccacatgatcaagttccgcggccacttcctgatcgagggggacctcaacccggacaactccgacgtggacaagctgttcatccaactggtgcagacctacaaccagctgttcgaggagaaccccatcaacgccagcggcgtcgacgccaaagccatcctgtccgcgagacttagcaagagtcgcaggctcgagaacctgatcgcccagcttcccggggagaagaagaacggcctattcggcaacctgattgccctgagcctcggactgacacccaacttcaagtccaacttcgatctggccgaggatgccaaactccagttgagtaaggacacctacgacgacgacctggacaacctcctggcgcagatcggcgaccagtacgccgacctgttcctcgccgccaagaacctgtctgacgccatcctgctcagcgacatcctgcgcgtgaacaccgaaatcaccaaggcgccgctgtccgcctcaatgatcaagcggtacgacgagcaccaccaggatctcacgctgctgaaggcgctagtgcgccagcagttgcccgagaaatacaaggagatcttcttcgaccagagcaaaaacgggtacgctggctacatcgacggcggggcctcccaggaggagttctataagttcatcaagcccatactggagaagatggacggcaccgaggagttactggtcaagctgaaccgggaggacctgctccgcaagcagcgcaccttcgacaatgggagcatcccccaccagatccacctgggcgagctgcacgcgatcctccggcgccaggaggacttctacccgttcctgaaggacaaccgggagaagatcgagaagatcctcacctttcgcatcccctactacgtggggcccttggcccggggcaactcccgcttcgcctggatgacgcgcaagagcgaggagaccatcactccctggaatttcgaggaggtggtcgacaagggcgccagtgcgcagagcttcattgagaggatgaccaactttgacaagaacctgccgaacgagaaggtgctgcccaagcactccctcctgtacgagtacttcacggtgtataacgaactcaccaaggtcaagtacgtgaccgaggggatgcggaagcccgctttcctcagcggcgagcagaagaaggccatcgtggacttgctgttcaagaccaaccgcaaggtcacggtgaagcagctcaaggaggattacttcaagaagatcgagtgcttcgactccgtcgagatcagcggggttgaggaccggttcaacgcctccctgggcacctaccacgacctgctcaaaatcatcaaggacaaggactttctggacaacgaggagaacgaggacatcctggaggacattgtgctcaccctgaccctgttcgaggaccgcgagatgatagaggagcggctcaagacgtatgcccacctgttcgacgacaaggtcatgaagcaactgaagcgtcggcgctacaccgggtggggccggctcagccgcaagttgatcaacggaatccgagataaacagagtgggaagacaatcctggacttcctaaagagcgacggctttgcaaaccgcaacttcatgcagctgatccacgacgactccttgaccttcaaggaggacatccagaaggcccaagtatctgggcagggagactccctccacgagcacatcgccaacctggccgggtcccccgccatcaagaagggcatcctgcagacggtgaaggtcgtggacgagctagtcaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaagagcaccccgtggagaacacccagctccagaacgagaagctctacctgtactaccttcagaacggccgggatatgtacgtcgaccaggagctggacattaacaggctgagcgactatgacgtggaccacatcgtgccccagtccttcctcaaagacgacagcatcgacaacaaggtcctgacacggtccgacaagaaccggggcaagagcgacaacgtgccctccgaggaggtagtcaagaaaatgaaaaactattggagacagctgctcaacgctaagctgatcacccagcgcaaattcgacaacttgaccaaagccgaacgcgggggcctcagcgagctagacaaggccgggttcatcaagcggcagctggtggagacccggcagatcaccaagcacgtagcccagatcctcgactccaggatgaacacgaagtacgacgagaacgacaaactgatccgggaggtcaaggtgatcaccctcaagagcaaacttgtgtccgacttcagaaaggacttccagttctataaggttagggagatcaacaactaccaccacgcgcacgacgcatacctgaacgccgtggtgggcaccgccctgatcaagaagtacccgaaacttgagagcgagttcgtctacggggactacaaggtgtacgacgtgcgcaagatgatcgcgaagtccgagcaggagatcggaaaggctaccgccaagtacttcttctacagcaacatcatgaacttcttcaagacggagatcaccctggcaaacggcgaaatccggaagcgccccctaatcgaaacgaacggagagaccggcgaaatcgtctgggacaaggggcgggacttcgccacggtgcgcaaggtgctctccatgccccaggtcaatatcgtaaagaagaccgaggtgcagaccggcgggttcagcaaggagtccatcctgcccaagcgcaacagcgataagttaatcgcgcgtaagaaggactgggacccgaagaagtacggcggcttcgactcccccaccgtcgcgtacagcgtgctggtggtcgccaaggtggagaagggcaagagcaagaagttaaagtccgtgaaggagctgctcggtatcacgatcatggagcgcagttccttcgagaagaaccccatcgatttcctggaggccaagggatacaaggaggtcaagaaggacctgatcatcaagctccccaagtacagcctgttcgagctggagaacggccggaaacgcatgctcgcctccgcgggggagctgcagaagggcaacgaactggccctccccagcaagtacgtgaacttcctgtacctggcctcccactatgagaagttaaaaggcagccccgaggacaacgaacagaagcagctgttcgtggagcagcacaagcattatctggacgagatcatcgagcagatatccgagttcagcaaacgggtgatcctcgccgacgccaacctcgacaaggtgctctccgcgtacaacaagcaccgtgacaagcccatccgggagcaggccgagaacatcatccacctcttcaccctgaccaaccttggggcccctgccgcgttcaagtacttcgacaccacgatcgaccggaagcggtacaccagcaccaaggaggtgttagacgcgaccctgatacaccagagtatcacgggcctgtacgagacccgcatcgatctcagccagctcgggggcgataagcggcccgccgccaccaagaaggccgggcaggcgaagaagaagaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 8211 - RNA, 5313 nt, synthetic construct; identical to SEQ ID NO: 2411
  misc_feature 1..5313: note = Cas9 variant mRNA product
  source 1..5313: mol_type = other RNA

SEQ ID NO: 8212 - RNA, 3585 nt, synthetic construct
  misc_feature 1..3585: note = Cas9 variant mRNA product
  source 1..3585: mol_type = other RNA
gggagaggcgctgcctacggaggtggcagccatctccttctcggcatcaagcttaccatggcccccaagaagaagcgcaaagtgggcatccacggggtcccggccgcgaagcggaactacatcctgggcctcgacatcgggatcaccagcgtgggctacgggatcatcgactacgaaacccgcgatgttatcgacgccggcgtccggctgttcaaggaggccaacgtggagaacaacgaaggccgccggtccaagcgcggggcccggcgcctgaagcggcgccggcgccaccggatccagcgcgtgaagaagctcctgttcgactacaacctgctcacggaccacagcgagctgtcgggcatcaacccctacgaggcccgggtcaagggtctcagccagaagctctccgaggaggagttcagcgcggccctgctgcacctcgccaagcgcaggggcgtgcacaacgtgaacgaggtcgaggaggacaccgggaacgagctctccaccaaggagcagatcagccgcaactccaaggccctggaggagaagtacgtggcggagctccagctcgagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaagacatcaaggagtggtacgagatgctgatgggccattgcacctacttcccggaggagctccgaagcgtgaagtacgcctacaacgccgacctgtacaacgcgctcaacgacctcaacaacctggtcatcacgcgcgacgagaacgagaagctggagtactacgagaagttccagatcatcgagaacgtgttcaagcagaagaagaagcccaccctcaagcagatagccaaggagatcttggtgaacgaggaggacatcaaggggtaccgggtcacctccaccggcaagcccgagttcacgaacctaaaggtgtaccacgacatcaaggacatcaccgcccgcaaggagatcatcgagaacgccgagctcctggaccagatcgccaaaatcctgaccatctaccagagctccgaggacatccaggaggagctcaccaacctgaacagcgagctgacacaggaggagatcgagcagatctccaacctcaaggggtacaccggcacccacaacctgagcctgaaggcgatcaacctcatcctggacgagctgtggcacaccaacgacaatcagatcgccatctttaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctacccaacgacataatcatcgagctggcccgggagaagaacagcaaggacgcccagaagatgatcaacgagatgcagaagcgcaaccggcagaccaacgagcgcatcgaggaaatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtggaccacatcatcccccgcagcgtgtccttcgataacagcttcaacaacaaggtgctggtcaagcaagaggagaactccaagaaggggaaccggacccccttccagtacctgagctccagcgactccaagatcagctacgagaccttcaagaagcacatcctcaacctggccaagggcaaagggcgcatctccaagaccaagaaggagtacctgctcgaggaacgggacattaaccgcttcagcgtgcagaaggacttcatcaaccggaacctggtggacacgcgctacgccacccggggcctgatgaacctcctgcgctcctactttcgcgtcaacaacctggacgtgaaggtcaagagcatcaacgggggcttcacctccttcctcaggcgcaaatggaagttcaagaaggagcggaacaagggctacaagcatcacgccgaggacgcgctgatcattgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcatatcaaggacttcaaggactacaagtacagccatcgcgtggacaagaagcccaatcgggagctcatcaacgacacactgtactccacccgcaaggacgacaaggggaacaccctgatcgtgaacaacctcaacggcctgtacgacaaggacaacgacaagctgaagaagctcatcaacaagagccccgagaagctcctgatgtaccaccacgacccccagacttaccagaagctcaagctgatcatggagcagtacggggacgagaagaacccgctgtacaaatactacgaggagaccggcaactacctcaccaagtactccaagaaggacaacgggcccgtcatcaagaagatcaagtactacggcaacaagctgaacgcccacttggacatcaccgacgactaccccaacagccggaacaaggtggtgaagctctccctgaagccctaccgcttcgacgtctacctggacaacggcgtgtacaagttcgtcaccgtcaagaacctcgacgtgatcaagaaggagaactactacgaggtgaacagcaagtgctacgaggaggctaagaagctgaagaagatctccaaccaggccgagttcatcgccagcttctacaacaacgacctgatcaagatcaatggtgagctctaccgggtcatcggcgtgaacaacgacctgctgaaccgcatcgaggtgaacatgatcgacatcacgtatcgggagtacttagagaacatgaacgacaagcgcccgcccagaatcatcaagaccatcgcgtccaagacccagagcatcaagaagtactcaaccgacatcctggggaacctgtacgaggtaaagagcaagaagcacccccagatcatcaagaagggcaagcgccccgccgccacgaagaaggccggtcaagccaagaagaagaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 8213 - RNA, 4653 nt, synthetic construct
  misc_feature 1..4653: note = Cas9 variant mRNA product
  source 1..4653: mol_type = other RNA
gggagaggcgctgcctacggaggtggcagccatctccttctcggcatcaagcttaccatggcccccaagaagaagcgcaaggtgggcatccacggggtcccggccgcgctgttcaacaagtgcattatcatcagcatcaacctggacttctccaacaaggagaaatgcatgaccaagccctacagcataggcctggacatcgggacgaactccgtgggctgggccgtgatcacggacaactataaggtccccagcaagaagatgaaggtgctggggaacacttccaagaagtacattaagaagaacttactgggcgtgctgctgttcgacagcggcatcaccgccgaggggcggcgcctgaagcggaccgcgcgccggcgctacacgcggcgccggaaccgcatcctgtacctccaggagatcttctctaccgagatggccaccctggacgacgcgttcttccagcggctggacgacagcttcctcgtgcccgacgacaagcgcgactccaagtacccgatcttcggcaacctggtggaggagaaggtgtaccacgacgagttccccaccatctaccacctccggaagtacctcgccgacagcacgaagaaggccgacctgcgcctcgtctacctcgccttagcgcacatgattaagtaccggggccacttcctgatcgagggcgagtttaactccaagaacaacgacatccaaaagaacttccaggacttcctcgacacctacaacgccatcttcgagagcgacctgtccctggagaacagcaagcagctcgaggagatcgtgaaggacaagatttccaagctggagaagaaggaccgcatcctgaagctgttccccggggagaagaacagcggcatcttctctgagttcctgaagctgatcgtgggcaaccaggctgacttccggaagtgcttcaacctcgatgagaaggcaagccttcacttctccaaggagagctacgacgaggacctggagaccctcctgggatacatcggcgacgactatagcgatgtcttcctgaaggctaagaagctctacgacgcgatcctgctgtccgggtttctcaccgtgacggacaacgagaccgaggcgcccctgagctccgccatgatcaagcgctacaacgagcacaaggaggacctcgccctcctgaaggagtacatccggaacatcagcctgaagacctacaacgaggtgttcaaagacgacaccaagaacggatacgccggctacattgacgggaagacgaaccaggaggacttctacgtatacctcaagaacctgctggccgagttcgagggcgccgactatttcctcgagaaaatcgaccgcgaggacttcctgcgcaagcagcgcaccttcgacaacgggtccatcccgtaccagatccaccttcaggagatgcgcgccatcctggacaagcaggccaagttctaccctttcctagccaagaacaaggagcggatcgagaagatcctgaccttccgcatcccctactatgtgggcccgctggcgcgggggaacagcgacttcgcttggtccatccgcaagcggaacgagaagatcaccccgtggaacttcgaggacgtgatcgacaaggagagctccgctgaggccttcatcaaccgcatgacgagcttcgacctctacctgcccgaggagaaggtcctgcctaagcactccctcctgtacgagaccttcaacgtgtacaatgagctgaccaaggtgcggttcatcgccgagagcatgcgcgactaccaattccttgactccaagcagaagaaggacatcgtccggctttacttcaaggacaagcgcaaggtgaccgacaaggacatcatcgagtacctgcacgcgatctacggctacgacggcatcgaactcaaggggatcgagaagcagttcaacagcagcctgagcacgtaccacgacctgctcaacatcattaacgacaaagagttcctggacgactccagcaacgaggctatcatcgaggagatcatccacaccttaaccatcttcgaggaccgggagatgatcaagcaacgcctctccaagttcgagaacatcttcgacaagagcgtgctgaagaagctgagccgtcgccactataccggctgggggaagctctccgccaaacttatcaacggcatccgggacgagaagtccgggaatacaatcctggactacctcatcgatgacggcatcagcaatcgcaacttcatgcagctgatccacgacgacgccctgagcttcaagaagaagatccagaaggcgcagattatcggcgacgaggacaagggtaacatcaaggaagtcgtgaagtccctccccggcagcccggccatcaagaagggaatcctgcagtccatcaagatcgtagacgagctggtgaaggtgatgggcgggcggaagcccgagagcatcgtcgtggagatggcccgagagaaccagtacaccaaccagggcaagtccaacagccagcagaggctcaagcgcctggagaagtcactgaaggagctcggcagcaagatcctgaaggagaacatccccgccaagctgagtaagatcgacaacaacgccctacagaacgaccgcctgtatctgtactacctccagaacgggaaggacatgtataccggagacgacctggacatcgaccggctgagcaactacgacatcgaccacataatcccccaggcgttcctcaaggacaactccatcgacaacaaggtgctggtcagctccgccagcaaccgcggaaagtccgacgacttcccgagcctggaggtggttaagaagcggaagactttctggtaccagttgctcaagagcaagctgatttcccagcgcaagttcgacaacctgacgaaggccgaacggggcggcctgctgcccgaagacaaggcaggcttcatccaacgccagctcgtcgaaacccggcaaatcaccaaacacgtggcccgcctgctggacgagaagttcaacaacaagaaggacgagaacaaccgggcggtgaggaccgtaaagatcatcacgctcaagagcaccctggtgtcccaattccggaaagacttcgagttgtacaaggtgcgcgagatcaacgacttccaccatgcccacgacgcctacctcaacgccgtcatcgccagcgcgctgctgaagaagtaccccaagctcgagcctgagtttgtgtacggcgactacccgaaatacaactccttccgtgagcgcaagagcgccaccgagaaggtgtacttctattccaatatcatgaacatcttcaagaagtccatctccctggctgacgggcgggtgatcgagcgccccctgatcgaagtgaacgaggagacgggcgagagcgtgtggaacaaggagtccgacctcgccaccgtccggcgcgtgctgagctacccccaggtgaacgtcgtaaagaaggtggaggaacagaaccacgggctggaccggggcaagcccaagggcctcttcaacgcgaacctgtccagcaagccgaagcccaactccaacgagaacctggtcggggccaaggaatacctcgaccccaagaagtacggcgggtacgccggcatcagcaactccttcgccgtgctggtcaaggggacgatcgaaaagggagccaagaagaagatcaccaacgtcctggagttccagggcatcagcatcctcgaccgcatcaactaccggaaagacaagctgaacttcctgttagagaaggggtacaaggacatcgagctgatcatcgaactgccgaagtactcactcttcgagctgtccgacggcagccgccggatgctcgcgtcgatcctcagcaccaacaataagcgtggggagatacataagggcaaccagattttcctgtcccagaagttcgtgaagctgctctaccacgccaagcggatcagcaacaccatcaacgagaaccaccgaaaatacgtggagaaccacaagaaggagttcgaggagctgttctactacatcctggagttcaacgagaactacgtcggtgccaagaagaacggaaagctcctgaacagtgccttccagagctggcagaaccattcgatcgacgagctatgcagctccttcatcggccccacggggagcgagcgcaagggcctcttcgagctaacatcccgggggagcgccgcagactttgagttcctgggcgtgaagataccccgctaccgggactacaccccctccagcctcctgaaagacgccaccctgatccaccagtccgtgacggggctgtacgagacccgcatcgacctcgccaagctgggcgagggcaagaggccggccgccaccaagaaggcagggcaggccaagaagaagaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 8214 - RNA, 3729 nt, synthetic construct
  misc_feature 1..3729: note = Cas9 variant mRNA product
  source 1..3729: mol_type = other RNA
gggagaggcgctgcctacggaggtggcagccatctccttctcggcatcaagcttaccatggcacccaaaaagaaacgcaaagtaggaatacacggagtgccggcagcatggtacgcgagccttatgagcgcccaccatctacgcgttggaatcgacgtaggcacccacagcgtaggactagccacactccgagtagacgaccacggaaccccaattgaattactatcggcactgagccacatccacgatagtggagtcgggaaagaaggaaagaaagaccacgacacacgaaagaaactgtcaggaatagcaagacgcgctcgaagactattacaccaccgacgaacacagctccaacaactagacgaagtcctacgagatctaggcttcccaatcccaacaccgggagagttcctagacttaaacgaacaaaccgacccataccgcgtgtggcgagtccgagcacgactcgtggaagagaaactcccagaggaattacgcggaccagccataagcatggcagtgaggcacatcgcccgacaccgagggtggaggaacccgtatagtaaagtagaatccctactaagccccgccgaggaaagcccattcatgaaagcactccgcgaacgaatcctcgcaaccaccggcgaagtactagacgatggcataacgccgggccaagctatggcccaagtcgcactgacccataacatctcaatgcgcggaccagaaggcatactaggaaaactacaccaatccgataacgcaaacgaaatccggaaaatatgtgcccgccagggggtcagccccgacgtttgcaaacagctactccgggccgtattcaaagccgactcacctagaggcagcgccgtgagtagagtagcacccgatccccttcccggtcaggggagcttccgcagagccccaaaatgcgacccagagttccagcgcttccgaataatatccatagtggcaaacctgcgaatatctgaaacgaaaggcgaaaacagaccactaaccgccgacgaacgcagacacgtcgtcaccttcctaacggaagacagtcaagccgatcttacttgggtggacgtcgcagaaaaactcggagttcaccgccgggacttaaggggaacagccgtacacaccgacgacggagaaagaagtgccgcccggcccccaatcgacgcaacggatagaatcatgagacagaccaaaatcagttccctcaaaacgtggtgggaagaagccgacagcgaacagagaggcgcaatgatcaggtacctgtacgaagacccaaccgattctgaatgcgcagaaatcatagctgaactcccagaagaagatcaagccaaactagactccctacacttacccgcaggacgcgccgcatacagcagagagagtctaacagccttaagcgaccacatgctcgcgacaaccgacgacctccacgaggcacgaaaacgccttttcggcgttgacgacagctgggccccacccgccgaagcaatcaacgcccccgtcgggaacccctcggtggaccgcacattaaaaatagtagggcgatacctctcagcagtcgaatctatgtggggcacgccagaagtcattcacgtagagcacgtccgagacgggttcacgagcgagcgcatggccgacgaacgagacaaggcaaaccgacgaagatataacgacaaccaagaagcaatgaagaaaatccagagagactacggaaaagaaggctacatatccagaggggacatagtaaggctggacgccctcgaactccagggatgtgcctgtctctactgcgggacaacaattggataccacacgtgccaactagaccacatcgtaccccaggcaggaccaggaagcaacaaccgccgagggaacctagtcgctgtatgcgaaagatgcaaccgctcgaaatcaaacaccccctttgcagtttgggcccaaaaatgcggcatcccccacgtcggagtaaaggaagcgatcggcagagtcaggggctggagaaagcaaacaccaaacacatcaagcgaagatcttacaaggctaaagaaggaggtcatcgcacgactaagacgaacacaggaggacccagaaatcgacgaaaggtccatggagagcgtagcctggatggcaaacgaactccaccacagaatcgcggccgcatacccagagacaaccgttatggtctatagaggtagtatcacagcggctgcacggaaagccgccggaatagactcccgcatcaatcttataggagagaagggacgaaaagacagaatcgaccgccggcaccacgccgtggatgcctccgtcgtcgcgctaatggaggcaagcgtcgcaaaaacactagccgaacgcagcagcctgcgcggcgaacagcgcctaaccggaaaagaacagacctggaaacaatatacaggcagtaccgtaggagccagagaacacttcgaaatgtggagaggccacatgctccacctcacggaactgttcaatgaaagactagccgaagacaaagtttacgtaacacagaacatacgcctgcgactcagcgacggcaatgcacacaccgtcaaccccagcaaactcgtatcacaccgactcggcgacggactcacagtacaacaaatcgaccgcgcgtgcactccagccctgtggtgtgccctaacccgagaaaaagacttcgacgagaaaaacggcctaccggcacgagaagaccgggccatccgagtgcatgggcacgaaataaaatcgtcagactacatacaagtgttctccaaaagaaagaaaaccgactcagaccgagatgagacaccgttcggagcaatagcggtacgtggagggttcgtcgagatcggacccagcatccaccacgccagaatatacagagtagaaggaaagaaaccagtctacgcaatgctcagggtgttcacacatgacctcttaagccagcgacatggcgacctatttagcgcggtgataccaccacaaagtatcagcatgagatgcgcggaacccaaactccgcaaagcgataacaacgggaaacgccacatatctagggtgggtcgtagtgggcgacgagcttgaaataaacgtagacagtttcaccaaatacgctattggacgcttcctcgaagacttcccaaacacaacacgatggcgcatctgcggttacgatacaaactcaaaactcacgctgaagccaatcgtcctggccgccgaaggactcgaaaacccgtcctcagccgtcaacgagatcgttgaactgaagggatggagagtagcgatcaacgtcctcacaaaagtccacccaacagtagtccgacgcgacgcactaggacgaccgcgctatagttcgagatcaaacctaccaacaagctggacgatcgagaaacgcccagccgcaacaaagaaagccggacaagcgaagaagaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 8215 - RNA, 4590 nt, synthetic construct
  misc_feature 1..4590: note = Cas9 variant mRNA product
  source 1..4590: mol_type = other RNA
gggagaggcgctgcctacggaggtggcagccatctccttctcggcatcaagcttaccatggcccccaagaagaagcgcaaggtgggcatccacggggtccctgccgcgaccaagccctacagcatcggcctggacatcgggaccaactccgtgggctgggccgtgacgaccgacaactacaaggttcccagcaagaagatgaaggtgctcgggaacactagcaagaagtacatcaagaagaacctattaggcgtgctcctgttcgacagcggcatcacggccgaggggcggcgcctgaagcggacggcccgcagacgctacacccggcgccggaatcgcatcctctatctgcaagagatcttctccaccgagatggccaccctagacgacgccttcttccaacggctagacgacagcttcctggtccccgacgacaagcgcgactccaaatacccgatcttcggcaacctggtggaggagaaggcctaccacgacgagttccccaccatctaccacctccggaagtacttggccgacagcaccaagaaggccgacctgcgcctcgtgtacctggcgctggcccacatgatcaagtaccgggggcactttctcatcgagggcgagttcaactccaagaacaacgacatccagaagaacttccaggacttccttgacacctacaacgccatcttcgaaagcgacctgtccttggagaatagcaagcagctggaggagatagtcaaggacaagatctccaagctggagaagaaggaccgcatcctcaagctgttccccggggagaagaacagcggcatcttctccgagttcctgaaactcatcgtgggcaaccaggccgacttccggaagtgcttcaacctggacgagaaggccagtctgcacttctccaaggagagctacgacgaggacctcgagaccctgctggggtacatcggcgacgactactccgacgtgttcctcaaggcgaagaagctgtacgacgccatcctgctcagtgggtttctgacggtcaccgacaacgagaccgaggcgcccctgagctccgccatgatcaagcgctacaacgagcacaaggaggacctcgcactgctgaaggagtacatccggaacatcagcctcaagacctacaacgaggtgttcaaggacgacacgaagaacggctacgccggctacatcgacggaaagaccaaccaggaggacttctacgtgtacctgaagaagctgctcgccgagttcgagggcgcagactacttccttgagaagatcgaccgcgaggacttcctgcggaagcagcgcaccttcgacaacggttccatcccgtaccaaatccacctccaggagatgcgcgccatcctggacaagcaggccaagttctaccccttcctggcgaagaacaaggaacggatcgaaaagatcctgaccttccgcatcccctactacgtcggccctctcgcccgggggaacagcgacttcgcctggtccatccgcaagagaaacgagaagatcacgccttggaacttcgaggacgtgatcgacaaggagagctccgccgaggccttcatcaatcgcatgaccagcttcgatctgtacctccccgaggagaaggttcttcccaagcactcgctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacattatcgagtacctccacgcaatctacggctacgacggcatcgagctgaaggggatcgagaagcagttcaacagctccctgagcacctaccacgacctcctgaacatcatcaacgacaaggagttcctggatgactccagcaacgaagccatcatcgaggagatcatccacaccctcaccatcttcgaggaccgggagatgatcaagcagcgcctgtcaaagttcgagaacatcttcgacaagagcgtgctgaagaagctctcccggcgccactacacgggctgggggaagctgagcgccaagctgatcaacggcatccgggacgagaagtccgggaacaccatcctcgattacctgatcgacgacggcatcagcaaccgcaacttcatgcagctgatccacgacgacgcgctcagcttcaagaagaagatccagaaagcacagatcatcggcgacgaggacaaggggaacatcaaggaggtggtcaagtccctgcccggcagcccggccatcaagaaagggatcctgcagtccatcaagatcgtggacgagctcgtcaaggtgatgggcgggcgaaagcccgagagcatcgtggtcgagatggcccgcgagaaccagtacaccaaccagggcaagtccaacagccagcagcggctgaagcgcctggagaagtccctcaaggagctgggcagcaagatactgaaggagaacatccccgccaagctctccaagatcgacaacaacgcgctgcagaacgaccgcctgtacttgtactacttgcagaacgggaaggacatgtacaccggcgacgacctggacatcgaccggctaagcaactacgacatcgaccacatcatcccccaggccttcctgaaggacaactccatcgacaacaaggtgctggtgagctccgcgagcaaccgcgggaagtccgacgacgtcccgagcctcgaggtggtgaagaaacggaagacgttctggtaccagctgctcaagagcaagctgatctcccagcgcaagtttgacaacctgaccaaagcagagcgtggcggcctgagccccgaggacaaggccgggttcatccaacgccagctcgtcgagacccggcagatcaccaagcacgtggcgcgcctgctggacgagaagttcaacaacaagaaggacgagaacaaccgggccgtgcgcacggtcaaaatcatcaccctcaagtccaccctggtgagccagttccgaaaggacttcgagctgtacaaggtgcgcgagatcaacgacttccaccacgcccacgacgcctacctcaacgccgtggtggcgtccgccctgctgaagaagtaccccaagctcgagcccgagttcgtgtacggcgactacccgaagtacaatagcttccgggaacgcaagtccgccaccgagaaggtctacttctacagcaatatcatgaacatattcaagaagtccatcagcctggccgacgggcgggtgatcgagcgccccctgatcgaggtgaacgaggagaccggcgaatccgtctggaacaaggagagcgacctcgcgacggtgcggcgcgtcctgtcctacccccaggtcaacgtggtgaagaaggtcgaggagcagaaccacgggctggaccgggggaagcccaagggcctcttcaacgccaacctgagctccaagccgaagcccaacagcaacgaaaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgatcgcatcaactaccggaaggacaagctgaacttcctgctcgagaaggggtacaaggacatcgagctgatcatcgagctgccaaagtacagcctcttcgagctgagtgacggctcccgccgcatgctggcgagcatcctctccacgaacaacaagcgcggggagatccacaagggcaaccagatcttcctgagccagaagttcgtgaagctgctctaccacgccaagcggatctccaacaccataaacgagaaccaccggaaatacgttgagaaccacaagaaggagttcgaggagctgttctactacatcctggagttcaacgagaactacgtcggggccaagaagaacgggaagctcctgaacagcgcctttcagtcctggcagaaccacagcatcgacgagctgtgctctagcttcatcggccccacagggtccgagcgcaagggcctcttcgaactgaccagccgggggtccgccgcggacttcgagttcctgggcgtgaagatcccccgctaccgggactacacgcccagctccctcctcaaggacgctaccctgatccaccagagcgtcacggggctctacgagacccgcatcgacctggccaagttgggagagggcaagcggccggccgccacgaagaaggcgggtcaggccaagaagaagaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 8216 - RNA, 3672 nt, synthetic construct
  misc_feature 1..3672: note = Cas9 variant mRNA product
  source 1..3672: mol_type = other RNA
gggagaggcgctgcctacggaggtggcagccatctccttctcggcatcaagcttaccatggcaccgaaaaagaaacgcaaagtgggcatccacggagtaccagccgctgccgccttcaaaccaaacagcataaattatatcctcggcctagatatcggtatcgcctccgtagggtgggccatggtcgagattgatgaagaagaaaacccaatcaggctcatagacctaggcgtacgagtcttcgaacgcgccgaagtcccaaaaacaggagattccctcgctatggcacgaagactagcaagaagcgtgagacgacttacccgccgacgcgcccaccgcctcctccgaactcgtcgcctcctaaagcgcgaaggagtcctccaagccgccaatttcgacgaaaacggtctaatcaaaagcctccccaacacgccatggcaactccgagcagcggccctagaccggaaactaacacccctagaatggtccgctgtcctactgcacctcatcaaacaccgcggatacctaagccagaggaaaaacgaaggagagaccgccgacaaagaactaggcgcgctactgaaaggtgtagcaggcaacgcacatgccctacagacgggtgactttcgaacaccggcagagctcgcacttaacaaattcgaaaaagaatctggacatatccgaaatcaaagatccgactacagccacacattcagccgaaaagatctacaagccgaactcatccttctattcgaaaaacaaaaagagttcggaaatccccacgtatcgggcggactgaaggaagggatcgaaaccctactcatgacacaacggcccgccctatcaggcgatgccgttcagaaaatgctaggccactgcacattcgaaccagccgaaccaaaggcggccaaaaacacctacacagcggaacgcttcatctggttaactaaactgaataacttacgcatactcgaacaaggctctgaacgacccctcacggatacagaacgcgcaaccctaatggacgagccctaccgcaaaagcaaactgacctatgcacaagcgagaaaactcctaggactcgaagacacagccttcttcaaaggtctcaggtacggaaaagataacgccgaggccagcacactcatggaaatgaaagcctaccatgccatcagccgagccctggaaaaagagggcctcaaagataagaaaagccctctcaaccttagccccgaacttcaagatgaaatcggaaccgcatttagcctcttcaaaacagacgaagacatcaccggacgactgaaagaccgcatccaaccagagatactcgaggcgctgctaaaacacatatccttcgacaaattcgtacaaatcagcttaaaggcactacgccggatagtacccctaatggaacaagggaaacgatacgacgaagcatgtgccgaaatatacggtgatcactacggaaagaaaaacactgaagaaaagatctacctcccaccaatacccgccgacgaaataaggaaccccgtagtactacgtgccctctcacaagcacgcaaagtcattaacggagtagtcagaagatatggcagccccgcgcggatccacatcgaaacagcccgcgaagtaggcaaatctttcaaagatcgcaaagaaatcgagaaaagacaagaagagaatagaaaagatcgagagaaagccgccgcaaaattccgagaatatttccccaacttcgtcggtgaaccaaaaagtaaagacatcctcaaactccgcctctatgagcaacagcacggaaaatgcctatacagcggaaaagaaatcaacctcggccggctaaacgagaagggatacgtagaaatagaccacgccctcccattctcgcgaacatgggacgactcttttaataacaaagtcttagtcctcggatcagagaaccaaaacaaaggaaatcaaacgccatacgagtacttcaacggcaaggacaacagcagagaatggcaagagttcaaagcacgagtggaaacctcccgattcccacgctccaagaaacaaagaatcctactccagaaattcgacgaagacgggttcaaagaacgcaacctgaacgatacacggtacgtcaaccgcttcttatgccaattcgtggcggaccgcatgcgcctcacgggaaaaggtaagaaacgggtattcgccagcaacggacagataacgaacctcctccggggattctggggcctccgaaaagtccgggcagaaaacgaccgacaccacgcgctagacgcggttgtcgttgcttgcagcaccgtcgccatgcagcagaaaataaccagatttgtcagatacaaagagatgaacgcctttgacggaaaaactatcgacaaagagacaggcgaagtactacaccaaaagacacacttcccgcaaccatgggagttcttcgcccaagaagtcatgataagggtattcgggaaaccagacggcaaaccagagttcgaagaagcagacaccctagaaaagctccgcaccctactggcagaaaagttgagcagccgccccgaagccgtacacgaatacgtaacaccactcttcgtctcccgagcacccaaccgaaaaatgagcggccaaggccacatggaaaccgtaaaatccgccaagcgcctggacgaaggcgtctccgtactaagagtacccctcacccaactcaagctaaaagacctggagaaaatggttaacagagaaagagaaccaaagctatatgaggccctcaaggcgcgcctcgaggcacacaaagacgacccagcaaaagcattcgctgaacccttctataaatacgataaagccgggaacagaacacaacaggtaaaggccgtccgggtagaacaggtacagaagaccggagtctgggtccgaaaccataatggcatcgcagacaacgcaacaatggtacgcgtcgatgtgttcgaaaaaggcgacaagtactacctagtacccatatacagctggcaggtcgcgaaaggcatcctaccggacagggccgtagtccagggcaaagatgaagaagactggcagctaatcgatgattccttcaactttaaattcagcctacacccaaatgacctcgtagaagtaatcaccaaaaaggcaagaatgttcggatacttcgccagctgccacagaggaaccggaaacatcaacattcggatacacgacctcgatcacaaaataggcaagaatggcatactcgagggcataggggtcaaaaccgcactatccttccagaagtaccaaatcgacgagcttggaaaagaaatccggccctgtcgactgaagaaaaggccaccagttcggaagagaccggccgccaccaaaaaggcaggtcaagccaaaaagaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 8217 - RNA, 4428 nt, synthetic construct
  misc_feature 1..4428: note = Cas9 variant mRNA product
  source 1..4428: mol_type = other RNA
gggagaggcgctgcctacggaggtggcagccatctccttctcggcatcaagcttaccatggcccccaagaagaagcgcaaggtgggcatccacggggtcccggccgcgaagaagccatacaccatcggcctggacatcgggaccaacagcgtgggctgggccgtgctcaccgaccagtacgacctggtcaagcggaagatgaagatcgccggggactccgagaagaagcagatcaagaagaacttctggggcgtgcgcctgttcgacgagggccagaccgccgctgaccggcgcatggcgcggaccgcccgccggcgcattgagcggcgccggaaccgcatcagctacctccagggaatcttcgccgaggagatgtccaagaccgatgccaacttcttctgccggctgagcgactccttctacgttgacaacgagaagcgcaacagccggcaccccttcttcgcgacgatagaggaggaggtcgagtatcacaagaactaccccacaatctaccacctccgcgaggaactcgtgaactccagcgaaaaggccgacctgcgtctagtgtacctcgccctggcccacatcatcaagtaccgcggcaacttcctgatcgagggggccctcgacacccagaacacctccgtcgacggcatctacaagcagttcatccagacgtacaaccaggtgttcgcgtccgggatcgaggacggctcccttaagaagctggaggacaataaggacgtggccaagatcctcgtcgagaaggtgacccggaaggagaagctggagcgcatcttaaagctctacccgggcgagaagtccgccgggatgttcgcccagttcatcagcctaatcgtgggcagcaaggggaacttccagaagcccttcgacctgatcgagaagtccgacatcgagtgcgccaaggactcgtacgaggaggacctcgagtccctgctggcgctcatcggggacgagtacgccgagctgttcgtcgccgccaagaatgcctacagcgcggtggtgctgagtagcatcatcaccgtcgccgagaccgagacgaacgccaagctcagcgcctccatgatcgagcggttcgacacccacgaggaggacctgggcgagctgaaggcattcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaagagaacttcctgcgcaagcagcgcacattcgacaacggggcgattccccaccaactgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgattttggcaagtccgccgtagacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcgtatttcagcggccaggagaaggagcagatcttcaacgacctgttcaagcagaagcggaaggtcaagaagaaggacctcgagctgttcctgcgtaacatgtcccacgtggagagccccacgatcgaggggctggaggactccttcaacagctcctacagcacctaccacgacctcctgaaggtgggcatcaagcaggagatcctggacaaccccgtcaacacagagatgctcgagaatatcgtgaagatcctgacagtgttcgaggacaagcggatgatcaaggagcagctgcagcagttctccgacgttctcgacggcgtggtgctgaagaagctggagcgccggcactacacggggtggggccgcctcagcgccaagctgctgatggggatccgggacaaacagtcccacctcaccatcctggactacctgatgaacgacgacggcctcaatcgcaacctgatgcagctgatcaacgacagcaacctttcattcaagagcatcatcgagaaggagcaggtcaccaccgccgacaaggatatccagagcatcgtggccgacctggcgggatccccggccatcaagaagggcatcctgcagagcctcaagatcgtggacgaactggtctccgtgatgggctacccgccccagacgatcgtggtcgagatggcccgggagaaccagactaccgggaagggcaagaataacagccgcccccggtacaagtccctggagaaggccatcaaggagttcgggagccagatccttaaggagcaccccaccgataatcaggagctgcgcaacaaccgactgtacctctactacctgcagaacggcaaggacatgtacacgggccaggaccttgacatccacaacctctccaactacgacatcgaccatatcgtgccccagagcttcatcaccgacaactccatcgacaacctggtgctgaccagctccgccgggaaccgcgaaaagggcgacgacgtcccgcccctcgagatcgtgcgcaagcgcaaggtgttctgggagaagctgtaccaggggaacctgatgagcaagcgcaagttcgactacctgaccaaggcggagcggggcgggctgaccgaagccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccaactctacaaggtgcgcgacgtcaacgactaccaccacgcccacgacgcctacctgaacggcgttgtggcgaacactctgctcaaggtctacccccagctggagcccgagttcgtgtacggggactaccaccagttcgactggttcaaggccaacaaggcgaccgccaagaagcagttctacaccaacatcatgttgttcttcgcccagaaggaccggatcatcgacgaaaacggtgagatcctctgggataagaagtacctggacaccgtgaagaaggtcatgtcctaccgccagatgaacatcgtgaagaagacggagatccagaagggggagttctcgaaggccaccatcaagcccaagggcaactccagcaagttaatcccccggaagaccaactgggacccgatgaagtacgggggcctcgacagccccaacatggcctacgcggttgtcatcgaatacgccaagggcaagaacaagctggtgttcgagaagaagatcatccgcgtgaccatcatggagcggaaggccttcgagaaggacgagaaggccttcctggaggagcaggggtaccgccagccgaaggtcctcgccaagctgccgaagtacacgctgtacgagtgcgaggagggccggcgccggatgctcgcgtccgcaaacgaggcccagaaggggaaccagcaggtcctgcccaaccacctggtgaccctcctgcaccacgccgcgaactgcgaggtgagcgacggcaagtccctggactacatcgagagcaaccgcgagatgttcgcggaactcctggcccatgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaaattcttcgagaccacgatcgagcgcaagcggtacaacaacctcaaggagctgctgaacagcaccatcatctaccaatccatcaccggcctctacgagtctcgcaagcgcctcgacgacaagcggcccgccgccaccaagaaggcagggcaggcgaagaagaagaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 8218 - RNA, 4461 nt, synthetic construct
  misc_feature 1..4461: note = Cas9 variant mRNA product
  source 1..4461: mol_type = other RNA
gggagaggcgctgcctacggaggtggcagccatctccttctcggcatcaagcttaccatggctcccaagaagaaacgcaaggtgggcatccacggggtcccggcagcgaagaagccctacagcatcggcctggacatcggcaccaattccgtgggttgggccgtggtaaccgacgactacaaggtgcccgccaagaagatgaaggtgctcgggaacacggacaagagccacatcgagaagaacctgctgggcgccctactgttcgactccggcaataccgccgaggatcggcgcctaaagcggaccgcgcgcagacgatacacccggcgccggaaccgcatcctctaccttcaggaaatcttctcagaggagatgggaaaggtcgacgactccttcttccaccggctggaggacagcttcctcgtgacggaagacaagcgaggcgagcggcaccccatcttcgggaacctggaggaggaagtgaagtaccatgagaacttcccgaccatctaccacctccgccagtacctggccgacaatcccgagaaggttgacctgcggctggtgtacctcgccctggcccacatcatcaagttccgcgggcacttcctgattgaggggaagttcgacacgcggaacaacgacgtgcaacgcctctttcaggagttcctggcggtctatgataacacgttcgagaactccagccttcaggagcagaacgtccaggtggaggagatcctcaccgacaagatctctaaaagcgccaagaaggaccgggtgctgaagctgttccccaacgaaaagtccaacggccgcttcgccgagttcctcaagctgatcgtgggcaaccaggccgacttcaagaagcatttcgagctggaggaaaaggccccgctacagttcagtaaggacacctacgaggaggagctggaggtgctgctcgcgcagataggtgataattacgccgagctgttcctgtccgccaaaaagctgtacgacagcatcctgctgtccggcattctaacagtcaccgacgtgggaacgaaggccccgcttagtgcttcaatgatccagcggtataacgaacaccagatggacctggcgcagctaaagcagttcataagacagaagctgagcgacaagtacaacgaagtgttctccgacgtcagcaaggacggctatgccggctacatcgacgggaagaccaaccaggaggccttctacaagtacctgaaggggctcctgaacaagatagaggggagcggctacttcctggacaagatagagcgcgaggacttcctacggaagcagcgtactttcgacaacgggtccataccccaccagatccacctccaggagatgcgggccatcatccgccgtcaggcagagttctaccccttcctcgcggacaaccaggaccgcatcgagaagctgctgaccttcagaatcccctactacgtggggccgctggcccgcggcaagagcgactttgcctggctgtcccgtaagagcgccgacaagataacgccctggaacttcgacgagatcgttgacaaggagagcagcgccgaggcgttcatcaacagaatgaccaactatgacctctacctccccaaccagaaggtcctgcccaagcactccctcctatacgagaagttcaccgtctacaatgagctgaccaaggtgaagtacaaaacggagcaagggaagaccgcgttcttcgacgctaacatgaagcaagagatcttcgacggcgttttcaaagtgtaccggaaggtcactaaagataagctcatggacttcctggagaaggagttcgacgagttccgcatcgtggacctgaccggtctggacaaggaaaacaaggtgtttaacgccagctacggcacgtaccacgacctgtgcaagatactcgataaggacttcttagataactccaagaacgagaagatcctggaggacatcgtcctgaccctcactctgttcgaggaccgggagatgatccgcaagcggctggagaactatagcgacctcctgacaaaggagcaggtcaagaagctggagcgccggcactacactgggtggggtcgcttgtccgcggagctaatccacggcatccggaacaaggagagcaggaagaccatcctagactacttaatcgacgacgggaactccaacaggaacttcatgcagctgatcaacgacgacgccttgtcttttaaggaggaaatcgccaaggcccaggtgatcggcgagaccgacaacctcaaccaagtggtgtccgacatcgccgggtctccggcgatcaagaagggcatcctgcagtccctgaaaatcgtggacgagctcgtcaagatcatgggccaccaacccgagaacatcgtggtggaaatggcccgtgaaaaccagttcaccaatcagggtcgccggaacagccagcagcgactgaagggcctgacggactccatcaaggagttcgggagccagatcctcaaagaacacccagtcgagaacagccaactgcagaatgaccgactgttcctctactacctgcaaaacgggcgcgacatgtacaccggggaggagctggacatcgactacctctcccagtacgatatcgaccacataatcccccaagccttcatcaaagacaacagcatcgataaccgggtgctgacctccagcaaagagaacaggggcaagtccgatgacgtacccagcaaggacgtcgtgcggaagatgaagtcctactggagcaagctgctctccgccaagctgatcacccagcgcaagttcgacaacttgacgaaggctgagcggggcgggctcaccgacgacgacaaggcgggcttcatcaagcgccagcttgtggagacccggcagatcaccaagcacgttgcccggatcctggacgagcggttcaacaccgagacggacgagaacaataagaaaatccgccaggtgaagatcgtgaccctcaagagcaacctggtctccaacttccggaaggagttcgaactgtacaaggtccgagagataaatgactaccaccacgcccacgacgcctacctcaacgccgtgatcgggaaggcgctgctgggcgtctacccccagctcgagcccgagttcgtttacggggactacccccacttccacggccacaaggagaacaaggccaccgccaagaagttcttctacagcaacatcatgaactttttcaagaaggacgatgtgcggactgacaagaacggcgagatcatctggaagaaagacgaacacataagtaacatcaagaaggtcctgagctacccccaggtgaacatcgttaaaaaggtcgaggagcagaccggaggcttctccaaagagtcgatcctccccaaggggaactccgacaaacttatcccccgcaagacgaagaagttctactgggacaccaagaagtacggcgggttcgacagccccatagtggcctacagcatcctggtgatcgcagacatcgagaagggcaagtccaagaaactgaagaccgtcaaggcactcgtgggcgtaacgataatggaaaagatgaccttcgagcgggacccggtcgccttcttggagcgcaaggggtatcgcaatgtgcaggaggagaacatcatcaagctgcccaagtatagcctcttcaagctcgagaacgggcggaagcgcctgctagcctccgccagggagctgcagaaggggaacgaaatcgtgctgcccaaccaccttggaaccctgttataccacgcgaagaacatccacaaggtcgatgagccgaagcatctcgactacgtggacaaacacaaggatgagtttaaggaactgctggacgtggtctcaaacttctccaagaagtacaccctcgccgagggtaatctagagaagatcaaggagctgtatgcccagaacaacggcgaggacctcaaggagctcgctagcagtttcatcaaccttctcactttcacggccatcggggcgcccgccaccttcaagttcttcgataagaacatcgaccgcaagcggtacaccagcacgaccgagatcctgaacgccacgcttatccaccagtccataaccggactctacgagacgcgcatcgacctgaacaagctgggcggggacaagcggcccgccgccaccaagaaggcgggccaagccaaaaagaagaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 8219 - RNA, 3594 nt, synthetic construct
  misc_feature 1..3594: note = Cas9 variant mRNA product
  source 1..3594: mol_type = other RNA
gggagaggcgctgcctacggaggtggcagccatctccttctcggcatcaagcttaccatggcacctaaaaagaaacggaaagtgggcatacacggcgttccagccgcacaaacaaccaacctcagttacatactaggtctagacctcggtatcgcatcagtcggctgggccgtcgtcgaaatcaacgaaaacgaagaccccatcggactaatagacgtcggcgtaaggatattcgaacgcgccgaagtcccaaaaaccggagaaagcctagcactgtccaggagactcgcgcggagtacccgccgcctaatacgccgccgagcccaccgcctactcctcgcgaaacgcttcctcaagagagaaggcatactgagcaccatagacctcgagaaaggcctgccaaaccaggcctgggagctaagagtcgccggcctcgaaaggcgactatcggccatcgaatggggagccgttctcctgcacctaataaaacacagggggtacctatcgaaaagaaagaacgagagtcaaacgaacaacaaggagctgggcgccctgctaagcggagtggcgcaaaaccaccagctcctacaatccgacgactaccgaacacccgcagaattagccctcaagaaatttgcaaaagaagaggggcacataagaaaccaacgcggcgcttacacacacaccttcaatagattagacctcttagcagaactgaacctgctattcgcacaacagcatcaattcggaaacccacactgtaaagagcacatccagcaatacatgactgaactcctaatgtggcagaaacccgcactcagtggcgaggccatcctaaaaatgctcggaaaatgcacacacgagaaaaacgagttcaaagccgcgaaacatacctacagcgccgaacgttttgtttggctcaccaaactcaataaccttcgaatactcgaagacggggccgaacgggcactaaacgaagaagaaagacaactactaatcaaccacccgtacgaaaagagcaaactaacatacgcgcaggtacgaaaattactaggcctctccgaacaagctattttcaagcacctacgctacagtaaagaaaacgcagagtcagccaccttcatggagctcaaagcctggcacgccatacgaaaagcactcgaaaaccagggcctgaaggacacctggcaggacctcgccaagaaacccgatctcctcgacgaaatcggaaccgccttctcactctacaaaacagatgaagacatccaacaatacctaacgaacaaagtacccaacagcgtaataaacgcactactcgtatccctgaacttcgataagttcatcgaactcagcctgaaaagcctgagaaaaatacttcctctaatggaacaaggcaaacgctacgatcaggcctgccgcgagatctacggacatcactacggggaggccaaccaaaagacgtcacaactcctgcccgccattccagcccaagaaatacgcaaccccgtagtcctgcgaacgctgtcccaagcaagaaaagtaataaacgccatcatacgacaatacggctcccccgcccgagtccacatagaaacgggtcgagaactagggaaatccttcaaagaacgacgcgaaatccaaaaacagcaggaggataatcgaaccaaacgcgagtcagcggttcaaaagttcaaggaactcttctccgacttcagcagcgaaccaaaatctaaagacatactcaagttccgcctttacgagcaacaacacggtaaatgcctatactcgggcaaagaaatcaacatacacaggctgaacgaaaaaggatacgtcgagatcgaccacgcactacccttcagtcggacctgggacgactcattcaacaataaagtacttgtcctagcaagcgagaaccaaaacaaaggcaaccagacaccatacgagtggctacaagggaaaataaactccgaacgctggaaaaacttcgtcgcactggtactcggcagccagtgctcagccgcgaagaaacaacgcctcttgacccaggtcattgacgacaacaaatttatcgaccgcaaccttaacgacactcgatacatcgcacgcttcctatcaaactacatccaggaaaacctcctactcgtcggcaaaaacaaaaagaacgtattcacgccaaacggccaaatcacagccctgctccggtcgcgatggggactaatcaaagctcgagaaaacaacaaccgacaccatgccctagatgcgatcgtggtcgcttgcgcgaccccctcaatgcaacagaaaataacccgcttcatccgatttaaagaagtccacccctacaaaatagaaaaccgatacgaaatggtcgaccaagagagtggagaaattataagcccccacttccccgagccatgggcatacttcaggcaagaggtaaacatccgagtattcgacaaccaccccgacacggtgctaaaagagatgctcccggaccggccacaggcaaaccaccaattcgtacaacctctattcgtctcccgagcgcccaccagaaaaatgtccggccaaggccacatggaaaccatcaagtccgccaaacggctggcagaaggcatctccgtactccgaatacccctaactcaactcaaacccaatctcctggaaaacatggtaaataaggagcgcgaacccgccctgtacgcaggccttaaagcccgactcgccgagttcaaccaggaccccgcaaaagccttcgccacaccattctacaaacaaggcggccagcaggtaaaagcaatccgagtagagcaagtacaaaaatcaggagtcctagtacgcgaaaacaacggagtcgccgacaatgcctcaatcgtacgaaccgacgtattcatcaaaaacaacaaattctttctcgtccccatctacacgtggcaagtagcaaagggaatcctaccaaacaaggcaatcgtcgcacacaaaaatgaagacgaatgggaagaaatggacgaaggtgccaaattcaagttctctctcttccccaacgaccttgtcgaactaaaaaccaagaaagaatacttcttcggctactacatcggactggaccgggcaacagggaacataagcctaaaagagcacgacggcgaaatctccaaaggcaaagacggagtctacagggtaggcgtcaaacttgcactgagctttgaaaaataccaagtagatgagcttgggaaaaaccgacaaatctgccgaccccaacaaagacaacctgtcagaaagagaccagccgcaactaaaaaggcaggacaagccaagaaaaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 8220 - RNA, 3672 nt, synthetic construct
  misc_feature 1..3672: note = Cas9 variant mRNA product
  source 1..3672: mol_type = other RNA
gggagaggcgctgcctacggaggtggcagccatctccttctcggcatcaagcttaccatggcacccaaaaagaaacgcaaagtcggaatccacggagtaccagcagcagccgcctttaaaccaaacccaatcaactacatactcggattagacatagggatagcatcagtcggatgggccatggtcgagatcgacgaggacgaaaaccccatatgcctcatagacctgggggttagggttttcgagcgtgcagaggttccaaaaacaggcgacagcctagcaatggcacgtagactagcgcgctctgtccgcagactcacgagacgacgggcccacagactgctaagagcccgccgcctgctcaaaagagaaggagtcctacaagccgccgactttgacgaaaacggactcataaaaagcctccccaacacaccctggcaacttcgggcggccgccttagaccgaaaactcacacccctcgagtggtccgccgtgctactgcacctgatcaaacatcgaggatacctcagccaacgcaaaaacgagggagaaacggcagacaaagagctcggcgcactgcttaaaggcgtagcggacaacgcacacgcactacagacgggggacttccgcacgccagccgagctcgcactcaacaaattcgagaaagaaagcggtcacatccgaaaccagcgcggagactactcccacacattctcccgaaaagacctgcaagccgaactcatcctactattcgaaaaacagaaagagttcggcaacccacacgtatcaggcggtctaaaagaaggtatagaaacactcctcatgacccaaagaccggccctgtcaggagacgcagtccagaaaatgctcgggcattgcacattcgaaccagcagagcccaaggcagctaaaaacacatacaccgcagaacgattcatctggctgaccaagctcaacaacctcagaatattagaacaagggtctgaacgccccctgactgacacggaacgcgcaacactcatggacgaaccgtaccgcaaaagcaaactcacctacgcacaagcccgtaaactactgggcctcgaagacacagctttcttcaagggtctgcgatacggaaaagacaacgcagaagcatcaacattaatggaaatgaaggcttaccatgccatcagccgagccctagaaaaggaaggcctaaaagataagaaaagtcccctaaacctgtcgcccgagctacaagatgaaatcggcacagccttctcgctttttaaaaccgacgaggacatcacagggcgactcaaagaccgaatacaacccgagattctggaggcgctcctcaaacacatatcattcgacaaattcgtccaaatatccctcaaagcactacgcagaatcgttcctctcatggaacaaggcaaacgctacgatgaagcctgcgcagaaatatatggagaccattacgggaaaaagaacaccgaagagaaaatctatctgcccccgatcccagcggacgaaatacggaatcccgtcgttctgcgagcgctatcccaagcgagaaaagtaatcaacggggtcgtcagacgctacggcagtcccgcaagaatacacatagaaaccgcccgagaggtcggcaaatccttcaaagaccgcaaagagatcgaaaaacgccaagaagaaaatcgcaaggaccgagaaaaagcggcagcgaaattcagagaatacttcccaaacttcgtcggggaacccaaatccaaagatatcctaaaactccgcctatatgaacaacagcatggcaaatgcctctacagcggtaaggaaatcaacttaggaagactgaacgaaaaaggctacgtggaaatagaccacgcgctcccattcagccgcacttgggacgactcattcaacaacaaagtgctggtcctcggctcagagaaccagaataaagggaatcaaaccccctacgaatacttcaacggcaaagacaacagccgcgaatggcaagagttcaaggcacgagtggagacctcgcgcttccccagaagcaagaaacagcgaatactcctacagaaattcgacgaagatggcttcaaagaaaggaacctaaatgacacacgctacgtaaaccgctttctttgccaattcgtagcagaccggatgcggctcactggaaagggcaaaaagagagtcttcgcatccaacggacaaatcactaacctgctgaggggattctggggattacgcaaagtccgggcagagaacgaccgacaccatgcgctcgacgccgtagtcgtagcatgcagcaccgtagccatgcaacagaaaatcacgcgcttcgtgagatacaaggaaatgaacgcattcgacggaaagaccatcgacaaagagaccggagaagtcctacaccagaagacccatttcccccaaccctgggagttcttcgcccaggaagtcatgatacgcgtcttcggcaaacccgacggaaagccagagttcgaagaagcggacacgccagaaaaactaagaacgctgctcgccgagaaacttagctccagacctgaagcagtacatgaatatgtaaccccactcttcgtaagccgagccccgaaccgcaaaatgtccggccaggggcacatggaaacagtaaaatcagccaaacgcctagacgagggcgtgagcgtactaagggtaccgcttacacaactcaagctaaaagacctagagaaaatggtcaaccgcgagcgcgaaccaaagctctacgaggcccttaaggctcggctagaggcacacaaagacgacccagccaaagccttcgcggaaccgttttacaaatacgacaaggccggcaatcggactcaacaagtcaaagccgtaagagtagagcaggtccagaaaacaggcgtctgggtacgtaaccacaacggcatagcagacaacgccactatggtacgcgtcgacgtgttcgaaaaaggcgacaaatattatctagtgcccatatacagctggcaagtcgcaaaaggaatcctaccagaccgcgcggtggtccaaggaaaggacgaagaagactggcaactcatcgacgacagcttcaacttcaaattcagcctacaccccaacgacctagtcgaagtcatcacaaagaaggcccggatgttcgggtacttcgcctcctgccaccgcggcaccggtaacataaacataaggatccatgacctcgaccacaaaataggcaaaaacggaatattagaaggcatcggggtaaaaacagcccttagcttccaaaaataccaaatagacgagctaggaaaagaaataaggccctgccgactcaaaaagagaccaccagtgcgcaaaaggcccgcagcaacgaagaaagccggccaagccaaaaagaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 8221 - RNA, 3678 nt, synthetic construct
  misc_feature 1..3678: note = Cas9 variant mRNA product
  source 1..3678: mol_type = other RNA
gggagaggcgctgcctacggaggtggcagccatctccttctcggcatcaagcttaccatggcaccgaagaagaaaaggaaagtcggcattcacggagtcccagccgcaaaataccatgtaggcatagacgtaggaacattcagcgtagggctcgcggcaatagaggtagacgacgcaggtatgcccatcaaaaccctaagccttgtgtcacacatccacgacagcggcctcgatccagatgaaatcaaatcggcggtcacgcgactagcaagcagcggtatcgccagacgaacgcgcagactgtaccgaaggaaaaggagaagactccagcaactggacaaattcatacaacggcaaggatggccagtgatagaattagaggactacagcgacccactatacccctggaaagtaagagccgagctcgcagcaagttacattgcggatgagaaagaacgaggcgagaaattgagcgtggcactgagacatatcgccagacacagaggatggcgcaacccatacgcaaaagtaagcagcctatacctcccagacgggccgtccgacgcattcaaagcgatcagagaagagataaagagggcgagtgggcaaccagtgccagaaacagccacggtgggacaaatggtgaccctatgcgaactaggcacgctgaagctaagaggagaaggcggagtcctgagtgcacggttgcagcaaagcgactacgcccgcgaaatacaagaaatatgccgcatgcaagaaatagggcaagaactctacagaaaaataatcgacgtagtattcgcagctgaaagcccaaaggggagcgccagcagccgagtaggaaaagaccccttacaacccgggaaaaaccgcgcgctaaaggccagcgacgcattccaacgatacaggatagcagccttaataggaaacctaagagtccgagtagatggagagaaacgcatcctcagcgtagaggagaagaacctcgtgttcgaccatctggtcaatctaaccccaaagaaagaaccagaatgggtaacgatcgcagaaatactgggcatagacagagggcagctaataggaaccgccacgatgacggacgacggagaacgcgcgggagcccgaccacctacgcacgacacgaacagatccatcgtgaacagccgaatagccccgctagtcgactggtggaaaacagcgagcgccctcgaacaacatgcaatggtcaaggctctaagcaacgcggaagtagacgacttcgactcaccagagggagcaaaagtccaagcattcttcgccgacctagacgacgacgtccacgcaaaactcgactcccttcatctgccagtcggacgagcggcgtacagcgaagacaccctagtacgattaacacgacgcatgctaagcgacggagtagatctgtacaccgcaagactacaggagttcggcattgaaccaagctggacgccaccaacccccaggatcggagaaccagttggtaacccagctgtagaccgagtactaaaaacagtcagtcgatggcttgaaagtgcgaccaagacttggggagcaccagaacgggtcataatagaacacgtaagggagggatttgtaacagaaaaacgggcgcgagaaatggacggggacatgcgtagacgagcagcaaggaacgcaaaactgttccaggaaatgcaggagaaactaaacgtacaaggaaaaccctctagagcagatctctggcggtaccagagcgtccaaagacaaaactgccaatgcgcatactgcggcagcccaatcacgttcagcaactcagaaatggaccacatcgtgccaagggctgggcagggatccaccaacacgcgcgagaacctagtggcggtgtgccacaggtgtaaccaaagcaaaggaaacaccccgttcgcgatatgggcgaaaaacacctccatagagggcgtaagcgtaaaggaagctgtggaaagaacacgacactgggtcacggacacaggaatgcgctcaaccgactttaagaaatttacaaaggctgtcgtcgagaggttccaaagagcaacgatggacgaagagatagacgcaaggagcatggaatcggtcgcatggatggcaaacgaattgcgcagtcgggtagcacagcacttcgctagccacggaacaacggtacgagtctaccgcggaagcctcacagcggaagcacggagggccagcggcataagcggcaaactaaagttcttcgacggagtcgggaaatctcgcctagaccgcagacaccatgccatagacgcggccgtgatcgcattcacaagtgactacgtggccgagaccctagcagtacgaagcaatttgaagcaaagccaagcgcacagacaggaagccccgcaatggcgagagttcacaggaaaagacgcagaacacagagcggcatggagggtatggtgccagaaaatggaaaaactaagcgcattgctcaccgaagacctcagggacgacagagtcgtcgttatgagcaacgtgcggctacgcctcggcaacggctcggcccacaaagaaacaataggaaaactcagcaaggtcaaactaagctcacaactgtccgtatccgacatagacaaagcgtcgagcgaagcactctggtgcgcgctaacgcgagaacccggatttgaccccaaggaaggcctccctgcaaacccagaacggcacatacgagtaaacggtacacacgtgtatgctggtgacaacatcggattattcccagtctcagcaggaagtattgcgctgcggggaggatacgcagaactcggctcaagttttcaccacgcaagggtatataaaataacaagcgggaagaaaccagcattcgctatgttgagagtatacacgatagacctgctcccctaccgcaaccaagacctattcagcgttgaactaaaaccacaaacaatgtcaatgaggcaagccgaaaagaaactgcgagacgccctcgccaccgggaacgccgaatacctcggctggttagtcgtcgacgacgagctcgtagtagacaccagcaaaatagcaacggaccaagtaaaagcagtcgaagcggagctaggaacgataagacgatggagggtagatggatttttcagcccaagcaaactacgcctaagaccgcttcaaatgtcaaaagaaggcatcaaaaaggaaagcgcaccagagctgagcaagataatcgacagacccggctggctaccagcagttaataaactcttcagcgacggcaacgtcacagtcgtgcgaagggactcgttggggcgggtacggctagaaagcacagcgcacctacccgtcacatggaaggtacaaaagagaccagccgcgacgaagaaggcaggccaggcgaagaaaaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 8222 - RNA, 3378 nt, synthetic construct
  misc_feature 1..3378: note = Cas9 variant mRNA product
  source 1..3378: mol_type = other RNA
gggagaggcgctgcctacggaggtggcagccatctccttctcggcatcaagcttaccatggcccccaagaagaaacgcaaggtgggcatccacggggtcccggccgcggcccggatactggccttcgacatcggcatcagctccatagggtgggccttcagcgagaacgacgagctcaaggactgcggcgtgcgcatcttcactaaggtggagaaccccaagacaggagagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgatgagagcctcgccaaggcctacaaaggctccctgatcagcccctacgagctgcggttccgcgcactcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacttgtacaaggagtacttccagaaattcaaggagaacagcaaggagttcacgaacgtgcgcaacaagaaggagtcctacgagcggtgcatcgcccagagcttcctgaaggacgagctgaagctcatctttaaaaagcagcgcgagttcgggttctccttcagcaagaagttcgaagaggaggtcctttccgtggcgttctacaagcgggctctgaaggacttcagccacctcgtgggcaactgctccttcttcaccgacgagaagcgcgccccgaagaacagccccctggccttcatgtttgtcgccctgacccggatcatcaatctcctgaacaacctgaagaacaccgagggcatcctctacacgaaggacgacctgaacgcgctgcttaacgaggtgctgaagaacggcaccctgacctacaagcagaccaagaagctcctggggctgagcgacgactacgagttcaaaggggaaaagggcacgtacttcatcgagttcaagaagtacaaggagttcattaaggccctcggggagcacaacctgtcccaggacgacctgaacgagatcgccaaagacatcaccctcatcaaggacgagatcaagctgaagaaggccctggccaagtacgacctcaaccagaaccagatcgacagcttatccaaacttgagttcaaggaccacctcaacatcagcttcaaggcgctaaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgtgcgatcaaggagtaccgcaaggtgctgaacgccctcctgaagaagtacggcaaggtgcacaaaatcaacatcgagctggcgcgggaggtcgggaagaaccactcccagcgcgccaagatcgagaaggagcagaacgagaactacaaggccaagaaagacgcggagctcgagtgtgagaagctgggcctgaagatcaacagcaagaacatcctcaagctgcggctgttcaaggagcagaaggagttctgtgcctactccggggagaaaatcaagatcagcgacctccaggacgagaagatgttagagatcgaccacatctacccatactcccgcagcttcgacgactcctacatgaacaaggtgctggtgttcaccaagcagaaccaggagaagctcaaccagacccccttcgaggccttcggcaacgacagcgcgaagtggcagaagatcgaggtcctggcaaagaacctacccaccaagaagcagaagcggatcctcgacaagaactacaaggacaaggagcagaagaacttcaaggaccgcaacctgaacgacacacggtacatagctcgcctggtgctcaactacaccaaggactacctggacttcctgccgctctccgacgacgagaacaccaagctgaacgacacccagaaggggagcaaggtgcacgtcgaggccaagtccggcatgctgacgagcgctctccggcacacctggggcttctccgccaaggaccgcaacaaccacctccaccacgccatcgatgcggtgataatcgcctacgccaacaacagcatcgtcaaggccttctccgacttcaaaaaggagcaggagagcaacagcgcggagctgtacgccaagaagatctccgagctggactacaagaacaagcggaagttcttcgagcccttcagcggtttccgccagaaggtgctggacaagatcgacgagatcttcgtgtccaaacccgagcggaagaagcccagcggtgccctgcacgaggagaccttccgtaaagaggaggagttctaccagtcctacgggggcaaggagggggtcctcaaggcgctggagctgggcaagatccggaaggtgaacgggaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttttgcttctccctctacaaggacagcctgatcctgatccagaccaaggacatgcaagagcccgagttcgtgtactacaacgccttcacctcctcaaccgtgtccctcatagttagcaagcacgacaacaagttcgagacgctgtccaagaaccagaagatcctgttcaaaaacgcaaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 8223 - RNA, 3789 nt, synthetic construct
  misc_feature 1..3789: note = Cas9 variant mRNA product
  source 1..3789: mol_type = other RNA
gggagaggcgctgcctacggaggtggcagccatctccttctcggcatcaagcttaccatggcccccaagaagaagcgcaaggtgggcatccacggggtcccggccgcgtcggacctagttctcggcctggacatcgggattggctccgtgggggtcgggatcctgaacaaggtgaccggcgagatcatccacaagaacagccggatcttccccgccgcccaggccgagaacaacctagtgcgccggacgaaccgccagggccggcgcctggcccggcgcaagaagcaccggcgcgtccggctgaaccgcctcttcgaggagtccggcctgatcacggacttcaccaagatcagcataaacctgaacccctaccagttacgggtgaaggggctgaccgacgaactgtccaacgaggagctgttcatcgcgctgaagaatatggtgaagcaccgcggcatcagctacctggatgacgcctccgacgacgggaacagctccgtcggcgattacgcccagatcgtgaaggagaatagcaagcagctcgagaccaagacgcccggacagatccagctggagcggtaccagacctacgggcagctgcgcggcgatttcaccgtggagaaagacgggaagaagcaccgactcatcaacgtcttcccgacctccgcctaccgaagcgaggcgctgcggatcctgcaaactcagcaggagttcaacccccagatcaccgatgagttcatcaaccgctacctcgagatcctgaccggcaagcggaagtactaccacggccccgggaacgagaagtcccgcaccgactacggccgctatcggacgagcggggagaccctggacaacatcttcggcatcctcatcgggaagtgcaccttctaccccgacgagttccgcgccgccaaggcctcctacaccgcccaggagttcaaccttttaaatgacctcaacaacctgacggtgccgaccgaaaccaagaagctcagcaaggagcagaagaaccagatcatcaactacgtgaagaacgagaaggctatgggccccgccaagctgttcaagtacatcgccaagctcctgtcctgcgacgtcgccgacatcaagggctaccggatcgacaagagcgggaaggccgagatccataccttcgaggcgtaccgcaagatgaagacgctcgagaccctggacatcgagcagatggacagagagaccctggacaagctcgcctacgtactgaccctgaacacggagcgcgagggcatccaggaggccctcgagcacgagttcgccgacgggtccttcagccagaagcaggtcgacgagctggtgcagttccggaaggccaacagctccatcttcggcaaagggtggcacaactttagcgtgaagctgatgatggagctcatccccgagctgtacgagaccagcgaggagcagatgaccatcctgacccgcctcggcaagcagaagacaaccagctccagcaacaagactaagtacattgacgagaagctgctgaccgaggaaatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgcctcacagcgtgttccacggccacaagcagctggccaccaagatccggctgtggcaccagcagggcgagcgctgcctctataccggcaagaccatctccatccacgacctgatcaacaacagcaaccagttcgaggtcgaccacatcctgcccctctccatcacgttcgacgacagcctggccaacaaagtgctggtgtacgcgaccgccaaccaggagaaggggcagcggacgccctaccaggccctggactccatggacgacgcctggtcgttccgcgagctgaaggccttcgtccgggagtccaagaccctgagcaacaagaagaaggagtacctcttgaccgaggaggacatctccaagttcgacgtgcgcaagaagttcatcgagcggaacctcgtggacacgcgctacgcgagccgggtcgtgctcaacgccctgcaggagcacttccgcgcccataaaatcgacaccaaggtgtccgtggtgcgcggccagttcaccagccagttaagacgccactggggcatcgagaagacccgggacacgtaccaccaccatgcagtggacgccctcatcatcgcggcctcctcccagctgaacctgtggaagaagcagaagaacaccctcgtcagctactccgaggaccagctgctggacatcgagaccggggagctcatcagcgacgacgagtacaaggagtccgtgttcaaggccccctaccaacatttcgtggacaccttaaagagcaaggagttcgaggattccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctcgagaactaccccaacaagcagatcaacgagaagggcaaggaggttccctgcaacccgttcctcaagtacaaggaggagcacgggtacatccggaaatacagcaagaagggcaacgggcccgagatcaagtccctgaagtactacgacagcaagctgggcaaccacatcgacattacccccaaagactccaacaacaaggtggtcctccagagtgtgtccccctggcgcgccgacgtgtacttcaacaagaccaccgggaagtacgagatcttgggcctgaaatacgcggacctccagttcgagaagggcacggggacctacaagatcagccaggagaagtacaacgacatcaagaagaaagagggcgtcgacagcgactccgagttcaagttcaccctgtacaagaacgacctgctcctggtgaaggacaccgagacgaaggagcagcagctgttccggttcctcagccgcaccatgccaaagcagaagcactacgtggagctaaagccctacgacaagcagaagttcgagggcggagaggccctgatcaaggtcctcgggaacgtggccaactccggccagtgcaagaagggactgggcaagagcaacatctccatctacaaggtgcggaccgacgtcctggggaaccaacacatcattaagaacgagggggacaaacccaagctcgacttcaagcgccccgccgccaccaagaaggcgggccaggccaagaagaagaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 8224 - RNA, 4347 nt, synthetic construct
  misc_feature 1..4347: note = Cpf1 variant mRNA product
  source 1..4347: mol_type = other RNA
gggagaggcgctgcctacggaggtggcagccatctccttctcggcatcaagcttaccatggcccccaagaagaagcgcaaggtgggaatccacggcgtcccggccgcgacccagttcgagggcttcaccaacctgtaccaggtgagcaagacgctccggttcgagctgatcccccaggggaagaccctgaaacacatccaggagcagggcttcatcgaggaggacaaggcccgcaacgaccactacaaggaactcaaacccatcatcgaccggatctataagacctacgccgaccagtgcttgcagctggtgcagctcgactgggagaatctgtccgccgccatcgacagctaccgcaaggagaagaccgaggagacccgtaacgcgcttatcgaggagcaggccacctaccgcaacgctattcatgactacttcatcgggcggaccgataacctcaccgacgccataaacaagcgccacgctgaaatctacaagggcctcttcaaggccgagctattcaacggcaaggtactaaagcagttagggacggtgaccaccaccgagcacgagaatgccctactccggtccttcgacaaattcacgacctacttctcaggcttctacgaaaaccgcaagaacgtgttcagcgcagaggacatcagcaccgcaatcccccaccggatcgtccaggacaatttcccgaagtttaaggagaactgccatatcttcacccgtctgatcacggcggtgccgtccctgcgggaacacttcgaaaacgtgaagaaggccatcggaatttttgtcagcacctccatcgaggaggtgttcagtttccccttctacaaccagttgctgacccagacccagatcgacctgtacaaccagctcttgggcgggatctctcgcgaggccggcacggagaagataaagggcttaaatgaggtgctcaacctggccatacagaagaacgacgagacagcccacatcatagcgagcctgccccaccggttcatcccgttattcaaacagatcctgtctgaccgtaacacccttagcttcatcctcgaggagttcaagagtgacgaagaggtcatccagtcgttctgcaaatacaagacccttctgcggaacgagaatgtgctcgagacggccgaggcccttttcaacgaactgaactccatcgacctcacccacatcttcatcagccacaagaaactcgagaccatcagcagcgccctgtgcgaccactgggacaccctccgcaacgccctgtacgagcggcgcatcagtgagctgacgggcaagatcaccaagtccgcgaaggagaaggtgcagcggagcctcaagcatgaagacatcaacctgcaggagatcatctccgccgccggcaaggagctgagtgaggccttcaagcaaaagacctcagaaatcctatcccacgctcatgcggccctggaccagccgttgcccaccacgctcaagaagcaagaagagaaggagatcctgaaatcccagttagacagcctgctcgggctgtaccacctcctcgactggttcgcagtcgacgaatccaacgaggtggaccccgagtttagcgcccgcctgaccggcattaaactggagatggagccgtccctcagcttctacaacaaggcgcgcaactacgccaccaagaagccctactccgtggagaagttcaagctgaacttccagatgcccacgctggccagcggctgggatgtaaacaaggagaagaacaatggggccatactcttcgtgaagaacggcctgtactacctggggatcatgcctaagcaaaagggccggtacaaggccttatccttcgagcccacggagaagaccagcgaagggttcgacaagatgtactacgactacttccccgacgcggccaaaatgatccccaagtgctccacacagctgaaagcagtgaccgcccacttccagacccacacgaccccgattctgttgagtaacaacttcatcgagccgctggagatcaccaaagagatctacgatctgaacaaccccgagaaggagcccaaaaagttccagaccgcctatgcgaaaaagacgggagaccagaaaggctaccgcgaggccctgtgcaagtggatcgacttcacccgggatttcctatccaagtacaccaagaccacgagcatcgacctgagttcactccggccaagctcccagtacaaagatctgggggagtactacgccgagctgaatccgctcctgtatcacatctcattccaacggatcgccgagaaagagatcatggacgccgtagagacgggcaagctctacctcttccagatctacaacaaggacttcgcgaagggacaccacggcaagcctaacctgcacacattgtactggaccggcctcttctcccccgagaacctcgccaagacgagcatcaagctgaacgggcaggccgagctgttctacaggcccaagagccggatgaagcgcatggcccacaggctgggtgagaagatgctgaacaagaagctaaaggaccagaagaccccgatccccgacaccctgtaccaagagctgtatgactacgtgaaccatcgcttaagccacgacctctccgacgaggcgcgtgccttactccccaacgtgatcaccaaggaggtcagccatgagatcatcaaggaccgcagattcacgtccgacaagttcttcttccacgtgccgatcacactgaactaccaggccgctaacagcccctccaagttcaaccagcgcgtcaacgcctacctaaaggagcaccccgagacgcccatcattgggatagaccggggcgagcgcaacctgatctatatcaccgtgatcgacagcacggggaagatcctggagcaacgatccctgaacaccatccagcagttcgactaccagaagaaactcgacaaccgcgaaaaagagcgggtggcggcacgccaggcctggagcgtcgtgggcaccatcaaggacctgaagcaggggtacctgagccaggtgatccacgagatcgtcgacctcatgattcactaccaggccgtcgtggtcctggagaacttaaacttcggcttcaaatcgaaacgcaccggcatcgccgagaaagcggtgtaccagcagttcgagaagatgctcattgacaagttaaactgcctggtgctaaaagattacccggccgagaaggtcggaggcgtgctgaacccctaccagttgacggaccagttcaccagcttcgccaagatgggcacccagtctggcttcctcttctacgtgcccgccccctacaccagcaagatcgacccgctgacggggttcgtagaccccttcgtttggaagaccatcaagaaccatgagagtcggaagcacttccttgaggggtttgacttcctccactatgatgtgaagactggcgatttcatcctgcacttcaagatgaaccgcaacctgagcttccagcgggggctccccggtttcatgcccgcctgggacatcgtcttcgagaagaatgagacccagttcgacgcgaaggggacgcccttcatcgccggcaagcgcatagtccctgtgatcgagaaccaccggttcaccggccgctaccgggatctgtaccccgcaaacgagctgatcgccctcctggaggagaaggggatcgtctttcgagacggctccaacatcctgcccaagttgttagagaatgacgacagccacgcaatcgacaccatggtggccctgattcggtccgtgctccagatgcgcaacagcaacgcggccaccggggaggactacatcaactccccggtccgggacctgaacggcgtgtgctttgatagccgcttccagaaccccgagtggcccatggacgccgacgcgaacggggcctaccatatcgccctgaagggacaactcttgctgaaccacctcaaggagtctaaggacctcaagctgcaaaacggtatcagcaaccaggactggctcgcctatatacaagagctgcggaacaagcgccccgccgcgactaaaaaggctgggcaggccaagaagaagaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 8225 - RNA, 4326 nt, synthetic construct; identical to SEQ ID NO: 2425
  misc_feature 1..4326: note = Cpf1 variant mRNA product
  source 1..4326: mol_type = other RNA

SEQ ID NO: 8226 - RNA, 4582 nt, synthetic construct
  misc_feature 1..4582: note = Cas9 variant mRNA product
  source 1..4582: mol_type = other RNA
ggggcgctgcctacggaggtggcagccatctccttctcggcatcaagcttaccatggcccccaagaagaagcgcaaagtgggaatccacggggtgccggcggcggacaagaagtacagcatcggcctggacatcgggaccaactcagtgggctgggccgtaatcaccgacgaatacaaagtccccagcaagaagttcaaggtgctggggaacacggaccggcattccatcaagaagaacctgatcggtgccctgctgttcgactcgggcgagaccgccgaggccacccgcctgaagcgaaccgcgcgccggcgctacacgcggcgcaagaaccggatctgttacctgcaggagatcttctccaacgagatggccaaggtggacgacagcttcttccaccgcctcgaggagtccttcctggtcgaggaggacaagaagcacgagcggcaccccattttcgggaacattgtggacgaagtggcctaccacgagaagtaccccaccatctaccaccttcgcaagaagctcgtcgacagcaccgacaaggccgacctgcggctgatttacctcgcgctggcccacatgatcaagttccgcggccacttcctgatcgagggggacctcaacccggacaactccgacgtggacaagctgttcatccaactggtgcagacctacaaccagctgttcgaggagaaccccatcaacgccagcggcgtcgacgccaaagccatcctgtccgcgagacttagcaagagtcgcaggctcgagaacctgatcgcccagcttcccggggagaagaagaacggcctattcggcaacctgattgccctgagcctcggactgacacccaacttcaagtccaacttcgatctggccgaggatgccaaactccagttgagtaaggacacctacgacgacgacctggacaacctcctggcgcagatcggcgaccagtacgccgacctgttcctcgccgccaagaacctgtctgacgccatcctgctcagcgacatcctgcgcgtgaacaccgaaatcaccaaggcgccgctgtccgcctcaatgatcaagcggtacgacgagcaccaccaggatctcacgctgctgaaggcgctagtgcgccagcagttgcccgagaaatacaaggagatcttcttcgaccagagcaaaaacgggtacgctggctacatcgacggcggggcctcccaggaggagttctataagttcatcaagcccatactggagaagatggacggcaccgaggagttactggtcaagctgaaccgggaggacctgctccgcaagcagcgcaccttcgacaatgggagcatcccccaccagatccacctgggcgagctgcacgcgatcctccggcgccaggaggacttctacccgttcctgaaggacaaccgggagaagatcgagaagatcctcacctttcgcatcccctactacgtggggcccttggcccggggcaactcccgcttcgcctggatgacgcgcaagagcgaggagaccatcactccctggaatttcgaggaggtggtcgacaagggcgccagtgcgcagagcttcattgagaggatgaccaactttgacaagaacctgccgaacgagaaggtgctgcccaagcactccctcctgtacgagtacttcacggtgtataacgaactcaccaaggtcaagtacgtgaccgaggggatgcggaagcccgctttcctcagcggcgagcagaagaaggccatcgtggacttgctgttcaagaccaaccgcaaggtcacggtgaagcagctcaaggaggattacttcaagaagatcgagtgcttcgactccgtcgagatcagcggggttgaggaccggttcaacgcctccctgggcacctaccacgacctgctcaaaatcatcaaggacaaggactttctggacaacgaggagaacgaggacatcctggaggacattgtgctcaccctgaccctgttcgaggaccgcgagatgatagaggagcggctcaagacgtatgcccacctgttcgacgacaaggtcatgaagcaactgaagcgtcggcgctacaccgggtggggccggctcagccgcaagttgatcaacggaatccgagataaacagagtgggaagacaatcctggacttcctaaagagcgacggctttgcaaaccgcaacttcatgcagctgatccacgacgactccttgaccttcaaggaggacatccagaaggcccaagtatctgggcagggagactccctccacgagcacatcgccaacctggccgggtcccccgccatcaagaagggcatcctgcagacggtgaaggtcgtggacgagctagtcaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaagagcaccccgtggagaacacccagctccagaacgagaagctctacctgtactaccttcagaacggccgggatatgtacgtcgaccaggagctggacattaacaggctgagcgactatgacgtggaccacatcgtgccccagtccttcctcaaagacgacagcatcgacaacaaggtcctgacacggtccgacaagaaccggggcaagagcgacaacgtgccctccgaggaggtagtcaagaaaatgaaaaactattggagacagctgctcaacgctaagctgatcacccagcgcaaattcgacaacttgaccaaagccgaacgcgggggcctcagcgagctagacaaggccgggttcatcaagcggcagctggtggagacccggcagatcaccaagcacgtagcccagatcctcgactccaggatgaacacgaagtacgacgagaacgacaaactgatccgggaggtcaaggtgatcaccctcaagagcaaacttgtgtccgacttcagaaaggacttccagttctataaggttagggagatcaacaactaccaccacgcgcacgacgcatacctgaacgccgtggtgggcaccgccctgatcaagaagtacccgaaacttgagagcgagttcgtctacggggactacaaggtgtacgacgtgcgcaagatgatcgcgaagtccgagcaggagatcggaaaggctaccgccaagtacttcttctacagcaacatcatgaacttcttcaagacggagatcaccctggcaaacggcgaaatccggaagcgccccctaatcgaaacgaacggagagaccggcgaaatcgtctgggacaaggggcgggacttcgccacggtgcgcaaggtgctctccatgccccaggtcaatatcgtaaagaagaccgaggtgcagaccggcgggttcagcaaggagtccatcctgcccaagcgcaacagcgataagttaatcgcgcgtaagaaggactgggacccgaagaagtacggcggcttcgactcccccaccgtcgcgtacagcgtgctggtggtcgccaaggtggagaagggcaagagcaagaagttaaagtccgtgaaggagctgctcggtatcacgatcatggagcgcagttccttcgagaagaaccccatcgatttcctggaggccaagggatacaaggaggtcaagaaggacctgatcatcaagctccccaagtacagcctgttcgagctggagaacggccggaaacgcatgctcgcctccgcgggggagctgcagaagggcaacgaactggccctccccagcaagtacgtgaacttcctgtacctggcctcccactatgagaagttaaaaggcagccccgaggacaacgaacagaagcagctgttcgtggagcagcacaagcattatctggacgagatcatcgagcagatatccgagttcagcaaacgggtgatcctcgccgacgccaacctcgacaaggtgctctccgcgtacaacaagcaccgtgacaagcccatccgggagcaggccgagaacatcatccacctcttcaccctgaccaaccttggggcccctgccgcgttcaagtacttcgacaccacgatcgaccggaagcggtacaccagcaccaaggaggtgttagacgcgaccctgatacaccagagtatcacgggcctgtacgagacccgcatcgatctcagccagctcgggggcgataagcggcccgccgccaccaagaaggccgggcaggcgaagaagaagaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8227 - RNA, 5365 nt, synthetic construct; identical to SEQ ID NO: 2427
  misc_feature 1..5365: note = Cas9 variant mRNA product
  source 1..5365: mol_type = other RNA

SEQ ID NO: 8228 - RNA, 3637 nt, synthetic construct
  misc_feature 1..3637: note = Cas9 variant mRNA product
  source 1..3637: mol_type = other RNA
ggggcgctgcctacggaggtggcagccatctccttctcggcatcaagcttaccatggcccccaagaagaagcgcaaagtgggcatccacggggtcccggccgcgaagcggaactacatcctgggcctcgacatcgggatcaccagcgtgggctacgggatcatcgactacgaaacccgcgatgttatcgacgccggcgtccggctgttcaaggaggccaacgtggagaacaacgaaggccgccggtccaagcgcggggcccggcgcctgaagcggcgccggcgccaccggatccagcgcgtgaagaagctcctgttcgactacaacctgctcacggaccacagcgagctgtcgggcatcaacccctacgaggcccgggtcaagggtctcagccagaagctctccgaggaggagttcagcgcggccctgctgcacctcgccaagcgcaggggcgtgcacaacgtgaacgaggtcgaggaggacaccgggaacgagctctccaccaaggagcagatcagccgcaactccaaggccctggaggagaagtacgtggcggagctccagctcgagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaagacatcaaggagtggtacgagatgctgatgggccattgcacctacttcccggaggagctccgaagcgtgaagtacgcctacaacgccgacctgtacaacgcgctcaacgacctcaacaacctggtcatcacgcgcgacgagaacgagaagctggagtactacgagaagttccagatcatcgagaacgtgttcaagcagaagaagaagcccaccctcaagcagatagccaaggagatcttggtgaacgaggaggacatcaaggggtaccgggtcacctccaccggcaagcccgagttcacgaacctaaaggtgtaccacgacatcaaggacatcaccgcccgcaaggagatcatcgagaacgccgagctcctggaccagatcgccaaaatcctgaccatctaccagagctccgaggacatccaggaggagctcaccaacctgaacagcgagctgacacaggaggagatcgagcagatctccaacctcaaggggtacaccggcacccacaacctgagcctgaaggcgatcaacctcatcctggacgagctgtggcacaccaacgacaatcagatcgccatctttaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctacccaacgacataatcatcgagctggcccgggagaagaacagcaaggacgcccagaagatgatcaacgagatgcagaagcgcaaccggcagaccaacgagcgcatcgaggaaatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtggaccacatcatcccccgcagcgtgtccttcgataacagcttcaacaacaaggtgctggtcaagcaagaggagaactccaagaaggggaaccggacccccttccagtacctgagctccagcgactccaagatcagctacgagaccttcaagaagcacatcctcaacctggccaagggcaaagggcgcatctccaagaccaagaaggagtacctgctcgaggaacgggacattaaccgcttcagcgtgcagaaggacttcatcaaccggaacctggtggacacgcgctacgccacccggggcctgatgaacctcctgcgctcctactttcgcgtcaacaacctggacgtgaaggtcaagagcatcaacgggggcttcacctccttcctcaggcgcaaatggaagttcaagaaggagcggaacaagggctacaagcatcacgccgaggacgcgctgatcattgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcatatcaaggacttcaaggactacaagtacagccatcgcgtggacaagaagcccaatcgggagctcatcaacgacacactgtactccacccgcaaggacgacaaggggaacaccctgatcgtgaacaacctcaacggcctgtacgacaaggacaacgacaagctgaagaagctcatcaacaagagccccgagaagctcctgatgtaccaccacgacccccagacttaccagaagctcaagctgatcatggagcagtacggggacgagaagaacccgctgtacaaatactacgaggagaccggcaactacctcaccaagtactccaagaaggacaacgggcccgtcatcaagaagatcaagtactacggcaacaagctgaacgcccacttggacatcaccgacgactaccccaacagccggaacaaggtggtgaagctctccctgaagccctaccgcttcgacgtctacctggacaacggcgtgtacaagttcgtcaccgtcaagaacctcgacgtgatcaagaaggagaactactacgaggtgaacagcaagtgctacgaggaggctaagaagctgaagaagatctccaaccaggccgagttcatcgccagcttctacaacaacgacctgatcaagatcaatggtgagctctaccgggtcatcggcgtgaacaacgacctgctgaaccgcatcgaggtgaacatgatcgacatcacgtatcgggagtacttagagaacatgaacgacaagcgcccgcccagaatcatcaagaccatcgcgtccaagacccagagcatcaagaagtactcaaccgacatcctggggaacctgtacgaggtaaagagcaagaagcacccccagatcatcaagaagggcaagcgccccgccgccacgaagaaggccggtcaagccaagaagaagaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8229 - RNA, 4705 nt, synthetic construct
  misc_feature 1..4705: note = Cas9 variant mRNA product
  source 1..4705: mol_type = other RNA
ggggcgctgcctacggaggtggcagccatctccttctcggcatcaagcttaccatggcccccaagaagaagcgcaaggtgggcatccacggggtcccggccgcgctgttcaacaagtgcattatcatcagcatcaacctggacttctccaacaaggagaaatgcatgaccaagccctacagcataggcctggacatcgggacgaactccgtgggctgggccgtgatcacggacaactataaggtccccagcaagaagatgaaggtgctggggaacacttccaagaagtacattaagaagaacttactgggcgtgctgctgttcgacagcggcatcaccgccgaggggcggcgcctgaagcggaccgcgcgccggcgctacacgcggcgccggaaccgcatcctgtacctccaggagatcttctctaccgagatggccaccctggacgacgcgttcttccagcggctggacgacagcttcctcgtgcccgacgacaagcgcgactccaagtacccgatcttcggcaacctggtggaggagaaggtgtaccacgacgagttccccaccatctaccacctccggaagtacctcgccgacagcacgaagaaggccgacctgcgcctcgtctacctcgccttagcgcacatgattaagtaccggggccacttcctgatcgagggcgagtttaactccaagaacaacgacatccaaaagaacttccaggacttcctcgacacctacaacgccatcttcgagagcgacctgtccctggagaacagcaagcagctcgaggagatcgtgaaggacaagatttccaagctggagaagaaggaccgcatcctgaagctgttccccggggagaagaacagcggcatcttctctgagttcctgaagctgatcgtgggcaaccaggctgacttccggaagtgcttcaacctcgatgagaaggcaagccttcacttctccaaggagagctacgacgaggacctggagaccctcctgggatacatcggcgacgactatagcgatgtcttcctgaaggctaagaagctctacgacgcgatcctgctgtccgggtttctcaccgtgacggacaacgagaccgaggcgcccctgagctccgccatgatcaagcgctacaacgagcacaaggaggacctcgccctcctgaaggagtacatccggaacatcagcctgaagacctacaacgaggtgttcaaagacgacaccaagaacggatacgccggctacattgacgggaagacgaaccaggaggacttctacgtatacctcaagaacctgctggccgagttcgagggcgccgactatttcctcgagaaaatcgaccgcgaggacttcctgcgcaagcagcgcaccttcgacaacgggtccatcccgtaccagatccaccttcaggagatgcgcgccatcctggacaagcaggccaagttctaccctttcctagccaagaacaaggagcggatcgagaagatcctgaccttccgcatcccctactatgtgggcccgctggcgcgggggaacagcgacttcgcttggtccatccgcaagcggaacgagaagatcaccccgtggaacttcgaggacgtgatcgacaaggagagctccgctgaggccttcatcaaccgcatgacgagcttcgacctctacctgcccgaggagaaggtcctgcctaagcactccctcctgtacgagaccttcaacgtgtacaatgagctgaccaaggtgcggttcatcgccgagagcatgcgcgactaccaattccttgactccaagcagaagaaggacatcgtccggctttacttcaaggacaagcgcaaggtgaccgacaaggacatcatcgagtacctgcacgcgatctacggctacgacggcatcgaactcaaggggatcgagaagcagttcaacagcagcctgagcacgtaccacgacctgctcaacatcattaacgacaaagagttcctggacgactccagcaacgaggctatcatcgaggagatcatccacaccttaaccatcttcgaggaccgggagatgatcaagcaacgcctctccaagttcgagaacatcttcgacaagagcgtgctgaagaagctgagccgtcgccactataccggctgggggaagctctccgccaaacttatcaacggcatccgggacgagaagtccgggaatacaatcctggactacctcatcgatgacggcatcagcaatcgcaacttcatgcagctgatccacgacgacgccctgagcttcaagaagaagatccagaaggcgcagattatcggcgacgaggacaagggtaacatcaaggaagtcgtgaagtccctccccggcagcccggccatcaagaagggaatcctgcagtccatcaagatcgtagacgagctggtgaaggtgatgggcgggcggaagcccgagagcatcgtcgtggagatggcccgagagaaccagtacaccaaccagggcaagtccaacagccagcagaggctcaagcgcctggagaagtcactgaaggagctcggcagcaagatcctgaaggagaacatccccgccaagctgagtaagatcgacaacaacgccctacagaacgaccgcctgtatctgtactacctccagaacgggaaggacatgtataccggagacgacctggacatcgaccggctgagcaactacgacatcgaccacataatcccccaggcgttcctcaaggacaactccatcgacaacaaggtgctggtcagctccgccagcaaccgcggaaagtccgacgacttcccgagcctggaggtggttaagaagcggaagactttctggtaccagttgctcaagagcaagctgatttcccagcgcaagttcgacaacctgacgaaggccgaacggggcggcctgctgcccgaagacaaggcaggcttcatccaacgccagctcgtcgaaacccggcaaatcaccaaacacgtggcccgcctgctggacgagaagttcaacaacaagaaggacgagaacaaccgggcggtgaggaccgtaaagatcatcacgctcaagagcaccctggtgtcccaattccggaaagacttcgagttgtacaaggtgcgcgagatcaacgacttccaccatgcccacgacgcctacctcaacgccgtcatcgccagcgcgctgctgaagaagtaccccaagctcgagcctgagtttgtgtacggcgactacccgaaatacaactccttccgtgagcgcaagagcgccaccgagaaggtgtacttctattccaatatcatgaacatcttcaagaagtccatctccctggctgacgggcgggtgatcgagcgccccctgatcgaagtgaacgaggagacgggcgagagcgtgtggaacaaggagtccgacctcgccaccgtccggcgcgtgctgagctacccccaggtgaacgtcgtaaagaaggtggaggaacagaaccacgggctggaccggggcaagcccaagggcctcttcaacgcgaacctgtccagcaagccgaagcccaactccaacgagaacctggtcggggccaaggaatacctcgaccccaagaagtacggcgggtacgccggcatcagcaactccttcgccgtgctggtcaaggggacgatcgaaaagggagccaagaagaagatcaccaacgtcctggagttccagggcatcagcatcctcgaccgcatcaactaccggaaagacaagctgaacttcctgttagagaaggggtacaaggacatcgagctgatcatcgaactgccgaagtactcactcttcgagctgtccgacggcagccgccggatgctcgcgtcgatcctcagcaccaacaataagcgtggggagatacataagggcaaccagattttcctgtcccagaagttcgtgaagctgctctaccacgccaagcggatcagcaacaccatcaacgagaaccaccgaaaatacgtggagaaccacaagaaggagttcgaggagctgttctactacatcctggagttcaacgagaactacgtcggtgccaagaagaacggaaagctcctgaacagtgccttccagagctggcagaaccattcgatcgacgagctatgcagctccttcatcggccccacggggagcgagcgcaagggcctcttcgagctaacatcccgggggagcgccgcagactttgagttcctgggcgtgaagataccccgctaccgggactacaccccctccagcctcctgaaagacgccaccctgatccaccagtccgtgacggggctgtacgagacccgcatcgacctcgccaagctgggcgagggcaagaggccggccgccaccaagaaggcagggcaggccaagaagaagaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8230 - RNA, 3781 nt, synthetic construct
  misc_feature 1..3781: note = Cas9 variant mRNA product
  source 1..3781: mol_type = other RNA
ggggcgctgcctacggaggtggcagccatctccttctcggcatcaagcttaccatggcacccaaaaagaaacgcaaagtaggaatacacggagtgccggcagcatggtacgcgagccttatgagcgcccaccatctacgcgttggaatcgacgtaggcacccacagcgtaggactagccacactccgagtagacgaccacggaaccccaattgaattactatcggcactgagccacatccacgatagtggagtcgggaaagaaggaaagaaagaccacgacacacgaaagaaactgtcaggaatagcaagacgcgctcgaagactattacaccaccgacgaacacagctccaacaactagacgaagtcctacgagatctaggcttcccaatcccaacaccgggagagttcctagacttaaacgaacaaaccgacccataccgcgtgtggcgagtccgagcacgactcgtggaagagaaactcccagaggaattacgcggaccagccataagcatggcagtgaggcacatcgcccgacaccgagggtggaggaacccgtatagtaaagtagaatccctactaagccccgccgaggaaagcccattcatgaaagcactccgcgaacgaatcctcgcaaccaccggcgaagtactagacgatggcataacgccgggccaagctatggcccaagtcgcactgacccataacatctcaatgcgcggaccagaaggcatactaggaaaactacaccaatccgataacgcaaacgaaatccggaaaatatgtgcccgccagggggtcagccccgacgtttgcaaacagctactccgggccgtattcaaagccgactcacctagaggcagcgccgtgagtagagtagcacccgatccccttcccggtcaggggagcttccgcagagccccaaaatgcgacccagagttccagcgcttccgaataatatccatagtggcaaacctgcgaatatctgaaacgaaaggcgaaaacagaccactaaccgccgacgaacgcagacacgtcgtcaccttcctaacggaagacagtcaagccgatcttacttgggtggacgtcgcagaaaaactcggagttcaccgccgggacttaaggggaacagccgtacacaccgacgacggagaaagaagtgccgcccggcccccaatcgacgcaacggatagaatcatgagacagaccaaaatcagttccctcaaaacgtggtgggaagaagccgacagcgaacagagaggcgcaatgatcaggtacctgtacgaagacccaaccgattctgaatgcgcagaaatcatagctgaactcccagaagaagatcaagccaaactagactccctacacttacccgcaggacgcgccgcatacagcagagagagtctaacagccttaagcgaccacatgctcgcgacaaccgacgacctccacgaggcacgaaaacgccttttcggcgttgacgacagctgggccccacccgccgaagcaatcaacgcccccgtcgggaacccctcggtggaccgcacattaaaaatagtagggcgatacctctcagcagtcgaatctatgtggggcacgccagaagtcattcacgtagagcacgtccgagacgggttcacgagcgagcgcatggccgacgaacgagacaaggcaaaccgacgaagatataacgacaaccaagaagcaatgaagaaaatccagagagactacggaaaagaaggctacatatccagaggggacatagtaaggctggacgccctcgaactccagggatgtgcctgtctctactgcgggacaacaattggataccacacgtgccaactagaccacatcgtaccccaggcaggaccaggaagcaacaaccgccgagggaacctagtcgctgtatgcgaaagatgcaaccgctcgaaatcaaacaccccctttgcagtttgggcccaaaaatgcggcatcccccacgtcggagtaaaggaagcgatcggcagagtcaggggctggagaaagcaaacaccaaacacatcaagcgaagatcttacaaggctaaagaaggaggtcatcgcacgactaagacgaacacaggaggacccagaaatcgacgaaaggtccatggagagcgtagcctggatggcaaacgaactccaccacagaatcgcggccgcatacccagagacaaccgttatggtctatagaggtagtatcacagcggctgcacggaaagccgccggaatagactcccgcatcaatcttataggagagaagggacgaaaagacagaatcgaccgccggcaccacgccgtggatgcctccgtcgtcgcgctaatggaggcaagcgtcgcaaaaacactagccgaacgcagcagcctgcgcggcgaacagcgcctaaccggaaaagaacagacctggaaacaatatacaggcagtaccgtaggagccagagaacacttcgaaatgtggagaggccacatgctccacctcacggaactgttcaatgaaagactagccgaagacaaagtttacgtaacacagaacatacgcctgcgactcagcgacggcaatgcacacaccgtcaaccccagcaaactcgtatcacaccgactcggcgacggactcacagtacaacaaatcgaccgcgcgtgcactccagccctgtggtgtgccctaacccgagaaaaagacttcgacgagaaaaacggcctaccggcacgagaagaccgggccatccgagtgcatgggcacgaaataaaatcgtcagactacatacaagtgttctccaaaagaaagaaaaccgactcagaccgagatgagacaccgttcggagcaatagcggtacgtggagggttcgtcgagatcggacccagcatccaccacgccagaatatacagagtagaaggaaagaaaccagtctacgcaatgctcagggtgttcacacatgacctcttaagccagcgacatggcgacctatttagcgcggtgataccaccacaaagtatcagcatgagatgcgcggaacccaaactccgcaaagcgataacaacgggaaacgccacatatctagggtgggtcgtagtgggcgacgagcttgaaataaacgtagacagtttcaccaaatacgctattggacgcttcctcgaagacttcccaaacacaacacgatggcgcatctgcggttacgatacaaactcaaaactcacgctgaagccaatcgtcctggccgccgaaggactcgaaaacccgtcctcagccgtcaacgagatcgttgaactgaagggatggagagtagcgatcaacgtcctcacaaaagtccacccaacagtagtccgacgcgacgcactaggacgaccgcgctatagttcgagatcaaacctaccaacaagctggacgatcgagaaacgcccagccgcaacaaagaaagccggacaagcgaagaagaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8231 - RNA, 4642 nt, synthetic construct
  misc_feature 1..4642: note = Cas9 variant mRNA product
  source 1..4642: mol_type = other RNA
ggggcgctgcctacggaggtggcagccatctccttctcggcatcaagcttaccatggcccccaagaagaagcgcaaggtgggcatccacggggtccctgccgcgaccaagccctacagcatcggcctggacatcgggaccaactccgtgggctgggccgtgacgaccgacaactacaaggttcccagcaagaagatgaaggtgctcgggaacactagcaagaagtacatcaagaagaacctattaggcgtgctcctgttcgacagcggcatcacggccgaggggcggcgcctgaagcggacggcccgcagacgctacacccggcgccggaatcgcatcctctatctgcaagagatcttctccaccgagatggccaccctagacgacgccttcttccaacggctagacgacagcttcctggtccccgacgacaagcgcgactccaaatacccgatcttcggcaacctggtggaggagaaggcctaccacgacgagttccccaccatctaccacctccggaagtacttggccgacagcaccaagaaggccgacctgcgcctcgtgtacctggcgctggcccacatgatcaagtaccgggggcactttctcatcgagggcgagttcaactccaagaacaacgacatccagaagaacttccaggacttccttgacacctacaacgccatcttcgaaagcgacctgtccttggagaatagcaagcagctggaggagatagtcaaggacaagatctccaagctggagaagaaggaccgcatcctcaagctgttccccggggagaagaacagcggcatcttctccgagttcctgaaactcatcgtgggcaaccaggccgacttccggaagtgcttcaacctggacgagaaggccagtctgcacttctccaaggagagctacgacgaggacctcgagaccctgctggggtacatcggcgacgactactccgacgtgttcctcaaggcgaagaagctgtacgacgccatcctgctcagtgggtttctgacggtcaccgacaacgagaccgaggcgcccctgagctccgccatgatcaagcgctacaacgagcacaaggaggacctcgcactgctgaaggagtacatccggaacatcagcctcaagacctacaacgaggtgttcaaggacgacacgaagaacggctacgccggctacatcgacggaaagaccaaccaggaggacttctacgtgtacctgaagaagctgctcgccgagttcgagggcgcagactacttccttgagaagatcgaccgcgaggacttcctgcggaagcagcgcaccttcgacaacggttccatcccgtaccaaatccacctccaggagatgcgcgccatcctggacaagcaggccaagttctaccccttcctggcgaagaacaaggaacggatcgaaaagatcctgaccttccgcatcccctactacgtcggccctctcgcccgggggaacagcgacttcgcctggtccatccgcaagagaaacgagaagatcacgccttggaacttcgaggacgtgatcgacaaggagagctccgccgaggccttcatcaatcgcatgaccagcttcgatctgtacctccccgaggagaaggttcttcccaagcactcgctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacattatcgagtacctccacgcaatctacggctacgacggcatcgagctgaaggggatcgagaagcagttcaacagctccctgagcacctaccacgacctcctgaacatcatcaacgacaaggagttcctggatgactccagcaacgaagccatcatcgaggagatcatccacaccctcaccatcttcgaggaccgggagatgatcaagcagcgcctgtcaaagttcgagaacatcttcgacaagagcgtgctgaagaagctctcccggcgccactacacgggctgggggaagctgagcgccaagctgatcaacggcatccgggacgagaagtccgggaacaccatcctcgattacctgatcgacgacggcatcagcaaccgcaacttcatgcagctgatccacgacgacgcgctcagcttcaagaagaagatccagaaagcacagatcatcggcgacgaggacaaggggaacatcaaggaggtggtcaagtccctgcccggcagcccggccatcaagaaagggatcctgcagtccatcaagatcgtggacgagctcgtcaaggtgatgggcgggcgaaagcccgagagcatcgtggtcgagatggcccgcgagaaccagtacaccaaccagggcaagtccaacagccagcagcggctgaagcgcctggagaagtccctcaaggagctgggcagcaagatactgaaggagaacatccccgccaagctctccaagatcgacaacaacgcgctgcagaacgaccgcctgtacttgtactacttgcagaacgggaaggacatgtacaccggcgacgacctggacatcgaccggctaagcaactacgacatcgaccacatcatcccccaggccttcctgaaggacaactccatcgacaacaaggtgctggtgagctccgcgagcaaccgcgggaagtccgacgacgtcccgagcctcgaggtggtgaagaaacggaagacgttctggtaccagctgctcaagagcaagctgatctcccagcgcaagtttgacaacctgaccaaagcagagcgtggcggcctgagccccgaggacaaggccgggttcatccaacgccagctcgtcgagacccggcagatcaccaagcacgtggcgcgcctgctggacgagaagttcaacaacaagaaggacgagaacaaccgggccgtgcgcacggtcaaaatcatcaccctcaagtccaccctggtgagccagttccgaaaggacttcgagctgtacaaggtgcgcgagatcaacgacttccaccacgcccacgacgcctacctcaacgccgtggtggcgtccgccctgctgaagaagtaccccaagctcgagcccgagttcgtgtacggcgactacccgaagtacaatagcttccgggaacgcaagtccgccaccgagaaggtctacttctacagcaatatcatgaacatattcaagaagtccatcagcctggccgacgggcgggtgatcgagcgccccctgatcgaggtgaacgaggagaccggcgaatccgtctggaacaaggagagcgacctcgcgacggtgcggcgcgtcctgtcctacccccaggtcaacgtggtgaagaaggtcgaggagcagaaccacgggctggaccgggggaagcccaagggcctcttcaacgccaacctgagctccaagccgaagcccaacagcaacgaaaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgatcgcatcaactaccggaaggacaagctgaacttcctgctcgagaaggggtacaaggacatcgagctgatcatcgagctgccaaagtacagcctcttcgagctgagtgacggctcccgccgcatgctggcgagcatcctctccacgaacaacaagcgcggggagatccacaagggcaaccagatcttcctgagccagaagttcgtgaagctgctctaccacgccaagcggatctccaacaccataaacgagaaccaccggaaatacgttgagaaccacaagaaggagttcgaggagctgttctactacatcctggagttcaacgagaactacgtcggggccaagaagaacgggaagctcctgaacagcgcctttcagtcctggcagaaccacagcatcgacgagctgtgctctagcttcatcggccccacagggtccgagcgcaagggcctcttcgaactgaccagccgggggtccgccgcggacttcgagttcctgggcgtgaagatcccccgctaccgggactacacgcccagctccctcctcaaggacgctaccctgatccaccagagcgtcacggggctctacgagacccgcatcgacctggccaagttgggagagggcaagcggccggccgccacgaagaaggcgggtcaggccaagaagaagaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8232 - RNA, 3724 nt, synthetic construct
  misc_feature 1..3724: note = Cas9 variant mRNA product
  source 1..3724: mol_type = other RNA
ggggcgctgcctacggaggtggcagccatctccttctcggcatcaagcttaccatggcaccgaaaaagaaacgcaaagtgggcatccacggagtaccagccgctgccgccttcaaaccaaacagcataaattatatcctcggcctagatatcggtatcgcctccgtagggtgggccatggtcgagattgatgaagaagaaaacccaatcaggctcatagacctaggcgtacgagtcttcgaacgcgccgaagtcccaaaaacaggagattccctcgctatggcacgaagactagcaagaagcgtgagacgacttacccgccgacgcgcccaccgcctcctccgaactcgtcgcctcctaaagcgcgaaggagtcctccaagccgccaatttcgacgaaaacggtctaatcaaaagcctccccaacacgccatggcaactccgagcagcggccctagaccggaaactaacacccctagaatggtccgctgtcctactgcacctcatcaaacaccgcggatacctaagccagaggaaaaacgaaggagagaccgccgacaaagaactaggcgcgctactgaaaggtgtagcaggcaacgcacatgccctacagacgggtgactttcgaacaccggcagagctcgcacttaacaaattcgaaaaagaatctggacatatccgaaatcaaagatccgactacagccacacattcagccgaaaagatctacaagccgaactcatccttctattcgaaaaacaaaaagagttcggaaatccccacgtatcgggcggactgaaggaagggatcgaaaccctactcatgacacaacggcccgccctatcaggcgatgccgttcagaaaatgctaggccactgcacattcgaaccagccgaaccaaaggcggccaaaaacacctacacagcggaacgcttcatctggttaactaaactgaataacttacgcatactcgaacaaggctctgaacgacccctcacggatacagaacgcgcaaccctaatggacgagccctaccgcaaaagcaaactgacctatgcacaagcgagaaaactcctaggactcgaagacacagccttcttcaaaggtctcaggtacggaaaagataacgccgaggccagcacactcatggaaatgaaagcctaccatgccatcagccgagccctggaaaaagagggcctcaaagataagaaaagccctctcaaccttagccccgaacttcaagatgaaatcggaaccgcatttagcctcttcaaaacagacgaagacatcaccggacgactgaaagaccgcatccaaccagagatactcgaggcgctgctaaaacacatatccttcgacaaattcgtacaaatcagcttaaaggcactacgccggatagtacccctaatggaacaagggaaacgatacgacgaagcatgtgccgaaatatacggtgatcactacggaaagaaaaacactgaagaaaagatctacctcccaccaatacccgccgacgaaataaggaaccccgtagtactacgtgccctctcacaagcacgcaaagtcattaacggagtagtcagaagatatggcagccccgcgcggatccacatcgaaacagcccgcgaagtaggcaaatctttcaaagatcgcaaagaaatcgagaaaagacaagaagagaatagaaaagatcgagagaaagccgccgcaaaattccgagaatatttccccaacttcgtcggtgaaccaaaaagtaaagacatcctcaaactccgcctctatgagcaacagcacggaaaatgcctatacagcggaaaagaaatcaacctcggccggctaaacgagaagggatacgtagaaatagaccacgccctcccattctcgcgaacatgggacgactcttttaataacaaagtcttagtcctcggatcagagaaccaaaacaaaggaaatcaaacgccatacgagtacttcaacggcaaggacaacagcagagaatggcaagagttcaaagcacgagtggaaacctcccgattcccacgctccaagaaacaaagaatcctactccagaaattcgacgaagacgggttcaaagaacgcaacctgaacgatacacggtacgtcaaccgcttcttatgccaattcgtggcggaccgcatgcgcctcacgggaaaaggtaagaaacgggtattcgccagcaacggacagataacgaacctcctccggggattctggggcctccgaaaagtccgggcagaaaacgaccgacaccacgcgctagacgcggttgtcgttgcttgcagcaccgtcgccatgcagcagaaaataaccagatttgtcagatacaaagagatgaacgcctttgacggaaaaactatcgacaaagagacaggcgaagtactacaccaaaagacacacttcccgcaaccatgggagttcttcgcccaagaagtcatgataagggtattcgggaaaccagacggcaaaccagagttcgaagaagcagacaccctagaaaagctccgcaccctactggcagaaaagttgagcagccgccccgaagccgtacacgaatacgtaacaccactcttcgtctcccgagcacccaaccgaaaaatgagcggccaaggccacatggaaaccgtaaaatccgccaagcgcctggacgaaggcgtctccgtactaagagtacccctcacccaactcaagctaaaagacctggagaaaatggttaacagagaaagagaaccaaagctatatgaggccctcaaggcgcgcctcgaggcacacaaagacgacccagcaaaagcattcgctgaacccttctataaatacgataaagccgggaacagaacacaacaggtaaaggccgtccgggtagaacaggtacagaagaccggagtctgggtccgaaaccataatggcatcgcagacaacgcaacaatggtacgcgtcgatgtgttcgaaaaaggcgacaagtactacctagtacccatatacagctggcaggtcgcgaaaggcatcctaccggacagggccgtagtccagggcaaagatgaagaagactggcagctaatcgatgattccttcaactttaaattcagcctacacccaaatgacctcgtagaagtaatcaccaaaaaggcaagaatgttcggatacttcgccagctgccacagaggaaccggaaacatcaacattcggatacacgacctcgatcacaaaataggcaagaatggcatactcgagggcataggggtcaaaaccgcactatccttccagaagtaccaaatcgacgagcttggaaaagaaatccggccctgtcgactgaagaaaaggccaccagttcggaagagaccggccgccaccaaaaaggcaggtcaagccaaaaagaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8233 - RNA, 4480 nt, synthetic construct
  misc_feature 1..4480: note = Cas9 variant mRNA product
  source 1..4480: mol_type = other RNA
ggggcgctgcctacggaggtggcagccatctccttctcggcatcaagcttaccatggcccccaagaagaagcgcaaggtgggcatccacggggtcccggccgcgaagaagccatacaccatcggcctggacatcgggaccaacagcgtgggctgggccgtgctcaccgaccagtacgacctggtcaagcggaagatgaagatcgccggggactccgagaagaagcagatcaagaagaacttctggggcgtgcgcctgttcgacgagggccagaccgccgctgaccggcgcatggcgcggaccgcccgccggcgcattgagcggcgccggaaccgcatcagctacctccagggaatcttcgccgaggagatgtccaagaccgatgccaacttcttctgccggctgagcgactccttctacgttgacaacgagaagcgcaacagccggcaccccttcttcgcgacgatagaggaggaggtcgagtatcacaagaactaccccacaatctaccacctccgcgaggaactcgtgaactccagcgaaaaggccgacctgcgtctagtgtacctcgccctggcccacatcatcaagtaccgcggcaacttcctgatcgagggggccctcgacacccagaacacctccgtcgacggcatctacaagcagttcatccagacgtacaaccaggtgttcgcgtccgggatcgaggacggctcccttaagaagctggaggacaataaggacgtggccaagatcctcgtcgagaaggtgacccggaaggagaagctggagcgcatcttaaagctctacccgggcgagaagtccgccgggatgttcgcccagttcatcagcctaatcgtgggcagcaaggggaacttccagaagcccttcgacctgatcgagaagtccgacatcgagtgcgccaaggactcgtacgaggaggacctcgagtccctgctggcgctcatcggggacgagtacgccgagctgttcgtcgccgccaagaatgcctacagcgcggtggtgctgagtagcatcatcaccgtcgccgagaccgagacgaacgccaagctcagcgcctccatgatcgagcggttcgacacccacgaggaggacctgggcgagctgaaggcattcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaagagaacttcctgcgcaagcagcgcacattcgacaacggggcgattccccaccaactgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgattttggcaagtccgccgtagacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcgtatttcagcggccaggagaaggagcagatcttcaacgacctgttcaagcagaagcggaaggtcaagaagaaggacctcgagctgttcctgcgtaacatgtcccacgtggagagccccacgatcgaggggctggaggactccttcaacagctcctacagcacctaccacgacctcctgaaggtgggcatcaagcaggagatcctggacaaccccgtcaacacagagatgctcgagaatatcgtgaagatcctgacagtgttcgaggacaagcggatgatcaaggagcagctgcagcagttctccgacgttctcgacggcgtggtgctgaagaagctggagcgccggcactacacggggtggggccgcctcagcgccaagctgctgatggggatccgggacaaacagtcccacctcaccatcctggactacctgatgaacgacgacggcctcaatcgcaacctgatgcagctgatcaacgacagcaacctttcattcaagagcatcatcgagaaggagcaggtcaccaccgccgacaaggatatccagagcatcgtggccgacctggcgggatccccggccatcaagaagggcatcctgcagagcctcaagatcgtggacgaactggtctccgtgatgggctacccgccccagacgatcgtggtcgagatggcccgggagaaccagactaccgggaagggcaagaataacagccgcccccggtacaagtccctggagaaggccatcaaggagttcgggagccagatccttaaggagcaccccaccgataatcaggagctgcgcaacaaccgactgtacctctactacctgcagaacggcaaggacatgtacacgggccaggaccttgacatccacaacctctccaactacgacatcgaccatatcgtgccccagagcttcatcaccgacaactccatcgacaacctggtgctgaccagctccgccgggaaccgcgaaaagggcgacgacgtcccgcccctcgagatcgtgcgcaagcgcaaggtgttctgggagaagctgtaccaggggaacctgatgagcaagcgcaagttcgactacctgaccaaggcggagcggggcgggctgaccgaagccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccaactctacaaggtgcgcgacgtcaacgactaccaccacgcccacgacgcctacctgaacggcgttgtggcgaacactctgctcaaggtctacccccagctggagcccgagttcgtgtacggggactaccaccagttcgactggttcaaggccaacaaggcgaccgccaagaagcagttctacaccaacatcatgttgttcttcgcccagaaggaccggatcatcgacgaaaacggtgagatcctctgggataagaagtacctggacaccgtgaagaaggtcatgtcctaccgccagatgaacatcgtgaagaagacggagatccagaagggggagttctcgaaggccaccatcaagcccaagggcaactccagcaagttaatcccccggaagaccaactgggacccgatgaagtacgggggcctcgacagccccaacatggcctacgcggttgtcatcgaatacgccaagggcaagaacaagctggtgttcgagaagaagatcatccgcgtgaccatcatggagcggaaggccttcgagaaggacgagaaggccttcctggaggagcaggggtaccgccagccgaaggtcctcgccaagctgccgaagtacacgctgtacgagtgcgaggagggccggcgccggatgctcgcgtccgcaaacgaggcccagaaggggaaccagcaggtcctgcccaaccacctggtgaccctcctgcaccacgccgcgaactgcgaggtgagcgacggcaagtccctggactacatcgagagcaaccgcgagatgttcgcggaactcctggcccatgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaaattcttcgagaccacgatcgagcgcaagcggtacaacaacctcaaggagctgctgaacagcaccatcatctaccaatccatcaccggcctctacgagtctcgcaagcgcctcgacgacaagcggcccgccgccaccaagaaggcagggcaggcgaagaagaagaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8234 - RNA, 4513 nt, synthetic construct
  misc_feature 1..4513: note = Cas9 variant mRNA product
  source 1..4513: mol_type = other RNA
ggggcgctgcctacggaggtggcagccatctccttctcggcatcaagcttaccatggctcccaagaagaaacgcaaggtgggcatccacggggtcccggcagcgaagaagccctacagcatcggcctggacatcggcaccaattccgtgggttgggccgtggtaaccgacgactacaaggtgcccgccaagaagatgaaggtgctcgggaacacggacaagagccacatcgagaagaacctgctgggcgccctactgttcgactccggcaataccgccgaggatcggcgcctaaagcggaccgcgcgcagacgatacacccggcgccggaaccgcatcctctaccttcaggaaatcttctcagaggagatgggaaaggtcgacgactccttcttccaccggctggaggacagcttcctcgtgacggaagacaagcgaggcgagcggcaccccatcttcgggaacctggaggaggaagtgaagtaccatgagaacttcccgaccatctaccacctccgccagtacctggccgacaatcccgagaaggttgacctgcggctggtgtacctcgccctggcccacatcatcaagttccgcgggcacttcctgattgaggggaagttcgacacgcggaacaacgacgtgcaacgcctctttcaggagttcctggcggtctatgataacacgttcgagaactccagccttcaggagcagaacgtccaggtggaggagatcctcaccgacaagatctctaaaagcgccaagaaggaccgggtgctgaagctgttccccaacgaaaagtccaacggccgcttcgccgagttcctcaagctgatcgtgggcaaccaggccgacttcaagaagcatttcgagctggaggaaaaggccccgctacagttcagtaaggacacctacgaggaggagctggaggtgctgctcgcgcagataggtgataattacgccgagctgttcctgtccgccaaaaagctgtacgacagcatcctgctgtccggcattctaacagtcaccgacgtgggaacgaaggccccgcttagtgcttcaatgatccagcggtataacgaacaccagatggacctggcgcagctaaagcagttcataagacagaagctgagcgacaagtacaacgaagtgttctccgacgtcagcaaggacggctatgccggctacatcgacgggaagaccaaccaggaggccttctacaagtacctgaaggggctcctgaacaagatagaggggagcggctacttcctggacaagatagagcgcgaggacttcctacggaagcagcgtactttcgacaacgggtccataccccaccagatccacctccaggagatgcgggccatcatccgccgtcaggcagagttctaccccttcctcgcggacaaccaggaccgcatcgagaagctgctgaccttcagaatcccctactacgtggggccgctggcccgcggcaagagcgactttgcctggctgtcccgtaagagcgccgacaagataacgccctggaacttcgacgagatcgttgacaaggagagcagcgccgaggcgttcatcaacagaatgaccaactatgacctctacctccccaaccagaaggtcctgcccaagcactccctcctatacgagaagttcaccgtctacaatgagctgaccaaggtgaagtacaaaacggagcaagggaagaccgcgttcttcgacgctaacatgaagcaagagatcttcgacggcgttttcaaagtgtaccggaaggtcactaaagataagctcatggacttcctggagaaggagttcgacgagttccgcatcgtggacctgaccggtctggacaaggaaaacaaggtgtttaacgccagctacggcacgtaccacgacctgtgcaagatactcgataaggacttcttagataactccaagaacgagaagatcctggaggacatcgtcctgaccctcactctgttcgaggaccgggagatgatccgcaagcggctggagaactatagcgacctcctgacaaaggagcaggtcaagaagctggagcgccggcactacactgggtggggtcgcttgtccgcggagctaatccacggcatccggaacaaggagagcaggaagaccatcctagactacttaatcgacgacgggaactccaacaggaacttcatgcagctgatcaacgacgacgccttgtcttttaaggaggaaatcgccaaggcccaggtgatcggcgagaccgacaacctcaaccaagtggtgtccgacatcgccgggtctccggcgatcaagaagggcatcctgcagtccctgaaaatcgtggacgagctcgtcaagatcatgggccaccaacccgagaacatcgtggtggaaatggcccgtgaaaaccagttcaccaatcagggtcgccggaacagccagcagcgactgaagggcctgacggactccatcaaggagttcgggagccagatcctcaaagaacacccagtcgagaacagccaactgcagaatgaccgactgttcctctactacctgcaaaacgggcgcgacatgtacaccggggaggagctggacatcgactacctctcccagtacgatatcgaccacataatcccccaagccttcatcaaagacaacagcatcgataaccgggtgctgacctccagcaaagagaacaggggcaagtccgatgacgtacccagcaaggacgtcgtgcggaagatgaagtcctactggagcaagctgctctccgccaagctgatcacccagcgcaagttcgacaacttgacgaaggctgagcggggcgggctcaccgacgacgacaaggcgggcttcatcaagcgccagcttgtggagacccggcagatcaccaagcacgttgcccggatcctggacgagcggttcaacaccgagacggacgagaacaataagaaaatccgccaggtgaagatcgtgaccctcaagagcaacctggtctccaacttccggaaggagttcgaactgtacaaggtccgagagataaatgactaccaccacgcccacgacgcctacctcaacgccgtgatcgggaaggcgctgctgggcgtctacccccagctcgagcccgagttcgtttacggggactacccccacttccacggccacaaggagaacaaggccaccgccaagaagttcttctacagcaacatcatgaactttttcaagaaggacgatgtgcggactgacaagaacggcgagatcatctggaagaaagacgaacacataagtaacatcaagaaggtcctgagctacccccaggtgaacatcgttaaaaaggtcgaggagcagaccggaggcttctccaaagagtcgatcctccccaaggggaactccgacaaacttatcccccgcaagacgaagaagttctactgggacaccaagaagtacggcgggttcgacagccccatagtggcctacagcatcctggtgatcgcagacatcgagaagggcaagtccaagaaactgaagaccgtcaaggcactcgtgggcgtaacgataatggaaaagatgaccttcgagcgggacccggtcgccttcttggagcgcaaggggtatcgcaatgtgcaggaggagaacatcatcaagctgcccaagtatagcctcttcaagctcgagaacgggcggaagcgcctgctagcctccgccagggagctgcagaaggggaacgaaatcgtgctgcccaaccaccttggaaccctgttataccacgcgaagaacatccacaaggtcgatgagccgaagcatctcgactacgtggacaaacacaaggatgagtttaaggaactgctggacgtggtctcaaacttctccaagaagtacaccctcgccgagggtaatctagagaagatcaaggagctgtatgcccagaacaacggcgaggacctcaaggagctcgctagcagtttcatcaaccttctcactttcacggccatcggggcgcccgccaccttcaagttcttcgataagaacatcgaccgcaagcggtacaccagcacgaccgagatcctgaacgccacgcttatccaccagtccataaccggactctacgagacgcgcatcgacctgaacaagctgggcggggacaagcggcccgccgccaccaagaaggcgggccaagccaaaaagaagaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8235 - RNA, 3646 nt, synthetic construct
  misc_feature 1..3646: note = Cas9 variant mRNA product
  source 1..3646: mol_type = other RNA
ggggcgctgcctacggaggtggcagccatctccttctcggcatcaagcttaccatggcacctaaaaagaaacggaaagtgggcatacacggcgttccagccgcacaaacaaccaacctcagttacatactaggtctagacctcggtatcgcatcagtcggctgggccgtcgtcgaaatcaacgaaaacgaagaccccatcggactaatagacgtcggcgtaaggatattcgaacgcgccgaagtcccaaaaaccggagaaagcctagcactgtccaggagactcgcgcggagtacccgccgcctaatacgccgccgagcccaccgcctactcctcgcgaaacgcttcctcaagagagaaggcatactgagcaccatagacctcgagaaaggcctgccaaaccaggcctgggagctaagagtcgccggcctcgaaaggcgactatcggccatcgaatggggagccgttctcctgcacctaataaaacacagggggtacctatcgaaaagaaagaacgagagtcaaacgaacaacaaggagctgggcgccctgctaagcggagtggcgcaaaaccaccagctcctacaatccgacgactaccgaacacccgcagaattagccctcaagaaatttgcaaaagaagaggggcacataagaaaccaacgcggcgcttacacacacaccttcaatagattagacctcttagcagaactgaacctgctattcgcacaacagcatcaattcggaaacccacactgtaaagagcacatccagcaatacatgactgaactcctaatgtggcagaaacccgcactcagtggcgaggccatcctaaaaatgctcggaaaatgcacacacgagaaaaacgagttcaaagccgcgaaacatacctacagcgccgaacgttttgtttggctcaccaaactcaataaccttcgaatactcgaagacggggccgaacgggcactaaacgaagaagaaagacaactactaatcaaccacccgtacgaaaagagcaaactaacatacgcgcaggtacgaaaattactaggcctctccgaacaagctattttcaagcacctacgctacagtaaagaaaacgcagagtcagccaccttcatggagctcaaagcctggcacgccatacgaaaagcactcgaaaaccagggcctgaaggacacctggcaggacctcgccaagaaacccgatctcctcgacgaaatcggaaccgccttctcactctacaaaacagatgaagacatccaacaatacctaacgaacaaagtacccaacagcgtaataaacgcactactcgtatccctgaacttcgataagttcatcgaactcagcctgaaaagcctgagaaaaatacttcctctaatggaacaaggcaaacgctacgatcaggcctgccgcgagatctacggacatcactacggggaggccaaccaaaagacgtcacaactcctgcccgccattccagcccaagaaatacgcaaccccgtagtcctgcgaacgctgtcccaagcaagaaaagtaataaacgccatcatacgacaatacggctcccccgcccgagtccacatagaaacgggtcgagaactagggaaatccttcaaagaacgacgcgaaatccaaaaacagcaggaggataatcgaaccaaacgcgagtcagcggttcaaaagttcaaggaactcttctccgacttcagcagcgaaccaaaatctaaagacatactcaagttccgcctttacgagcaacaacacggtaaatgcctatactcgggcaaagaaatcaacatacacaggctgaacgaaaaaggatacgtcgagatcgaccacgcactacccttcagtcggacctgggacgactcattcaacaataaagtacttgtcctagcaagcgagaaccaaaacaaaggcaaccagacaccatacgagtggctacaagggaaaataaactccgaacgctggaaaaacttcgtcgcactggtactcggcagccagtgctcagccgcgaagaaacaacgcctcttgacccaggtcattgacgacaacaaatttatcgaccgcaaccttaacgacactcgatacatcgcacgcttcctatcaaactacatccaggaaaacctcctactcgtcggcaaaaacaaaaagaacgtattcacgccaaacggccaaatcacagccctgctccggtcgcgatggggactaatcaaagctcgagaaaacaacaaccgacaccatgccctagatgcgatcgtggtcgcttgcgcgaccccctcaatgcaacagaaaataacccgcttcatccgatttaaagaagtccacccctacaaaatagaaaaccgatacgaaatggtcgaccaagagagtggagaaattataagcccccacttccccgagccatgggcatacttcaggcaagaggtaaacatccgagtattcgacaaccaccccgacacggtgctaaaagagatgctcccggaccggccacaggcaaaccaccaattcgtacaacctctattcgtctcccgagcgcccaccagaaaaatgtccggccaaggccacatggaaaccatcaagtccgccaaacggctggcagaaggcatctccgtactccgaatacccctaactcaactcaaacccaatctcctggaaaacatggtaaataaggagcgcgaacccgccctgtacgcaggccttaaagcccgactcgccgagttcaaccaggaccccgcaaaagccttcgccacaccattctacaaacaaggcggccagcaggtaaaagcaatccgagtagagcaagtacaaaaatcaggagtcctagtacgcgaaaacaacggagtcgccgacaatgcctcaatcgtacgaaccgacgtattcatcaaaaacaacaaattctttctcgtccccatctacacgtggcaagtagcaaagggaatcctaccaaacaaggcaatcgtcgcacacaaaaatgaagacgaatgggaagaaatggacgaaggtgccaaattcaagttctctctcttccccaacgaccttgtcgaactaaaaaccaagaaagaatacttcttcggctactacatcggactggaccgggcaacagggaacataagcctaaaagagcacgacggcgaaatctccaaaggcaaagacggagtctacagggtaggcgtcaaacttgcactgagctttgaaaaataccaagtagatgagcttgggaaaaaccgacaaatctgccgaccccaacaaagacaacctgtcagaaagagaccagccgcaactaaaaaggcaggacaagccaagaaaaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8236 - RNA, 3724 nt, synthetic construct
  misc_feature 1..3724: note = Cas9 variant mRNA product
  source 1..3724: mol_type = other RNA
ggggcgctgcctacggaggtggcagccatctccttctcggcatcaagcttaccatggcacccaaaaagaaacgcaaagtcggaatccacggagtaccagcagcagccgcctttaaaccaaacccaatcaactacatactcggattagacatagggatagcatcagtcggatgggccatggtcgagatcgacgaggacgaaaaccccatatgcctcatagacctgggggttagggttttcgagcgtgcagaggttccaaaaacaggcgacagcctagcaatggcacgtagactagcgcgctctgtccgcagactcacgagacgacgggcccacagactgctaagagcccgccgcctgctcaaaagagaaggagtcctacaagccgccgactttgacgaaaacggactcataaaaagcctccccaacacaccctggcaacttcgggcggccgccttagaccgaaaactcacacccctcgagtggtccgccgtgctactgcacctgatcaaacatcgaggatacctcagccaacgcaaaaacgagggagaaacggcagacaaagagctcggcgcactgcttaaaggcgtagcggacaacgcacacgcactacagacgggggacttccgcacgccagccgagctcgcactcaacaaattcgagaaagaaagcggtcacatccgaaaccagcgcggagactactcccacacattctcccgaaaagacctgcaagccgaactcatcctactattcgaaaaacagaaagagttcggcaacccacacgtatcaggcggtctaaaagaaggtatagaaacactcctcatgacccaaagaccggccctgtcaggagacgcagtccagaaaatgctcgggcattgcacattcgaaccagcagagcccaaggcagctaaaaacacatacaccgcagaacgattcatctggctgaccaagctcaacaacctcagaatattagaacaagggtctgaacgccccctgactgacacggaacgcgcaacactcatggacgaaccgtaccgcaaaagcaaactcacctacgcacaagcccgtaaactactgggcctcgaagacacagctttcttcaagggtctgcgatacggaaaagacaacgcagaagcatcaacattaatggaaatgaaggcttaccatgccatcagccgagccctagaaaaggaaggcctaaaagataagaaaagtcccctaaacctgtcgcccgagctacaagatgaaatcggcacagccttctcgctttttaaaaccgacgaggacatcacagggcgactcaaagaccgaatacaacccgagattctggaggcgctcctcaaacacatatcattcgacaaattcgtccaaatatccctcaaagcactacgcagaatcgttcctctcatggaacaaggcaaacgctacgatgaagcctgcgcagaaatatatggagaccattacgggaaaaagaacaccgaagagaaaatctatctgcccccgatcccagcggacgaaatacggaatcccgtcgttctgcgagcgctatcccaagcgagaaaagtaatcaacggggtcgtcagacgctacggcagtcccgcaagaatacacatagaaaccgcccgagaggtcggcaaatccttcaaagaccgcaaagagatcgaaaaacgccaagaagaaaatcgcaaggaccgagaaaaagcggcagcgaaattcagagaatacttcccaaacttcgtcggggaacccaaatccaaagatatcctaaaactccgcctatatgaacaacagcatggcaaatgcctctacagcggtaaggaaatcaacttaggaagactgaacgaaaaaggctacgtggaaatagaccacgcgctcccattcagccgcacttgggacgactcattcaacaacaaagtgctggtcctcggctcagagaaccagaataaagggaatcaaaccccctacgaatacttcaacggcaaagacaacagccgcgaatggcaagagttcaaggcacgagtggagacctcgcgcttccccagaagcaagaaacagcgaatactcctacagaaattcgacgaagatggcttcaaagaaaggaacctaaatgacacacgctacgtaaaccgctttctttgccaattcgtagcagaccggatgcggctcactggaaagggcaaaaagagagtcttcgcatccaacggacaaatcactaacctgctgaggggattctggggattacgcaaagtccgggcagagaacgaccgacaccatgcgctcgacgccgtagtcgtagcatgcagcaccgtagccatgcaacagaaaatcacgcgcttcgtgagatacaaggaaatgaacgcattcgacggaaagaccatcgacaaagagaccggagaagtcctacaccagaagacccatttcccccaaccctgggagttcttcgcccaggaagtcatgatacgcgtcttcggcaaacccgacggaaagccagagttcgaagaagcggacacgccagaaaaactaagaacgctgctcgccgagaaacttagctccagacctgaagcagtacatgaatatgtaaccccactcttcgtaagccgagccccgaaccgcaaaatgtccggccaggggcacatggaaacagtaaaatcagccaaacgcctagacgagggcgtgagcgtactaagggtaccgcttacacaactcaagctaaaagacctagagaaaatggtcaaccgcgagcgcgaaccaaagctctacgaggcccttaaggctcggctagaggcacacaaagacgacccagccaaagccttcgcggaaccgttttacaaatacgacaaggccggcaatcggactcaacaagtcaaagccgtaagagtagagcaggtccagaaaacaggcgtctgggtacgtaaccacaacggcatagcagacaacgccactatggtacgcgtcgacgtgttcgaaaaaggcgacaaatattatctagtgcccatatacagctggcaagtcgcaaaaggaatcctaccagaccgcgcggtggtccaaggaaaggacgaagaagactggcaactcatcgacgacagcttcaacttcaaattcagcctacaccccaacgacctagtcgaagtcatcacaaagaaggcccggatgttcgggtacttcgcctcctgccaccgcggcaccggtaacataaacataaggatccatgacctcgaccacaaaataggcaaaaacggaatattagaaggcatcggggtaaaaacagcccttagcttccaaaaataccaaatagacgagctaggaaaagaaataaggccctgccgactcaaaaagagaccaccagtgcgcaaaaggcccgcagcaacgaagaaagccggccaagccaaaaagaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8237 - RNA, 3730 nt, synthetic construct
  misc_feature 1..3730: note = Cas9 variant mRNA product
  source 1..3730: mol_type = other RNA
ggggcgctgcctacggaggtggcagccatctccttctcggcatcaagcttaccatggcaccgaagaagaaaaggaaagtcggcattcacggagtcccagccgcaaaataccatgtaggcatagacgtaggaacattcagcgtagggctcgcggcaatagaggtagacgacgcaggtatgcccatcaaaaccctaagccttgtgtcacacatccacgacagcggcctcgatccagatgaaatcaaatcggcggtcacgcgactagcaagcagcggtatcgccagacgaacgcgcagactgtaccgaaggaaaaggagaagactccagcaactggacaaattcatacaacggcaaggatggccagtgatagaattagaggactacagcgacccactatacccctggaaagtaagagccgagctcgcagcaagttacattgcggatgagaaagaacgaggcgagaaattgagcgtggcactgagacatatcgccagacacagaggatggcgcaacccatacgcaaaagtaagcagcctatacctcccagacgggccgtccgacgcattcaaagcgatcagagaagagataaagagggcgagtgggcaaccagtgccagaaacagccacggtgggacaaatggtgaccctatgcgaactaggcacgctgaagctaagaggagaaggcggagtcctgagtgcacggttgcagcaaagcgactacgcccgcgaaatacaagaaatatgccgcatgcaagaaatagggcaagaactctacagaaaaataatcgacgtagtattcgcagctgaaagcccaaaggggagcgccagcagccgagtaggaaaagaccccttacaacccgggaaaaaccgcgcgctaaaggccagcgacgcattccaacgatacaggatagcagccttaataggaaacctaagagtccgagtagatggagagaaacgcatcctcagcgtagaggagaagaacctcgtgttcgaccatctggtcaatctaaccccaaagaaagaaccagaatgggtaacgatcgcagaaatactgggcatagacagagggcagctaataggaaccgccacgatgacggacgacggagaacgcgcgggagcccgaccacctacgcacgacacgaacagatccatcgtgaacagccgaatagccccgctagtcgactggtggaaaacagcgagcgccctcgaacaacatgcaatggtcaaggctctaagcaacgcggaagtagacgacttcgactcaccagagggagcaaaagtccaagcattcttcgccgacctagacgacgacgtccacgcaaaactcgactcccttcatctgccagtcggacgagcggcgtacagcgaagacaccctagtacgattaacacgacgcatgctaagcgacggagtagatctgtacaccgcaagactacaggagttcggcattgaaccaagctggacgccaccaacccccaggatcggagaaccagttggtaacccagctgtagaccgagtactaaaaacagtcagtcgatggcttgaaagtgcgaccaagacttggggagcaccagaacgggtcataatagaacacgtaagggagggatttgtaacagaaaaacgggcgcgagaaatggacggggacatgcgtagacgagcagcaaggaacgcaaaactgttccaggaaatgcaggagaaactaaacgtacaaggaaaaccctctagagcagatctctggcggtaccagagcgtccaaagacaaaactgccaatgcgcatactgcggcagcccaatcacgttcagcaactcagaaatggaccacatcgtgccaagggctgggcagggatccaccaacacgcgcgagaacctagtggcggtgtgccacaggtgtaaccaaagcaaaggaaacaccccgttcgcgatatgggcgaaaaacacctccatagagggcgtaagcgtaaaggaagctgtggaaagaacacgacactgggtcacggacacaggaatgcgctcaaccgactttaagaaatttacaaaggctgtcgtcgagaggttccaaagagcaacgatggacgaagagatagacgcaaggagcatggaatcggtcgcatggatggcaaacgaattgcgcagtcgggtagcacagcacttcgctagccacggaacaacggtacgagtctaccgcggaagcctcacagcggaagcacggagggccagcggcataagcggcaaactaaagttcttcgacggagtcgggaaatctcgcctagaccgcagacaccatgccatagacgcggccgtgatcgcattcacaagtgactacgtggccgagaccctagcagtacgaagcaatttgaagcaaagccaagcgcacagacaggaagccccgcaatggcgagagttcacaggaaaagacgcagaacacagagcggcatggagggtatggtgccagaaaatggaaaaactaagcgcattgctcaccgaagacctcagggacgacagagtcgtcgttatgagcaacgtgcggctacgcctcggcaacggctcggcccacaaagaaacaataggaaaactcagcaaggtcaaactaagctcacaactgtccgtatccgacatagacaaagcgtcgagcgaagcactctggtgcgcgctaacgcgagaacccggatttgaccccaaggaaggcctccctgcaaacccagaacggcacatacgagtaaacggtacacacgtgtatgctggtgacaacatcggattattcccagtctcagcaggaagtattgcgctgcggggaggatacgcagaactcggctcaagttttcaccacgcaagggtatataaaataacaagcgggaagaaaccagcattcgctatgttgagagtatacacgatagacctgctcccctaccgcaaccaagacctattcagcgttgaactaaaaccacaaacaatgtcaatgaggcaagccgaaaagaaactgcgagacgccctcgccaccgggaacgccgaatacctcggctggttagtcgtcgacgacgagctcgtagtagacaccagcaaaatagcaacggaccaagtaaaagcagtcgaagcggagctaggaacgataagacgatggagggtagatggatttttcagcccaagcaaactacgcctaagaccgcttcaaatgtcaaaagaaggcatcaaaaaggaaagcgcaccagagctgagcaagataatcgacagacccggctggctaccagcagttaataaactcttcagcgacggcaacgtcacagtcgtgcgaagggactcgttggggcgggtacggctagaaagcacagcgcacctacccgtcacatggaaggtacaaaagagaccagccgcgacgaagaaggcaggccaggcgaagaaaaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8238 - RNA, 3430 nt, synthetic construct
  misc_feature 1..3430: note = Cas9 variant mRNA product
  source 1..3430: mol_type = other RNA
ggggcgctgcctacggaggtggcagccatctccttctcggcatcaagcttaccatggcccccaagaagaaacgcaaggtgggcatccacggggtcccggccgcggcccggatactggccttcgacatcggcatcagctccatagggtgggccttcagcgagaacgacgagctcaaggactgcggcgtgcgcatcttcactaaggtggagaaccccaagacaggagagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgatgagagcctcgccaaggcctacaaaggctccctgatcagcccctacgagctgcggttccgcgcactcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacttgtacaaggagtacttccagaaattcaaggagaacagcaaggagttcacgaacgtgcgcaacaagaaggagtcctacgagcggtgcatcgcccagagcttcctgaaggacgagctgaagctcatctttaaaaagcagcgcgagttcgggttctccttcagcaagaagttcgaagaggaggtcctttccgtggcgttctacaagcgggctctgaaggacttcagccacctcgtgggcaactgctccttcttcaccgacgagaagcgcgccccgaagaacagccccctggccttcatgtttgtcgccctgacccggatcatcaatctcctgaacaacctgaagaacaccgagggcatcctctacacgaaggacgacctgaacgcgctgcttaacgaggtgctgaagaacggcaccctgacctacaagcagaccaagaagctcctggggctgagcgacgactacgagttcaaaggggaaaagggcacgtacttcatcgagttcaagaagtacaaggagttcattaaggccctcggggagcacaacctgtcccaggacgacctgaacgagatcgccaaagacatcaccctcatcaaggacgagatcaagctgaagaaggccctggccaagtacgacctcaaccagaaccagatcgacagcttatccaaacttgagttcaaggaccacctcaacatcagcttcaaggcgctaaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgtgcgatcaaggagtaccgcaaggtgctgaacgccctcctgaagaagtacggcaaggtgcacaaaatcaacatcgagctggcgcgggaggtcgggaagaaccactcccagcgcgccaagatcgagaaggagcagaacgagaactacaaggccaagaaagacgcggagctcgagtgtgagaagctgggcctgaagatcaacagcaagaacatcctcaagctgcggctgttcaaggagcagaaggagttctgtgcctactccggggagaaaatcaagatcagcgacctccaggacgagaagatgttagagatcgaccacatctacccatactcccgcagcttcgacgactcctacatgaacaaggtgctggtgttcaccaagcagaaccaggagaagctcaaccagacccccttcgaggccttcggcaacgacagcgcgaagtggcagaagatcgaggtcctggcaaagaacctacccaccaagaagcagaagcggatcctcgacaagaactacaaggacaaggagcagaagaacttcaaggaccgcaacctgaacgacacacggtacatagctcgcctggtgctcaactacaccaaggactacctggacttcctgccgctctccgacgacgagaacaccaagctgaacgacacccagaaggggagcaaggtgcacgtcgaggccaagtccggcatgctgacgagcgctctccggcacacctggggcttctccgccaaggaccgcaacaaccacctccaccacgccatcgatgcggtgataatcgcctacgccaacaacagcatcgtcaaggccttctccgacttcaaaaaggagcaggagagcaacagcgcggagctgtacgccaagaagatctccgagctggactacaagaacaagcggaagttcttcgagcccttcagcggtttccgccagaaggtgctggacaagatcgacgagatcttcgtgtccaaacccgagcggaagaagcccagcggtgccctgcacgaggagaccttccgtaaagaggaggagttctaccagtcctacgggggcaaggagggggtcctcaaggcgctggagctgggcaagatccggaaggtgaacgggaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttttgcttctccctctacaaggacagcctgatcctgatccagaccaaggacatgcaagagcccgagttcgtgtactacaacgccttcacctcctcaaccgtgtccctcatagttagcaagcacgacaacaagttcgagacgctgtccaagaaccagaagatcctgttcaaaaacgcaaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8239 - RNA, 3841 nt, synthetic construct
  misc_feature 1..3841: note = Cas9 variant mRNA product
  source 1..3841: mol_type = other RNA
ggggcgctgcctacggaggtggcagccatctccttctcggcatcaagcttaccatggcccccaagaagaagcgcaaggtgggcatccacggggtcccggccgcgtcggacctagttctcggcctggacatcgggattggctccgtgggggtcgggatcctgaacaaggtgaccggcgagatcatccacaagaacagccggatcttccccgccgcccaggccgagaacaacctagtgcgccggacgaaccgccagggccggcgcctggcccggcgcaagaagcaccggcgcgtccggctgaaccgcctcttcgaggagtccggcctgatcacggacttcaccaagatcagcataaacctgaacccctaccagttacgggtgaaggggctgaccgacgaactgtccaacgaggagctgttcatcgcgctgaagaatatggtgaagcaccgcggcatcagctacctggatgacgcctccgacgacgggaacagctccgtcggcgattacgcccagatcgtgaaggagaatagcaagcagctcgagaccaagacgcccggacagatccagctggagcggtaccagacctacgggcagctgcgcggcgatttcaccgtggagaaagacgggaagaagcaccgactcatcaacgtcttcccgacctccgcctaccgaagcgaggcgctgcggatcctgcaaactcagcaggagttcaacccccagatcaccgatgagttcatcaaccgctacctcgagatcctgaccggcaagcggaagtactaccacggccccgggaacgagaagtcccgcaccgactacggccgctatcggacgagcggggagaccctggacaacatcttcggcatcctcatcgggaagtgcaccttctaccccgacgagttccgcgccgccaaggcctcctacaccgcccaggagttcaaccttttaaatgacctcaacaacctgacggtgccgaccgaaaccaagaagctcagcaaggagcagaagaaccagatcatcaactacgtgaagaacgagaaggctatgggccccgccaagctgttcaagtacatcgccaagctcctgtcctgcgacgtcgccgacatcaagggctaccggatcgacaagagcgggaaggccgagatccataccttcgaggcgtaccgcaagatgaagacgctcgagaccctggacatcgagcagatggacagagagaccctggacaagctcgcctacgtactgaccctgaacacggagcgcgagggcatccaggaggccctcgagcacgagttcgccgacgggtccttcagccagaagcaggtcgacgagctggtgcagttccggaaggccaacagctccatcttcggcaaagggtggcacaactttagcgtgaagctgatgatggagctcatccccgagctgtacgagaccagcgaggagcagatgaccatcctgacccgcctcggcaagcagaagacaaccagctccagcaacaagactaagtacattgacgagaagctgctgaccgaggaaatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgcctcacagcgtgttccacggccacaagcagctggccaccaagatccggctgtggcaccagcagggcgagcgctgcctctataccggcaagaccatctccatccacgacctgatcaacaacagcaaccagttcgaggtcgaccacatcctgcccctctccatcacgttcgacgacagcctggccaacaaagtgctggtgtacgcgaccgccaaccaggagaaggggcagcggacgccctaccaggccctggactccatggacgacgcctggtcgttccgcgagctgaaggccttcgtccgggagtccaagaccctgagcaacaagaagaaggagtacctcttgaccgaggaggacatctccaagttcgacgtgcgcaagaagttcatcgagcggaacctcgtggacacgcgctacgcgagccgggtcgtgctcaacgccctgcaggagcacttccgcgcccataaaatcgacaccaaggtgtccgtggtgcgcggccagttcaccagccagttaagacgccactggggcatcgagaagacccgggacacgtaccaccaccatgcagtggacgccctcatcatcgcggcctcctcccagctgaacctgtggaagaagcagaagaacaccctcgtcagctactccgaggaccagctgctggacatcgagaccggggagctcatcagcgacgacgagtacaaggagtccgtgttcaaggccccctaccaacatttcgtggacaccttaaagagcaaggagttcgaggattccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctcgagaactaccccaacaagcagatcaacgagaagggcaaggaggttccctgcaacccgttcctcaagtacaaggaggagcacgggtacatccggaaatacagcaagaagggcaacgggcccgagatcaagtccctgaagtactacgacagcaagctgggcaaccacatcgacattacccccaaagactccaacaacaaggtggtcctccagagtgtgtccccctggcgcgccgacgtgtacttcaacaagaccaccgggaagtacgagatcttgggcctgaaatacgcggacctccagttcgagaagggcacggggacctacaagatcagccaggagaagtacaacgacatcaagaagaaagagggcgtcgacagcgactccgagttcaagttcaccctgtacaagaacgacctgctcctggtgaaggacaccgagacgaaggagcagcagctgttccggttcctcagccgcaccatgccaaagcagaagcactacgtggagctaaagccctacgacaagcagaagttcgagggcggagaggccctgatcaaggtcctcgggaacgtggccaactccggccagtgcaagaagggactgggcaagagcaacatctccatctacaaggtgcggaccgacgtcctggggaaccaacacatcattaagaacgagggggacaaacccaagctcgacttcaagcgccccgccgccaccaagaaggcgggccaggccaagaagaagaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8240 - RNA, 4399 nt, synthetic construct
  misc_feature 1..4399: note = Cpf1 variant mRNA product
  source 1..4399: mol_type = other RNA
ggggcgctgcctacggaggtggcagccatctccttctcggcatcaagcttaccatggcccccaagaagaagcgcaaggtgggaatccacggcgtcccggccgcgacccagttcgagggcttcaccaacctgtaccaggtgagcaagacgctccggttcgagctgatcccccaggggaagaccctgaaacacatccaggagcagggcttcatcgaggaggacaaggcccgcaacgaccactacaaggaactcaaacccatcatcgaccggatctataagacctacgccgaccagtgcttgcagctggtgcagctcgactgggagaatctgtccgccgccatcgacagctaccgcaaggagaagaccgaggagacccgtaacgcgcttatcgaggagcaggccacctaccgcaacgctattcatgactacttcatcgggcggaccgataacctcaccgacgccataaacaagcgccacgctgaaatctacaagggcctcttcaaggccgagctattcaacggcaaggtactaaagcagttagggacggtgaccaccaccgagcacgagaatgccctactccggtccttcgacaaattcacgacctacttctcaggcttctacgaaaaccgcaagaacgtgttcagcgcagaggacatcagcaccgcaatcccccaccggatcgtccaggacaatttcccgaagtttaaggagaactgccatatcttcacccgtctgatcacggcggtgccgtccctgcgggaacacttcgaaaacgtgaagaaggccatcggaatttttgtcagcacctccatcgaggaggtgttcagtttccccttctacaaccagttgctgacccagacccagatcgacctgtacaaccagctcttgggcgggatctctcgcgaggccggcacggagaagataaagggcttaaatgaggtgctcaacctggccatacagaagaacgacgagacagcccacatcatagcgagcctgccccaccggttcatcccgttattcaaacagatcctgtctgaccgtaacacccttagcttcatcctcgaggagttcaagagtgacgaagaggtcatccagtcgttctgcaaatacaagacccttctgcggaacgagaatgtgctcgagacggccgaggcccttttcaacgaactgaactccatcgacctcacccacatcttcatcagccacaagaaactcgagaccatcagcagcgccctgtgcgaccactgggacaccctccgcaacgccctgtacgagcggcgcatcagtgagctgacgggcaagatcaccaagtccgcgaaggagaaggtgcagcggagcctcaagcatgaagacatcaacctgcaggagatcatctccgccgccggcaaggagctgagtgaggccttcaagcaaaagacctcagaaatcctatcccacgctcatgcggccctggaccagccgttgcccaccacgctcaagaagcaagaagagaaggagatcctgaaatcccagttagacagcctgctcgggctgtaccacctcctcgactggttcgcagtcgacgaatccaacgaggtggaccccgagtttagcgcccgcctgaccggcattaaactggagatggagccgtccctcagcttctacaacaaggcgcgcaactacgccaccaagaagccctactccgtggagaagttcaagctgaacttccagatgcccacgctggccagcggctgggatgtaaacaaggagaagaacaatggggccatactcttcgtgaagaacggcctgtactacctggggatcatgcctaagcaaaagggccggtacaaggccttatccttcgagcccacggagaagaccagcgaagggttcgacaagatgtactacgactacttccccgacgcggccaaaatgatccccaagtgctccacacagctgaaagcagtgaccgcccacttccagacccacacgaccccgattctgttgagtaacaacttcatcgagccgctggagatcaccaaagagatctacgatctgaacaaccccgagaaggagcccaaaaagttccagaccgcctatgcgaaaaagacgggagaccagaaaggctaccgcgaggccctgtgcaagtggatcgacttcacccgggatttcctatccaagtacaccaagaccacgagcatcgacctgagttcactccggccaagctcccagtacaaagatctgggggagtactacgccgagctgaatccgctcctgtatcacatctcattccaacggatcgccgagaaagagatcatggacgccgtagagacgggcaagctctacctcttccagatctacaacaaggacttcgcgaagggacaccacggcaagcctaacctgcacacattgtactggaccggcctcttctcccccgagaacctcgccaagacgagcatcaagctgaacgggcaggccgagctgttctacaggcccaagagccggatgaagcgcatggcccacaggctgggtgagaagatgctgaacaagaagctaaaggaccagaagaccccgatccccgacaccctgtaccaagagctgtatgactacgtgaaccatcgcttaagccacgacctctccgacgaggcgcgtgccttactccccaacgtgatcaccaaggaggtcagccatgagatcatcaaggaccgcagattcacgtccgacaagttcttcttccacgtgccgatcacactgaactaccaggccgctaacagcccctccaagttcaaccagcgcgtcaacgcctacctaaaggagcaccccgagacgcccatcattgggatagaccggggcgagcgcaacctgatctatatcaccgtgatcgacagcacggggaagatcctggagcaacgatccctgaacaccatccagcagttcgactaccagaagaaactcgacaaccgcgaaaaagagcgggtggcggcacgccaggcctggagcgtcgtgggcaccatcaaggacctgaagcaggggtacctgagccaggtgatccacgagatcgtcgacctcatgattcactaccaggccgtcgtggtcctggagaacttaaacttcggcttcaaatcgaaacgcaccggcatcgccgagaaagcggtgtaccagcagttcgagaagatgctcattgacaagttaaactgcctggtgctaaaagattacccggccgagaaggtcggaggcgtgctgaacccctaccagttgacggaccagttcaccagcttcgccaagatgggcacccagtctggcttcctcttctacgtgcccgccccctacaccagcaagatcgacccgctgacggggttcgtagaccccttcgtttggaagaccatcaagaaccatgagagtcggaagcacttccttgaggggtttgacttcctccactatgatgtgaagactggcgatttcatcctgcacttcaagatgaaccgcaacctgagcttccagcgggggctccccggtttcatgcccgcctgggacatcgtcttcgagaagaatgagacccagttcgacgcgaaggggacgcccttcatcgccggcaagcgcatagtccctgtgatcgagaaccaccggttcaccggccgctaccgggatctgtaccccgcaaacgagctgatcgccctcctggaggagaaggggatcgtctttcgagacggctccaacatcctgcccaagttgttagagaatgacgacagccacgcaatcgacaccatggtggccctgattcggtccgtgctccagatgcgcaacagcaacgcggccaccggggaggactacatcaactccccggtccgggacctgaacggcgtgtgctttgatagccgcttccagaaccccgagtggcccatggacgccgacgcgaacggggcctaccatatcgccctgaagggacaactcttgctgaaccacctcaaggagtctaaggacctcaagctgcaaaacggtatcagcaaccaggactggctcgcctatatacaagagctgcggaacaagcgccccgccgcgactaaaaaggctgggcaggccaagaagaagaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 8241 - RNA, 4378 nt, synthetic construct; identical to SEQ ID NO: 2441
  misc_feature 1..4378: note = Cpf1 variant mRNA product
  source 1..4378: mol_type = other RNA

SEQ ID NO: 8242 - RNA, 4484 nt, synthetic construct
  misc_feature 1..4484: note = Cas9 variant mRNA product
  source 1..4484: mol_type = other RNA
gggagagtcccgcagtcggcgtccagcggctctgcttgttcgtgtgtgtgtcgttgcaggccttattcaagcttaccatggcccccaagaagaagcgcaaagtgggaatccacggggtgccggcggcggacaagaagtacagcatcggcctggacatcgggaccaactcagtgggctgggccgtaatcaccgacgaatacaaagtccccagcaagaagttcaaggtgctggggaacacggaccggcattccatcaagaagaacctgatcggtgccctgctgttcgactcgggcgagaccgccgaggccacccgcctgaagcgaaccgcgcgccggcgctacacgcggcgcaagaaccggatctgttacctgcaggagatcttctccaacgagatggccaaggtggacgacagcttcttccaccgcctcgaggagtccttcctggtcgaggaggacaagaagcacgagcggcaccccattttcgggaacattgtggacgaagtggcctaccacgagaagtaccccaccatctaccaccttcgcaagaagctcgtcgacagcaccgacaaggccgacctgcggctgatttacctcgcgctggcccacatgatcaagttccgcggccacttcctgatcgagggggacctcaacccggacaactccgacgtggacaagctgttcatccaactggtgcagacctacaaccagctgttcgaggagaaccccatcaacgccagcggcgtcgacgccaaagccatcctgtccgcgagacttagcaagagtcgcaggctcgagaacctgatcgcccagcttcccggggagaagaagaacggcctattcggcaacctgattgccctgagcctcggactgacacccaacttcaagtccaacttcgatctggccgaggatgccaaactccagttgagtaaggacacctacgacgacgacctggacaacctcctggcgcagatcggcgaccagtacgccgacctgttcctcgccgccaagaacctgtctgacgccatcctgctcagcgacatcctgcgcgtgaacaccgaaatcaccaaggcgccgctgtccgcctcaatgatcaagcggtacgacgagcaccaccaggatctcacgctgctgaaggcgctagtgcgccagcagttgcccgagaaatacaaggagatcttcttcgaccagagcaaaaacgggtacgctggctacatcgacggcggggcctcccaggaggagttctataagttcatcaagcccatactggagaagatggacggcaccgaggagttactggtcaagctgaaccgggaggacctgctccgcaagcagcgcaccttcgacaatgggagcatcccccaccagatccacctgggcgagctgcacgcgatcctccggcgccaggaggacttctacccgttcctgaaggacaaccgggagaagatcgagaagatcctcacctttcgcatcccctactacgtggggcccttggcccggggcaactcccgcttcgcctggatgacgcgcaagagcgaggagaccatcactccctggaatttcgaggaggtggtcgacaagggcgccagtgcgcagagcttcattgagaggatgaccaactttgacaagaacctgccgaacgagaaggtgctgcccaagcactccctcctgtacgagtacttcacggtgtataacgaactcaccaaggtcaagtacgtgaccgaggggatgcggaagcccgctttcctcagcggcgagcagaagaaggccatcgtggacttgctgttcaagaccaaccgcaaggtcacggtgaagcagctcaaggaggattacttcaagaagatcgagtgcttcgactccgtcgagatcagcggggttgaggaccggttcaacgcctccctgggcacctaccacgacctgctcaaaatcatcaaggacaaggactttctggacaacgaggagaacgaggacatcctggaggacattgtgctcaccctgaccctgttcgaggaccgcgagatgatagaggagcggctcaagacgtatgcccacctgttcgacgacaaggtcatgaagcaactgaagcgtcggcgctacaccgggtggggccggctcagccgcaagttgatcaacggaatccgagataaacagagtgggaagacaatcctggacttcctaaagagcgacggctttgcaaaccgcaacttcatgcagctgatccacgacgactccttgaccttcaaggaggacatccagaaggcccaagtatctgggcagggagactccctccacgagcacatcgccaacctggccgggtcccccgccatcaagaagggcatcctgcagacggtgaaggtcgtggacgagctagtcaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaagagcaccccgtggagaacacccagctccagaacgagaagctctacctgtactaccttcagaacggccgggatatgtacgtcgaccaggagctggacattaacaggctgagcgactatgacgtggaccacatcgtgccccagtccttcctcaaagacgacagcatcgacaacaaggtcctgacacggtccgacaagaaccggggcaagagcgacaacgtgccctccgaggaggtagtcaagaaaatgaaaaactattggagacagctgctcaacgctaagctgatcacccagcgcaaattcgacaacttgaccaaagccgaacgcgggggcctcagcgagctagacaaggccgggttcatcaagcggcagctggtggagacccggcagatcaccaagcacgtagcccagatcctcgactccaggatgaacacgaagtacgacgagaacgacaaactgatccgggaggtcaaggtgatcaccctcaagagcaaacttgtgtccgacttcagaaaggacttccagttctataaggttagggagatcaacaactaccaccacgcgcacgacgcatacctgaacgccgtggtgggcaccgccctgatcaagaagtacccgaaacttgagagcgagttcgtctacggggactacaaggtgtacgacgtgcgcaagatgatcgcgaagtccgagcaggagatcggaaaggctaccgccaagtacttcttctacagcaacatcatgaacttcttcaagacggagatcaccctggcaaacggcgaaatccggaagcgccccctaatcgaaacgaacggagagaccggcgaaatcgtctgggacaaggggcgggacttcgccacggtgcgcaaggtgctctccatgccccaggtcaatatcgtaaagaagaccgaggtgcagaccggcgggttcagcaaggagtccatcctgcccaagcgcaacagcgataagttaatcgcgcgtaagaaggactgggacccgaagaagtacggcggcttcgactcccccaccgtcgcgtacagcgtgctggtggtcgccaaggtggagaagggcaagagcaagaagttaaagtccgtgaaggagctgctcggtatcacgatcatggagcgcagttccttcgagaagaaccccatcgatttcctggaggccaagggatacaaggaggtcaagaaggacctgatcatcaagctccccaagtacagcctgttcgagctggagaacggccggaaacgcatgctcgcctccgcgggggagctgcagaagggcaacgaactggccctccccagcaagtacgtgaacttcctgtacctggcctcccactatgagaagttaaaaggcagccccgaggacaacgaacagaagcagctgttcgtggagcagcacaagcattatctggacgagatcatcgagcagatatccgagttcagcaaacgggtgatcctcgccgacgccaacctcgacaaggtgctctccgcgtacaacaagcaccgtgacaagcccatccgggagcaggccgagaacatcatccacctcttcaccctgaccaaccttggggcccctgccgcgttcaagtacttcgacaccacgatcgaccggaagcggtacaccagcaccaaggaggtgttagacgcgaccctgatacaccagagtatcacgggcctgtacgagacccgcatcgatctcagccagctcgggggcgataagcggcccgccgccaccaagaaggccgggcaggcgaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8243 - RNA, 5267 nt, synthetic construct; identical to SEQ ID NO: 2443
  misc_feature 1..5267: note = Cas9 variant mRNA product
  source 1..5267: mol_type = other RNA

SEQ ID NO: 8244 - RNA, 3539 nt, synthetic construct
  misc_feature 1..3539: note = Cas9 variant mRNA product
  source 1..3539: mol_type = other RNA
gggagagtcccgcagtcggcgtccagcggctctgcttgttcgtgtgtgtgtcgttgcaggccttattcaagcttaccatggcccccaagaagaagcgcaaagtgggcatccacggggtcccggccgcgaagcggaactacatcctgggcctcgacatcgggatcaccagcgtgggctacgggatcatcgactacgaaacccgcgatgttatcgacgccggcgtccggctgttcaaggaggccaacgtggagaacaacgaaggccgccggtccaagcgcggggcccggcgcctgaagcggcgccggcgccaccggatccagcgcgtgaagaagctcctgttcgactacaacctgctcacggaccacagcgagctgtcgggcatcaacccctacgaggcccgggtcaagggtctcagccagaagctctccgaggaggagttcagcgcggccctgctgcacctcgccaagcgcaggggcgtgcacaacgtgaacgaggtcgaggaggacaccgggaacgagctctccaccaaggagcagatcagccgcaactccaaggccctggaggagaagtacgtggcggagctccagctcgagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaagacatcaaggagtggtacgagatgctgatgggccattgcacctacttcccggaggagctccgaagcgtgaagtacgcctacaacgccgacctgtacaacgcgctcaacgacctcaacaacctggtcatcacgcgcgacgagaacgagaagctggagtactacgagaagttccagatcatcgagaacgtgttcaagcagaagaagaagcccaccctcaagcagatagccaaggagatcttggtgaacgaggaggacatcaaggggtaccgggtcacctccaccggcaagcccgagttcacgaacctaaaggtgtaccacgacatcaaggacatcaccgcccgcaaggagatcatcgagaacgccgagctcctggaccagatcgccaaaatcctgaccatctaccagagctccgaggacatccaggaggagctcaccaacctgaacagcgagctgacacaggaggagatcgagcagatctccaacctcaaggggtacaccggcacccacaacctgagcctgaaggcgatcaacctcatcctggacgagctgtggcacaccaacgacaatcagatcgccatctttaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctacccaacgacataatcatcgagctggcccgggagaagaacagcaaggacgcccagaagatgatcaacgagatgcagaagcgcaaccggcagaccaacgagcgcatcgaggaaatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtggaccacatcatcccccgcagcgtgtccttcgataacagcttcaacaacaaggtgctggtcaagcaagaggagaactccaagaaggggaaccggacccccttccagtacctgagctccagcgactccaagatcagctacgagaccttcaagaagcacatcctcaacctggccaagggcaaagggcgcatctccaagaccaagaaggagtacctgctcgaggaacgggacattaaccgcttcagcgtgcagaaggacttcatcaaccggaacctggtggacacgcgctacgccacccggggcctgatgaacctcctgcgctcctactttcgcgtcaacaacctggacgtgaaggtcaagagcatcaacgggggcttcacctccttcctcaggcgcaaatggaagttcaagaaggagcggaacaagggctacaagcatcacgccgaggacgcgctgatcattgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcatatcaaggacttcaaggactacaagtacagccatcgcgtggacaagaagcccaatcgggagctcatcaacgacacactgtactccacccgcaaggacgacaaggggaacaccctgatcgtgaacaacctcaacggcctgtacgacaaggacaacgacaagctgaagaagctcatcaacaagagccccgagaagctcctgatgtaccaccacgacccccagacttaccagaagctcaagctgatcatggagcagtacggggacgagaagaacccgctgtacaaatactacgaggagaccggcaactacctcaccaagtactccaagaaggacaacgggcccgtcatcaagaagatcaagtactacggcaacaagctgaacgcccacttggacatcaccgacgactaccccaacagccggaacaaggtggtgaagctctccctgaagccctaccgcttcgacgtctacctggacaacggcgtgtacaagttcgtcaccgtcaagaacctcgacgtgatcaagaaggagaactactacgaggtgaacagcaagtgctacgaggaggctaagaagctgaagaagatctccaaccaggccgagttcatcgccagcttctacaacaacgacctgatcaagatcaatggtgagctctaccgggtcatcggcgtgaacaacgacctgctgaaccgcatcgaggtgaacatgatcgacatcacgtatcgggagtacttagagaacatgaacgacaagcgcccgcccagaatcatcaagaccatcgcgtccaagacccagagcatcaagaagtactcaaccgacatcctggggaacctgtacgaggtaaagagcaagaagcacccccagatcatcaagaagggcaagcgccccgccgccacgaagaaggccggtcaagccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8245 - RNA, 4607 nt, synthetic construct
  misc_feature 1..4607: note = Cas9 variant mRNA product
  source 1..4607: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgctgttcaacaagtgcattatcatcagcatcaacctggacttctccaacaaggagaaatgcatgaccaagccctacagcataggcctggacatcgggacgaactccgtgggctgggccgtgatcacggacaactataaggtccccagcaagaagatgaaggtgctggggaacacttccaagaagtacattaagaagaacttactgggcgtgctgctgttcgacagcggcatcaccgccgaggggcggcgcctgaagcggaccgcgcgccggcgctacacgcggcgccggaaccgcatcctgtacctccaggagatcttctctaccgagatggccaccctggacgacgcgttcttccagcggctggacgacagcttcctcgtgcccgacgacaagcgcgactccaagtacccgatcttcggcaacctggtggaggagaaggtgtaccacgacgagttccccaccatctaccacctccggaagtacctcgccgacagcacgaagaaggccgacctgcgcctcgtctacctcgccttagcgcacatgattaagtaccggggccacttcctgatcgagggcgagtttaactccaagaacaacgacatccaaaagaacttccaggacttcctcgacacctacaacgccatcttcgagagcgacctgtccctggagaacagcaagcagctcgaggagatcgtgaaggacaagatttccaagctggagaagaaggaccgcatcctgaagctgttccccggggagaagaacagcggcatcttctctgagttcctgaagctgatcgtgggcaaccaggctgacttccggaagtgcttcaacctcgatgagaaggcaagccttcacttctccaaggagagctacgacgaggacctggagaccctcctgggatacatcggcgacgactatagcgatgtcttcctgaaggctaagaagctctacgacgcgatcctgctgtccgggtttctcaccgtgacggacaacgagaccgaggcgcccctgagctccgccatgatcaagcgctacaacgagcacaaggaggacctcgccctcctgaaggagtacatccggaacatcagcctgaagacctacaacgaggtgttcaaagacgacaccaagaacggatacgccggctacattgacgggaagacgaaccaggaggacttctacgtatacctcaagaacctgctggccgagttcgagggcgccgactatttcctcgagaaaatcgaccgcgaggacttcctgcgcaagcagcgcaccttcgacaacgggtccatcccgtaccagatccaccttcaggagatgcgcgccatcctggacaagcaggccaagttctaccctttcctagccaagaacaaggagcggatcgagaagatcctgaccttccgcatcccctactatgtgggcccgctggcgcgggggaacagcgacttcgcttggtccatccgcaagcggaacgagaagatcaccccgtggaacttcgaggacgtgatcgacaaggagagctccgctgaggccttcatcaaccgcatgacgagcttcgacctctacctgcccgaggagaaggtcctgcctaagcactccctcctgtacgagaccttcaacgtgtacaatgagctgaccaaggtgcggttcatcgccgagagcatgcgcgactaccaattccttgactccaagcagaagaaggacatcgtccggctttacttcaaggacaagcgcaaggtgaccgacaaggacatcatcgagtacctgcacgcgatctacggctacgacggcatcgaactcaaggggatcgagaagcagttcaacagcagcctgagcacgtaccacgacctgctcaacatcattaacgacaaagagttcctggacgactccagcaacgaggctatcatcgaggagatcatccacaccttaaccatcttcgaggaccgggagatgatcaagcaacgcctctccaagttcgagaacatcttcgacaagagcgtgctgaagaagctgagccgtcgccactataccggctgggggaagctctccgccaaacttatcaacggcatccgggacgagaagtccgggaatacaatcctggactacctcatcgatgacggcatcagcaatcgcaacttcatgcagctgatccacgacgacgccctgagcttcaagaagaagatccagaaggcgcagattatcggcgacgaggacaagggtaacatcaaggaagtcgtgaagtccctccccggcagcccggccatcaagaagggaatcctgcagtccatcaagatcgtagacgagctggtgaaggtgatgggcgggcggaagcccgagagcatcgtcgtggagatggcccgagagaaccagtacaccaaccagggcaagtccaacagccagcagaggctcaagcgcctggagaagtcactgaaggagctcggcagcaagatcctgaaggagaacatccccgccaagctgagtaagatcgacaacaacgccctacagaacgaccgcctgtatctgtactacctccagaacgggaaggacatgtataccggagacgacctggacatcgaccggctgagcaactacgacatcgaccacataatcccccaggcgttcctcaaggacaactccatcgacaacaaggtgctggtcagctccgccagcaaccgcggaaagtccgacgacttcccgagcctggaggtggttaagaagcggaagactttctggtaccagttgctcaagagcaagctgatttcccagcgcaagttcgacaacctgacgaaggccgaacggggcggcctgctgcccgaagacaaggcaggcttcatccaacgccagctcgtcgaaacccggcaaatcaccaaacacgtggcccgcctgctggacgagaagttcaacaacaagaaggacgagaacaaccgggcggtgaggaccgtaaagatcatcacgctcaagagcaccctggtgtcccaattccggaaagacttcgagttgtacaaggtgcgcgagatcaacgacttccaccatgcccacgacgcctacctcaacgccgtcatcgccagcgcgctgctgaagaagtaccccaagctcgagcctgagtttgtgtacggcgactacccgaaatacaactccttccgtgagcgcaagagcgccaccgagaaggtgtacttctattccaatatcatgaacatcttcaagaagtccatctccctggctgacgggcgggtgatcgagcgccccctgatcgaagtgaacgaggagacgggcgagagcgtgtggaacaaggagtccgacctcgccaccgtccggcgcgtgctgagctacccccaggtgaacgtcgtaaagaaggtggaggaacagaaccacgggctggaccggggcaagcccaagggcctcttcaacgcgaacctgtccagcaagccgaagcccaactccaacgagaacctggtcggggccaaggaatacctcgaccccaagaagtacggcgggtacgccggcatcagcaactccttcgccgtgctggtcaaggggacgatcgaaaagggagccaagaagaagatcaccaacgtcctggagttccagggcatcagcatcctcgaccgcatcaactaccggaaagacaagctgaacttcctgttagagaaggggtacaaggacatcgagctgatcatcgaactgccgaagtactcactcttcgagctgtccgacggcagccgccggatgctcgcgtcgatcctcagcaccaacaataagcgtggggagatacataagggcaaccagattttcctgtcccagaagttcgtgaagctgctctaccacgccaagcggatcagcaacaccatcaacgagaaccaccgaaaatacgtggagaaccacaagaaggagttcgaggagctgttctactacatcctggagttcaacgagaactacgtcggtgccaagaagaacggaaagctcctgaacagtgccttccagagctggcagaaccattcgatcgacgagctatgcagctccttcatcggccccacggggagcgagcgcaagggcctcttcgagctaacatcccgggggagcgccgcagactttgagttcctgggcgtgaagataccccgctaccgggactacaccccctccagcctcctgaaagacgccaccctgatccaccagtccgtgacggggctgtacgagacccgcatcgacctcgccaagctgggcgagggcaagaggccggccgccaccaagaaggcagggcaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8246 - RNA, 3683 nt, synthetic construct
  misc_feature 1..3683: note = Cas9 variant mRNA product
  source 1..3683: mol_type = other RNA
gggagagtcccgcagtcggcgtccagcggctctgcttgttcgtgtgtgtgtcgttgcaggccttattcaagcttaccatggcacccaaaaagaaacgcaaagtaggaatacacggagtgccggcagcatggtacgcgagccttatgagcgcccaccatctacgcgttggaatcgacgtaggcacccacagcgtaggactagccacactccgagtagacgaccacggaaccccaattgaattactatcggcactgagccacatccacgatagtggagtcgggaaagaaggaaagaaagaccacgacacacgaaagaaactgtcaggaatagcaagacgcgctcgaagactattacaccaccgacgaacacagctccaacaactagacgaagtcctacgagatctaggcttcccaatcccaacaccgggagagttcctagacttaaacgaacaaaccgacccataccgcgtgtggcgagtccgagcacgactcgtggaagagaaactcccagaggaattacgcggaccagccataagcatggcagtgaggcacatcgcccgacaccgagggtggaggaacccgtatagtaaagtagaatccctactaagccccgccgaggaaagcccattcatgaaagcactccgcgaacgaatcctcgcaaccaccggcgaagtactagacgatggcataacgccgggccaagctatggcccaagtcgcactgacccataacatctcaatgcgcggaccagaaggcatactaggaaaactacaccaatccgataacgcaaacgaaatccggaaaatatgtgcccgccagggggtcagccccgacgtttgcaaacagctactccgggccgtattcaaagccgactcacctagaggcagcgccgtgagtagagtagcacccgatccccttcccggtcaggggagcttccgcagagccccaaaatgcgacccagagttccagcgcttccgaataatatccatagtggcaaacctgcgaatatctgaaacgaaaggcgaaaacagaccactaaccgccgacgaacgcagacacgtcgtcaccttcctaacggaagacagtcaagccgatcttacttgggtggacgtcgcagaaaaactcggagttcaccgccgggacttaaggggaacagccgtacacaccgacgacggagaaagaagtgccgcccggcccccaatcgacgcaacggatagaatcatgagacagaccaaaatcagttccctcaaaacgtggtgggaagaagccgacagcgaacagagaggcgcaatgatcaggtacctgtacgaagacccaaccgattctgaatgcgcagaaatcatagctgaactcccagaagaagatcaagccaaactagactccctacacttacccgcaggacgcgccgcatacagcagagagagtctaacagccttaagcgaccacatgctcgcgacaaccgacgacctccacgaggcacgaaaacgccttttcggcgttgacgacagctgggccccacccgccgaagcaatcaacgcccccgtcgggaacccctcggtggaccgcacattaaaaatagtagggcgatacctctcagcagtcgaatctatgtggggcacgccagaagtcattcacgtagagcacgtccgagacgggttcacgagcgagcgcatggccgacgaacgagacaaggcaaaccgacgaagatataacgacaaccaagaagcaatgaagaaaatccagagagactacggaaaagaaggctacatatccagaggggacatagtaaggctggacgccctcgaactccagggatgtgcctgtctctactgcgggacaacaattggataccacacgtgccaactagaccacatcgtaccccaggcaggaccaggaagcaacaaccgccgagggaacctagtcgctgtatgcgaaagatgcaaccgctcgaaatcaaacaccccctttgcagtttgggcccaaaaatgcggcatcccccacgtcggagtaaaggaagcgatcggcagagtcaggggctggagaaagcaaacaccaaacacatcaagcgaagatcttacaaggctaaagaaggaggtcatcgcacgactaagacgaacacaggaggacccagaaatcgacgaaaggtccatggagagcgtagcctggatggcaaacgaactccaccacagaatcgcggccgcatacccagagacaaccgttatggtctatagaggtagtatcacagcggctgcacggaaagccgccggaatagactcccgcatcaatcttataggagagaagggacgaaaagacagaatcgaccgccggcaccacgccgtggatgcctccgtcgtcgcgctaatggaggcaagcgtcgcaaaaacactagccgaacgcagcagcctgcgcggcgaacagcgcctaaccggaaaagaacagacctggaaacaatatacaggcagtaccgtaggagccagagaacacttcgaaatgtggagaggccacatgctccacctcacggaactgttcaatgaaagactagccgaagacaaagtttacgtaacacagaacatacgcctgcgactcagcgacggcaatgcacacaccgtcaaccccagcaaactcgtatcacaccgactcggcgacggactcacagtacaacaaatcgaccgcgcgtgcactccagccctgtggtgtgccctaacccgagaaaaagacttcgacgagaaaaacggcctaccggcacgagaagaccgggccatccgagtgcatgggcacgaaataaaatcgtcagactacatacaagtgttctccaaaagaaagaaaaccgactcagaccgagatgagacaccgttcggagcaatagcggtacgtggagggttcgtcgagatcggacccagcatccaccacgccagaatatacagagtagaaggaaagaaaccagtctacgcaatgctcagggtgttcacacatgacctcttaagccagcgacatggcgacctatttagcgcggtgataccaccacaaagtatcagcatgagatgcgcggaacccaaactccgcaaagcgataacaacgggaaacgccacatatctagggtgggtcgtagtgggcgacgagcttgaaataaacgtagacagtttcaccaaatacgctattggacgcttcctcgaagacttcccaaacacaacacgatggcgcatctgcggttacgatacaaactcaaaactcacgctgaagccaatcgtcctggccgccgaaggactcgaaaacccgtcctcagccgtcaacgagatcgttgaactgaagggatggagagtagcgatcaacgtcctcacaaaagtccacccaacagtagtccgacgcgacgcactaggacgaccgcgctatagttcgagatcaaacctaccaacaagctggacgatcgagaaacgcccagccgcaacaaagaaagccggacaagcgaagaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8247 - RNA, 4544 nt, synthetic construct
  misc_feature 1..4544: note = Cas9 variant mRNA product
  source 1..4544: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtccctgccgcgaccaagccctacagcatcggcctggacatcgggaccaactccgtgggctgggccgtgacgaccgacaactacaaggttcccagcaagaagatgaaggtgctcgggaacactagcaagaagtacatcaagaagaacctattaggcgtgctcctgttcgacagcggcatcacggccgaggggcggcgcctgaagcggacggcccgcagacgctacacccggcgccggaatcgcatcctctatctgcaagagatcttctccaccgagatggccaccctagacgacgccttcttccaacggctagacgacagcttcctggtccccgacgacaagcgcgactccaaatacccgatcttcggcaacctggtggaggagaaggcctaccacgacgagttccccaccatctaccacctccggaagtacttggccgacagcaccaagaaggccgacctgcgcctcgtgtacctggcgctggcccacatgatcaagtaccgggggcactttctcatcgagggcgagttcaactccaagaacaacgacatccagaagaacttccaggacttccttgacacctacaacgccatcttcgaaagcgacctgtccttggagaatagcaagcagctggaggagatagtcaaggacaagatctccaagctggagaagaaggaccgcatcctcaagctgttccccggggagaagaacagcggcatcttctccgagttcctgaaactcatcgtgggcaaccaggccgacttccggaagtgcttcaacctggacgagaaggccagtctgcacttctccaaggagagctacgacgaggacctcgagaccctgctggggtacatcggcgacgactactccgacgtgttcctcaaggcgaagaagctgtacgacgccatcctgctcagtgggtttctgacggtcaccgacaacgagaccgaggcgcccctgagctccgccatgatcaagcgctacaacgagcacaaggaggacctcgcactgctgaaggagtacatccggaacatcagcctcaagacctacaacgaggtgttcaaggacgacacgaagaacggctacgccggctacatcgacggaaagaccaaccaggaggacttctacgtgtacctgaagaagctgctcgccgagttcgagggcgcagactacttccttgagaagatcgaccgcgaggacttcctgcggaagcagcgcaccttcgacaacggttccatcccgtaccaaatccacctccaggagatgcgcgccatcctggacaagcaggccaagttctaccccttcctggcgaagaacaaggaacggatcgaaaagatcctgaccttccgcatcccctactacgtcggccctctcgcccgggggaacagcgacttcgcctggtccatccgcaagagaaacgagaagatcacgccttggaacttcgaggacgtgatcgacaaggagagctccgccgaggccttcatcaatcgcatgaccagcttcgatctgtacctccccgaggagaaggttcttcccaagcactcgctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacattatcgagtacctccacgcaatctacggctacgacggcatcgagctgaaggggatcgagaagcagttcaacagctccctgagcacctaccacgacctcctgaacatcatcaacgacaaggagttcctggatgactccagcaacgaagccatcatcgaggagatcatccacaccctcaccatcttcgaggaccgggagatgatcaagcagcgcctgtcaaagttcgagaacatcttcgacaagagcgtgctgaagaagctctcccggcgccactacacgggctgggggaagctgagcgccaagctgatcaacggcatccgggacgagaagtccgggaacaccatcctcgattacctgatcgacgacggcatcagcaaccgcaacttcatgcagctgatccacgacgacgcgctcagcttcaagaagaagatccagaaagcacagatcatcggcgacgaggacaaggggaacatcaaggaggtggtcaagtccctgcccggcagcccggccatcaagaaagggatcctgcagtccatcaagatcgtggacgagctcgtcaaggtgatgggcgggcgaaagcccgagagcatcgtggtcgagatggcccgcgagaaccagtacaccaaccagggcaagtccaacagccagcagcggctgaagcgcctggagaagtccctcaaggagctgggcagcaagatactgaaggagaacatccccgccaagctctccaagatcgacaacaacgcgctgcagaacgaccgcctgtacttgtactacttgcagaacgggaaggacatgtacaccggcgacgacctggacatcgaccggctaagcaactacgacatcgaccacatcatcccccaggccttcctgaaggacaactccatcgacaacaaggtgctggtgagctccgcgagcaaccgcgggaagtccgacgacgtcccgagcctcgaggtggtgaagaaacggaagacgttctggtaccagctgctcaagagcaagctgatctcccagcgcaagtttgacaacctgaccaaagcagagcgtggcggcctgagccccgaggacaaggccgggttcatccaacgccagctcgtcgagacccggcagatcaccaagcacgtggcgcgcctgctggacgagaagttcaacaacaagaaggacgagaacaaccgggccgtgcgcacggtcaaaatcatcaccctcaagtccaccctggtgagccagttccgaaaggacttcgagctgtacaaggtgcgcgagatcaacgacttccaccacgcccacgacgcctacctcaacgccgtggtggcgtccgccctgctgaagaagtaccccaagctcgagcccgagttcgtgtacggcgactacccgaagtacaatagcttccgggaacgcaagtccgccaccgagaaggtctacttctacagcaatatcatgaacatattcaagaagtccatcagcctggccgacgggcgggtgatcgagcgccccctgatcgaggtgaacgaggagaccggcgaatccgtctggaacaaggagagcgacctcgcgacggtgcggcgcgtcctgtcctacccccaggtcaacgtggtgaagaaggtcgaggagcagaaccacgggctggaccgggggaagcccaagggcctcttcaacgccaacctgagctccaagccgaagcccaacagcaacgaaaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgatcgcatcaactaccggaaggacaagctgaacttcctgctcgagaaggggtacaaggacatcgagctgatcatcgagctgccaaagtacagcctcttcgagctgagtgacggctcccgccgcatgctggcgagcatcctctccacgaacaacaagcgcggggagatccacaagggcaaccagatcttcctgagccagaagttcgtgaagctgctctaccacgccaagcggatctccaacaccataaacgagaaccaccggaaatacgttgagaaccacaagaaggagttcgaggagctgttctactacatcctggagttcaacgagaactacgtcggggccaagaagaacgggaagctcctgaacagcgcctttcagtcctggcagaaccacagcatcgacgagctgtgctctagcttcatcggccccacagggtccgagcgcaagggcctcttcgaactgaccagccgggggtccgccgcggacttcgagttcctgggcgtgaagatcccccgctaccgggactacacgcccagctccctcctcaaggacgctaccctgatccaccagagcgtcacggggctctacgagacccgcatcgacctggccaagttgggagagggcaagcggccggccgccacgaagaaggcgggtcaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8248 - RNA, 3626 nt, synthetic construct
  misc_feature 1..3626: note = Cas9 variant mRNA product
  source 1..3626: mol_type = other RNA
gggagagtcccgcagtcggcgtccagcggctctgcttgttcgtgtgtgtgtcgttgcaggccttattcaagcttaccatggcaccgaaaaagaaacgcaaagtgggcatccacggagtaccagccgctgccgccttcaaaccaaacagcataaattatatcctcggcctagatatcggtatcgcctccgtagggtgggccatggtcgagattgatgaagaagaaaacccaatcaggctcatagacctaggcgtacgagtcttcgaacgcgccgaagtcccaaaaacaggagattccctcgctatggcacgaagactagcaagaagcgtgagacgacttacccgccgacgcgcccaccgcctcctccgaactcgtcgcctcctaaagcgcgaaggagtcctccaagccgccaatttcgacgaaaacggtctaatcaaaagcctccccaacacgccatggcaactccgagcagcggccctagaccggaaactaacacccctagaatggtccgctgtcctactgcacctcatcaaacaccgcggatacctaagccagaggaaaaacgaaggagagaccgccgacaaagaactaggcgcgctactgaaaggtgtagcaggcaacgcacatgccctacagacgggtgactttcgaacaccggcagagctcgcacttaacaaattcgaaaaagaatctggacatatccgaaatcaaagatccgactacagccacacattcagccgaaaagatctacaagccgaactcatccttctattcgaaaaacaaaaagagttcggaaatccccacgtatcgggcggactgaaggaagggatcgaaaccctactcatgacacaacggcccgccctatcaggcgatgccgttcagaaaatgctaggccactgcacattcgaaccagccgaaccaaaggcggccaaaaacacctacacagcggaacgcttcatctggttaactaaactgaataacttacgcatactcgaacaaggctctgaacgacccctcacggatacagaacgcgcaaccctaatggacgagccctaccgcaaaagcaaactgacctatgcacaagcgagaaaactcctaggactcgaagacacagccttcttcaaaggtctcaggtacggaaaagataacgccgaggccagcacactcatggaaatgaaagcctaccatgccatcagccgagccctggaaaaagagggcctcaaagataagaaaagccctctcaaccttagccccgaacttcaagatgaaatcggaaccgcatttagcctcttcaaaacagacgaagacatcaccggacgactgaaagaccgcatccaaccagagatactcgaggcgctgctaaaacacatatccttcgacaaattcgtacaaatcagcttaaaggcactacgccggatagtacccctaatggaacaagggaaacgatacgacgaagcatgtgccgaaatatacggtgatcactacggaaagaaaaacactgaagaaaagatctacctcccaccaatacccgccgacgaaataaggaaccccgtagtactacgtgccctctcacaagcacgcaaagtcattaacggagtagtcagaagatatggcagccccgcgcggatccacatcgaaacagcccgcgaagtaggcaaatctttcaaagatcgcaaagaaatcgagaaaagacaagaagagaatagaaaagatcgagagaaagccgccgcaaaattccgagaatatttccccaacttcgtcggtgaaccaaaaagtaaagacatcctcaaactccgcctctatgagcaacagcacggaaaatgcctatacagcggaaaagaaatcaacctcggccggctaaacgagaagggatacgtagaaatagaccacgccctcccattctcgcgaacatgggacgactcttttaataacaaagtcttagtcctcggatcagagaaccaaaacaaaggaaatcaaacgccatacgagtacttcaacggcaaggacaacagcagagaatggcaagagttcaaagcacgagtggaaacctcccgattcccacgctccaagaaacaaagaatcctactccagaaattcgacgaagacgggttcaaagaacgcaacctgaacgatacacggtacgtcaaccgcttcttatgccaattcgtggcggaccgcatgcgcctcacgggaaaaggtaagaaacgggtattcgccagcaacggacagataacgaacctcctccggggattctggggcctccgaaaagtccgggcagaaaacgaccgacaccacgcgctagacgcggttgtcgttgcttgcagcaccgtcgccatgcagcagaaaataaccagatttgtcagatacaaagagatgaacgcctttgacggaaaaactatcgacaaagagacaggcgaagtactacaccaaaagacacacttcccgcaaccatgggagttcttcgcccaagaagtcatgataagggtattcgggaaaccagacggcaaaccagagttcgaagaagcagacaccctagaaaagctccgcaccctactggcagaaaagttgagcagccgccccgaagccgtacacgaatacgtaacaccactcttcgtctcccgagcacccaaccgaaaaatgagcggccaaggccacatggaaaccgtaaaatccgccaagcgcctggacgaaggcgtctccgtactaagagtacccctcacccaactcaagctaaaagacctggagaaaatggttaacagagaaagagaaccaaagctatatgaggccctcaaggcgcgcctcgaggcacacaaagacgacccagcaaaagcattcgctgaacccttctataaatacgataaagccgggaacagaacacaacaggtaaaggccgtccgggtagaacaggtacagaagaccggagtctgggtccgaaaccataatggcatcgcagacaacgcaacaatggtacgcgtcgatgtgttcgaaaaaggcgacaagtactacctagtacccatatacagctggcaggtcgcgaaaggcatcctaccggacagggccgtagtccagggcaaagatgaagaagactggcagctaatcgatgattccttcaactttaaattcagcctacacccaaatgacctcgtagaagtaatcaccaaaaaggcaagaatgttcggatacttcgccagctgccacagaggaaccggaaacatcaacattcggatacacgacctcgatcacaaaataggcaagaatggcatactcgagggcataggggtcaaaaccgcactatccttccagaagtaccaaatcgacgagcttggaaaagaaatccggccctgtcgactgaagaaaaggccaccagttcggaagagaccggccgccaccaaaaaggcaggtcaagccaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8249 - RNA, 4382 nt, synthetic construct
  misc_feature 1..4382: note = Cas9 variant mRNA product
  source 1..4382: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgaagaagccatacaccatcggcctggacatcgggaccaacagcgtgggctgggccgtgctcaccgaccagtacgacctggtcaagcggaagatgaagatcgccggggactccgagaagaagcagatcaagaagaacttctggggcgtgcgcctgttcgacgagggccagaccgccgctgaccggcgcatggcgcggaccgcccgccggcgcattgagcggcgccggaaccgcatcagctacctccagggaatcttcgccgaggagatgtccaagaccgatgccaacttcttctgccggctgagcgactccttctacgttgacaacgagaagcgcaacagccggcaccccttcttcgcgacgatagaggaggaggtcgagtatcacaagaactaccccacaatctaccacctccgcgaggaactcgtgaactccagcgaaaaggccgacctgcgtctagtgtacctcgccctggcccacatcatcaagtaccgcggcaacttcctgatcgagggggccctcgacacccagaacacctccgtcgacggcatctacaagcagttcatccagacgtacaaccaggtgttcgcgtccgggatcgaggacggctcccttaagaagctggaggacaataaggacgtggccaagatcctcgtcgagaaggtgacccggaaggagaagctggagcgcatcttaaagctctacccgggcgagaagtccgccgggatgttcgcccagttcatcagcctaatcgtgggcagcaaggggaacttccagaagcccttcgacctgatcgagaagtccgacatcgagtgcgccaaggactcgtacgaggaggacctcgagtccctgctggcgctcatcggggacgagtacgccgagctgttcgtcgccgccaagaatgcctacagcgcggtggtgctgagtagcatcatcaccgtcgccgagaccgagacgaacgccaagctcagcgcctccatgatcgagcggttcgacacccacgaggaggacctgggcgagctgaaggcattcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaagagaacttcctgcgcaagcagcgcacattcgacaacggggcgattccccaccaactgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgattttggcaagtccgccgtagacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcgtatttcagcggccaggagaaggagcagatcttcaacgacctgttcaagcagaagcggaaggtcaagaagaaggacctcgagctgttcctgcgtaacatgtcccacgtggagagccccacgatcgaggggctggaggactccttcaacagctcctacagcacctaccacgacctcctgaaggtgggcatcaagcaggagatcctggacaaccccgtcaacacagagatgctcgagaatatcgtgaagatcctgacagtgttcgaggacaagcggatgatcaaggagcagctgcagcagttctccgacgttctcgacggcgtggtgctgaagaagctggagcgccggcactacacggggtggggccgcctcagcgccaagctgctgatggggatccgggacaaacagtcccacctcaccatcctggactacctgatgaacgacgacggcctcaatcgcaacctgatgcagctgatcaacgacagcaacctttcattcaagagcatcatcgagaaggagcaggtcaccaccgccgacaaggatatccagagcatcgtggccgacctggcgggatccccggccatcaagaagggcatcctgcagagcctcaagatcgtggacgaactggtctccgtgatgggctacccgccccagacgatcgtggtcgagatggcccgggagaaccagactaccgggaagggcaagaataacagccgcccccggtacaagtccctggagaaggccatcaaggagttcgggagccagatccttaaggagcaccccaccgataatcaggagctgcgcaacaaccgactgtacctctactacctgcagaacggcaaggacatgtacacgggccaggaccttgacatccacaacctctccaactacgacatcgaccatatcgtgccccagagcttcatcaccgacaactccatcgacaacctggtgctgaccagctccgccgggaaccgcgaaaagggcgacgacgtcccgcccctcgagatcgtgcgcaagcgcaaggtgttctgggagaagctgtaccaggggaacctgatgagcaagcgcaagttcgactacctgaccaaggcggagcggggcgggctgaccgaagccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccaactctacaaggtgcgcgacgtcaacgactaccaccacgcccacgacgcctacctgaacggcgttgtggcgaacactctgctcaaggtctacccccagctggagcccgagttcgtgtacggggactaccaccagttcgactggttcaaggccaacaaggcgaccgccaagaagcagttctacaccaacatcatgttgttcttcgcccagaaggaccggatcatcgacgaaaacggtgagatcctctgggataagaagtacctggacaccgtgaagaaggtcatgtcctaccgccagatgaacatcgtgaagaagacggagatccagaagggggagttctcgaaggccaccatcaagcccaagggcaactccagcaagttaatcccccggaagaccaactgggacccgatgaagtacgggggcctcgacagccccaacatggcctacgcggttgtcatcgaatacgccaagggcaagaacaagctggtgttcgagaagaagatcatccgcgtgaccatcatggagcggaaggccttcgagaaggacgagaaggccttcctggaggagcaggggtaccgccagccgaaggtcctcgccaagctgccgaagtacacgctgtacgagtgcgaggagggccggcgccggatgctcgcgtccgcaaacgaggcccagaaggggaaccagcaggtcctgcccaaccacctggtgaccctcctgcaccacgccgcgaactgcgaggtgagcgacggcaagtccctggactacatcgagagcaaccgcgagatgttcgcggaactcctggcccatgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaaattcttcgagaccacgatcgagcgcaagcggtacaacaacctcaaggagctgctgaacagcaccatcatctaccaatccatcaccggcctctacgagtctcgcaagcgcctcgacgacaagcggcccgccgccaccaagaaggcagggcaggcgaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8250 - RNA, 4415 nt, synthetic construct
  misc_feature 1..4415: note = Cas9 variant mRNA product
  source 1..4415: mol_type = other RNA
gggagagtcccgcagtcggcgtccagcggctctgcttgttcgtgtgtgtgtcgttgcaggccttattcaagcttaccatggctcccaagaagaaacgcaaggtgggcatccacggggtcccggcagcgaagaagccctacagcatcggcctggacatcggcaccaattccgtgggttgggccgtggtaaccgacgactacaaggtgcccgccaagaagatgaaggtgctcgggaacacggacaagagccacatcgagaagaacctgctgggcgccctactgttcgactccggcaataccgccgaggatcggcgcctaaagcggaccgcgcgcagacgatacacccggcgccggaaccgcatcctctaccttcaggaaatcttctcagaggagatgggaaaggtcgacgactccttcttccaccggctggaggacagcttcctcgtgacggaagacaagcgaggcgagcggcaccccatcttcgggaacctggaggaggaagtgaagtaccatgagaacttcccgaccatctaccacctccgccagtacctggccgacaatcccgagaaggttgacctgcggctggtgtacctcgccctggcccacatcatcaagttccgcgggcacttcctgattgaggggaagttcgacacgcggaacaacgacgtgcaacgcctctttcaggagttcctggcggtctatgataacacgttcgagaactccagccttcaggagcagaacgtccaggtggaggagatcctcaccgacaagatctctaaaagcgccaagaaggaccgggtgctgaagctgttccccaacgaaaagtccaacggccgcttcgccgagttcctcaagctgatcgtgggcaaccaggccgacttcaagaagcatttcgagctggaggaaaaggccccgctacagttcagtaaggacacctacgaggaggagctggaggtgctgctcgcgcagataggtgataattacgccgagctgttcctgtccgccaaaaagctgtacgacagcatcctgctgtccggcattctaacagtcaccgacgtgggaacgaaggccccgcttagtgcttcaatgatccagcggtataacgaacaccagatggacctggcgcagctaaagcagttcataagacagaagctgagcgacaagtacaacgaagtgttctccgacgtcagcaaggacggctatgccggctacatcgacgggaagaccaaccaggaggccttctacaagtacctgaaggggctcctgaacaagatagaggggagcggctacttcctggacaagatagagcgcgaggacttcctacggaagcagcgtactttcgacaacgggtccataccccaccagatccacctccaggagatgcgggccatcatccgccgtcaggcagagttctaccccttcctcgcggacaaccaggaccgcatcgagaagctgctgaccttcagaatcccctactacgtggggccgctggcccgcggcaagagcgactttgcctggctgtcccgtaagagcgccgacaagataacgccctggaacttcgacgagatcgttgacaaggagagcagcgccgaggcgttcatcaacagaatgaccaactatgacctctacctccccaaccagaaggtcctgcccaagcactccctcctatacgagaagttcaccgtctacaatgagctgaccaaggtgaagtacaaaacggagcaagggaagaccgcgttcttcgacgctaacatgaagcaagagatcttcgacggcgttttcaaagtgtaccggaaggtcactaaagataagctcatggacttcctggagaaggagttcgacgagttccgcatcgtggacctgaccggtctggacaaggaaaacaaggtgtttaacgccagctacggcacgtaccacgacctgtgcaagatactcgataaggacttcttagataactccaagaacgagaagatcctggaggacatcgtcctgaccctcactctgttcgaggaccgggagatgatccgcaagcggctggagaactatagcgacctcctgacaaaggagcaggtcaagaagctggagcgccggcactacactgggtggggtcgcttgtccgcggagctaatccacggcatccggaacaaggagagcaggaagaccatcctagactacttaatcgacgacgggaactccaacaggaacttcatgcagctgatcaacgacgacgccttgtcttttaaggaggaaatcgccaaggcccaggtgatcggcgagaccgacaacctcaaccaagtggtgtccgacatcgccgggtctccggcgatcaagaagggcatcctgcagtccctgaaaatcgtggacgagctcgtcaagatcatgggccaccaacccgagaacatcgtggtggaaatggcccgtgaaaaccagttcaccaatcagggtcgccggaacagccagcagcgactgaagggcctgacggactccatcaaggagttcgggagccagatcctcaaagaacacccagtcgagaacagccaactgcagaatgaccgactgttcctctactacctgcaaaacgggcgcgacatgtacaccggggaggagctggacatcgactacctctcccagtacgatatcgaccacataatcccccaagccttcatcaaagacaacagcatcgataaccgggtgctgacctccagcaaagagaacaggggcaagtccgatgacgtacccagcaaggacgtcgtgcggaagatgaagtcctactggagcaagctgctctccgccaagctgatcacccagcgcaagttcgacaacttgacgaaggctgagcggggcgggctcaccgacgacgacaaggcgggcttcatcaagcgccagcttgtggagacccggcagatcaccaagcacgttgcccggatcctggacgagcggttcaacaccgagacggacgagaacaataagaaaatccgccaggtgaagatcgtgaccctcaagagcaacctggtctccaacttccggaaggagttcgaactgtacaaggtccgagagataaatgactaccaccacgcccacgacgcctacctcaacgccgtgatcgggaaggcgctgctgggcgtctacccccagctcgagcccgagttcgtttacggggactacccccacttccacggccacaaggagaacaaggccaccgccaagaagttcttctacagcaacatcatgaactttttcaagaaggacgatgtgcggactgacaagaacggcgagatcatctggaagaaagacgaacacataagtaacatcaagaaggtcctgagctacccccaggtgaacatcgttaaaaaggtcgaggagcagaccggaggcttctccaaagagtcgatcctccccaaggggaactccgacaaacttatcccccgcaagacgaagaagttctactgggacaccaagaagtacggcgggttcgacagccccatagtggcctacagcatcctggtgatcgcagacatcgagaagggcaagtccaagaaactgaagaccgtcaaggcactcgtgggcgtaacgataatggaaaagatgaccttcgagcgggacccggtcgccttcttggagcgcaaggggtatcgcaatgtgcaggaggagaacatcatcaagctgcccaagtatagcctcttcaagctcgagaacgggcggaagcgcctgctagcctccgccagggagctgcagaaggggaacgaaatcgtgctgcccaaccaccttggaaccctgttataccacgcgaagaacatccacaaggtcgatgagccgaagcatctcgactacgtggacaaacacaaggatgagtttaaggaactgctggacgtggtctcaaacttctccaagaagtacaccctcgccgagggtaatctagagaagatcaaggagctgtatgcccagaacaacggcgaggacctcaaggagctcgctagcagtttcatcaaccttctcactttcacggccatcggggcgcccgccaccttcaagttcttcgataagaacatcgaccgcaagcggtacaccagcacgaccgagatcctgaacgccacgcttatccaccagtccataaccggactctacgagacgcgcatcgacctgaacaagctgggcggggacaagcggcccgccgccaccaagaaggcgggccaagccaaaaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8251 - RNA, 3548 nt, synthetic construct
  misc_feature 1..3548: note = Cas9 variant mRNA product
  source 1..3548: mol_type = other RNA
gggagagtcccgcagtcggcgtccagcggctctgcttgttcgtgtgtgtgtcgttgcaggccttattcaagcttaccatggcacctaaaaagaaacggaaagtgggcatacacggcgttccagccgcacaaacaaccaacctcagttacatactaggtctagacctcggtatcgcatcagtcggctgggccgtcgtcgaaatcaacgaaaacgaagaccccatcggactaatagacgtcggcgtaaggatattcgaacgcgccgaagtcccaaaaaccggagaaagcctagcactgtccaggagactcgcgcggagtacccgccgcctaatacgccgccgagcccaccgcctactcctcgcgaaacgcttcctcaagagagaaggcatactgagcaccatagacctcgagaaaggcctgccaaaccaggcctgggagctaagagtcgccggcctcgaaaggcgactatcggccatcgaatggggagccgttctcctgcacctaataaaacacagggggtacctatcgaaaagaaagaacgagagtcaaacgaacaacaaggagctgggcgccctgctaagcggagtggcgcaaaaccaccagctcctacaatccgacgactaccgaacacccgcagaattagccctcaagaaatttgcaaaagaagaggggcacataagaaaccaacgcggcgcttacacacacaccttcaatagattagacctcttagcagaactgaacctgctattcgcacaacagcatcaattcggaaacccacactgtaaagagcacatccagcaatacatgactgaactcctaatgtggcagaaacccgcactcagtggcgaggccatcctaaaaatgctcggaaaatgcacacacgagaaaaacgagttcaaagccgcgaaacatacctacagcgccgaacgttttgtttggctcaccaaactcaataaccttcgaatactcgaagacggggccgaacgggcactaaacgaagaagaaagacaactactaatcaaccacccgtacgaaaagagcaaactaacatacgcgcaggtacgaaaattactaggcctctccgaacaagctattttcaagcacctacgctacagtaaagaaaacgcagagtcagccaccttcatggagctcaaagcctggcacgccatacgaaaagcactcgaaaaccagggcctgaaggacacctggcaggacctcgccaagaaacccgatctcctcgacgaaatcggaaccgccttctcactctacaaaacagatgaagacatccaacaatacctaacgaacaaagtacccaacagcgtaataaacgcactactcgtatccctgaacttcgataagttcatcgaactcagcctgaaaagcctgagaaaaatacttcctctaatggaacaaggcaaacgctacgatcaggcctgccgcgagatctacggacatcactacggggaggccaaccaaaagacgtcacaactcctgcccgccattccagcccaagaaatacgcaaccccgtagtcctgcgaacgctgtcccaagcaagaaaagtaataaacgccatcatacgacaatacggctcccccgcccgagtccacatagaaacgggtcgagaactagggaaatccttcaaagaacgacgcgaaatccaaaaacagcaggaggataatcgaaccaaacgcgagtcagcggttcaaaagttcaaggaactcttctccgacttcagcagcgaaccaaaatctaaagacatactcaagttccgcctttacgagcaacaacacggtaaatgcctatactcgggcaaagaaatcaacatacacaggctgaacgaaaaaggatacgtcgagatcgaccacgcactacccttcagtcggacctgggacgactcattcaacaataaagtacttgtcctagcaagcgagaaccaaaacaaaggcaaccagacaccatacgagtggctacaagggaaaataaactccgaacgctggaaaaacttcgtcgcactggtactcggcagccagtgctcagccgcgaagaaacaacgcctcttgacccaggtcattgacgacaacaaatttatcgaccgcaaccttaacgacactcgatacatcgcacgcttcctatcaaactacatccaggaaaacctcctactcgtcggcaaaaacaaaaagaacgtattcacgccaaacggccaaatcacagccctgctccggtcgcgatggggactaatcaaagctcgagaaaacaacaaccgacaccatgccctagatgcgatcgtggtcgcttgcgcgaccccctcaatgcaacagaaaataacccgcttcatccgatttaaagaagtccacccctacaaaatagaaaaccgatacgaaatggtcgaccaagagagtggagaaattataagcccccacttccccgagccatgggcatacttcaggcaagaggtaaacatccgagtattcgacaaccaccccgacacggtgctaaaagagatgctcccggaccggccacaggcaaaccaccaattcgtacaacctctattcgtctcccgagcgcccaccagaaaaatgtccggccaaggccacatggaaaccatcaagtccgccaaacggctggcagaaggcatctccgtactccgaatacccctaactcaactcaaacccaatctcctggaaaacatggtaaataaggagcgcgaacccgccctgtacgcaggccttaaagcccgactcgccgagttcaaccaggaccccgcaaaagccttcgccacaccattctacaaacaaggcggccagcaggtaaaagcaatccgagtagagcaagtacaaaaatcaggagtcctagtacgcgaaaacaacggagtcgccgacaatgcctcaatcgtacgaaccgacgtattcatcaaaaacaacaaattctttctcgtccccatctacacgtggcaagtagcaaagggaatcctaccaaacaaggcaatcgtcgcacacaaaaatgaagacgaatgggaagaaatggacgaaggtgccaaattcaagttctctctcttccccaacgaccttgtcgaactaaaaaccaagaaagaatacttcttcggctactacatcggactggaccgggcaacagggaacataagcctaaaagagcacgacggcgaaatctccaaaggcaaagacggagtctacagggtaggcgtcaaacttgcactgagctttgaaaaataccaagtagatgagcttgggaaaaaccgacaaatctgccgaccccaacaaagacaacctgtcagaaagagaccagccgcaactaaaaaggcaggacaagccaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8252 - RNA, 3626 nt, synthetic construct
  misc_feature 1..3626: note = Cas9 variant mRNA product
  source 1..3626: mol_type = other RNA
gggagagtcccgcagtcggcgtccagcggctctgcttgttcgtgtgtgtgtcgttgcaggccttattcaagcttaccatggcacccaaaaagaaacgcaaagtcggaatccacggagtaccagcagcagccgcctttaaaccaaacccaatcaactacatactcggattagacatagggatagcatcagtcggatgggccatggtcgagatcgacgaggacgaaaaccccatatgcctcatagacctgggggttagggttttcgagcgtgcagaggttccaaaaacaggcgacagcctagcaatggcacgtagactagcgcgctctgtccgcagactcacgagacgacgggcccacagactgctaagagcccgccgcctgctcaaaagagaaggagtcctacaagccgccgactttgacgaaaacggactcataaaaagcctccccaacacaccctggcaacttcgggcggccgccttagaccgaaaactcacacccctcgagtggtccgccgtgctactgcacctgatcaaacatcgaggatacctcagccaacgcaaaaacgagggagaaacggcagacaaagagctcggcgcactgcttaaaggcgtagcggacaacgcacacgcactacagacgggggacttccgcacgccagccgagctcgcactcaacaaattcgagaaagaaagcggtcacatccgaaaccagcgcggagactactcccacacattctcccgaaaagacctgcaagccgaactcatcctactattcgaaaaacagaaagagttcggcaacccacacgtatcaggcggtctaaaagaaggtatagaaacactcctcatgacccaaagaccggccctgtcaggagacgcagtccagaaaatgctcgggcattgcacattcgaaccagcagagcccaaggcagctaaaaacacatacaccgcagaacgattcatctggctgaccaagctcaacaacctcagaatattagaacaagggtctgaacgccccctgactgacacggaacgcgcaacactcatggacgaaccgtaccgcaaaagcaaactcacctacgcacaagcccgtaaactactgggcctcgaagacacagctttcttcaagggtctgcgatacggaaaagacaacgcagaagcatcaacattaatggaaatgaaggcttaccatgccatcagccgagccctagaaaaggaaggcctaaaagataagaaaagtcccctaaacctgtcgcccgagctacaagatgaaatcggcacagccttctcgctttttaaaaccgacgaggacatcacagggcgactcaaagaccgaatacaacccgagattctggaggcgctcctcaaacacatatcattcgacaaattcgtccaaatatccctcaaagcactacgcagaatcgttcctctcatggaacaaggcaaacgctacgatgaagcctgcgcagaaatatatggagaccattacgggaaaaagaacaccgaagagaaaatctatctgcccccgatcccagcggacgaaatacggaatcccgtcgttctgcgagcgctatcccaagcgagaaaagtaatcaacggggtcgtcagacgctacggcagtcccgcaagaatacacatagaaaccgcccgagaggtcggcaaatccttcaaagaccgcaaagagatcgaaaaacgccaagaagaaaatcgcaaggaccgagaaaaagcggcagcgaaattcagagaatacttcccaaacttcgtcggggaacccaaatccaaagatatcctaaaactccgcctatatgaacaacagcatggcaaatgcctctacagcggtaaggaaatcaacttaggaagactgaacgaaaaaggctacgtggaaatagaccacgcgctcccattcagccgcacttgggacgactcattcaacaacaaagtgctggtcctcggctcagagaaccagaataaagggaatcaaaccccctacgaatacttcaacggcaaagacaacagccgcgaatggcaagagttcaaggcacgagtggagacctcgcgcttccccagaagcaagaaacagcgaatactcctacagaaattcgacgaagatggcttcaaagaaaggaacctaaatgacacacgctacgtaaaccgctttctttgccaattcgtagcagaccggatgcggctcactggaaagggcaaaaagagagtcttcgcatccaacggacaaatcactaacctgctgaggggattctggggattacgcaaagtccgggcagagaacgaccgacaccatgcgctcgacgccgtagtcgtagcatgcagcaccgtagccatgcaacagaaaatcacgcgcttcgtgagatacaaggaaatgaacgcattcgacggaaagaccatcgacaaagagaccggagaagtcctacaccagaagacccatttcccccaaccctgggagttcttcgcccaggaagtcatgatacgcgtcttcggcaaacccgacggaaagccagagttcgaagaagcggacacgccagaaaaactaagaacgctgctcgccgagaaacttagctccagacctgaagcagtacatgaatatgtaaccccactcttcgtaagccgagccccgaaccgcaaaatgtccggccaggggcacatggaaacagtaaaatcagccaaacgcctagacgagggcgtgagcgtactaagggtaccgcttacacaactcaagctaaaagacctagagaaaatggtcaaccgcgagcgcgaaccaaagctctacgaggcccttaaggctcggctagaggcacacaaagacgacccagccaaagccttcgcggaaccgttttacaaatacgacaaggccggcaatcggactcaacaagtcaaagccgtaagagtagagcaggtccagaaaacaggcgtctgggtacgtaaccacaacggcatagcagacaacgccactatggtacgcgtcgacgtgttcgaaaaaggcgacaaatattatctagtgcccatatacagctggcaagtcgcaaaaggaatcctaccagaccgcgcggtggtccaaggaaaggacgaagaagactggcaactcatcgacgacagcttcaacttcaaattcagcctacaccccaacgacctagtcgaagtcatcacaaagaaggcccggatgttcgggtacttcgcctcctgccaccgcggcaccggtaacataaacataaggatccatgacctcgaccacaaaataggcaaaaacggaatattagaaggcatcggggtaaaaacagcccttagcttccaaaaataccaaatagacgagctaggaaaagaaataaggccctgccgactcaaaaagagaccaccagtgcgcaaaaggcccgcagcaacgaagaaagccggccaagccaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8253 - RNA, 3632 nt, synthetic construct
  misc_feature 1..3632: note = Cas9 variant mRNA product
  source 1..3632: mol_type = other RNA
gggagagtcccgcagtcggcgtccagcggctctgcttgttcgtgtgtgtgtcgttgcaggccttattcaagcttaccatggcaccgaagaagaaaaggaaagtcggcattcacggagtcccagccgcaaaataccatgtaggcatagacgtaggaacattcagcgtagggctcgcggcaatagaggtagacgacgcaggtatgcccatcaaaaccctaagccttgtgtcacacatccacgacagcggcctcgatccagatgaaatcaaatcggcggtcacgcgactagcaagcagcggtatcgccagacgaacgcgcagactgtaccgaaggaaaaggagaagactccagcaactggacaaattcatacaacggcaaggatggccagtgatagaattagaggactacagcgacccactatacccctggaaagtaagagccgagctcgcagcaagttacattgcggatgagaaagaacgaggcgagaaattgagcgtggcactgagacatatcgccagacacagaggatggcgcaacccatacgcaaaagtaagcagcctatacctcccagacgggccgtccgacgcattcaaagcgatcagagaagagataaagagggcgagtgggcaaccagtgccagaaacagccacggtgggacaaatggtgaccctatgcgaactaggcacgctgaagctaagaggagaaggcggagtcctgagtgcacggttgcagcaaagcgactacgcccgcgaaatacaagaaatatgccgcatgcaagaaatagggcaagaactctacagaaaaataatcgacgtagtattcgcagctgaaagcccaaaggggagcgccagcagccgagtaggaaaagaccccttacaacccgggaaaaaccgcgcgctaaaggccagcgacgcattccaacgatacaggatagcagccttaataggaaacctaagagtccgagtagatggagagaaacgcatcctcagcgtagaggagaagaacctcgtgttcgaccatctggtcaatctaaccccaaagaaagaaccagaatgggtaacgatcgcagaaatactgggcatagacagagggcagctaataggaaccgccacgatgacggacgacggagaacgcgcgggagcccgaccacctacgcacgacacgaacagatccatcgtgaacagccgaatagccccgctagtcgactggtggaaaacagcgagcgccctcgaacaacatgcaatggtcaaggctctaagcaacgcggaagtagacgacttcgactcaccagagggagcaaaagtccaagcattcttcgccgacctagacgacgacgtccacgcaaaactcgactcccttcatctgccagtcggacgagcggcgtacagcgaagacaccctagtacgattaacacgacgcatgctaagcgacggagtagatctgtacaccgcaagactacaggagttcggcattgaaccaagctggacgccaccaacccccaggatcggagaaccagttggtaacccagctgtagaccgagtactaaaaacagtcagtcgatggcttgaaagtgcgaccaagacttggggagcaccagaacgggtcataatagaacacgtaagggagggatttgtaacagaaaaacgggcgcgagaaatggacggggacatgcgtagacgagcagcaaggaacgcaaaactgttccaggaaatgcaggagaaactaaacgtacaaggaaaaccctctagagcagatctctggcggtaccagagcgtccaaagacaaaactgccaatgcgcatactgcggcagcccaatcacgttcagcaactcagaaatggaccacatcgtgccaagggctgggcagggatccaccaacacgcgcgagaacctagtggcggtgtgccacaggtgtaaccaaagcaaaggaaacaccccgttcgcgatatgggcgaaaaacacctccatagagggcgtaagcgtaaaggaagctgtggaaagaacacgacactgggtcacggacacaggaatgcgctcaaccgactttaagaaatttacaaaggctgtcgtcgagaggttccaaagagcaacgatggacgaagagatagacgcaaggagcatggaatcggtcgcatggatggcaaacgaattgcgcagtcgggtagcacagcacttcgctagccacggaacaacggtacgagtctaccgcggaagcctcacagcggaagcacggagggccagcggcataagcggcaaactaaagttcttcgacggagtcgggaaatctcgcctagaccgcagacaccatgccatagacgcggccgtgatcgcattcacaagtgactacgtggccgagaccctagcagtacgaagcaatttgaagcaaagccaagcgcacagacaggaagccccgcaatggcgagagttcacaggaaaagacgcagaacacagagcggcatggagggtatggtgccagaaaatggaaaaactaagcgcattgctcaccgaagacctcagggacgacagagtcgtcgttatgagcaacgtgcggctacgcctcggcaacggctcggcccacaaagaaacaataggaaaactcagcaaggtcaaactaagctcacaactgtccgtatccgacatagacaaagcgtcgagcgaagcactctggtgcgcgctaacgcgagaacccggatttgaccccaaggaaggcctccctgcaaacccagaacggcacatacgagtaaacggtacacacgtgtatgctggtgacaacatcggattattcccagtctcagcaggaagtattgcgctgcggggaggatacgcagaactcggctcaagttttcaccacgcaagggtatataaaataacaagcgggaagaaaccagcattcgctatgttgagagtatacacgatagacctgctcccctaccgcaaccaagacctattcagcgttgaactaaaaccacaaacaatgtcaatgaggcaagccgaaaagaaactgcgagacgccctcgccaccgggaacgccgaatacctcggctggttagtcgtcgacgacgagctcgtagtagacaccagcaaaatagcaacggaccaagtaaaagcagtcgaagcggagctaggaacgataagacgatggagggtagatggatttttcagcccaagcaaactacgcctaagaccgcttcaaatgtcaaaagaaggcatcaaaaaggaaagcgcaccagagctgagcaagataatcgacagacccggctggctaccagcagttaataaactcttcagcgacggcaacgtcacagtcgtgcgaagggactcgttggggcgggtacggctagaaagcacagcgcacctacccgtcacatggaaggtacaaaagagaccagccgcgacgaagaaggcaggccaggcgaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8254 - RNA, 3332 nt, synthetic construct
  misc_feature 1..3332: note = Cas9 variant mRNA product
  source 1..3332: mol_type = other RNA
gggagagtcccgcagtcggcgtccagcggctctgcttgttcgtgtgtgtgtcgttgcaggccttattcaagcttaccatggcccccaagaagaaacgcaaggtgggcatccacggggtcccggccgcggcccggatactggccttcgacatcggcatcagctccatagggtgggccttcagcgagaacgacgagctcaaggactgcggcgtgcgcatcttcactaaggtggagaaccccaagacaggagagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgatgagagcctcgccaaggcctacaaaggctccctgatcagcccctacgagctgcggttccgcgcactcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacttgtacaaggagtacttccagaaattcaaggagaacagcaaggagttcacgaacgtgcgcaacaagaaggagtcctacgagcggtgcatcgcccagagcttcctgaaggacgagctgaagctcatctttaaaaagcagcgcgagttcgggttctccttcagcaagaagttcgaagaggaggtcctttccgtggcgttctacaagcgggctctgaaggacttcagccacctcgtgggcaactgctccttcttcaccgacgagaagcgcgccccgaagaacagccccctggccttcatgtttgtcgccctgacccggatcatcaatctcctgaacaacctgaagaacaccgagggcatcctctacacgaaggacgacctgaacgcgctgcttaacgaggtgctgaagaacggcaccctgacctacaagcagaccaagaagctcctggggctgagcgacgactacgagttcaaaggggaaaagggcacgtacttcatcgagttcaagaagtacaaggagttcattaaggccctcggggagcacaacctgtcccaggacgacctgaacgagatcgccaaagacatcaccctcatcaaggacgagatcaagctgaagaaggccctggccaagtacgacctcaaccagaaccagatcgacagcttatccaaacttgagttcaaggaccacctcaacatcagcttcaaggcgctaaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgtgcgatcaaggagtaccgcaaggtgctgaacgccctcctgaagaagtacggcaaggtgcacaaaatcaacatcgagctggcgcgggaggtcgggaagaaccactcccagcgcgccaagatcgagaaggagcagaacgagaactacaaggccaagaaagacgcggagctcgagtgtgagaagctgggcctgaagatcaacagcaagaacatcctcaagctgcggctgttcaaggagcagaaggagttctgtgcctactccggggagaaaatcaagatcagcgacctccaggacgagaagatgttagagatcgaccacatctacccatactcccgcagcttcgacgactcctacatgaacaaggtgctggtgttcaccaagcagaaccaggagaagctcaaccagacccccttcgaggccttcggcaacgacagcgcgaagtggcagaagatcgaggtcctggcaaagaacctacccaccaagaagcagaagcggatcctcgacaagaactacaaggacaaggagcagaagaacttcaaggaccgcaacctgaacgacacacggtacatagctcgcctggtgctcaactacaccaaggactacctggacttcctgccgctctccgacgacgagaacaccaagctgaacgacacccagaaggggagcaaggtgcacgtcgaggccaagtccggcatgctgacgagcgctctccggcacacctggggcttctccgccaaggaccgcaacaaccacctccaccacgccatcgatgcggtgataatcgcctacgccaacaacagcatcgtcaaggccttctccgacttcaaaaaggagcaggagagcaacagcgcggagctgtacgccaagaagatctccgagctggactacaagaacaagcggaagttcttcgagcccttcagcggtttccgccagaaggtgctggacaagatcgacgagatcttcgtgtccaaacccgagcggaagaagcccagcggtgccctgcacgaggagaccttccgtaaagaggaggagttctaccagtcctacgggggcaaggagggggtcctcaaggcgctggagctgggcaagatccggaaggtgaacgggaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttttgcttctccctctacaaggacagcctgatcctgatccagaccaaggacatgcaagagcccgagttcgtgtactacaacgccttcacctcctcaaccgtgtccctcatagttagcaagcacgacaacaagttcgagacgctgtccaagaaccagaagatcctgttcaaaaacgcaaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8255 - RNA, 3743 nt, synthetic construct
  misc_feature 1..3743: note = Cas9 variant mRNA product
  source 1..3743: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgtcggacctagttctcggcctggacatcgggattggctccgtgggggtcgggatcctgaacaaggtgaccggcgagatcatccacaagaacagccggatcttccccgccgcccaggccgagaacaacctagtgcgccggacgaaccgccagggccggcgcctggcccggcgcaagaagcaccggcgcgtccggctgaaccgcctcttcgaggagtccggcctgatcacggacttcaccaagatcagcataaacctgaacccctaccagttacgggtgaaggggctgaccgacgaactgtccaacgaggagctgttcatcgcgctgaagaatatggtgaagcaccgcggcatcagctacctggatgacgcctccgacgacgggaacagctccgtcggcgattacgcccagatcgtgaaggagaatagcaagcagctcgagaccaagacgcccggacagatccagctggagcggtaccagacctacgggcagctgcgcggcgatttcaccgtggagaaagacgggaagaagcaccgactcatcaacgtcttcccgacctccgcctaccgaagcgaggcgctgcggatcctgcaaactcagcaggagttcaacccccagatcaccgatgagttcatcaaccgctacctcgagatcctgaccggcaagcggaagtactaccacggccccgggaacgagaagtcccgcaccgactacggccgctatcggacgagcggggagaccctggacaacatcttcggcatcctcatcgggaagtgcaccttctaccccgacgagttccgcgccgccaaggcctcctacaccgcccaggagttcaaccttttaaatgacctcaacaacctgacggtgccgaccgaaaccaagaagctcagcaaggagcagaagaaccagatcatcaactacgtgaagaacgagaaggctatgggccccgccaagctgttcaagtacatcgccaagctcctgtcctgcgacgtcgccgacatcaagggctaccggatcgacaagagcgggaaggccgagatccataccttcgaggcgtaccgcaagatgaagacgctcgagaccctggacatcgagcagatggacagagagaccctggacaagctcgcctacgtactgaccctgaacacggagcgcgagggcatccaggaggccctcgagcacgagttcgccgacgggtccttcagccagaagcaggtcgacgagctggtgcagttccggaaggccaacagctccatcttcggcaaagggtggcacaactttagcgtgaagctgatgatggagctcatccccgagctgtacgagaccagcgaggagcagatgaccatcctgacccgcctcggcaagcagaagacaaccagctccagcaacaagactaagtacattgacgagaagctgctgaccgaggaaatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgcctcacagcgtgttccacggccacaagcagctggccaccaagatccggctgtggcaccagcagggcgagcgctgcctctataccggcaagaccatctccatccacgacctgatcaacaacagcaaccagttcgaggtcgaccacatcctgcccctctccatcacgttcgacgacagcctggccaacaaagtgctggtgtacgcgaccgccaaccaggagaaggggcagcggacgccctaccaggccctggactccatggacgacgcctggtcgttccgcgagctgaaggccttcgtccgggagtccaagaccctgagcaacaagaagaaggagtacctcttgaccgaggaggacatctccaagttcgacgtgcgcaagaagttcatcgagcggaacctcgtggacacgcgctacgcgagccgggtcgtgctcaacgccctgcaggagcacttccgcgcccataaaatcgacaccaaggtgtccgtggtgcgcggccagttcaccagccagttaagacgccactggggcatcgagaagacccgggacacgtaccaccaccatgcagtggacgccctcatcatcgcggcctcctcccagctgaacctgtggaagaagcagaagaacaccctcgtcagctactccgaggaccagctgctggacatcgagaccggggagctcatcagcgacgacgagtacaaggagtccgtgttcaaggccccctaccaacatttcgtggacaccttaaagagcaaggagttcgaggattccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctcgagaactaccccaacaagcagatcaacgagaagggcaaggaggttccctgcaacccgttcctcaagtacaaggaggagcacgggtacatccggaaatacagcaagaagggcaacgggcccgagatcaagtccctgaagtactacgacagcaagctgggcaaccacatcgacattacccccaaagactccaacaacaaggtggtcctccagagtgtgtccccctggcgcgccgacgtgtacttcaacaagaccaccgggaagtacgagatcttgggcctgaaatacgcggacctccagttcgagaagggcacggggacctacaagatcagccaggagaagtacaacgacatcaagaagaaagagggcgtcgacagcgactccgagttcaagttcaccctgtacaagaacgacctgctcctggtgaaggacaccgagacgaaggagcagcagctgttccggttcctcagccgcaccatgccaaagcagaagcactacgtggagctaaagccctacgacaagcagaagttcgagggcggagaggccctgatcaaggtcctcgggaacgtggccaactccggccagtgcaagaagggactgggcaagagcaacatctccatctacaaggtgcggaccgacgtcctggggaaccaacacatcattaagaacgagggggacaaacccaagctcgacttcaagcgccccgccgccaccaagaaggcgggccaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8256 - RNA, 4301 nt, synthetic construct
  misc_feature 1..4301: note = Cpf1 variant mRNA product
  source 1..4301: mol_type = other RNA
gggagagtcccgcagtcggcgtccagcggctctgcttgttcgtgtgtgtgtcgttgcaggccttattcaagcttaccatggcccccaagaagaagcgcaaggtgggaatccacggcgtcccggccgcgacccagttcgagggcttcaccaacctgtaccaggtgagcaagacgctccggttcgagctgatcccccaggggaagaccctgaaacacatccaggagcagggcttcatcgaggaggacaaggcccgcaacgaccactacaaggaactcaaacccatcatcgaccggatctataagacctacgccgaccagtgcttgcagctggtgcagctcgactgggagaatctgtccgccgccatcgacagctaccgcaaggagaagaccgaggagacccgtaacgcgcttatcgaggagcaggccacctaccgcaacgctattcatgactacttcatcgggcggaccgataacctcaccgacgccataaacaagcgccacgctgaaatctacaagggcctcttcaaggccgagctattcaacggcaaggtactaaagcagttagggacggtgaccaccaccgagcacgagaatgccctactccggtccttcgacaaattcacgacctacttctcaggcttctacgaaaaccgcaagaacgtgttcagcgcagaggacatcagcaccgcaatcccccaccggatcgtccaggacaatttcccgaagtttaaggagaactgccatatcttcacccgtctgatcacggcggtgccgtccctgcgggaacacttcgaaaacgtgaagaaggccatcggaatttttgtcagcacctccatcgaggaggtgttcagtttccccttctacaaccagttgctgacccagacccagatcgacctgtacaaccagctcttgggcgggatctctcgcgaggccggcacggagaagataaagggcttaaatgaggtgctcaacctggccatacagaagaacgacgagacagcccacatcatagcgagcctgccccaccggttcatcccgttattcaaacagatcctgtctgaccgtaacacccttagcttcatcctcgaggagttcaagagtgacgaagaggtcatccagtcgttctgcaaatacaagacccttctgcggaacgagaatgtgctcgagacggccgaggcccttttcaacgaactgaactccatcgacctcacccacatcttcatcagccacaagaaactcgagaccatcagcagcgccctgtgcgaccactgggacaccctccgcaacgccctgtacgagcggcgcatcagtgagctgacgggcaagatcaccaagtccgcgaaggagaaggtgcagcggagcctcaagcatgaagacatcaacctgcaggagatcatctccgccgccggcaaggagctgagtgaggccttcaagcaaaagacctcagaaatcctatcccacgctcatgcggccctggaccagccgttgcccaccacgctcaagaagcaagaagagaaggagatcctgaaatcccagttagacagcctgctcgggctgtaccacctcctcgactggttcgcagtcgacgaatccaacgaggtggaccccgagtttagcgcccgcctgaccggcattaaactggagatggagccgtccctcagcttctacaacaaggcgcgcaactacgccaccaagaagccctactccgtggagaagttcaagctgaacttccagatgcccacgctggccagcggctgggatgtaaacaaggagaagaacaatggggccatactcttcgtgaagaacggcctgtactacctggggatcatgcctaagcaaaagggccggtacaaggccttatccttcgagcccacggagaagaccagcgaagggttcgacaagatgtactacgactacttccccgacgcggccaaaatgatccccaagtgctccacacagctgaaagcagtgaccgcccacttccagacccacacgaccccgattctgttgagtaacaacttcatcgagccgctggagatcaccaaagagatctacgatctgaacaaccccgagaaggagcccaaaaagttccagaccgcctatgcgaaaaagacgggagaccagaaaggctaccgcgaggccctgtgcaagtggatcgacttcacccgggatttcctatccaagtacaccaagaccacgagcatcgacctgagttcactccggccaagctcccagtacaaagatctgggggagtactacgccgagctgaatccgctcctgtatcacatctcattccaacggatcgccgagaaagagatcatggacgccgtagagacgggcaagctctacctcttccagatctacaacaaggacttcgcgaagggacaccacggcaagcctaacctgcacacattgtactggaccggcctcttctcccccgagaacctcgccaagacgagcatcaagctgaacgggcaggccgagctgttctacaggcccaagagccggatgaagcgcatggcccacaggctgggtgagaagatgctgaacaagaagctaaaggaccagaagaccccgatccccgacaccctgtaccaagagctgtatgactacgtgaaccatcgcttaagccacgacctctccgacgaggcgcgtgccttactccccaacgtgatcaccaaggaggtcagccatgagatcatcaaggaccgcagattcacgtccgacaagttcttcttccacgtgccgatcacactgaactaccaggccgctaacagcccctccaagttcaaccagcgcgtcaacgcctacctaaaggagcaccccgagacgcccatcattgggatagaccggggcgagcgcaacctgatctatatcaccgtgatcgacagcacggggaagatcctggagcaacgatccctgaacaccatccagcagttcgactaccagaagaaactcgacaaccgcgaaaaagagcgggtggcggcacgccaggcctggagcgtcgtgggcaccatcaaggacctgaagcaggggtacctgagccaggtgatccacgagatcgtcgacctcatgattcactaccaggccgtcgtggtcctggagaacttaaacttcggcttcaaatcgaaacgcaccggcatcgccgagaaagcggtgtaccagcagttcgagaagatgctcattgacaagttaaactgcctggtgctaaaagattacccggccgagaaggtcggaggcgtgctgaacccctaccagttgacggaccagttcaccagcttcgccaagatgggcacccagtctggcttcctcttctacgtgcccgccccctacaccagcaagatcgacccgctgacggggttcgtagaccccttcgtttggaagaccatcaagaaccatgagagtcggaagcacttccttgaggggtttgacttcctccactatgatgtgaagactggcgatttcatcctgcacttcaagatgaaccgcaacctgagcttccagcgggggctccccggtttcatgcccgcctgggacatcgtcttcgagaagaatgagacccagttcgacgcgaaggggacgcccttcatcgccggcaagcgcatagtccctgtgatcgagaaccaccggttcaccggccgctaccgggatctgtaccccgcaaacgagctgatcgccctcctggaggagaaggggatcgtctttcgagacggctccaacatcctgcccaagttgttagagaatgacgacagccacgcaatcgacaccatggtggccctgattcggtccgtgctccagatgcgcaacagcaacgcggccaccggggaggactacatcaactccccggtccgggacctgaacggcgtgtgctttgatagccgcttccagaaccccgagtggcccatggacgccgacgcgaacggggcctaccatatcgccctgaagggacaactcttgctgaaccacctcaaggagtctaaggacctcaagctgcaaaacggtatcagcaaccaggactggctcgcctatatacaagagctgcggaacaagcgccccgccgcgactaaaaaggctgggcaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8257 - RNA, 4280 nt, synthetic construct; identical to SEQ ID NO: 2457
  misc_feature 1..4280: note = Cpf1 variant mRNA product
  source 1..4280: mol_type = other RNA

SEQ ID NO: 8258 - RNA, 4581 nt, synthetic construct
  misc_feature 1..4581: note = Cas9 variant mRNA product
  source 1..4581: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaagtgggaatccacggggtgccggcggcggacaagaagtacagcatcggcctggacatcgggaccaactcagtgggctgggccgtaatcaccgacgaatacaaagtccccagcaagaagttcaaggtgctggggaacacggaccggcattccatcaagaagaacctgatcggtgccctgctgttcgactcgggcgagaccgccgaggccacccgcctgaagcgaaccgcgcgccggcgctacacgcggcgcaagaaccggatctgttacctgcaggagatcttctccaacgagatggccaaggtggacgacagcttcttccaccgcctcgaggagtccttcctggtcgaggaggacaagaagcacgagcggcaccccattttcgggaacattgtggacgaagtggcctaccacgagaagtaccccaccatctaccaccttcgcaagaagctcgtcgacagcaccgacaaggccgacctgcggctgatttacctcgcgctggcccacatgatcaagttccgcggccacttcctgatcgagggggacctcaacccggacaactccgacgtggacaagctgttcatccaactggtgcagacctacaaccagctgttcgaggagaaccccatcaacgccagcggcgtcgacgccaaagccatcctgtccgcgagacttagcaagagtcgcaggctcgagaacctgatcgcccagcttcccggggagaagaagaacggcctattcggcaacctgattgccctgagcctcggactgacacccaacttcaagtccaacttcgatctggccgaggatgccaaactccagttgagtaaggacacctacgacgacgacctggacaacctcctggcgcagatcggcgaccagtacgccgacctgttcctcgccgccaagaacctgtctgacgccatcctgctcagcgacatcctgcgcgtgaacaccgaaatcaccaaggcgccgctgtccgcctcaatgatcaagcggtacgacgagcaccaccaggatctcacgctgctgaaggcgctagtgcgccagcagttgcccgagaaatacaaggagatcttcttcgaccagagcaaaaacgggtacgctggctacatcgacggcggggcctcccaggaggagttctataagttcatcaagcccatactggagaagatggacggcaccgaggagttactggtcaagctgaaccgggaggacctgctccgcaagcagcgcaccttcgacaatgggagcatcccccaccagatccacctgggcgagctgcacgcgatcctccggcgccaggaggacttctacccgttcctgaaggacaaccgggagaagatcgagaagatcctcacctttcgcatcccctactacgtggggcccttggcccggggcaactcccgcttcgcctggatgacgcgcaagagcgaggagaccatcactccctggaatttcgaggaggtggtcgacaagggcgccagtgcgcagagcttcattgagaggatgaccaactttgacaagaacctgccgaacgagaaggtgctgcccaagcactccctcctgtacgagtacttcacggtgtataacgaactcaccaaggtcaagtacgtgaccgaggggatgcggaagcccgctttcctcagcggcgagcagaagaaggccatcgtggacttgctgttcaagaccaaccgcaaggtcacggtgaagcagctcaaggaggattacttcaagaagatcgagtgcttcgactccgtcgagatcagcggggttgaggaccggttcaacgcctccctgggcacctaccacgacctgctcaaaatcatcaaggacaaggactttctggacaacgaggagaacgaggacatcctggaggacattgtgctcaccctgaccctgttcgaggaccgcgagatgatagaggagcggctcaagacgtatgcccacctgttcgacgacaaggtcatgaagcaactgaagcgtcggcgctacaccgggtggggccggctcagccgcaagttgatcaacggaatccgagataaacagagtgggaagacaatcctggacttcctaaagagcgacggctttgcaaaccgcaacttcatgcagctgatccacgacgactccttgaccttcaaggaggacatccagaaggcccaagtatctgggcagggagactccctccacgagcacatcgccaacctggccgggtcccccgccatcaagaagggcatcctgcagacggtgaaggtcgtggacgagctagtcaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaagagcaccccgtggagaacacccagctccagaacgagaagctctacctgtactaccttcagaacggccgggatatgtacgtcgaccaggagctggacattaacaggctgagcgactatgacgtggaccacatcgtgccccagtccttcctcaaagacgacagcatcgacaacaaggtcctgacacggtccgacaagaaccggggcaagagcgacaacgtgccctccgaggaggtagtcaagaaaatgaaaaactattggagacagctgctcaacgctaagctgatcacccagcgcaaattcgacaacttgaccaaagccgaacgcgggggcctcagcgagctagacaaggccgggttcatcaagcggcagctggtggagacccggcagatcaccaagcacgtagcccagatcctcgactccaggatgaacacgaagtacgacgagaacgacaaactgatccgggaggtcaaggtgatcaccctcaagagcaaacttgtgtccgacttcagaaaggacttccagttctataaggttagggagatcaacaactaccaccacgcgcacgacgcatacctgaacgccgtggtgggcaccgccctgatcaagaagtacccgaaacttgagagcgagttcgtctacggggactacaaggtgtacgacgtgcgcaagatgatcgcgaagtccgagcaggagatcggaaaggctaccgccaagtacttcttctacagcaacatcatgaacttcttcaagacggagatcaccctggcaaacggcgaaatccggaagcgccccctaatcgaaacgaacggagagaccggcgaaatcgtctgggacaaggggcgggacttcgccacggtgcgcaaggtgctctccatgccccaggtcaatatcgtaaagaagaccgaggtgcagaccggcgggttcagcaaggagtccatcctgcccaagcgcaacagcgataagttaatcgcgcgtaagaaggactgggacccgaagaagtacggcggcttcgactcccccaccgtcgcgtacagcgtgctggtggtcgccaaggtggagaagggcaagagcaagaagttaaagtccgtgaaggagctgctcggtatcacgatcatggagcgcagttccttcgagaagaaccccatcgatttcctggaggccaagggatacaaggaggtcaagaaggacctgatcatcaagctccccaagtacagcctgttcgagctggagaacggccggaaacgcatgctcgcctccgcgggggagctgcagaagggcaacgaactggccctccccagcaagtacgtgaacttcctgtacctggcctcccactatgagaagttaaaaggcagccccgaggacaacgaacagaagcagctgttcgtggagcagcacaagcattatctggacgagatcatcgagcagatatccgagttcagcaaacgggtgatcctcgccgacgccaacctcgacaaggtgctctccgcgtacaacaagcaccgtgacaagcccatccgggagcaggccgagaacatcatccacctcttcaccctgaccaaccttggggcccctgccgcgttcaagtacttcgacaccacgatcgaccggaagcggtacaccagcaccaaggaggtgttagacgcgaccctgatacaccagagtatcacgggcctgtacgagacccgcatcgatctcagccagctcgggggcgataagcggcccgccgccaccaagaaggccgggcaggcgaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8259 - RNA, 5364 nt, synthetic construct; identical to SEQ ID NO: 2459
  misc_feature 1..5364: note = Cas9 variant mRNA product
  source 1..5364: mol_type = other RNA

SEQ ID NO: 8260 - RNA, 3636 nt, synthetic construct
  misc_feature 1..3636: note = Cas9 variant mRNA product
  source 1..3636: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaagtgggcatccacggggtcccggccgcgaagcggaactacatcctgggcctcgacatcgggatcaccagcgtgggctacgggatcatcgactacgaaacccgcgatgttatcgacgccggcgtccggctgttcaaggaggccaacgtggagaacaacgaaggccgccggtccaagcgcggggcccggcgcctgaagcggcgccggcgccaccggatccagcgcgtgaagaagctcctgttcgactacaacctgctcacggaccacagcgagctgtcgggcatcaacccctacgaggcccgggtcaagggtctcagccagaagctctccgaggaggagttcagcgcggccctgctgcacctcgccaagcgcaggggcgtgcacaacgtgaacgaggtcgaggaggacaccgggaacgagctctccaccaaggagcagatcagccgcaactccaaggccctggaggagaagtacgtggcggagctccagctcgagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaagacatcaaggagtggtacgagatgctgatgggccattgcacctacttcccggaggagctccgaagcgtgaagtacgcctacaacgccgacctgtacaacgcgctcaacgacctcaacaacctggtcatcacgcgcgacgagaacgagaagctggagtactacgagaagttccagatcatcgagaacgtgttcaagcagaagaagaagcccaccctcaagcagatagccaaggagatcttggtgaacgaggaggacatcaaggggtaccgggtcacctccaccggcaagcccgagttcacgaacctaaaggtgtaccacgacatcaaggacatcaccgcccgcaaggagatcatcgagaacgccgagctcctggaccagatcgccaaaatcctgaccatctaccagagctccgaggacatccaggaggagctcaccaacctgaacagcgagctgacacaggaggagatcgagcagatctccaacctcaaggggtacaccggcacccacaacctgagcctgaaggcgatcaacctcatcctggacgagctgtggcacaccaacgacaatcagatcgccatctttaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctacccaacgacataatcatcgagctggcccgggagaagaacagcaaggacgcccagaagatgatcaacgagatgcagaagcgcaaccggcagaccaacgagcgcatcgaggaaatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtggaccacatcatcccccgcagcgtgtccttcgataacagcttcaacaacaaggtgctggtcaagcaagaggagaactccaagaaggggaaccggacccccttccagtacctgagctccagcgactccaagatcagctacgagaccttcaagaagcacatcctcaacctggccaagggcaaagggcgcatctccaagaccaagaaggagtacctgctcgaggaacgggacattaaccgcttcagcgtgcagaaggacttcatcaaccggaacctggtggacacgcgctacgccacccggggcctgatgaacctcctgcgctcctactttcgcgtcaacaacctggacgtgaaggtcaagagcatcaacgggggcttcacctccttcctcaggcgcaaatggaagttcaagaaggagcggaacaagggctacaagcatcacgccgaggacgcgctgatcattgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcatatcaaggacttcaaggactacaagtacagccatcgcgtggacaagaagcccaatcgggagctcatcaacgacacactgtactccacccgcaaggacgacaaggggaacaccctgatcgtgaacaacctcaacggcctgtacgacaaggacaacgacaagctgaagaagctcatcaacaagagccccgagaagctcctgatgtaccaccacgacccccagacttaccagaagctcaagctgatcatggagcagtacggggacgagaagaacccgctgtacaaatactacgaggagaccggcaactacctcaccaagtactccaagaaggacaacgggcccgtcatcaagaagatcaagtactacggcaacaagctgaacgcccacttggacatcaccgacgactaccccaacagccggaacaaggtggtgaagctctccctgaagccctaccgcttcgacgtctacctggacaacggcgtgtacaagttcgtcaccgtcaagaacctcgacgtgatcaagaaggagaactactacgaggtgaacagcaagtgctacgaggaggctaagaagctgaagaagatctccaaccaggccgagttcatcgccagcttctacaacaacgacctgatcaagatcaatggtgagctctaccgggtcatcggcgtgaacaacgacctgctgaaccgcatcgaggtgaacatgatcgacatcacgtatcgggagtacttagagaacatgaacgacaagcgcccgcccagaatcatcaagaccatcgcgtccaagacccagagcatcaagaagtactcaaccgacatcctggggaacctgtacgaggtaaagagcaagaagcacccccagatcatcaagaagggcaagcgccccgccgccacgaagaaggccggtcaagccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8261 - RNA, 4704 nt, synthetic construct
  misc_feature 1..4704: note = Cas9 variant mRNA product
  source 1..4704: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgctgttcaacaagtgcattatcatcagcatcaacctggacttctccaacaaggagaaatgcatgaccaagccctacagcataggcctggacatcgggacgaactccgtgggctgggccgtgatcacggacaactataaggtccccagcaagaagatgaaggtgctggggaacacttccaagaagtacattaagaagaacttactgggcgtgctgctgttcgacagcggcatcaccgccgaggggcggcgcctgaagcggaccgcgcgccggcgctacacgcggcgccggaaccgcatcctgtacctccaggagatcttctctaccgagatggccaccctggacgacgcgttcttccagcggctggacgacagcttcctcgtgcccgacgacaagcgcgactccaagtacccgatcttcggcaacctggtggaggagaaggtgtaccacgacgagttccccaccatctaccacctccggaagtacctcgccgacagcacgaagaaggccgacctgcgcctcgtctacctcgccttagcgcacatgattaagtaccggggccacttcctgatcgagggcgagtttaactccaagaacaacgacatccaaaagaacttccaggacttcctcgacacctacaacgccatcttcgagagcgacctgtccctggagaacagcaagcagctcgaggagatcgtgaaggacaagatttccaagctggagaagaaggaccgcatcctgaagctgttccccggggagaagaacagcggcatcttctctgagttcctgaagctgatcgtgggcaaccaggctgacttccggaagtgcttcaacctcgatgagaaggcaagccttcacttctccaaggagagctacgacgaggacctggagaccctcctgggatacatcggcgacgactatagcgatgtcttcctgaaggctaagaagctctacgacgcgatcctgctgtccgggtttctcaccgtgacggacaacgagaccgaggcgcccctgagctccgccatgatcaagcgctacaacgagcacaaggaggacctcgccctcctgaaggagtacatccggaacatcagcctgaagacctacaacgaggtgttcaaagacgacaccaagaacggatacgccggctacattgacgggaagacgaaccaggaggacttctacgtatacctcaagaacctgctggccgagttcgagggcgccgactatttcctcgagaaaatcgaccgcgaggacttcctgcgcaagcagcgcaccttcgacaacgggtccatcccgtaccagatccaccttcaggagatgcgcgccatcctggacaagcaggccaagttctaccctttcctagccaagaacaaggagcggatcgagaagatcctgaccttccgcatcccctactatgtgggcccgctggcgcgggggaacagcgacttcgcttggtccatccgcaagcggaacgagaagatcaccccgtggaacttcgaggacgtgatcgacaaggagagctccgctgaggccttcatcaaccgcatgacgagcttcgacctctacctgcccgaggagaaggtcctgcctaagcactccctcctgtacgagaccttcaacgtgtacaatgagctgaccaaggtgcggttcatcgccgagagcatgcgcgactaccaattccttgactccaagcagaagaaggacatcgtccggctttacttcaaggacaagcgcaaggtgaccgacaaggacatcatcgagtacctgcacgcgatctacggctacgacggcatcgaactcaaggggatcgagaagcagttcaacagcagcctgagcacgtaccacgacctgctcaacatcattaacgacaaagagttcctggacgactccagcaacgaggctatcatcgaggagatcatccacaccttaaccatcttcgaggaccgggagatgatcaagcaacgcctctccaagttcgagaacatcttcgacaagagcgtgctgaagaagctgagccgtcgccactataccggctgggggaagctctccgccaaacttatcaacggcatccgggacgagaagtccgggaatacaatcctggactacctcatcgatgacggcatcagcaatcgcaacttcatgcagctgatccacgacgacgccctgagcttcaagaagaagatccagaaggcgcagattatcggcgacgaggacaagggtaacatcaaggaagtcgtgaagtccctccccggcagcccggccatcaagaagggaatcctgcagtccatcaagatcgtagacgagctggtgaaggtgatgggcgggcggaagcccgagagcatcgtcgtggagatggcccgagagaaccagtacaccaaccagggcaagtccaacagccagcagaggctcaagcgcctggagaagtcactgaaggagctcggcagcaagatcctgaaggagaacatccccgccaagctgagtaagatcgacaacaacgccctacagaacgaccgcctgtatctgtactacctccagaacgggaaggacatgtataccggagacgacctggacatcgaccggctgagcaactacgacatcgaccacataatcccccaggcgttcctcaaggacaactccatcgacaacaaggtgctggtcagctccgccagcaaccgcggaaagtccgacgacttcccgagcctggaggtggttaagaagcggaagactttctggtaccagttgctcaagagcaagctgatttcccagcgcaagttcgacaacctgacgaaggccgaacggggcggcctgctgcccgaagacaaggcaggcttcatccaacgccagctcgtcgaaacccggcaaatcaccaaacacgtggcccgcctgctggacgagaagttcaacaacaagaaggacgagaacaaccgggcggtgaggaccgtaaagatcatcacgctcaagagcaccctggtgtcccaattccggaaagacttcgagttgtacaaggtgcgcgagatcaacgacttccaccatgcccacgacgcctacctcaacgccgtcatcgccagcgcgctgctgaagaagtaccccaagctcgagcctgagtttgtgtacggcgactacccgaaatacaactccttccgtgagcgcaagagcgccaccgagaaggtgtacttctattccaatatcatgaacatcttcaagaagtccatctccctggctgacgggcgggtgatcgagcgccccctgatcgaagtgaacgaggagacgggcgagagcgtgtggaacaaggagtccgacctcgccaccgtccggcgcgtgctgagctacccccaggtgaacgtcgtaaagaaggtggaggaacagaaccacgggctggaccggggcaagcccaagggcctcttcaacgcgaacctgtccagcaagccgaagcccaactccaacgagaacctggtcggggccaaggaatacctcgaccccaagaagtacggcgggtacgccggcatcagcaactccttcgccgtgctggtcaaggggacgatcgaaaagggagccaagaagaagatcaccaacgtcctggagttccagggcatcagcatcctcgaccgcatcaactaccggaaagacaagctgaacttcctgttagagaaggggtacaaggacatcgagctgatcatcgaactgccgaagtactcactcttcgagctgtccgacggcagccgccggatgctcgcgtcgatcctcagcaccaacaataagcgtggggagatacataagggcaaccagattttcctgtcccagaagttcgtgaagctgctctaccacgccaagcggatcagcaacaccatcaacgagaaccaccgaaaatacgtggagaaccacaagaaggagttcgaggagctgttctactacatcctggagttcaacgagaactacgtcggtgccaagaagaacggaaagctcctgaacagtgccttccagagctggcagaaccattcgatcgacgagctatgcagctccttcatcggccccacggggagcgagcgcaagggcctcttcgagctaacatcccgggggagcgccgcagactttgagttcctgggcgtgaagataccccgctaccgggactacaccccctccagcctcctgaaagacgccaccctgatccaccagtccgtgacggggctgtacgagacccgcatcgacctcgccaagctgggcgagggcaagaggccggccgccaccaagaaggcagggcaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8262 - RNA, 3780 nt, synthetic construct
  misc_feature 1..3780: note = Cas9 variant mRNA product
  source 1..3780: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacccaaaaagaaacgcaaagtaggaatacacggagtgccggcagcatggtacgcgagccttatgagcgcccaccatctacgcgttggaatcgacgtaggcacccacagcgtaggactagccacactccgagtagacgaccacggaaccccaattgaattactatcggcactgagccacatccacgatagtggagtcgggaaagaaggaaagaaagaccacgacacacgaaagaaactgtcaggaatagcaagacgcgctcgaagactattacaccaccgacgaacacagctccaacaactagacgaagtcctacgagatctaggcttcccaatcccaacaccgggagagttcctagacttaaacgaacaaaccgacccataccgcgtgtggcgagtccgagcacgactcgtggaagagaaactcccagaggaattacgcggaccagccataagcatggcagtgaggcacatcgcccgacaccgagggtggaggaacccgtatagtaaagtagaatccctactaagccccgccgaggaaagcccattcatgaaagcactccgcgaacgaatcctcgcaaccaccggcgaagtactagacgatggcataacgccgggccaagctatggcccaagtcgcactgacccataacatctcaatgcgcggaccagaaggcatactaggaaaactacaccaatccgataacgcaaacgaaatccggaaaatatgtgcccgccagggggtcagccccgacgtttgcaaacagctactccgggccgtattcaaagccgactcacctagaggcagcgccgtgagtagagtagcacccgatccccttcccggtcaggggagcttccgcagagccccaaaatgcgacccagagttccagcgcttccgaataatatccatagtggcaaacctgcgaatatctgaaacgaaaggcgaaaacagaccactaaccgccgacgaacgcagacacgtcgtcaccttcctaacggaagacagtcaagccgatcttacttgggtggacgtcgcagaaaaactcggagttcaccgccgggacttaaggggaacagccgtacacaccgacgacggagaaagaagtgccgcccggcccccaatcgacgcaacggatagaatcatgagacagaccaaaatcagttccctcaaaacgtggtgggaagaagccgacagcgaacagagaggcgcaatgatcaggtacctgtacgaagacccaaccgattctgaatgcgcagaaatcatagctgaactcccagaagaagatcaagccaaactagactccctacacttacccgcaggacgcgccgcatacagcagagagagtctaacagccttaagcgaccacatgctcgcgacaaccgacgacctccacgaggcacgaaaacgccttttcggcgttgacgacagctgggccccacccgccgaagcaatcaacgcccccgtcgggaacccctcggtggaccgcacattaaaaatagtagggcgatacctctcagcagtcgaatctatgtggggcacgccagaagtcattcacgtagagcacgtccgagacgggttcacgagcgagcgcatggccgacgaacgagacaaggcaaaccgacgaagatataacgacaaccaagaagcaatgaagaaaatccagagagactacggaaaagaaggctacatatccagaggggacatagtaaggctggacgccctcgaactccagggatgtgcctgtctctactgcgggacaacaattggataccacacgtgccaactagaccacatcgtaccccaggcaggaccaggaagcaacaaccgccgagggaacctagtcgctgtatgcgaaagatgcaaccgctcgaaatcaaacaccccctttgcagtttgggcccaaaaatgcggcatcccccacgtcggagtaaaggaagcgatcggcagagtcaggggctggagaaagcaaacaccaaacacatcaagcgaagatcttacaaggctaaagaaggaggtcatcgcacgactaagacgaacacaggaggacccagaaatcgacgaaaggtccatggagagcgtagcctggatggcaaacgaactccaccacagaatcgcggccgcatacccagagacaaccgttatggtctatagaggtagtatcacagcggctgcacggaaagccgccggaatagactcccgcatcaatcttataggagagaagggacgaaaagacagaatcgaccgccggcaccacgccgtggatgcctccgtcgtcgcgctaatggaggcaagcgtcgcaaaaacactagccgaacgcagcagcctgcgcggcgaacagcgcctaaccggaaaagaacagacctggaaacaatatacaggcagtaccgtaggagccagagaacacttcgaaatgtggagaggccacatgctccacctcacggaactgttcaatgaaagactagccgaagacaaagtttacgtaacacagaacatacgcctgcgactcagcgacggcaatgcacacaccgtcaaccccagcaaactcgtatcacaccgactcggcgacggactcacagtacaacaaatcgaccgcgcgtgcactccagccctgtggtgtgccctaacccgagaaaaagacttcgacgagaaaaacggcctaccggcacgagaagaccgggccatccgagtgcatgggcacgaaataaaatcgtcagactacatacaagtgttctccaaaagaaagaaaaccgactcagaccgagatgagacaccgttcggagcaatagcggtacgtggagggttcgtcgagatcggacccagcatccaccacgccagaatatacagagtagaaggaaagaaaccagtctacgcaatgctcagggtgttcacacatgacctcttaagccagcgacatggcgacctatttagcgcggtgataccaccacaaagtatcagcatgagatgcgcggaacccaaactccgcaaagcgataacaacgggaaacgccacatatctagggtgggtcgtagtgggcgacgagcttgaaataaacgtagacagtttcaccaaatacgctattggacgcttcctcgaagacttcccaaacacaacacgatggcgcatctgcggttacgatacaaactcaaaactcacgctgaagccaatcgtcctggccgccgaaggactcgaaaacccgtcctcagccgtcaacgagatcgttgaactgaagggatggagagtagcgatcaacgtcctcacaaaagtccacccaacagtagtccgacgcgacgcactaggacgaccgcgctatagttcgagatcaaacctaccaacaagctggacgatcgagaaacgcccagccgcaacaaagaaagccggacaagcgaagaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8263 - RNA, 4641 nt, synthetic construct
  misc_feature 1..4641: note = Cas9 variant mRNA product
  source 1..4641: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtccctgccgcgaccaagccctacagcatcggcctggacatcgggaccaactccgtgggctgggccgtgacgaccgacaactacaaggttcccagcaagaagatgaaggtgctcgggaacactagcaagaagtacatcaagaagaacctattaggcgtgctcctgttcgacagcggcatcacggccgaggggcggcgcctgaagcggacggcccgcagacgctacacccggcgccggaatcgcatcctctatctgcaagagatcttctccaccgagatggccaccctagacgacgccttcttccaacggctagacgacagcttcctggtccccgacgacaagcgcgactccaaatacccgatcttcggcaacctggtggaggagaaggcctaccacgacgagttccccaccatctaccacctccggaagtacttggccgacagcaccaagaaggccgacctgcgcctcgtgtacctggcgctggcccacatgatcaagtaccgggggcactttctcatcgagggcgagttcaactccaagaacaacgacatccagaagaacttccaggacttccttgacacctacaacgccatcttcgaaagcgacctgtccttggagaatagcaagcagctggaggagatagtcaaggacaagatctccaagctggagaagaaggaccgcatcctcaagctgttccccggggagaagaacagcggcatcttctccgagttcctgaaactcatcgtgggcaaccaggccgacttccggaagtgcttcaacctggacgagaaggccagtctgcacttctccaaggagagctacgacgaggacctcgagaccctgctggggtacatcggcgacgactactccgacgtgttcctcaaggcgaagaagctgtacgacgccatcctgctcagtgggtttctgacggtcaccgacaacgagaccgaggcgcccctgagctccgccatgatcaagcgctacaacgagcacaaggaggacctcgcactgctgaaggagtacatccggaacatcagcctcaagacctacaacgaggtgttcaaggacgacacgaagaacggctacgccggctacatcgacggaaagaccaaccaggaggacttctacgtgtacctgaagaagctgctcgccgagttcgagggcgcagactacttccttgagaagatcgaccgcgaggacttcctgcggaagcagcgcaccttcgacaacggttccatcccgtaccaaatccacctccaggagatgcgcgccatcctggacaagcaggccaagttctaccccttcctggcgaagaacaaggaacggatcgaaaagatcctgaccttccgcatcccctactacgtcggccctctcgcccgggggaacagcgacttcgcctggtccatccgcaagagaaacgagaagatcacgccttggaacttcgaggacgtgatcgacaaggagagctccgccgaggccttcatcaatcgcatgaccagcttcgatctgtacctccccgaggagaaggttcttcccaagcactcgctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacattatcgagtacctccacgcaatctacggctacgacggcatcgagctgaaggggatcgagaagcagttcaacagctccctgagcacctaccacgacctcctgaacatcatcaacgacaaggagttcctggatgactccagcaacgaagccatcatcgaggagatcatccacaccctcaccatcttcgaggaccgggagatgatcaagcagcgcctgtcaaagttcgagaacatcttcgacaagagcgtgctgaagaagctctcccggcgccactacacgggctgggggaagctgagcgccaagctgatcaacggcatccgggacgagaagtccgggaacaccatcctcgattacctgatcgacgacggcatcagcaaccgcaacttcatgcagctgatccacgacgacgcgctcagcttcaagaagaagatccagaaagcacagatcatcggcgacgaggacaaggggaacatcaaggaggtggtcaagtccctgcccggcagcccggccatcaagaaagggatcctgcagtccatcaagatcgtggacgagctcgtcaaggtgatgggcgggcgaaagcccgagagcatcgtggtcgagatggcccgcgagaaccagtacaccaaccagggcaagtccaacagccagcagcggctgaagcgcctggagaagtccctcaaggagctgggcagcaagatactgaaggagaacatccccgccaagctctccaagatcgacaacaacgcgctgcagaacgaccgcctgtacttgtactacttgcagaacgggaaggacatgtacaccggcgacgacctggacatcgaccggctaagcaactacgacatcgaccacatcatcccccaggccttcctgaaggacaactccatcgacaacaaggtgctggtgagctccgcgagcaaccgcgggaagtccgacgacgtcccgagcctcgaggtggtgaagaaacggaagacgttctggtaccagctgctcaagagcaagctgatctcccagcgcaagtttgacaacctgaccaaagcagagcgtggcggcctgagccccgaggacaaggccgggttcatccaacgccagctcgtcgagacccggcagatcaccaagcacgtggcgcgcctgctggacgagaagttcaacaacaagaaggacgagaacaaccgggccgtgcgcacggtcaaaatcatcaccctcaagtccaccctggtgagccagttccgaaaggacttcgagctgtacaaggtgcgcgagatcaacgacttccaccacgcccacgacgcctacctcaacgccgtggtggcgtccgccctgctgaagaagtaccccaagctcgagcccgagttcgtgtacggcgactacccgaagtacaatagcttccgggaacgcaagtccgccaccgagaaggtctacttctacagcaatatcatgaacatattcaagaagtccatcagcctggccgacgggcgggtgatcgagcgccccctgatcgaggtgaacgaggagaccggcgaatccgtctggaacaaggagagcgacctcgcgacggtgcggcgcgtcctgtcctacccccaggtcaacgtggtgaagaaggtcgaggagcagaaccacgggctggaccgggggaagcccaagggcctcttcaacgccaacctgagctccaagccgaagcccaacagcaacgaaaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgatcgcatcaactaccggaaggacaagctgaacttcctgctcgagaaggggtacaaggacatcgagctgatcatcgagctgccaaagtacagcctcttcgagctgagtgacggctcccgccgcatgctggcgagcatcctctccacgaacaacaagcgcggggagatccacaagggcaaccagatcttcctgagccagaagttcgtgaagctgctctaccacgccaagcggatctccaacaccataaacgagaaccaccggaaatacgttgagaaccacaagaaggagttcgaggagctgttctactacatcctggagttcaacgagaactacgtcggggccaagaagaacgggaagctcctgaacagcgcctttcagtcctggcagaaccacagcatcgacgagctgtgctctagcttcatcggccccacagggtccgagcgcaagggcctcttcgaactgaccagccgggggtccgccgcggacttcgagttcctgggcgtgaagatcccccgctaccgggactacacgcccagctccctcctcaaggacgctaccctgatccaccagagcgtcacggggctctacgagacccgcatcgacctggccaagttgggagagggcaagcggccggccgccacgaagaaggcgggtcaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8264 - RNA, 3723 nt, synthetic construct
  misc_feature 1..3723: note = Cas9 variant mRNA product
  source 1..3723: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccgaaaaagaaacgcaaagtgggcatccacggagtaccagccgctgccgccttcaaaccaaacagcataaattatatcctcggcctagatatcggtatcgcctccgtagggtgggccatggtcgagattgatgaagaagaaaacccaatcaggctcatagacctaggcgtacgagtcttcgaacgcgccgaagtcccaaaaacaggagattccctcgctatggcacgaagactagcaagaagcgtgagacgacttacccgccgacgcgcccaccgcctcctccgaactcgtcgcctcctaaagcgcgaaggagtcctccaagccgccaatttcgacgaaaacggtctaatcaaaagcctccccaacacgccatggcaactccgagcagcggccctagaccggaaactaacacccctagaatggtccgctgtcctactgcacctcatcaaacaccgcggatacctaagccagaggaaaaacgaaggagagaccgccgacaaagaactaggcgcgctactgaaaggtgtagcaggcaacgcacatgccctacagacgggtgactttcgaacaccggcagagctcgcacttaacaaattcgaaaaagaatctggacatatccgaaatcaaagatccgactacagccacacattcagccgaaaagatctacaagccgaactcatccttctattcgaaaaacaaaaagagttcggaaatccccacgtatcgggcggactgaaggaagggatcgaaaccctactcatgacacaacggcccgccctatcaggcgatgccgttcagaaaatgctaggccactgcacattcgaaccagccgaaccaaaggcggccaaaaacacctacacagcggaacgcttcatctggttaactaaactgaataacttacgcatactcgaacaaggctctgaacgacccctcacggatacagaacgcgcaaccctaatggacgagccctaccgcaaaagcaaactgacctatgcacaagcgagaaaactcctaggactcgaagacacagccttcttcaaaggtctcaggtacggaaaagataacgccgaggccagcacactcatggaaatgaaagcctaccatgccatcagccgagccctggaaaaagagggcctcaaagataagaaaagccctctcaaccttagccccgaacttcaagatgaaatcggaaccgcatttagcctcttcaaaacagacgaagacatcaccggacgactgaaagaccgcatccaaccagagatactcgaggcgctgctaaaacacatatccttcgacaaattcgtacaaatcagcttaaaggcactacgccggatagtacccctaatggaacaagggaaacgatacgacgaagcatgtgccgaaatatacggtgatcactacggaaagaaaaacactgaagaaaagatctacctcccaccaatacccgccgacgaaataaggaaccccgtagtactacgtgccctctcacaagcacgcaaagtcattaacggagtagtcagaagatatggcagccccgcgcggatccacatcgaaacagcccgcgaagtaggcaaatctttcaaagatcgcaaagaaatcgagaaaagacaagaagagaatagaaaagatcgagagaaagccgccgcaaaattccgagaatatttccccaacttcgtcggtgaaccaaaaagtaaagacatcctcaaactccgcctctatgagcaacagcacggaaaatgcctatacagcggaaaagaaatcaacctcggccggctaaacgagaagggatacgtagaaatagaccacgccctcccattctcgcgaacatgggacgactcttttaataacaaagtcttagtcctcggatcagagaaccaaaacaaaggaaatcaaacgccatacgagtacttcaacggcaaggacaacagcagagaatggcaagagttcaaagcacgagtggaaacctcccgattcccacgctccaagaaacaaagaatcctactccagaaattcgacgaagacgggttcaaagaacgcaacctgaacgatacacggtacgtcaaccgcttcttatgccaattcgtggcggaccgcatgcgcctcacgggaaaaggtaagaaacgggtattcgccagcaacggacagataacgaacctcctccggggattctggggcctccgaaaagtccgggcagaaaacgaccgacaccacgcgctagacgcggttgtcgttgcttgcagcaccgtcgccatgcagcagaaaataaccagatttgtcagatacaaagagatgaacgcctttgacggaaaaactatcgacaaagagacaggcgaagtactacaccaaaagacacacttcccgcaaccatgggagttcttcgcccaagaagtcatgataagggtattcgggaaaccagacggcaaaccagagttcgaagaagcagacaccctagaaaagctccgcaccctactggcagaaaagttgagcagccgccccgaagccgtacacgaatacgtaacaccactcttcgtctcccgagcacccaaccgaaaaatgagcggccaaggccacatggaaaccgtaaaatccgccaagcgcctggacgaaggcgtctccgtactaagagtacccctcacccaactcaagctaaaagacctggagaaaatggttaacagagaaagagaaccaaagctatatgaggccctcaaggcgcgcctcgaggcacacaaagacgacccagcaaaagcattcgctgaacccttctataaatacgataaagccgggaacagaacacaacaggtaaaggccgtccgggtagaacaggtacagaagaccggagtctgggtccgaaaccataatggcatcgcagacaacgcaacaatggtacgcgtcgatgtgttcgaaaaaggcgacaagtactacctagtacccatatacagctggcaggtcgcgaaaggcatcctaccggacagggccgtagtccagggcaaagatgaagaagactggcagctaatcgatgattccttcaactttaaattcagcctacacccaaatgacctcgtagaagtaatcaccaaaaaggcaagaatgttcggatacttcgccagctgccacagaggaaccggaaacatcaacattcggatacacgacctcgatcacaaaataggcaagaatggcatactcgagggcataggggtcaaaaccgcactatccttccagaagtaccaaatcgacgagcttggaaaagaaatccggccctgtcgactgaagaaaaggccaccagttcggaagagaccggccgccaccaaaaaggcaggtcaagccaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8265 - RNA, 4479 nt, synthetic construct
  misc_feature 1..4479: note = Cas9 variant mRNA product
  source 1..4479: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgaagaagccatacaccatcggcctggacatcgggaccaacagcgtgggctgggccgtgctcaccgaccagtacgacctggtcaagcggaagatgaagatcgccggggactccgagaagaagcagatcaagaagaacttctggggcgtgcgcctgttcgacgagggccagaccgccgctgaccggcgcatggcgcggaccgcccgccggcgcattgagcggcgccggaaccgcatcagctacctccagggaatcttcgccgaggagatgtccaagaccgatgccaacttcttctgccggctgagcgactccttctacgttgacaacgagaagcgcaacagccggcaccccttcttcgcgacgatagaggaggaggtcgagtatcacaagaactaccccacaatctaccacctccgcgaggaactcgtgaactccagcgaaaaggccgacctgcgtctagtgtacctcgccctggcccacatcatcaagtaccgcggcaacttcctgatcgagggggccctcgacacccagaacacctccgtcgacggcatctacaagcagttcatccagacgtacaaccaggtgttcgcgtccgggatcgaggacggctcccttaagaagctggaggacaataaggacgtggccaagatcctcgtcgagaaggtgacccggaaggagaagctggagcgcatcttaaagctctacccgggcgagaagtccgccgggatgttcgcccagttcatcagcctaatcgtgggcagcaaggggaacttccagaagcccttcgacctgatcgagaagtccgacatcgagtgcgccaaggactcgtacgaggaggacctcgagtccctgctggcgctcatcggggacgagtacgccgagctgttcgtcgccgccaagaatgcctacagcgcggtggtgctgagtagcatcatcaccgtcgccgagaccgagacgaacgccaagctcagcgcctccatgatcgagcggttcgacacccacgaggaggacctgggcgagctgaaggcattcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaagagaacttcctgcgcaagcagcgcacattcgacaacggggcgattccccaccaactgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgattttggcaagtccgccgtagacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcgtatttcagcggccaggagaaggagcagatcttcaacgacctgttcaagcagaagcggaaggtcaagaagaaggacctcgagctgttcctgcgtaacatgtcccacgtggagagccccacgatcgaggggctggaggactccttcaacagctcctacagcacctaccacgacctcctgaaggtgggcatcaagcaggagatcctggacaaccccgtcaacacagagatgctcgagaatatcgtgaagatcctgacagtgttcgaggacaagcggatgatcaaggagcagctgcagcagttctccgacgttctcgacggcgtggtgctgaagaagctggagcgccggcactacacggggtggggccgcctcagcgccaagctgctgatggggatccgggacaaacagtcccacctcaccatcctggactacctgatgaacgacgacggcctcaatcgcaacctgatgcagctgatcaacgacagcaacctttcattcaagagcatcatcgagaaggagcaggtcaccaccgccgacaaggatatccagagcatcgtggccgacctggcgggatccccggccatcaagaagggcatcctgcagagcctcaagatcgtggacgaactggtctccgtgatgggctacccgccccagacgatcgtggtcgagatggcccgggagaaccagactaccgggaagggcaagaataacagccgcccccggtacaagtccctggagaaggccatcaaggagttcgggagccagatccttaaggagcaccccaccgataatcaggagctgcgcaacaaccgactgtacctctactacctgcagaacggcaaggacatgtacacgggccaggaccttgacatccacaacctctccaactacgacatcgaccatatcgtgccccagagcttcatcaccgacaactccatcgacaacctggtgctgaccagctccgccgggaaccgcgaaaagggcgacgacgtcccgcccctcgagatcgtgcgcaagcgcaaggtgttctgggagaagctgtaccaggggaacctgatgagcaagcgcaagttcgactacctgaccaaggcggagcggggcgggctgaccgaagccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccaactctacaaggtgcgcgacgtcaacgactaccaccacgcccacgacgcctacctgaacggcgttgtggcgaacactctgctcaaggtctacccccagctggagcccgagttcgtgtacggggactaccaccagttcgactggttcaaggccaacaaggcgaccgccaagaagcagttctacaccaacatcatgttgttcttcgcccagaaggaccggatcatcgacgaaaacggtgagatcctctgggataagaagtacctggacaccgtgaagaaggtcatgtcctaccgccagatgaacatcgtgaagaagacggagatccagaagggggagttctcgaaggccaccatcaagcccaagggcaactccagcaagttaatcccccggaagaccaactgggacccgatgaagtacgggggcctcgacagccccaacatggcctacgcggttgtcatcgaatacgccaagggcaagaacaagctggtgttcgagaagaagatcatccgcgtgaccatcatggagcggaaggccttcgagaaggacgagaaggccttcctggaggagcaggggtaccgccagccgaaggtcctcgccaagctgccgaagtacacgctgtacgagtgcgaggagggccggcgccggatgctcgcgtccgcaaacgaggcccagaaggggaaccagcaggtcctgcccaaccacctggtgaccctcctgcaccacgccgcgaactgcgaggtgagcgacggcaagtccctggactacatcgagagcaaccgcgagatgttcgcggaactcctggcccatgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaaattcttcgagaccacgatcgagcgcaagcggtacaacaacctcaaggagctgctgaacagcaccatcatctaccaatccatcaccggcctctacgagtctcgcaagcgcctcgacgacaagcggcccgccgccaccaagaaggcagggcaggcgaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8266 - RNA, 4512 nt, synthetic construct
  misc_feature 1..4512: note = Cas9 variant mRNA product
  source 1..4512: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggctcccaagaagaaacgcaaggtgggcatccacggggtcccggcagcgaagaagccctacagcatcggcctggacatcggcaccaattccgtgggttgggccgtggtaaccgacgactacaaggtgcccgccaagaagatgaaggtgctcgggaacacggacaagagccacatcgagaagaacctgctgggcgccctactgttcgactccggcaataccgccgaggatcggcgcctaaagcggaccgcgcgcagacgatacacccggcgccggaaccgcatcctctaccttcaggaaatcttctcagaggagatgggaaaggtcgacgactccttcttccaccggctggaggacagcttcctcgtgacggaagacaagcgaggcgagcggcaccccatcttcgggaacctggaggaggaagtgaagtaccatgagaacttcccgaccatctaccacctccgccagtacctggccgacaatcccgagaaggttgacctgcggctggtgtacctcgccctggcccacatcatcaagttccgcgggcacttcctgattgaggggaagttcgacacgcggaacaacgacgtgcaacgcctctttcaggagttcctggcggtctatgataacacgttcgagaactccagccttcaggagcagaacgtccaggtggaggagatcctcaccgacaagatctctaaaagcgccaagaaggaccgggtgctgaagctgttccccaacgaaaagtccaacggccgcttcgccgagttcctcaagctgatcgtgggcaaccaggccgacttcaagaagcatttcgagctggaggaaaaggccccgctacagttcagtaaggacacctacgaggaggagctggaggtgctgctcgcgcagataggtgataattacgccgagctgttcctgtccgccaaaaagctgtacgacagcatcctgctgtccggcattctaacagtcaccgacgtgggaacgaaggccccgcttagtgcttcaatgatccagcggtataacgaacaccagatggacctggcgcagctaaagcagttcataagacagaagctgagcgacaagtacaacgaagtgttctccgacgtcagcaaggacggctatgccggctacatcgacgggaagaccaaccaggaggccttctacaagtacctgaaggggctcctgaacaagatagaggggagcggctacttcctggacaagatagagcgcgaggacttcctacggaagcagcgtactttcgacaacgggtccataccccaccagatccacctccaggagatgcgggccatcatccgccgtcaggcagagttctaccccttcctcgcggacaaccaggaccgcatcgagaagctgctgaccttcagaatcccctactacgtggggccgctggcccgcggcaagagcgactttgcctggctgtcccgtaagagcgccgacaagataacgccctggaacttcgacgagatcgttgacaaggagagcagcgccgaggcgttcatcaacagaatgaccaactatgacctctacctccccaaccagaaggtcctgcccaagcactccctcctatacgagaagttcaccgtctacaatgagctgaccaaggtgaagtacaaaacggagcaagggaagaccgcgttcttcgacgctaacatgaagcaagagatcttcgacggcgttttcaaagtgtaccggaaggtcactaaagataagctcatggacttcctggagaaggagttcgacgagttccgcatcgtggacctgaccggtctggacaaggaaaacaaggtgtttaacgccagctacggcacgtaccacgacctgtgcaagatactcgataaggacttcttagataactccaagaacgagaagatcctggaggacatcgtcctgaccctcactctgttcgaggaccgggagatgatccgcaagcggctggagaactatagcgacctcctgacaaaggagcaggtcaagaagctggagcgccggcactacactgggtggggtcgcttgtccgcggagctaatccacggcatccggaacaaggagagcaggaagaccatcctagactacttaatcgacgacgggaactccaacaggaacttcatgcagctgatcaacgacgacgccttgtcttttaaggaggaaatcgccaaggcccaggtgatcggcgagaccgacaacctcaaccaagtggtgtccgacatcgccgggtctccggcgatcaagaagggcatcctgcagtccctgaaaatcgtggacgagctcgtcaagatcatgggccaccaacccgagaacatcgtggtggaaatggcccgtgaaaaccagttcaccaatcagggtcgccggaacagccagcagcgactgaagggcctgacggactccatcaaggagttcgggagccagatcctcaaagaacacccagtcgagaacagccaactgcagaatgaccgactgttcctctactacctgcaaaacgggcgcgacatgtacaccggggaggagctggacatcgactacctctcccagtacgatatcgaccacataatcccccaagccttcatcaaagacaacagcatcgataaccgggtgctgacctccagcaaagagaacaggggcaagtccgatgacgtacccagcaaggacgtcgtgcggaagatgaagtcctactggagcaagctgctctccgccaagctgatcacccagcgcaagttcgacaacttgacgaaggctgagcggggcgggctcaccgacgacgacaaggcgggcttcatcaagcgccagcttgtggagacccggcagatcaccaagcacgttgcccggatcctggacgagcggttcaacaccgagacggacgagaacaataagaaaatccgccaggtgaagatcgtgaccctcaagagcaacctggtctccaacttccggaaggagttcgaactgtacaaggtccgagagataaatgactaccaccacgcccacgacgcctacctcaacgccgtgatcgggaaggcgctgctgggcgtctacccccagctcgagcccgagttcgtttacggggactacccccacttccacggccacaaggagaacaaggccaccgccaagaagttcttctacagcaacatcatgaactttttcaagaaggacgatgtgcggactgacaagaacggcgagatcatctggaagaaagacgaacacataagtaacatcaagaaggtcctgagctacccccaggtgaacatcgttaaaaaggtcgaggagcagaccggaggcttctccaaagagtcgatcctccccaaggggaactccgacaaacttatcccccgcaagacgaagaagttctactgggacaccaagaagtacggcgggttcgacagccccatagtggcctacagcatcctggtgatcgcagacatcgagaagggcaagtccaagaaactgaagaccgtcaaggcactcgtgggcgtaacgataatggaaaagatgaccttcgagcgggacccggtcgccttcttggagcgcaaggggtatcgcaatgtgcaggaggagaacatcatcaagctgcccaagtatagcctcttcaagctcgagaacgggcggaagcgcctgctagcctccgccagggagctgcagaaggggaacgaaatcgtgctgcccaaccaccttggaaccctgttataccacgcgaagaacatccacaaggtcgatgagccgaagcatctcgactacgtggacaaacacaaggatgagtttaaggaactgctggacgtggtctcaaacttctccaagaagtacaccctcgccgagggtaatctagagaagatcaaggagctgtatgcccagaacaacggcgaggacctcaaggagctcgctagcagtttcatcaaccttctcactttcacggccatcggggcgcccgccaccttcaagttcttcgataagaacatcgaccgcaagcggtacaccagcacgaccgagatcctgaacgccacgcttatccaccagtccataaccggactctacgagacgcgcatcgacctgaacaagctgggcggggacaagcggcccgccgccaccaagaaggcgggccaagccaaaaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8267 - RNA, 3645 nt, synthetic construct
  misc_feature 1..3645: note = Cas9 variant mRNA product
  source 1..3645: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacctaaaaagaaacggaaagtgggcatacacggcgttccagccgcacaaacaaccaacctcagttacatactaggtctagacctcggtatcgcatcagtcggctgggccgtcgtcgaaatcaacgaaaacgaagaccccatcggactaatagacgtcggcgtaaggatattcgaacgcgccgaagtcccaaaaaccggagaaagcctagcactgtccaggagactcgcgcggagtacccgccgcctaatacgccgccgagcccaccgcctactcctcgcgaaacgcttcctcaagagagaaggcatactgagcaccatagacctcgagaaaggcctgccaaaccaggcctgggagctaagagtcgccggcctcgaaaggcgactatcggccatcgaatggggagccgttctcctgcacctaataaaacacagggggtacctatcgaaaagaaagaacgagagtcaaacgaacaacaaggagctgggcgccctgctaagcggagtggcgcaaaaccaccagctcctacaatccgacgactaccgaacacccgcagaattagccctcaagaaatttgcaaaagaagaggggcacataagaaaccaacgcggcgcttacacacacaccttcaatagattagacctcttagcagaactgaacctgctattcgcacaacagcatcaattcggaaacccacactgtaaagagcacatccagcaatacatgactgaactcctaatgtggcagaaacccgcactcagtggcgaggccatcctaaaaatgctcggaaaatgcacacacgagaaaaacgagttcaaagccgcgaaacatacctacagcgccgaacgttttgtttggctcaccaaactcaataaccttcgaatactcgaagacggggccgaacgggcactaaacgaagaagaaagacaactactaatcaaccacccgtacgaaaagagcaaactaacatacgcgcaggtacgaaaattactaggcctctccgaacaagctattttcaagcacctacgctacagtaaagaaaacgcagagtcagccaccttcatggagctcaaagcctggcacgccatacgaaaagcactcgaaaaccagggcctgaaggacacctggcaggacctcgccaagaaacccgatctcctcgacgaaatcggaaccgccttctcactctacaaaacagatgaagacatccaacaatacctaacgaacaaagtacccaacagcgtaataaacgcactactcgtatccctgaacttcgataagttcatcgaactcagcctgaaaagcctgagaaaaatacttcctctaatggaacaaggcaaacgctacgatcaggcctgccgcgagatctacggacatcactacggggaggccaaccaaaagacgtcacaactcctgcccgccattccagcccaagaaatacgcaaccccgtagtcctgcgaacgctgtcccaagcaagaaaagtaataaacgccatcatacgacaatacggctcccccgcccgagtccacatagaaacgggtcgagaactagggaaatccttcaaagaacgacgcgaaatccaaaaacagcaggaggataatcgaaccaaacgcgagtcagcggttcaaaagttcaaggaactcttctccgacttcagcagcgaaccaaaatctaaagacatactcaagttccgcctttacgagcaacaacacggtaaatgcctatactcgggcaaagaaatcaacatacacaggctgaacgaaaaaggatacgtcgagatcgaccacgcactacccttcagtcggacctgggacgactcattcaacaataaagtacttgtcctagcaagcgagaaccaaaacaaaggcaaccagacaccatacgagtggctacaagggaaaataaactccgaacgctggaaaaacttcgtcgcactggtactcggcagccagtgctcagccgcgaagaaacaacgcctcttgacccaggtcattgacgacaacaaatttatcgaccgcaaccttaacgacactcgatacatcgcacgcttcctatcaaactacatccaggaaaacctcctactcgtcggcaaaaacaaaaagaacgtattcacgccaaacggccaaatcacagccctgctccggtcgcgatggggactaatcaaagctcgagaaaacaacaaccgacaccatgccctagatgcgatcgtggtcgcttgcgcgaccccctcaatgcaacagaaaataacccgcttcatccgatttaaagaagtccacccctacaaaatagaaaaccgatacgaaatggtcgaccaagagagtggagaaattataagcccccacttccccgagccatgggcatacttcaggcaagaggtaaacatccgagtattcgacaaccaccccgacacggtgctaaaagagatgctcccggaccggccacaggcaaaccaccaattcgtacaacctctattcgtctcccgagcgcccaccagaaaaatgtccggccaaggccacatggaaaccatcaagtccgccaaacggctggcagaaggcatctccgtactccgaatacccctaactcaactcaaacccaatctcctggaaaacatggtaaataaggagcgcgaacccgccctgtacgcaggccttaaagcccgactcgccgagttcaaccaggaccccgcaaaagccttcgccacaccattctacaaacaaggcggccagcaggtaaaagcaatccgagtagagcaagtacaaaaatcaggagtcctagtacgcgaaaacaacggagtcgccgacaatgcctcaatcgtacgaaccgacgtattcatcaaaaacaacaaattctttctcgtccccatctacacgtggcaagtagcaaagggaatcctaccaaacaaggcaatcgtcgcacacaaaaatgaagacgaatgggaagaaatggacgaaggtgccaaattcaagttctctctcttccccaacgaccttgtcgaactaaaaaccaagaaagaatacttcttcggctactacatcggactggaccgggcaacagggaacataagcctaaaagagcacgacggcgaaatctccaaaggcaaagacggagtctacagggtaggcgtcaaacttgcactgagctttgaaaaataccaagtagatgagcttgggaaaaaccgacaaatctgccgaccccaacaaagacaacctgtcagaaagagaccagccgcaactaaaaaggcaggacaagccaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8268 - RNA, 3723 nt, synthetic construct
  misc_feature 1..3723: note = Cas9 variant mRNA product
  source 1..3723: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacccaaaaagaaacgcaaagtcggaatccacggagtaccagcagcagccgcctttaaaccaaacccaatcaactacatactcggattagacatagggatagcatcagtcggatgggccatggtcgagatcgacgaggacgaaaaccccatatgcctcatagacctgggggttagggttttcgagcgtgcagaggttccaaaaacaggcgacagcctagcaatggcacgtagactagcgcgctctgtccgcagactcacgagacgacgggcccacagactgctaagagcccgccgcctgctcaaaagagaaggagtcctacaagccgccgactttgacgaaaacggactcataaaaagcctccccaacacaccctggcaacttcgggcggccgccttagaccgaaaactcacacccctcgagtggtccgccgtgctactgcacctgatcaaacatcgaggatacctcagccaacgcaaaaacgagggagaaacggcagacaaagagctcggcgcactgcttaaaggcgtagcggacaacgcacacgcactacagacgggggacttccgcacgccagccgagctcgcactcaacaaattcgagaaagaaagcggtcacatccgaaaccagcgcggagactactcccacacattctcccgaaaagacctgcaagccgaactcatcctactattcgaaaaacagaaagagttcggcaacccacacgtatcaggcggtctaaaagaaggtatagaaacactcctcatgacccaaagaccggccctgtcaggagacgcagtccagaaaatgctcgggcattgcacattcgaaccagcagagcccaaggcagctaaaaacacatacaccgcagaacgattcatctggctgaccaagctcaacaacctcagaatattagaacaagggtctgaacgccccctgactgacacggaacgcgcaacactcatggacgaaccgtaccgcaaaagcaaactcacctacgcacaagcccgtaaactactgggcctcgaagacacagctttcttcaagggtctgcgatacggaaaagacaacgcagaagcatcaacattaatggaaatgaaggcttaccatgccatcagccgagccctagaaaaggaaggcctaaaagataagaaaagtcccctaaacctgtcgcccgagctacaagatgaaatcggcacagccttctcgctttttaaaaccgacgaggacatcacagggcgactcaaagaccgaatacaacccgagattctggaggcgctcctcaaacacatatcattcgacaaattcgtccaaatatccctcaaagcactacgcagaatcgttcctctcatggaacaaggcaaacgctacgatgaagcctgcgcagaaatatatggagaccattacgggaaaaagaacaccgaagagaaaatctatctgcccccgatcccagcggacgaaatacggaatcccgtcgttctgcgagcgctatcccaagcgagaaaagtaatcaacggggtcgtcagacgctacggcagtcccgcaagaatacacatagaaaccgcccgagaggtcggcaaatccttcaaagaccgcaaagagatcgaaaaacgccaagaagaaaatcgcaaggaccgagaaaaagcggcagcgaaattcagagaatacttcccaaacttcgtcggggaacccaaatccaaagatatcctaaaactccgcctatatgaacaacagcatggcaaatgcctctacagcggtaaggaaatcaacttaggaagactgaacgaaaaaggctacgtggaaatagaccacgcgctcccattcagccgcacttgggacgactcattcaacaacaaagtgctggtcctcggctcagagaaccagaataaagggaatcaaaccccctacgaatacttcaacggcaaagacaacagccgcgaatggcaagagttcaaggcacgagtggagacctcgcgcttccccagaagcaagaaacagcgaatactcctacagaaattcgacgaagatggcttcaaagaaaggaacctaaatgacacacgctacgtaaaccgctttctttgccaattcgtagcagaccggatgcggctcactggaaagggcaaaaagagagtcttcgcatccaacggacaaatcactaacctgctgaggggattctggggattacgcaaagtccgggcagagaacgaccgacaccatgcgctcgacgccgtagtcgtagcatgcagcaccgtagccatgcaacagaaaatcacgcgcttcgtgagatacaaggaaatgaacgcattcgacggaaagaccatcgacaaagagaccggagaagtcctacaccagaagacccatttcccccaaccctgggagttcttcgcccaggaagtcatgatacgcgtcttcggcaaacccgacggaaagccagagttcgaagaagcggacacgccagaaaaactaagaacgctgctcgccgagaaacttagctccagacctgaagcagtacatgaatatgtaaccccactcttcgtaagccgagccccgaaccgcaaaatgtccggccaggggcacatggaaacagtaaaatcagccaaacgcctagacgagggcgtgagcgtactaagggtaccgcttacacaactcaagctaaaagacctagagaaaatggtcaaccgcgagcgcgaaccaaagctctacgaggcccttaaggctcggctagaggcacacaaagacgacccagccaaagccttcgcggaaccgttttacaaatacgacaaggccggcaatcggactcaacaagtcaaagccgtaagagtagagcaggtccagaaaacaggcgtctgggtacgtaaccacaacggcatagcagacaacgccactatggtacgcgtcgacgtgttcgaaaaaggcgacaaatattatctagtgcccatatacagctggcaagtcgcaaaaggaatcctaccagaccgcgcggtggtccaaggaaaggacgaagaagactggcaactcatcgacgacagcttcaacttcaaattcagcctacaccccaacgacctagtcgaagtcatcacaaagaaggcccggatgttcgggtacttcgcctcctgccaccgcggcaccggtaacataaacataaggatccatgacctcgaccacaaaataggcaaaaacggaatattagaaggcatcggggtaaaaacagcccttagcttccaaaaataccaaatagacgagctaggaaaagaaataaggccctgccgactcaaaaagagaccaccagtgcgcaaaaggcccgcagcaacgaagaaagccggccaagccaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8269 - RNA, 3729 nt, synthetic construct
  misc_feature 1..3729: note = Cas9 variant mRNA product
  source 1..3729: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccgaagaagaaaaggaaagtcggcattcacggagtcccagccgcaaaataccatgtaggcatagacgtaggaacattcagcgtagggctcgcggcaatagaggtagacgacgcaggtatgcccatcaaaaccctaagccttgtgtcacacatccacgacagcggcctcgatccagatgaaatcaaatcggcggtcacgcgactagcaagcagcggtatcgccagacgaacgcgcagactgtaccgaaggaaaaggagaagactccagcaactggacaaattcatacaacggcaaggatggccagtgatagaattagaggactacagcgacccactatacccctggaaagtaagagccgagctcgcagcaagttacattgcggatgagaaagaacgaggcgagaaattgagcgtggcactgagacatatcgccagacacagaggatggcgcaacccatacgcaaaagtaagcagcctatacctcccagacgggccgtccgacgcattcaaagcgatcagagaagagataaagagggcgagtgggcaaccagtgccagaaacagccacggtgggacaaatggtgaccctatgcgaactaggcacgctgaagctaagaggagaaggcggagtcctgagtgcacggttgcagcaaagcgactacgcccgcgaaatacaagaaatatgccgcatgcaagaaatagggcaagaactctacagaaaaataatcgacgtagtattcgcagctgaaagcccaaaggggagcgccagcagccgagtaggaaaagaccccttacaacccgggaaaaaccgcgcgctaaaggccagcgacgcattccaacgatacaggatagcagccttaataggaaacctaagagtccgagtagatggagagaaacgcatcctcagcgtagaggagaagaacctcgtgttcgaccatctggtcaatctaaccccaaagaaagaaccagaatgggtaacgatcgcagaaatactgggcatagacagagggcagctaataggaaccgccacgatgacggacgacggagaacgcgcgggagcccgaccacctacgcacgacacgaacagatccatcgtgaacagccgaatagccccgctagtcgactggtggaaaacagcgagcgccctcgaacaacatgcaatggtcaaggctctaagcaacgcggaagtagacgacttcgactcaccagagggagcaaaagtccaagcattcttcgccgacctagacgacgacgtccacgcaaaactcgactcccttcatctgccagtcggacgagcggcgtacagcgaagacaccctagtacgattaacacgacgcatgctaagcgacggagtagatctgtacaccgcaagactacaggagttcggcattgaaccaagctggacgccaccaacccccaggatcggagaaccagttggtaacccagctgtagaccgagtactaaaaacagtcagtcgatggcttgaaagtgcgaccaagacttggggagcaccagaacgggtcataatagaacacgtaagggagggatttgtaacagaaaaacgggcgcgagaaatggacggggacatgcgtagacgagcagcaaggaacgcaaaactgttccaggaaatgcaggagaaactaaacgtacaaggaaaaccctctagagcagatctctggcggtaccagagcgtccaaagacaaaactgccaatgcgcatactgcggcagcccaatcacgttcagcaactcagaaatggaccacatcgtgccaagggctgggcagggatccaccaacacgcgcgagaacctagtggcggtgtgccacaggtgtaaccaaagcaaaggaaacaccccgttcgcgatatgggcgaaaaacacctccatagagggcgtaagcgtaaaggaagctgtggaaagaacacgacactgggtcacggacacaggaatgcgctcaaccgactttaagaaatttacaaaggctgtcgtcgagaggttccaaagagcaacgatggacgaagagatagacgcaaggagcatggaatcggtcgcatggatggcaaacgaattgcgcagtcgggtagcacagcacttcgctagccacggaacaacggtacgagtctaccgcggaagcctcacagcggaagcacggagggccagcggcataagcggcaaactaaagttcttcgacggagtcgggaaatctcgcctagaccgcagacaccatgccatagacgcggccgtgatcgcattcacaagtgactacgtggccgagaccctagcagtacgaagcaatttgaagcaaagccaagcgcacagacaggaagccccgcaatggcgagagttcacaggaaaagacgcagaacacagagcggcatggagggtatggtgccagaaaatggaaaaactaagcgcattgctcaccgaagacctcagggacgacagagtcgtcgttatgagcaacgtgcggctacgcctcggcaacggctcggcccacaaagaaacaataggaaaactcagcaaggtcaaactaagctcacaactgtccgtatccgacatagacaaagcgtcgagcgaagcactctggtgcgcgctaacgcgagaacccggatttgaccccaaggaaggcctccctgcaaacccagaacggcacatacgagtaaacggtacacacgtgtatgctggtgacaacatcggattattcccagtctcagcaggaagtattgcgctgcggggaggatacgcagaactcggctcaagttttcaccacgcaagggtatataaaataacaagcgggaagaaaccagcattcgctatgttgagagtatacacgatagacctgctcccctaccgcaaccaagacctattcagcgttgaactaaaaccacaaacaatgtcaatgaggcaagccgaaaagaaactgcgagacgccctcgccaccgggaacgccgaatacctcggctggttagtcgtcgacgacgagctcgtagtagacaccagcaaaatagcaacggaccaagtaaaagcagtcgaagcggagctaggaacgataagacgatggagggtagatggatttttcagcccaagcaaactacgcctaagaccgcttcaaatgtcaaaagaaggcatcaaaaaggaaagcgcaccagagctgagcaagataatcgacagacccggctggctaccagcagttaataaactcttcagcgacggcaacgtcacagtcgtgcgaagggactcgttggggcgggtacggctagaaagcacagcgcacctacccgtcacatggaaggtacaaaagagaccagccgcgacgaagaaggcaggccaggcgaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8270 - RNA, 3429 nt, synthetic construct
  misc_feature 1..3429: note = Cas9 variant mRNA product
  source 1..3429: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaaacgcaaggtgggcatccacggggtcccggccgcggcccggatactggccttcgacatcggcatcagctccatagggtgggccttcagcgagaacgacgagctcaaggactgcggcgtgcgcatcttcactaaggtggagaaccccaagacaggagagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgatgagagcctcgccaaggcctacaaaggctccctgatcagcccctacgagctgcggttccgcgcactcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacttgtacaaggagtacttccagaaattcaaggagaacagcaaggagttcacgaacgtgcgcaacaagaaggagtcctacgagcggtgcatcgcccagagcttcctgaaggacgagctgaagctcatctttaaaaagcagcgcgagttcgggttctccttcagcaagaagttcgaagaggaggtcctttccgtggcgttctacaagcgggctctgaaggacttcagccacctcgtgggcaactgctccttcttcaccgacgagaagcgcgccccgaagaacagccccctggccttcatgtttgtcgccctgacccggatcatcaatctcctgaacaacctgaagaacaccgagggcatcctctacacgaaggacgacctgaacgcgctgcttaacgaggtgctgaagaacggcaccctgacctacaagcagaccaagaagctcctggggctgagcgacgactacgagttcaaaggggaaaagggcacgtacttcatcgagttcaagaagtacaaggagttcattaaggccctcggggagcacaacctgtcccaggacgacctgaacgagatcgccaaagacatcaccctcatcaaggacgagatcaagctgaagaaggccctggccaagtacgacctcaaccagaaccagatcgacagcttatccaaacttgagttcaaggaccacctcaacatcagcttcaaggcgctaaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgtgcgatcaaggagtaccgcaaggtgctgaacgccctcctgaagaagtacggcaaggtgcacaaaatcaacatcgagctggcgcgggaggtcgggaagaaccactcccagcgcgccaagatcgagaaggagcagaacgagaactacaaggccaagaaagacgcggagctcgagtgtgagaagctgggcctgaagatcaacagcaagaacatcctcaagctgcggctgttcaaggagcagaaggagttctgtgcctactccggggagaaaatcaagatcagcgacctccaggacgagaagatgttagagatcgaccacatctacccatactcccgcagcttcgacgactcctacatgaacaaggtgctggtgttcaccaagcagaaccaggagaagctcaaccagacccccttcgaggccttcggcaacgacagcgcgaagtggcagaagatcgaggtcctggcaaagaacctacccaccaagaagcagaagcggatcctcgacaagaactacaaggacaaggagcagaagaacttcaaggaccgcaacctgaacgacacacggtacatagctcgcctggtgctcaactacaccaaggactacctggacttcctgccgctctccgacgacgagaacaccaagctgaacgacacccagaaggggagcaaggtgcacgtcgaggccaagtccggcatgctgacgagcgctctccggcacacctggggcttctccgccaaggaccgcaacaaccacctccaccacgccatcgatgcggtgataatcgcctacgccaacaacagcatcgtcaaggccttctccgacttcaaaaaggagcaggagagcaacagcgcggagctgtacgccaagaagatctccgagctggactacaagaacaagcggaagttcttcgagcccttcagcggtttccgccagaaggtgctggacaagatcgacgagatcttcgtgtccaaacccgagcggaagaagcccagcggtgccctgcacgaggagaccttccgtaaagaggaggagttctaccagtcctacgggggcaaggagggggtcctcaaggcgctggagctgggcaagatccggaaggtgaacgggaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttttgcttctccctctacaaggacagcctgatcctgatccagaccaaggacatgcaagagcccgagttcgtgtactacaacgccttcacctcctcaaccgtgtccctcatagttagcaagcacgacaacaagttcgagacgctgtccaagaaccagaagatcctgttcaaaaacgcaaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8271 - RNA, 3840 nt, synthetic construct
  misc_feature 1..3840: note = Cas9 variant mRNA product
  source 1..3840: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgtcggacctagttctcggcctggacatcgggattggctccgtgggggtcgggatcctgaacaaggtgaccggcgagatcatccacaagaacagccggatcttccccgccgcccaggccgagaacaacctagtgcgccggacgaaccgccagggccggcgcctggcccggcgcaagaagcaccggcgcgtccggctgaaccgcctcttcgaggagtccggcctgatcacggacttcaccaagatcagcataaacctgaacccctaccagttacgggtgaaggggctgaccgacgaactgtccaacgaggagctgttcatcgcgctgaagaatatggtgaagcaccgcggcatcagctacctggatgacgcctccgacgacgggaacagctccgtcggcgattacgcccagatcgtgaaggagaatagcaagcagctcgagaccaagacgcccggacagatccagctggagcggtaccagacctacgggcagctgcgcggcgatttcaccgtggagaaagacgggaagaagcaccgactcatcaacgtcttcccgacctccgcctaccgaagcgaggcgctgcggatcctgcaaactcagcaggagttcaacccccagatcaccgatgagttcatcaaccgctacctcgagatcctgaccggcaagcggaagtactaccacggccccgggaacgagaagtcccgcaccgactacggccgctatcggacgagcggggagaccctggacaacatcttcggcatcctcatcgggaagtgcaccttctaccccgacgagttccgcgccgccaaggcctcctacaccgcccaggagttcaaccttttaaatgacctcaacaacctgacggtgccgaccgaaaccaagaagctcagcaaggagcagaagaaccagatcatcaactacgtgaagaacgagaaggctatgggccccgccaagctgttcaagtacatcgccaagctcctgtcctgcgacgtcgccgacatcaagggctaccggatcgacaagagcgggaaggccgagatccataccttcgaggcgtaccgcaagatgaagacgctcgagaccctggacatcgagcagatggacagagagaccctggacaagctcgcctacgtactgaccctgaacacggagcgcgagggcatccaggaggccctcgagcacgagttcgccgacgggtccttcagccagaagcaggtcgacgagctggtgcagttccggaaggccaacagctccatcttcggcaaagggtggcacaactttagcgtgaagctgatgatggagctcatccccgagctgtacgagaccagcgaggagcagatgaccatcctgacccgcctcggcaagcagaagacaaccagctccagcaacaagactaagtacattgacgagaagctgctgaccgaggaaatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgcctcacagcgtgttccacggccacaagcagctggccaccaagatccggctgtggcaccagcagggcgagcgctgcctctataccggcaagaccatctccatccacgacctgatcaacaacagcaaccagttcgaggtcgaccacatcctgcccctctccatcacgttcgacgacagcctggccaacaaagtgctggtgtacgcgaccgccaaccaggagaaggggcagcggacgccctaccaggccctggactccatggacgacgcctggtcgttccgcgagctgaaggccttcgtccgggagtccaagaccctgagcaacaagaagaaggagtacctcttgaccgaggaggacatctccaagttcgacgtgcgcaagaagttcatcgagcggaacctcgtggacacgcgctacgcgagccgggtcgtgctcaacgccctgcaggagcacttccgcgcccataaaatcgacaccaaggtgtccgtggtgcgcggccagttcaccagccagttaagacgccactggggcatcgagaagacccgggacacgtaccaccaccatgcagtggacgccctcatcatcgcggcctcctcccagctgaacctgtggaagaagcagaagaacaccctcgtcagctactccgaggaccagctgctggacatcgagaccggggagctcatcagcgacgacgagtacaaggagtccgtgttcaaggccccctaccaacatttcgtggacaccttaaagagcaaggagttcgaggattccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctcgagaactaccccaacaagcagatcaacgagaagggcaaggaggttccctgcaacccgttcctcaagtacaaggaggagcacgggtacatccggaaatacagcaagaagggcaacgggcccgagatcaagtccctgaagtactacgacagcaagctgggcaaccacatcgacattacccccaaagactccaacaacaaggtggtcctccagagtgtgtccccctggcgcgccgacgtgtacttcaacaagaccaccgggaagtacgagatcttgggcctgaaatacgcggacctccagttcgagaagggcacggggacctacaagatcagccaggagaagtacaacgacatcaagaagaaagagggcgtcgacagcgactccgagttcaagttcaccctgtacaagaacgacctgctcctggtgaaggacaccgagacgaaggagcagcagctgttccggttcctcagccgcaccatgccaaagcagaagcactacgtggagctaaagccctacgacaagcagaagttcgagggcggagaggccctgatcaaggtcctcgggaacgtggccaactccggccagtgcaagaagggactgggcaagagcaacatctccatctacaaggtgcggaccgacgtcctggggaaccaacacatcattaagaacgagggggacaaacccaagctcgacttcaagcgccccgccgccaccaagaaggcgggccaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8272 - RNA, 4398 nt, synthetic construct
  misc_feature 1..4398: note = Cpf1 variant mRNA product
  source 1..4398: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggaatccacggcgtcccggccgcgacccagttcgagggcttcaccaacctgtaccaggtgagcaagacgctccggttcgagctgatcccccaggggaagaccctgaaacacatccaggagcagggcttcatcgaggaggacaaggcccgcaacgaccactacaaggaactcaaacccatcatcgaccggatctataagacctacgccgaccagtgcttgcagctggtgcagctcgactgggagaatctgtccgccgccatcgacagctaccgcaaggagaagaccgaggagacccgtaacgcgcttatcgaggagcaggccacctaccgcaacgctattcatgactacttcatcgggcggaccgataacctcaccgacgccataaacaagcgccacgctgaaatctacaagggcctcttcaaggccgagctattcaacggcaaggtactaaagcagttagggacggtgaccaccaccgagcacgagaatgccctactccggtccttcgacaaattcacgacctacttctcaggcttctacgaaaaccgcaagaacgtgttcagcgcagaggacatcagcaccgcaatcccccaccggatcgtccaggacaatttcccgaagtttaaggagaactgccatatcttcacccgtctgatcacggcggtgccgtccctgcgggaacacttcgaaaacgtgaagaaggccatcggaatttttgtcagcacctccatcgaggaggtgttcagtttccccttctacaaccagttgctgacccagacccagatcgacctgtacaaccagctcttgggcgggatctctcgcgaggccggcacggagaagataaagggcttaaatgaggtgctcaacctggccatacagaagaacgacgagacagcccacatcatagcgagcctgccccaccggttcatcccgttattcaaacagatcctgtctgaccgtaacacccttagcttcatcctcgaggagttcaagagtgacgaagaggtcatccagtcgttctgcaaatacaagacccttctgcggaacgagaatgtgctcgagacggccgaggcccttttcaacgaactgaactccatcgacctcacccacatcttcatcagccacaagaaactcgagaccatcagcagcgccctgtgcgaccactgggacaccctccgcaacgccctgtacgagcggcgcatcagtgagctgacgggcaagatcaccaagtccgcgaaggagaaggtgcagcggagcctcaagcatgaagacatcaacctgcaggagatcatctccgccgccggcaaggagctgagtgaggccttcaagcaaaagacctcagaaatcctatcccacgctcatgcggccctggaccagccgttgcccaccacgctcaagaagcaagaagagaaggagatcctgaaatcccagttagacagcctgctcgggctgtaccacctcctcgactggttcgcagtcgacgaatccaacgaggtggaccccgagtttagcgcccgcctgaccggcattaaactggagatggagccgtccctcagcttctacaacaaggcgcgcaactacgccaccaagaagccctactccgtggagaagttcaagctgaacttccagatgcccacgctggccagcggctgggatgtaaacaaggagaagaacaatggggccatactcttcgtgaagaacggcctgtactacctggggatcatgcctaagcaaaagggccggtacaaggccttatccttcgagcccacggagaagaccagcgaagggttcgacaagatgtactacgactacttccccgacgcggccaaaatgatccccaagtgctccacacagctgaaagcagtgaccgcccacttccagacccacacgaccccgattctgttgagtaacaacttcatcgagccgctggagatcaccaaagagatctacgatctgaacaaccccgagaaggagcccaaaaagttccagaccgcctatgcgaaaaagacgggagaccagaaaggctaccgcgaggccctgtgcaagtggatcgacttcacccgggatttcctatccaagtacaccaagaccacgagcatcgacctgagttcactccggccaagctcccagtacaaagatctgggggagtactacgccgagctgaatccgctcctgtatcacatctcattccaacggatcgccgagaaagagatcatggacgccgtagagacgggcaagctctacctcttccagatctacaacaaggacttcgcgaagggacaccacggcaagcctaacctgcacacattgtactggaccggcctcttctcccccgagaacctcgccaagacgagcatcaagctgaacgggcaggccgagctgttctacaggcccaagagccggatgaagcgcatggcccacaggctgggtgagaagatgctgaacaagaagctaaaggaccagaagaccccgatccccgacaccctgtaccaagagctgtatgactacgtgaaccatcgcttaagccacgacctctccgacgaggcgcgtgccttactccccaacgtgatcaccaaggaggtcagccatgagatcatcaaggaccgcagattcacgtccgacaagttcttcttccacgtgccgatcacactgaactaccaggccgctaacagcccctccaagttcaaccagcgcgtcaacgcctacctaaaggagcaccccgagacgcccatcattgggatagaccggggcgagcgcaacctgatctatatcaccgtgatcgacagcacggggaagatcctggagcaacgatccctgaacaccatccagcagttcgactaccagaagaaactcgacaaccgcgaaaaagagcgggtggcggcacgccaggcctggagcgtcgtgggcaccatcaaggacctgaagcaggggtacctgagccaggtgatccacgagatcgtcgacctcatgattcactaccaggccgtcgtggtcctggagaacttaaacttcggcttcaaatcgaaacgcaccggcatcgccgagaaagcggtgtaccagcagttcgagaagatgctcattgacaagttaaactgcctggtgctaaaagattacccggccgagaaggtcggaggcgtgctgaacccctaccagttgacggaccagttcaccagcttcgccaagatgggcacccagtctggcttcctcttctacgtgcccgccccctacaccagcaagatcgacccgctgacggggttcgtagaccccttcgtttggaagaccatcaagaaccatgagagtcggaagcacttccttgaggggtttgacttcctccactatgatgtgaagactggcgatttcatcctgcacttcaagatgaaccgcaacctgagcttccagcgggggctccccggtttcatgcccgcctgggacatcgtcttcgagaagaatgagacccagttcgacgcgaaggggacgcccttcatcgccggcaagcgcatagtccctgtgatcgagaaccaccggttcaccggccgctaccgggatctgtaccccgcaaacgagctgatcgccctcctggaggagaaggggatcgtctttcgagacggctccaacatcctgcccaagttgttagagaatgacgacagccacgcaatcgacaccatggtggccctgattcggtccgtgctccagatgcgcaacagcaacgcggccaccggggaggactacatcaactccccggtccgggacctgaacggcgtgtgctttgatagccgcttccagaaccccgagtggcccatggacgccgacgcgaacggggcctaccatatcgccctgaagggacaactcttgctgaaccacctcaaggagtctaaggacctcaagctgcaaaacggtatcagcaaccaggactggctcgcctatatacaagagctgcggaacaagcgccccgccgcgactaaaaaggctgggcaggccaagaagaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 8273 - RNA, 4377 nt, synthetic construct; identical to SEQ ID NO: 2473
  misc_feature 1..4377: note = Cpf1 variant mRNA product
  source 1..4377: mol_type = other RNA

SEQ ID NO: 8274 - RNA, 4517 nt, synthetic construct
  misc_feature 1..4517: note = Cas9 variant mRNA product
  source 1..4517: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaagtgggaatccacggggtgccggcggcggacaagaagtacagcatcggcctggacatcgggaccaactcagtgggctgggccgtaatcaccgacgaatacaaagtccccagcaagaagttcaaggtgctggggaacacggaccggcattccatcaagaagaacctgatcggtgccctgctgttcgactcgggcgagaccgccgaggccacccgcctgaagcgaaccgcgcgccggcgctacacgcggcgcaagaaccggatctgttacctgcaggagatcttctccaacgagatggccaaggtggacgacagcttcttccaccgcctcgaggagtccttcctggtcgaggaggacaagaagcacgagcggcaccccattttcgggaacattgtggacgaagtggcctaccacgagaagtaccccaccatctaccaccttcgcaagaagctcgtcgacagcaccgacaaggccgacctgcggctgatttacctcgcgctggcccacatgatcaagttccgcggccacttcctgatcgagggggacctcaacccggacaactccgacgtggacaagctgttcatccaactggtgcagacctacaaccagctgttcgaggagaaccccatcaacgccagcggcgtcgacgccaaagccatcctgtccgcgagacttagcaagagtcgcaggctcgagaacctgatcgcccagcttcccggggagaagaagaacggcctattcggcaacctgattgccctgagcctcggactgacacccaacttcaagtccaacttcgatctggccgaggatgccaaactccagttgagtaaggacacctacgacgacgacctggacaacctcctggcgcagatcggcgaccagtacgccgacctgttcctcgccgccaagaacctgtctgacgccatcctgctcagcgacatcctgcgcgtgaacaccgaaatcaccaaggcgccgctgtccgcctcaatgatcaagcggtacgacgagcaccaccaggatctcacgctgctgaaggcgctagtgcgccagcagttgcccgagaaatacaaggagatcttcttcgaccagagcaaaaacgggtacgctggctacatcgacggcggggcctcccaggaggagttctataagttcatcaagcccatactggagaagatggacggcaccgaggagttactggtcaagctgaaccgggaggacctgctccgcaagcagcgcaccttcgacaatgggagcatcccccaccagatccacctgggcgagctgcacgcgatcctccggcgccaggaggacttctacccgttcctgaaggacaaccgggagaagatcgagaagatcctcacctttcgcatcccctactacgtggggcccttggcccggggcaactcccgcttcgcctggatgacgcgcaagagcgaggagaccatcactccctggaatttcgaggaggtggtcgacaagggcgccagtgcgcagagcttcattgagaggatgaccaactttgacaagaacctgccgaacgagaaggtgctgcccaagcactccctcctgtacgagtacttcacggtgtataacgaactcaccaaggtcaagtacgtgaccgaggggatgcggaagcccgctttcctcagcggcgagcagaagaaggccatcgtggacttgctgttcaagaccaaccgcaaggtcacggtgaagcagctcaaggaggattacttcaagaagatcgagtgcttcgactccgtcgagatcagcggggttgaggaccggttcaacgcctccctgggcacctaccacgacctgctcaaaatcatcaaggacaaggactttctggacaacgaggagaacgaggacatcctggaggacattgtgctcaccctgaccctgttcgaggaccgcgagatgatagaggagcggctcaagacgtatgcccacctgttcgacgacaaggtcatgaagcaactgaagcgtcggcgctacaccgggtggggccggctcagccgcaagttgatcaacggaatccgagataaacagagtgggaagacaatcctggacttcctaaagagcgacggctttgcaaaccgcaacttcatgcagctgatccacgacgactccttgaccttcaaggaggacatccagaaggcccaagtatctgggcagggagactccctccacgagcacatcgccaacctggccgggtcccccgccatcaagaagggcatcctgcagacggtgaaggtcgtggacgagctagtcaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaagagcaccccgtggagaacacccagctccagaacgagaagctctacctgtactaccttcagaacggccgggatatgtacgtcgaccaggagctggacattaacaggctgagcgactatgacgtggaccacatcgtgccccagtccttcctcaaagacgacagcatcgacaacaaggtcctgacacggtccgacaagaaccggggcaagagcgacaacgtgccctccgaggaggtagtcaagaaaatgaaaaactattggagacagctgctcaacgctaagctgatcacccagcgcaaattcgacaacttgaccaaagccgaacgcgggggcctcagcgagctagacaaggccgggttcatcaagcggcagctggtggagacccggcagatcaccaagcacgtagcccagatcctcgactccaggatgaacacgaagtacgacgagaacgacaaactgatccgggaggtcaaggtgatcaccctcaagagcaaacttgtgtccgacttcagaaaggacttccagttctataaggttagggagatcaacaactaccaccacgcgcacgacgcatacctgaacgccgtggtgggcaccgccctgatcaagaagtacccgaaacttgagagcgagttcgtctacggggactacaaggtgtacgacgtgcgcaagatgatcgcgaagtccgagcaggagatcggaaaggctaccgccaagtacttcttctacagcaacatcatgaacttcttcaagacggagatcaccctggcaaacggcgaaatccggaagcgccccctaatcgaaacgaacggagagaccggcgaaatcgtctgggacaaggggcgggacttcgccacggtgcgcaaggtgctctccatgccccaggtcaatatcgtaaagaagaccgaggtgcagaccggcgggttcagcaaggagtccatcctgcccaagcgcaacagcgataagttaatcgcgcgtaagaaggactgggacccgaagaagtacggcggcttcgactcccccaccgtcgcgtacagcgtgctggtggtcgccaaggtggagaagggcaagagcaagaagttaaagtccgtgaaggagctgctcggtatcacgatcatggagcgcagttccttcgagaagaaccccatcgatttcctggaggccaagggatacaaggaggtcaagaaggacctgatcatcaagctccccaagtacagcctgttcgagctggagaacggccggaaacgcatgctcgcctccgcgggggagctgcagaagggcaacgaactggccctccccagcaagtacgtgaacttcctgtacctggcctcccactatgagaagttaaaaggcagccccgaggacaacgaacagaagcagctgttcgtggagcagcacaagcattatctggacgagatcatcgagcagatatccgagttcagcaaacgggtgatcctcgccgacgccaacctcgacaaggtgctctccgcgtacaacaagcaccgtgacaagcccatccgggagcaggccgagaacatcatccacctcttcaccctgaccaaccttggggcccctgccgcgttcaagtacttcgacaccacgatcgaccggaagcggtacaccagcaccaaggaggtgttagacgcgaccctgatacaccagagtatcacgggcctgtacgagacccgcatcgatctcagccagctcgggggcgataagcggcccgccgccaccaagaaggccgggcaggcgaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8275 - RNA, 5300 nt, synthetic construct; identical to SEQ ID NO: 2475
  misc_feature 1..5300: note = Cas9 variant mRNA product
  source 1..5300: mol_type = other RNA

SEQ ID NO: 8276 - RNA, 3572 nt, synthetic construct
  misc_feature 1..3572: note = Cas9 variant mRNA product
  source 1..3572: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaagtgggcatccacggggtcccggccgcgaagcggaactacatcctgggcctcgacatcgggatcaccagcgtgggctacgggatcatcgactacgaaacccgcgatgttatcgacgccggcgtccggctgttcaaggaggccaacgtggagaacaacgaaggccgccggtccaagcgcggggcccggcgcctgaagcggcgccggcgccaccggatccagcgcgtgaagaagctcctgttcgactacaacctgctcacggaccacagcgagctgtcgggcatcaacccctacgaggcccgggtcaagggtctcagccagaagctctccgaggaggagttcagcgcggccctgctgcacctcgccaagcgcaggggcgtgcacaacgtgaacgaggtcgaggaggacaccgggaacgagctctccaccaaggagcagatcagccgcaactccaaggccctggaggagaagtacgtggcggagctccagctcgagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaagacatcaaggagtggtacgagatgctgatgggccattgcacctacttcccggaggagctccgaagcgtgaagtacgcctacaacgccgacctgtacaacgcgctcaacgacctcaacaacctggtcatcacgcgcgacgagaacgagaagctggagtactacgagaagttccagatcatcgagaacgtgttcaagcagaagaagaagcccaccctcaagcagatagccaaggagatcttggtgaacgaggaggacatcaaggggtaccgggtcacctccaccggcaagcccgagttcacgaacctaaaggtgtaccacgacatcaaggacatcaccgcccgcaaggagatcatcgagaacgccgagctcctggaccagatcgccaaaatcctgaccatctaccagagctccgaggacatccaggaggagctcaccaacctgaacagcgagctgacacaggaggagatcgagcagatctccaacctcaaggggtacaccggcacccacaacctgagcctgaaggcgatcaacctcatcctggacgagctgtggcacaccaacgacaatcagatcgccatctttaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctacccaacgacataatcatcgagctggcccgggagaagaacagcaaggacgcccagaagatgatcaacgagatgcagaagcgcaaccggcagaccaacgagcgcatcgaggaaatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtggaccacatcatcccccgcagcgtgtccttcgataacagcttcaacaacaaggtgctggtcaagcaagaggagaactccaagaaggggaaccggacccccttccagtacctgagctccagcgactccaagatcagctacgagaccttcaagaagcacatcctcaacctggccaagggcaaagggcgcatctccaagaccaagaaggagtacctgctcgaggaacgggacattaaccgcttcagcgtgcagaaggacttcatcaaccggaacctggtggacacgcgctacgccacccggggcctgatgaacctcctgcgctcctactttcgcgtcaacaacctggacgtgaaggtcaagagcatcaacgggggcttcacctccttcctcaggcgcaaatggaagttcaagaaggagcggaacaagggctacaagcatcacgccgaggacgcgctgatcattgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcatatcaaggacttcaaggactacaagtacagccatcgcgtggacaagaagcccaatcgggagctcatcaacgacacactgtactccacccgcaaggacgacaaggggaacaccctgatcgtgaacaacctcaacggcctgtacgacaaggacaacgacaagctgaagaagctcatcaacaagagccccgagaagctcctgatgtaccaccacgacccccagacttaccagaagctcaagctgatcatggagcagtacggggacgagaagaacccgctgtacaaatactacgaggagaccggcaactacctcaccaagtactccaagaaggacaacgggcccgtcatcaagaagatcaagtactacggcaacaagctgaacgcccacttggacatcaccgacgactaccccaacagccggaacaaggtggtgaagctctccctgaagccctaccgcttcgacgtctacctggacaacggcgtgtacaagttcgtcaccgtcaagaacctcgacgtgatcaagaaggagaactactacgaggtgaacagcaagtgctacgaggaggctaagaagctgaagaagatctccaaccaggccgagttcatcgccagcttctacaacaacgacctgatcaagatcaatggtgagctctaccgggtcatcggcgtgaacaacgacctgctgaaccgcatcgaggtgaacatgatcgacatcacgtatcgggagtacttagagaacatgaacgacaagcgcccgcccagaatcatcaagaccatcgcgtccaagacccagagcatcaagaagtactcaaccgacatcctggggaacctgtacgaggtaaagagcaagaagcacccccagatcatcaagaagggcaagcgccccgccgccacgaagaaggccggtcaagccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8277 - RNA, 4640 nt, synthetic construct
  misc_feature 1..4640: note = Cas9 variant mRNA product
  source 1..4640: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgctgttcaacaagtgcattatcatcagcatcaacctggacttctccaacaaggagaaatgcatgaccaagccctacagcataggcctggacatcgggacgaactccgtgggctgggccgtgatcacggacaactataaggtccccagcaagaagatgaaggtgctggggaacacttccaagaagtacattaagaagaacttactgggcgtgctgctgttcgacagcggcatcaccgccgaggggcggcgcctgaagcggaccgcgcgccggcgctacacgcggcgccggaaccgcatcctgtacctccaggagatcttctctaccgagatggccaccctggacgacgcgttcttccagcggctggacgacagcttcctcgtgcccgacgacaagcgcgactccaagtacccgatcttcggcaacctggtggaggagaaggtgtaccacgacgagttccccaccatctaccacctccggaagtacctcgccgacagcacgaagaaggccgacctgcgcctcgtctacctcgccttagcgcacatgattaagtaccggggccacttcctgatcgagggcgagtttaactccaagaacaacgacatccaaaagaacttccaggacttcctcgacacctacaacgccatcttcgagagcgacctgtccctggagaacagcaagcagctcgaggagatcgtgaaggacaagatttccaagctggagaagaaggaccgcatcctgaagctgttccccggggagaagaacagcggcatcttctctgagttcctgaagctgatcgtgggcaaccaggctgacttccggaagtgcttcaacctcgatgagaaggcaagccttcacttctccaaggagagctacgacgaggacctggagaccctcctgggatacatcggcgacgactatagcgatgtcttcctgaaggctaagaagctctacgacgcgatcctgctgtccgggtttctcaccgtgacggacaacgagaccgaggcgcccctgagctccgccatgatcaagcgctacaacgagcacaaggaggacctcgccctcctgaaggagtacatccggaacatcagcctgaagacctacaacgaggtgttcaaagacgacaccaagaacggatacgccggctacattgacgggaagacgaaccaggaggacttctacgtatacctcaagaacctgctggccgagttcgagggcgccgactatttcctcgagaaaatcgaccgcgaggacttcctgcgcaagcagcgcaccttcgacaacgggtccatcccgtaccagatccaccttcaggagatgcgcgccatcctggacaagcaggccaagttctaccctttcctagccaagaacaaggagcggatcgagaagatcctgaccttccgcatcccctactatgtgggcccgctggcgcgggggaacagcgacttcgcttggtccatccgcaagcggaacgagaagatcaccccgtggaacttcgaggacgtgatcgacaaggagagctccgctgaggccttcatcaaccgcatgacgagcttcgacctctacctgcccgaggagaaggtcctgcctaagcactccctcctgtacgagaccttcaacgtgtacaatgagctgaccaaggtgcggttcatcgccgagagcatgcgcgactaccaattccttgactccaagcagaagaaggacatcgtccggctttacttcaaggacaagcgcaaggtgaccgacaaggacatcatcgagtacctgcacgcgatctacggctacgacggcatcgaactcaaggggatcgagaagcagttcaacagcagcctgagcacgtaccacgacctgctcaacatcattaacgacaaagagttcctggacgactccagcaacgaggctatcatcgaggagatcatccacaccttaaccatcttcgaggaccgggagatgatcaagcaacgcctctccaagttcgagaacatcttcgacaagagcgtgctgaagaagctgagccgtcgccactataccggctgggggaagctctccgccaaacttatcaacggcatccgggacgagaagtccgggaatacaatcctggactacctcatcgatgacggcatcagcaatcgcaacttcatgcagctgatccacgacgacgccctgagcttcaagaagaagatccagaaggcgcagattatcggcgacgaggacaagggtaacatcaaggaagtcgtgaagtccctccccggcagcccggccatcaagaagggaatcctgcagtccatcaagatcgtagacgagctggtgaaggtgatgggcgggcggaagcccgagagcatcgtcgtggagatggcccgagagaaccagtacaccaaccagggcaagtccaacagccagcagaggctcaagcgcctggagaagtcactgaaggagctcggcagcaagatcctgaaggagaacatccccgccaagctgagtaagatcgacaacaacgccctacagaacgaccgcctgtatctgtactacctccagaacgggaaggacatgtataccggagacgacctggacatcgaccggctgagcaactacgacatcgaccacataatcccccaggcgttcctcaaggacaactccatcgacaacaaggtgctggtcagctccgccagcaaccgcggaaagtccgacgacttcccgagcctggaggtggttaagaagcggaagactttctggtaccagttgctcaagagcaagctgatttcccagcgcaagttcgacaacctgacgaaggccgaacggggcggcctgctgcccgaagacaaggcaggcttcatccaacgccagctcgtcgaaacccggcaaatcaccaaacacgtggcccgcctgctggacgagaagttcaacaacaagaaggacgagaacaaccgggcggtgaggaccgtaaagatcatcacgctcaagagcaccctggtgtcccaattccggaaagacttcgagttgtacaaggtgcgcgagatcaacgacttccaccatgcccacgacgcctacctcaacgccgtcatcgccagcgcgctgctgaagaagtaccccaagctcgagcctgagtttgtgtacggcgactacccgaaatacaactccttccgtgagcgcaagagcgccaccgagaaggtgtacttctattccaatatcatgaacatcttcaagaagtccatctccctggctgacgggcgggtgatcgagcgccccctgatcgaagtgaacgaggagacgggcgagagcgtgtggaacaaggagtccgacctcgccaccgtccggcgcgtgctgagctacccccaggtgaacgtcgtaaagaaggtggaggaacagaaccacgggctggaccggggcaagcccaagggcctcttcaacgcgaacctgtccagcaagccgaagcccaactccaacgagaacctggtcggggccaaggaatacctcgaccccaagaagtacggcgggtacgccggcatcagcaactccttcgccgtgctggtcaaggggacgatcgaaaagggagccaagaagaagatcaccaacgtcctggagttccagggcatcagcatcctcgaccgcatcaactaccggaaagacaagctgaacttcctgttagagaaggggtacaaggacatcgagctgatcatcgaactgccgaagtactcactcttcgagctgtccgacggcagccgccggatgctcgcgtcgatcctcagcaccaacaataagcgtggggagatacataagggcaaccagattttcctgtcccagaagttcgtgaagctgctctaccacgccaagcggatcagcaacaccatcaacgagaaccaccgaaaatacgtggagaaccacaagaaggagttcgaggagctgttctactacatcctggagttcaacgagaactacgtcggtgccaagaagaacggaaagctcctgaacagtgccttccagagctggcagaaccattcgatcgacgagctatgcagctccttcatcggccccacggggagcgagcgcaagggcctcttcgagctaacatcccgggggagcgccgcagactttgagttcctgggcgtgaagataccccgctaccgggactacaccccctccagcctcctgaaagacgccaccctgatccaccagtccgtgacggggctgtacgagacccgcatcgacctcgccaagctgggcgagggcaagaggccggccgccaccaagaaggcagggcaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8278 - RNA, 3716 nt, synthetic construct
  misc_feature 1..3716: note = Cas9 variant mRNA product
  source 1..3716: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacccaaaaagaaacgcaaagtaggaatacacggagtgccggcagcatggtacgcgagccttatgagcgcccaccatctacgcgttggaatcgacgtaggcacccacagcgtaggactagccacactccgagtagacgaccacggaaccccaattgaattactatcggcactgagccacatccacgatagtggagtcgggaaagaaggaaagaaagaccacgacacacgaaagaaactgtcaggaatagcaagacgcgctcgaagactattacaccaccgacgaacacagctccaacaactagacgaagtcctacgagatctaggcttcccaatcccaacaccgggagagttcctagacttaaacgaacaaaccgacccataccgcgtgtggcgagtccgagcacgactcgtggaagagaaactcccagaggaattacgcggaccagccataagcatggcagtgaggcacatcgcccgacaccgagggtggaggaacccgtatagtaaagtagaatccctactaagccccgccgaggaaagcccattcatgaaagcactccgcgaacgaatcctcgcaaccaccggcgaagtactagacgatggcataacgccgggccaagctatggcccaagtcgcactgacccataacatctcaatgcgcggaccagaaggcatactaggaaaactacaccaatccgataacgcaaacgaaatccggaaaatatgtgcccgccagggggtcagccccgacgtttgcaaacagctactccgggccgtattcaaagccgactcacctagaggcagcgccgtgagtagagtagcacccgatccccttcccggtcaggggagcttccgcagagccccaaaatgcgacccagagttccagcgcttccgaataatatccatagtggcaaacctgcgaatatctgaaacgaaaggcgaaaacagaccactaaccgccgacgaacgcagacacgtcgtcaccttcctaacggaagacagtcaagccgatcttacttgggtggacgtcgcagaaaaactcggagttcaccgccgggacttaaggggaacagccgtacacaccgacgacggagaaagaagtgccgcccggcccccaatcgacgcaacggatagaatcatgagacagaccaaaatcagttccctcaaaacgtggtgggaagaagccgacagcgaacagagaggcgcaatgatcaggtacctgtacgaagacccaaccgattctgaatgcgcagaaatcatagctgaactcccagaagaagatcaagccaaactagactccctacacttacccgcaggacgcgccgcatacagcagagagagtctaacagccttaagcgaccacatgctcgcgacaaccgacgacctccacgaggcacgaaaacgccttttcggcgttgacgacagctgggccccacccgccgaagcaatcaacgcccccgtcgggaacccctcggtggaccgcacattaaaaatagtagggcgatacctctcagcagtcgaatctatgtggggcacgccagaagtcattcacgtagagcacgtccgagacgggttcacgagcgagcgcatggccgacgaacgagacaaggcaaaccgacgaagatataacgacaaccaagaagcaatgaagaaaatccagagagactacggaaaagaaggctacatatccagaggggacatagtaaggctggacgccctcgaactccagggatgtgcctgtctctactgcgggacaacaattggataccacacgtgccaactagaccacatcgtaccccaggcaggaccaggaagcaacaaccgccgagggaacctagtcgctgtatgcgaaagatgcaaccgctcgaaatcaaacaccccctttgcagtttgggcccaaaaatgcggcatcccccacgtcggagtaaaggaagcgatcggcagagtcaggggctggagaaagcaaacaccaaacacatcaagcgaagatcttacaaggctaaagaaggaggtcatcgcacgactaagacgaacacaggaggacccagaaatcgacgaaaggtccatggagagcgtagcctggatggcaaacgaactccaccacagaatcgcggccgcatacccagagacaaccgttatggtctatagaggtagtatcacagcggctgcacggaaagccgccggaatagactcccgcatcaatcttataggagagaagggacgaaaagacagaatcgaccgccggcaccacgccgtggatgcctccgtcgtcgcgctaatggaggcaagcgtcgcaaaaacactagccgaacgcagcagcctgcgcggcgaacagcgcctaaccggaaaagaacagacctggaaacaatatacaggcagtaccgtaggagccagagaacacttcgaaatgtggagaggccacatgctccacctcacggaactgttcaatgaaagactagccgaagacaaagtttacgtaacacagaacatacgcctgcgactcagcgacggcaatgcacacaccgtcaaccccagcaaactcgtatcacaccgactcggcgacggactcacagtacaacaaatcgaccgcgcgtgcactccagccctgtggtgtgccctaacccgagaaaaagacttcgacgagaaaaacggcctaccggcacgagaagaccgggccatccgagtgcatgggcacgaaataaaatcgtcagactacatacaagtgttctccaaaagaaagaaaaccgactcagaccgagatgagacaccgttcggagcaatagcggtacgtggagggttcgtcgagatcggacccagcatccaccacgccagaatatacagagtagaaggaaagaaaccagtctacgcaatgctcagggtgttcacacatgacctcttaagccagcgacatggcgacctatttagcgcggtgataccaccacaaagtatcagcatgagatgcgcggaacccaaactccgcaaagcgataacaacgggaaacgccacatatctagggtgggtcgtagtgggcgacgagcttgaaataaacgtagacagtttcaccaaatacgctattggacgcttcctcgaagacttcccaaacacaacacgatggcgcatctgcggttacgatacaaactcaaaactcacgctgaagccaatcgtcctggccgccgaaggactcgaaaacccgtcctcagccgtcaacgagatcgttgaactgaagggatggagagtagcgatcaacgtcctcacaaaagtccacccaacagtagtccgacgcgacgcactaggacgaccgcgctatagttcgagatcaaacctaccaacaagctggacgatcgagaaacgcccagccgcaacaaagaaagccggacaagcgaagaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8279 - RNA, 4577 nt, synthetic construct
  misc_feature 1..4577: note = Cas9 variant mRNA product
  source 1..4577: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtccctgccgcgaccaagccctacagcatcggcctggacatcgggaccaactccgtgggctgggccgtgacgaccgacaactacaaggttcccagcaagaagatgaaggtgctcgggaacactagcaagaagtacatcaagaagaacctattaggcgtgctcctgttcgacagcggcatcacggccgaggggcggcgcctgaagcggacggcccgcagacgctacacccggcgccggaatcgcatcctctatctgcaagagatcttctccaccgagatggccaccctagacgacgccttcttccaacggctagacgacagcttcctggtccccgacgacaagcgcgactccaaatacccgatcttcggcaacctggtggaggagaaggcctaccacgacgagttccccaccatctaccacctccggaagtacttggccgacagcaccaagaaggccgacctgcgcctcgtgtacctggcgctggcccacatgatcaagtaccgggggcactttctcatcgagggcgagttcaactccaagaacaacgacatccagaagaacttccaggacttccttgacacctacaacgccatcttcgaaagcgacctgtccttggagaatagcaagcagctggaggagatagtcaaggacaagatctccaagctggagaagaaggaccgcatcctcaagctgttccccggggagaagaacagcggcatcttctccgagttcctgaaactcatcgtgggcaaccaggccgacttccggaagtgcttcaacctggacgagaaggccagtctgcacttctccaaggagagctacgacgaggacctcgagaccctgctggggtacatcggcgacgactactccgacgtgttcctcaaggcgaagaagctgtacgacgccatcctgctcagtgggtttctgacggtcaccgacaacgagaccgaggcgcccctgagctccgccatgatcaagcgctacaacgagcacaaggaggacctcgcactgctgaaggagtacatccggaacatcagcctcaagacctacaacgaggtgttcaaggacgacacgaagaacggctacgccggctacatcgacggaaagaccaaccaggaggacttctacgtgtacctgaagaagctgctcgccgagttcgagggcgcagactacttccttgagaagatcgaccgcgaggacttcctgcggaagcagcgcaccttcgacaacggttccatcccgtaccaaatccacctccaggagatgcgcgccatcctggacaagcaggccaagttctaccccttcctggcgaagaacaaggaacggatcgaaaagatcctgaccttccgcatcccctactacgtcggccctctcgcccgggggaacagcgacttcgcctggtccatccgcaagagaaacgagaagatcacgccttggaacttcgaggacgtgatcgacaaggagagctccgccgaggccttcatcaatcgcatgaccagcttcgatctgtacctccccgaggagaaggttcttcccaagcactcgctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacattatcgagtacctccacgcaatctacggctacgacggcatcgagctgaaggggatcgagaagcagttcaacagctccctgagcacctaccacgacctcctgaacatcatcaacgacaaggagttcctggatgactccagcaacgaagccatcatcgaggagatcatccacaccctcaccatcttcgaggaccgggagatgatcaagcagcgcctgtcaaagttcgagaacatcttcgacaagagcgtgctgaagaagctctcccggcgccactacacgggctgggggaagctgagcgccaagctgatcaacggcatccgggacgagaagtccgggaacaccatcctcgattacctgatcgacgacggcatcagcaaccgcaacttcatgcagctgatccacgacgacgcgctcagcttcaagaagaagatccagaaagcacagatcatcggcgacgaggacaaggggaacatcaaggaggtggtcaagtccctgcccggcagcccggccatcaagaaagggatcctgcagtccatcaagatcgtggacgagctcgtcaaggtgatgggcgggcgaaagcccgagagcatcgtggtcgagatggcccgcgagaaccagtacaccaaccagggcaagtccaacagccagcagcggctgaagcgcctggagaagtccctcaaggagctgggcagcaagatactgaaggagaacatccccgccaagctctccaagatcgacaacaacgcgctgcagaacgaccgcctgtacttgtactacttgcagaacgggaaggacatgtacaccggcgacgacctggacatcgaccggctaagcaactacgacatcgaccacatcatcccccaggccttcctgaaggacaactccatcgacaacaaggtgctggtgagctccgcgagcaaccgcgggaagtccgacgacgtcccgagcctcgaggtggtgaagaaacggaagacgttctggtaccagctgctcaagagcaagctgatctcccagcgcaagtttgacaacctgaccaaagcagagcgtggcggcctgagccccgaggacaaggccgggttcatccaacgccagctcgtcgagacccggcagatcaccaagcacgtggcgcgcctgctggacgagaagttcaacaacaagaaggacgagaacaaccgggccgtgcgcacggtcaaaatcatcaccctcaagtccaccctggtgagccagttccgaaaggacttcgagctgtacaaggtgcgcgagatcaacgacttccaccacgcccacgacgcctacctcaacgccgtggtggcgtccgccctgctgaagaagtaccccaagctcgagcccgagttcgtgtacggcgactacccgaagtacaatagcttccgggaacgcaagtccgccaccgagaaggtctacttctacagcaatatcatgaacatattcaagaagtccatcagcctggccgacgggcgggtgatcgagcgccccctgatcgaggtgaacgaggagaccggcgaatccgtctggaacaaggagagcgacctcgcgacggtgcggcgcgtcctgtcctacccccaggtcaacgtggtgaagaaggtcgaggagcagaaccacgggctggaccgggggaagcccaagggcctcttcaacgccaacctgagctccaagccgaagcccaacagcaacgaaaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgatcgcatcaactaccggaaggacaagctgaacttcctgctcgagaaggggtacaaggacatcgagctgatcatcgagctgccaaagtacagcctcttcgagctgagtgacggctcccgccgcatgctggcgagcatcctctccacgaacaacaagcgcggggagatccacaagggcaaccagatcttcctgagccagaagttcgtgaagctgctctaccacgccaagcggatctccaacaccataaacgagaaccaccggaaatacgttgagaaccacaagaaggagttcgaggagctgttctactacatcctggagttcaacgagaactacgtcggggccaagaagaacgggaagctcctgaacagcgcctttcagtcctggcagaaccacagcatcgacgagctgtgctctagcttcatcggccccacagggtccgagcgcaagggcctcttcgaactgaccagccgggggtccgccgcggacttcgagttcctgggcgtgaagatcccccgctaccgggactacacgcccagctccctcctcaaggacgctaccctgatccaccagagcgtcacggggctctacgagacccgcatcgacctggccaagttgggagagggcaagcggccggccgccacgaagaaggcgggtcaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8280 - RNA, 3659 nt, synthetic construct
  misc_feature 1..3659: note = Cas9 variant mRNA product
  source 1..3659: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccgaaaaagaaacgcaaagtgggcatccacggagtaccagccgctgccgccttcaaaccaaacagcataaattatatcctcggcctagatatcggtatcgcctccgtagggtgggccatggtcgagattgatgaagaagaaaacccaatcaggctcatagacctaggcgtacgagtcttcgaacgcgccgaagtcccaaaaacaggagattccctcgctatggcacgaagactagcaagaagcgtgagacgacttacccgccgacgcgcccaccgcctcctccgaactcgtcgcctcctaaagcgcgaaggagtcctccaagccgccaatttcgacgaaaacggtctaatcaaaagcctccccaacacgccatggcaactccgagcagcggccctagaccggaaactaacacccctagaatggtccgctgtcctactgcacctcatcaaacaccgcggatacctaagccagaggaaaaacgaaggagagaccgccgacaaagaactaggcgcgctactgaaaggtgtagcaggcaacgcacatgccctacagacgggtgactttcgaacaccggcagagctcgcacttaacaaattcgaaaaagaatctggacatatccgaaatcaaagatccgactacagccacacattcagccgaaaagatctacaagccgaactcatccttctattcgaaaaacaaaaagagttcggaaatccccacgtatcgggcggactgaaggaagggatcgaaaccctactcatgacacaacggcccgccctatcaggcgatgccgttcagaaaatgctaggccactgcacattcgaaccagccgaaccaaaggcggccaaaaacacctacacagcggaacgcttcatctggttaactaaactgaataacttacgcatactcgaacaaggctctgaacgacccctcacggatacagaacgcgcaaccctaatggacgagccctaccgcaaaagcaaactgacctatgcacaagcgagaaaactcctaggactcgaagacacagccttcttcaaaggtctcaggtacggaaaagataacgccgaggccagcacactcatggaaatgaaagcctaccatgccatcagccgagccctggaaaaagagggcctcaaagataagaaaagccctctcaaccttagccccgaacttcaagatgaaatcggaaccgcatttagcctcttcaaaacagacgaagacatcaccggacgactgaaagaccgcatccaaccagagatactcgaggcgctgctaaaacacatatccttcgacaaattcgtacaaatcagcttaaaggcactacgccggatagtacccctaatggaacaagggaaacgatacgacgaagcatgtgccgaaatatacggtgatcactacggaaagaaaaacactgaagaaaagatctacctcccaccaatacccgccgacgaaataaggaaccccgtagtactacgtgccctctcacaagcacgcaaagtcattaacggagtagtcagaagatatggcagccccgcgcggatccacatcgaaacagcccgcgaagtaggcaaatctttcaaagatcgcaaagaaatcgagaaaagacaagaagagaatagaaaagatcgagagaaagccgccgcaaaattccgagaatatttccccaacttcgtcggtgaaccaaaaagtaaagacatcctcaaactccgcctctatgagcaacagcacggaaaatgcctatacagcggaaaagaaatcaacctcggccggctaaacgagaagggatacgtagaaatagaccacgccctcccattctcgcgaacatgggacgactcttttaataacaaagtcttagtcctcggatcagagaaccaaaacaaaggaaatcaaacgccatacgagtacttcaacggcaaggacaacagcagagaatggcaagagttcaaagcacgagtggaaacctcccgattcccacgctccaagaaacaaagaatcctactccagaaattcgacgaagacgggttcaaagaacgcaacctgaacgatacacggtacgtcaaccgcttcttatgccaattcgtggcggaccgcatgcgcctcacgggaaaaggtaagaaacgggtattcgccagcaacggacagataacgaacctcctccggggattctggggcctccgaaaagtccgggcagaaaacgaccgacaccacgcgctagacgcggttgtcgttgcttgcagcaccgtcgccatgcagcagaaaataaccagatttgtcagatacaaagagatgaacgcctttgacggaaaaactatcgacaaagagacaggcgaagtactacaccaaaagacacacttcccgcaaccatgggagttcttcgcccaagaagtcatgataagggtattcgggaaaccagacggcaaaccagagttcgaagaagcagacaccctagaaaagctccgcaccctactggcagaaaagttgagcagccgccccgaagccgtacacgaatacgtaacaccactcttcgtctcccgagcacccaaccgaaaaatgagcggccaaggccacatggaaaccgtaaaatccgccaagcgcctggacgaaggcgtctccgtactaagagtacccctcacccaactcaagctaaaagacctggagaaaatggttaacagagaaagagaaccaaagctatatgaggccctcaaggcgcgcctcgaggcacacaaagacgacccagcaaaagcattcgctgaacccttctataaatacgataaagccgggaacagaacacaacaggtaaaggccgtccgggtagaacaggtacagaagaccggagtctgggtccgaaaccataatggcatcgcagacaacgcaacaatggtacgcgtcgatgtgttcgaaaaaggcgacaagtactacctagtacccatatacagctggcaggtcgcgaaaggcatcctaccggacagggccgtagtccagggcaaagatgaagaagactggcagctaatcgatgattccttcaactttaaattcagcctacacccaaatgacctcgtagaagtaatcaccaaaaaggcaagaatgttcggatacttcgccagctgccacagaggaaccggaaacatcaacattcggatacacgacctcgatcacaaaataggcaagaatggcatactcgagggcataggggtcaaaaccgcactatccttccagaagtaccaaatcgacgagcttggaaaagaaatccggccctgtcgactgaagaaaaggccaccagttcggaagagaccggccgccaccaaaaaggcaggtcaagccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8281 - RNA, 4415 nt, synthetic construct
  misc_feature 1..4415: note = Cas9 variant mRNA product
  source 1..4415: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgaagaagccatacaccatcggcctggacatcgggaccaacagcgtgggctgggccgtgctcaccgaccagtacgacctggtcaagcggaagatgaagatcgccggggactccgagaagaagcagatcaagaagaacttctggggcgtgcgcctgttcgacgagggccagaccgccgctgaccggcgcatggcgcggaccgcccgccggcgcattgagcggcgccggaaccgcatcagctacctccagggaatcttcgccgaggagatgtccaagaccgatgccaacttcttctgccggctgagcgactccttctacgttgacaacgagaagcgcaacagccggcaccccttcttcgcgacgatagaggaggaggtcgagtatcacaagaactaccccacaatctaccacctccgcgaggaactcgtgaactccagcgaaaaggccgacctgcgtctagtgtacctcgccctggcccacatcatcaagtaccgcggcaacttcctgatcgagggggccctcgacacccagaacacctccgtcgacggcatctacaagcagttcatccagacgtacaaccaggtgttcgcgtccgggatcgaggacggctcccttaagaagctggaggacaataaggacgtggccaagatcctcgtcgagaaggtgacccggaaggagaagctggagcgcatcttaaagctctacccgggcgagaagtccgccgggatgttcgcccagttcatcagcctaatcgtgggcagcaaggggaacttccagaagcccttcgacctgatcgagaagtccgacatcgagtgcgccaaggactcgtacgaggaggacctcgagtccctgctggcgctcatcggggacgagtacgccgagctgttcgtcgccgccaagaatgcctacagcgcggtggtgctgagtagcatcatcaccgtcgccgagaccgagacgaacgccaagctcagcgcctccatgatcgagcggttcgacacccacgaggaggacctgggcgagctgaaggcattcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaagagaacttcctgcgcaagcagcgcacattcgacaacggggcgattccccaccaactgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgattttggcaagtccgccgtagacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcgtatttcagcggccaggagaaggagcagatcttcaacgacctgttcaagcagaagcggaaggtcaagaagaaggacctcgagctgttcctgcgtaacatgtcccacgtggagagccccacgatcgaggggctggaggactccttcaacagctcctacagcacctaccacgacctcctgaaggtgggcatcaagcaggagatcctggacaaccccgtcaacacagagatgctcgagaatatcgtgaagatcctgacagtgttcgaggacaagcggatgatcaaggagcagctgcagcagttctccgacgttctcgacggcgtggtgctgaagaagctggagcgccggcactacacggggtggggccgcctcagcgccaagctgctgatggggatccgggacaaacagtcccacctcaccatcctggactacctgatgaacgacgacggcctcaatcgcaacctgatgcagctgatcaacgacagcaacctttcattcaagagcatcatcgagaaggagcaggtcaccaccgccgacaaggatatccagagcatcgtggccgacctggcgggatccccggccatcaagaagggcatcctgcagagcctcaagatcgtggacgaactggtctccgtgatgggctacccgccccagacgatcgtggtcgagatggcccgggagaaccagactaccgggaagggcaagaataacagccgcccccggtacaagtccctggagaaggccatcaaggagttcgggagccagatccttaaggagcaccccaccgataatcaggagctgcgcaacaaccgactgtacctctactacctgcagaacggcaaggacatgtacacgggccaggaccttgacatccacaacctctccaactacgacatcgaccatatcgtgccccagagcttcatcaccgacaactccatcgacaacctggtgctgaccagctccgccgggaaccgcgaaaagggcgacgacgtcccgcccctcgagatcgtgcgcaagcgcaaggtgttctgggagaagctgtaccaggggaacctgatgagcaagcgcaagttcgactacctgaccaaggcggagcggggcgggctgaccgaagccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccaactctacaaggtgcgcgacgtcaacgactaccaccacgcccacgacgcctacctgaacggcgttgtggcgaacactctgctcaaggtctacccccagctggagcccgagttcgtgtacggggactaccaccagttcgactggttcaaggccaacaaggcgaccgccaagaagcagttctacaccaacatcatgttgttcttcgcccagaaggaccggatcatcgacgaaaacggtgagatcctctgggataagaagtacctggacaccgtgaagaaggtcatgtcctaccgccagatgaacatcgtgaagaagacggagatccagaagggggagttctcgaaggccaccatcaagcccaagggcaactccagcaagttaatcccccggaagaccaactgggacccgatgaagtacgggggcctcgacagccccaacatggcctacgcggttgtcatcgaatacgccaagggcaagaacaagctggtgttcgagaagaagatcatccgcgtgaccatcatggagcggaaggccttcgagaaggacgagaaggccttcctggaggagcaggggtaccgccagccgaaggtcctcgccaagctgccgaagtacacgctgtacgagtgcgaggagggccggcgccggatgctcgcgtccgcaaacgaggcccagaaggggaaccagcaggtcctgcccaaccacctggtgaccctcctgcaccacgccgcgaactgcgaggtgagcgacggcaagtccctggactacatcgagagcaaccgcgagatgttcgcggaactcctggcccatgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaaattcttcgagaccacgatcgagcgcaagcggtacaacaacctcaaggagctgctgaacagcaccatcatctaccaatccatcaccggcctctacgagtctcgcaagcgcctcgacgacaagcggcccgccgccaccaagaaggcagggcaggcgaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8282 - RNA, 4448 nt, synthetic construct
  misc_feature 1..4448: note = Cas9 variant mRNA product
  source 1..4448: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggctcccaagaagaaacgcaaggtgggcatccacggggtcccggcagcgaagaagccctacagcatcggcctggacatcggcaccaattccgtgggttgggccgtggtaaccgacgactacaaggtgcccgccaagaagatgaaggtgctcgggaacacggacaagagccacatcgagaagaacctgctgggcgccctactgttcgactccggcaataccgccgaggatcggcgcctaaagcggaccgcgcgcagacgatacacccggcgccggaaccgcatcctctaccttcaggaaatcttctcagaggagatgggaaaggtcgacgactccttcttccaccggctggaggacagcttcctcgtgacggaagacaagcgaggcgagcggcaccccatcttcgggaacctggaggaggaagtgaagtaccatgagaacttcccgaccatctaccacctccgccagtacctggccgacaatcccgagaaggttgacctgcggctggtgtacctcgccctggcccacatcatcaagttccgcgggcacttcctgattgaggggaagttcgacacgcggaacaacgacgtgcaacgcctctttcaggagttcctggcggtctatgataacacgttcgagaactccagccttcaggagcagaacgtccaggtggaggagatcctcaccgacaagatctctaaaagcgccaagaaggaccgggtgctgaagctgttccccaacgaaaagtccaacggccgcttcgccgagttcctcaagctgatcgtgggcaaccaggccgacttcaagaagcatttcgagctggaggaaaaggccccgctacagttcagtaaggacacctacgaggaggagctggaggtgctgctcgcgcagataggtgataattacgccgagctgttcctgtccgccaaaaagctgtacgacagcatcctgctgtccggcattctaacagtcaccgacgtgggaacgaaggccccgcttagtgcttcaatgatccagcggtataacgaacaccagatggacctggcgcagctaaagcagttcataagacagaagctgagcgacaagtacaacgaagtgttctccgacgtcagcaaggacggctatgccggctacatcgacgggaagaccaaccaggaggccttctacaagtacctgaaggggctcctgaacaagatagaggggagcggctacttcctggacaagatagagcgcgaggacttcctacggaagcagcgtactttcgacaacgggtccataccccaccagatccacctccaggagatgcgggccatcatccgccgtcaggcagagttctaccccttcctcgcggacaaccaggaccgcatcgagaagctgctgaccttcagaatcccctactacgtggggccgctggcccgcggcaagagcgactttgcctggctgtcccgtaagagcgccgacaagataacgccctggaacttcgacgagatcgttgacaaggagagcagcgccgaggcgttcatcaacagaatgaccaactatgacctctacctccccaaccagaaggtcctgcccaagcactccctcctatacgagaagttcaccgtctacaatgagctgaccaaggtgaagtacaaaacggagcaagggaagaccgcgttcttcgacgctaacatgaagcaagagatcttcgacggcgttttcaaagtgtaccggaaggtcactaaagataagctcatggacttcctggagaaggagttcgacgagttccgcatcgtggacctgaccggtctggacaaggaaaacaaggtgtttaacgccagctacggcacgtaccacgacctgtgcaagatactcgataaggacttcttagataactccaagaacgagaagatcctggaggacatcgtcctgaccctcactctgttcgaggaccgggagatgatccgcaagcggctggagaactatagcgacctcctgacaaaggagcaggtcaagaagctggagcgccggcactacactgggtggggtcgcttgtccgcggagctaatccacggcatccggaacaaggagagcaggaagaccatcctagactacttaatcgacgacgggaactccaacaggaacttcatgcagctgatcaacgacgacgccttgtcttttaaggaggaaatcgccaaggcccaggtgatcggcgagaccgacaacctcaaccaagtggtgtccgacatcgccgggtctccggcgatcaagaagggcatcctgcagtccctgaaaatcgtggacgagctcgtcaagatcatgggccaccaacccgagaacatcgtggtggaaatggcccgtgaaaaccagttcaccaatcagggtcgccggaacagccagcagcgactgaagggcctgacggactccatcaaggagttcgggagccagatcctcaaagaacacccagtcgagaacagccaactgcagaatgaccgactgttcctctactacctgcaaaacgggcgcgacatgtacaccggggaggagctggacatcgactacctctcccagtacgatatcgaccacataatcccccaagccttcatcaaagacaacagcatcgataaccgggtgctgacctccagcaaagagaacaggggcaagtccgatgacgtacccagcaaggacgtcgtgcggaagatgaagtcctactggagcaagctgctctccgccaagctgatcacccagcgcaagttcgacaacttgacgaaggctgagcggggcgggctcaccgacgacgacaaggcgggcttcatcaagcgccagcttgtggagacccggcagatcaccaagcacgttgcccggatcctggacgagcggttcaacaccgagacggacgagaacaataagaaaatccgccaggtgaagatcgtgaccctcaagagcaacctggtctccaacttccggaaggagttcgaactgtacaaggtccgagagataaatgactaccaccacgcccacgacgcctacctcaacgccgtgatcgggaaggcgctgctgggcgtctacccccagctcgagcccgagttcgtttacggggactacccccacttccacggccacaaggagaacaaggccaccgccaagaagttcttctacagcaacatcatgaactttttcaagaaggacgatgtgcggactgacaagaacggcgagatcatctggaagaaagacgaacacataagtaacatcaagaaggtcctgagctacccccaggtgaacatcgttaaaaaggtcgaggagcagaccggaggcttctccaaagagtcgatcctccccaaggggaactccgacaaacttatcccccgcaagacgaagaagttctactgggacaccaagaagtacggcgggttcgacagccccatagtggcctacagcatcctggtgatcgcagacatcgagaagggcaagtccaagaaactgaagaccgtcaaggcactcgtgggcgtaacgataatggaaaagatgaccttcgagcgggacccggtcgccttcttggagcgcaaggggtatcgcaatgtgcaggaggagaacatcatcaagctgcccaagtatagcctcttcaagctcgagaacgggcggaagcgcctgctagcctccgccagggagctgcagaaggggaacgaaatcgtgctgcccaaccaccttggaaccctgttataccacgcgaagaacatccacaaggtcgatgagccgaagcatctcgactacgtggacaaacacaaggatgagtttaaggaactgctggacgtggtctcaaacttctccaagaagtacaccctcgccgagggtaatctagagaagatcaaggagctgtatgcccagaacaacggcgaggacctcaaggagctcgctagcagtttcatcaaccttctcactttcacggccatcggggcgcccgccaccttcaagttcttcgataagaacatcgaccgcaagcggtacaccagcacgaccgagatcctgaacgccacgcttatccaccagtccataaccggactctacgagacgcgcatcgacctgaacaagctgggcggggacaagcggcccgccgccaccaagaaggcgggccaagccaaaaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8283 - RNA, 3581 nt, synthetic construct
  misc_feature 1..3581: note = Cas9 variant mRNA product
  source 1..3581: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacctaaaaagaaacggaaagtgggcatacacggcgttccagccgcacaaacaaccaacctcagttacatactaggtctagacctcggtatcgcatcagtcggctgggccgtcgtcgaaatcaacgaaaacgaagaccccatcggactaatagacgtcggcgtaaggatattcgaacgcgccgaagtcccaaaaaccggagaaagcctagcactgtccaggagactcgcgcggagtacccgccgcctaatacgccgccgagcccaccgcctactcctcgcgaaacgcttcctcaagagagaaggcatactgagcaccatagacctcgagaaaggcctgccaaaccaggcctgggagctaagagtcgccggcctcgaaaggcgactatcggccatcgaatggggagccgttctcctgcacctaataaaacacagggggtacctatcgaaaagaaagaacgagagtcaaacgaacaacaaggagctgggcgccctgctaagcggagtggcgcaaaaccaccagctcctacaatccgacgactaccgaacacccgcagaattagccctcaagaaatttgcaaaagaagaggggcacataagaaaccaacgcggcgcttacacacacaccttcaatagattagacctcttagcagaactgaacctgctattcgcacaacagcatcaattcggaaacccacactgtaaagagcacatccagcaatacatgactgaactcctaatgtggcagaaacccgcactcagtggcgaggccatcctaaaaatgctcggaaaatgcacacacgagaaaaacgagttcaaagccgcgaaacatacctacagcgccgaacgttttgtttggctcaccaaactcaataaccttcgaatactcgaagacggggccgaacgggcactaaacgaagaagaaagacaactactaatcaaccacccgtacgaaaagagcaaactaacatacgcgcaggtacgaaaattactaggcctctccgaacaagctattttcaagcacctacgctacagtaaagaaaacgcagagtcagccaccttcatggagctcaaagcctggcacgccatacgaaaagcactcgaaaaccagggcctgaaggacacctggcaggacctcgccaagaaacccgatctcctcgacgaaatcggaaccgccttctcactctacaaaacagatgaagacatccaacaatacctaacgaacaaagtacccaacagcgtaataaacgcactactcgtatccctgaacttcgataagttcatcgaactcagcctgaaaagcctgagaaaaatacttcctctaatggaacaaggcaaacgctacgatcaggcctgccgcgagatctacggacatcactacggggaggccaaccaaaagacgtcacaactcctgcccgccattccagcccaagaaatacgcaaccccgtagtcctgcgaacgctgtcccaagcaagaaaagtaataaacgccatcatacgacaatacggctcccccgcccgagtccacatagaaacgggtcgagaactagggaaatccttcaaagaacgacgcgaaatccaaaaacagcaggaggataatcgaaccaaacgcgagtcagcggttcaaaagttcaaggaactcttctccgacttcagcagcgaaccaaaatctaaagacatactcaagttccgcctttacgagcaacaacacggtaaatgcctatactcgggcaaagaaatcaacatacacaggctgaacgaaaaaggatacgtcgagatcgaccacgcactacccttcagtcggacctgggacgactcattcaacaataaagtacttgtcctagcaagcgagaaccaaaacaaaggcaaccagacaccatacgagtggctacaagggaaaataaactccgaacgctggaaaaacttcgtcgcactggtactcggcagccagtgctcagccgcgaagaaacaacgcctcttgacccaggtcattgacgacaacaaatttatcgaccgcaaccttaacgacactcgatacatcgcacgcttcctatcaaactacatccaggaaaacctcctactcgtcggcaaaaacaaaaagaacgtattcacgccaaacggccaaatcacagccctgctccggtcgcgatggggactaatcaaagctcgagaaaacaacaaccgacaccatgccctagatgcgatcgtggtcgcttgcgcgaccccctcaatgcaacagaaaataacccgcttcatccgatttaaagaagtccacccctacaaaatagaaaaccgatacgaaatggtcgaccaagagagtggagaaattataagcccccacttccccgagccatgggcatacttcaggcaagaggtaaacatccgagtattcgacaaccaccccgacacggtgctaaaagagatgctcccggaccggccacaggcaaaccaccaattcgtacaacctctattcgtctcccgagcgcccaccagaaaaatgtccggccaaggccacatggaaaccatcaagtccgccaaacggctggcagaaggcatctccgtactccgaatacccctaactcaactcaaacccaatctcctggaaaacatggtaaataaggagcgcgaacccgccctgtacgcaggccttaaagcccgactcgccgagttcaaccaggaccccgcaaaagccttcgccacaccattctacaaacaaggcggccagcaggtaaaagcaatccgagtagagcaagtacaaaaatcaggagtcctagtacgcgaaaacaacggagtcgccgacaatgcctcaatcgtacgaaccgacgtattcatcaaaaacaacaaattctttctcgtccccatctacacgtggcaagtagcaaagggaatcctaccaaacaaggcaatcgtcgcacacaaaaatgaagacgaatgggaagaaatggacgaaggtgccaaattcaagttctctctcttccccaacgaccttgtcgaactaaaaaccaagaaagaatacttcttcggctactacatcggactggaccgggcaacagggaacataagcctaaaagagcacgacggcgaaatctccaaaggcaaagacggagtctacagggtaggcgtcaaacttgcactgagctttgaaaaataccaagtagatgagcttgggaaaaaccgacaaatctgccgaccccaacaaagacaacctgtcagaaagagaccagccgcaactaaaaaggcaggacaagccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8284 - RNA, 3659 nt, synthetic construct
  misc_feature 1..3659: note = Cas9 variant mRNA product
  source 1..3659: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacccaaaaagaaacgcaaagtcggaatccacggagtaccagcagcagccgcctttaaaccaaacccaatcaactacatactcggattagacatagggatagcatcagtcggatgggccatggtcgagatcgacgaggacgaaaaccccatatgcctcatagacctgggggttagggttttcgagcgtgcagaggttccaaaaacaggcgacagcctagcaatggcacgtagactagcgcgctctgtccgcagactcacgagacgacgggcccacagactgctaagagcccgccgcctgctcaaaagagaaggagtcctacaagccgccgactttgacgaaaacggactcataaaaagcctccccaacacaccctggcaacttcgggcggccgccttagaccgaaaactcacacccctcgagtggtccgccgtgctactgcacctgatcaaacatcgaggatacctcagccaacgcaaaaacgagggagaaacggcagacaaagagctcggcgcactgcttaaaggcgtagcggacaacgcacacgcactacagacgggggacttccgcacgccagccgagctcgcactcaacaaattcgagaaagaaagcggtcacatccgaaaccagcgcggagactactcccacacattctcccgaaaagacctgcaagccgaactcatcctactattcgaaaaacagaaagagttcggcaacccacacgtatcaggcggtctaaaagaaggtatagaaacactcctcatgacccaaagaccggccctgtcaggagacgcagtccagaaaatgctcgggcattgcacattcgaaccagcagagcccaaggcagctaaaaacacatacaccgcagaacgattcatctggctgaccaagctcaacaacctcagaatattagaacaagggtctgaacgccccctgactgacacggaacgcgcaacactcatggacgaaccgtaccgcaaaagcaaactcacctacgcacaagcccgtaaactactgggcctcgaagacacagctttcttcaagggtctgcgatacggaaaagacaacgcagaagcatcaacattaatggaaatgaaggcttaccatgccatcagccgagccctagaaaaggaaggcctaaaagataagaaaagtcccctaaacctgtcgcccgagctacaagatgaaatcggcacagccttctcgctttttaaaaccgacgaggacatcacagggcgactcaaagaccgaatacaacccgagattctggaggcgctcctcaaacacatatcattcgacaaattcgtccaaatatccctcaaagcactacgcagaatcgttcctctcatggaacaaggcaaacgctacgatgaagcctgcgcagaaatatatggagaccattacgggaaaaagaacaccgaagagaaaatctatctgcccccgatcccagcggacgaaatacggaatcccgtcgttctgcgagcgctatcccaagcgagaaaagtaatcaacggggtcgtcagacgctacggcagtcccgcaagaatacacatagaaaccgcccgagaggtcggcaaatccttcaaagaccgcaaagagatcgaaaaacgccaagaagaaaatcgcaaggaccgagaaaaagcggcagcgaaattcagagaatacttcccaaacttcgtcggggaacccaaatccaaagatatcctaaaactccgcctatatgaacaacagcatggcaaatgcctctacagcggtaaggaaatcaacttaggaagactgaacgaaaaaggctacgtggaaatagaccacgcgctcccattcagccgcacttgggacgactcattcaacaacaaagtgctggtcctcggctcagagaaccagaataaagggaatcaaaccccctacgaatacttcaacggcaaagacaacagccgcgaatggcaagagttcaaggcacgagtggagacctcgcgcttccccagaagcaagaaacagcgaatactcctacagaaattcgacgaagatggcttcaaagaaaggaacctaaatgacacacgctacgtaaaccgctttctttgccaattcgtagcagaccggatgcggctcactggaaagggcaaaaagagagtcttcgcatccaacggacaaatcactaacctgctgaggggattctggggattacgcaaagtccgggcagagaacgaccgacaccatgcgctcgacgccgtagtcgtagcatgcagcaccgtagccatgcaacagaaaatcacgcgcttcgtgagatacaaggaaatgaacgcattcgacggaaagaccatcgacaaagagaccggagaagtcctacaccagaagacccatttcccccaaccctgggagttcttcgcccaggaagtcatgatacgcgtcttcggcaaacccgacggaaagccagagttcgaagaagcggacacgccagaaaaactaagaacgctgctcgccgagaaacttagctccagacctgaagcagtacatgaatatgtaaccccactcttcgtaagccgagccccgaaccgcaaaatgtccggccaggggcacatggaaacagtaaaatcagccaaacgcctagacgagggcgtgagcgtactaagggtaccgcttacacaactcaagctaaaagacctagagaaaatggtcaaccgcgagcgcgaaccaaagctctacgaggcccttaaggctcggctagaggcacacaaagacgacccagccaaagccttcgcggaaccgttttacaaatacgacaaggccggcaatcggactcaacaagtcaaagccgtaagagtagagcaggtccagaaaacaggcgtctgggtacgtaaccacaacggcatagcagacaacgccactatggtacgcgtcgacgtgttcgaaaaaggcgacaaatattatctagtgcccatatacagctggcaagtcgcaaaaggaatcctaccagaccgcgcggtggtccaaggaaaggacgaagaagactggcaactcatcgacgacagcttcaacttcaaattcagcctacaccccaacgacctagtcgaagtcatcacaaagaaggcccggatgttcgggtacttcgcctcctgccaccgcggcaccggtaacataaacataaggatccatgacctcgaccacaaaataggcaaaaacggaatattagaaggcatcggggtaaaaacagcccttagcttccaaaaataccaaatagacgagctaggaaaagaaataaggccctgccgactcaaaaagagaccaccagtgcgcaaaaggcccgcagcaacgaagaaagccggccaagccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8285 - RNA, 3665 nt, synthetic construct
  misc_feature 1..3665: note = Cas9 variant mRNA product
  source 1..3665: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccgaagaagaaaaggaaagtcggcattcacggagtcccagccgcaaaataccatgtaggcatagacgtaggaacattcagcgtagggctcgcggcaatagaggtagacgacgcaggtatgcccatcaaaaccctaagccttgtgtcacacatccacgacagcggcctcgatccagatgaaatcaaatcggcggtcacgcgactagcaagcagcggtatcgccagacgaacgcgcagactgtaccgaaggaaaaggagaagactccagcaactggacaaattcatacaacggcaaggatggccagtgatagaattagaggactacagcgacccactatacccctggaaagtaagagccgagctcgcagcaagttacattgcggatgagaaagaacgaggcgagaaattgagcgtggcactgagacatatcgccagacacagaggatggcgcaacccatacgcaaaagtaagcagcctatacctcccagacgggccgtccgacgcattcaaagcgatcagagaagagataaagagggcgagtgggcaaccagtgccagaaacagccacggtgggacaaatggtgaccctatgcgaactaggcacgctgaagctaagaggagaaggcggagtcctgagtgcacggttgcagcaaagcgactacgcccgcgaaatacaagaaatatgccgcatgcaagaaatagggcaagaactctacagaaaaataatcgacgtagtattcgcagctgaaagcccaaaggggagcgccagcagccgagtaggaaaagaccccttacaacccgggaaaaaccgcgcgctaaaggccagcgacgcattccaacgatacaggatagcagccttaataggaaacctaagagtccgagtagatggagagaaacgcatcctcagcgtagaggagaagaacctcgtgttcgaccatctggtcaatctaaccccaaagaaagaaccagaatgggtaacgatcgcagaaatactgggcatagacagagggcagctaataggaaccgccacgatgacggacgacggagaacgcgcgggagcccgaccacctacgcacgacacgaacagatccatcgtgaacagccgaatagccccgctagtcgactggtggaaaacagcgagcgccctcgaacaacatgcaatggtcaaggctctaagcaacgcggaagtagacgacttcgactcaccagagggagcaaaagtccaagcattcttcgccgacctagacgacgacgtccacgcaaaactcgactcccttcatctgccagtcggacgagcggcgtacagcgaagacaccctagtacgattaacacgacgcatgctaagcgacggagtagatctgtacaccgcaagactacaggagttcggcattgaaccaagctggacgccaccaacccccaggatcggagaaccagttggtaacccagctgtagaccgagtactaaaaacagtcagtcgatggcttgaaagtgcgaccaagacttggggagcaccagaacgggtcataatagaacacgtaagggagggatttgtaacagaaaaacgggcgcgagaaatggacggggacatgcgtagacgagcagcaaggaacgcaaaactgttccaggaaatgcaggagaaactaaacgtacaaggaaaaccctctagagcagatctctggcggtaccagagcgtccaaagacaaaactgccaatgcgcatactgcggcagcccaatcacgttcagcaactcagaaatggaccacatcgtgccaagggctgggcagggatccaccaacacgcgcgagaacctagtggcggtgtgccacaggtgtaaccaaagcaaaggaaacaccccgttcgcgatatgggcgaaaaacacctccatagagggcgtaagcgtaaaggaagctgtggaaagaacacgacactgggtcacggacacaggaatgcgctcaaccgactttaagaaatttacaaaggctgtcgtcgagaggttccaaagagcaacgatggacgaagagatagacgcaaggagcatggaatcggtcgcatggatggcaaacgaattgcgcagtcgggtagcacagcacttcgctagccacggaacaacggtacgagtctaccgcggaagcctcacagcggaagcacggagggccagcggcataagcggcaaactaaagttcttcgacggagtcgggaaatctcgcctagaccgcagacaccatgccatagacgcggccgtgatcgcattcacaagtgactacgtggccgagaccctagcagtacgaagcaatttgaagcaaagccaagcgcacagacaggaagccccgcaatggcgagagttcacaggaaaagacgcagaacacagagcggcatggagggtatggtgccagaaaatggaaaaactaagcgcattgctcaccgaagacctcagggacgacagagtcgtcgttatgagcaacgtgcggctacgcctcggcaacggctcggcccacaaagaaacaataggaaaactcagcaaggtcaaactaagctcacaactgtccgtatccgacatagacaaagcgtcgagcgaagcactctggtgcgcgctaacgcgagaacccggatttgaccccaaggaaggcctccctgcaaacccagaacggcacatacgagtaaacggtacacacgtgtatgctggtgacaacatcggattattcccagtctcagcaggaagtattgcgctgcggggaggatacgcagaactcggctcaagttttcaccacgcaagggtatataaaataacaagcgggaagaaaccagcattcgctatgttgagagtatacacgatagacctgctcccctaccgcaaccaagacctattcagcgttgaactaaaaccacaaacaatgtcaatgaggcaagccgaaaagaaactgcgagacgccctcgccaccgggaacgccgaatacctcggctggttagtcgtcgacgacgagctcgtagtagacaccagcaaaatagcaacggaccaagtaaaagcagtcgaagcggagctaggaacgataagacgatggagggtagatggatttttcagcccaagcaaactacgcctaagaccgcttcaaatgtcaaaagaaggcatcaaaaaggaaagcgcaccagagctgagcaagataatcgacagacccggctggctaccagcagttaataaactcttcagcgacggcaacgtcacagtcgtgcgaagggactcgttggggcgggtacggctagaaagcacagcgcacctacccgtcacatggaaggtacaaaagagaccagccgcgacgaagaaggcaggccaggcgaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8286 - RNA, 3365 nt, synthetic construct
  misc_feature 1..3365: note = Cas9 variant mRNA product
  source 1..3365: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaaacgcaaggtgggcatccacggggtcccggccgcggcccggatactggccttcgacatcggcatcagctccatagggtgggccttcagcgagaacgacgagctcaaggactgcggcgtgcgcatcttcactaaggtggagaaccccaagacaggagagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgatgagagcctcgccaaggcctacaaaggctccctgatcagcccctacgagctgcggttccgcgcactcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacttgtacaaggagtacttccagaaattcaaggagaacagcaaggagttcacgaacgtgcgcaacaagaaggagtcctacgagcggtgcatcgcccagagcttcctgaaggacgagctgaagctcatctttaaaaagcagcgcgagttcgggttctccttcagcaagaagttcgaagaggaggtcctttccgtggcgttctacaagcgggctctgaaggacttcagccacctcgtgggcaactgctccttcttcaccgacgagaagcgcgccccgaagaacagccccctggccttcatgtttgtcgccctgacccggatcatcaatctcctgaacaacctgaagaacaccgagggcatcctctacacgaaggacgacctgaacgcgctgcttaacgaggtgctgaagaacggcaccctgacctacaagcagaccaagaagctcctggggctgagcgacgactacgagttcaaaggggaaaagggcacgtacttcatcgagttcaagaagtacaaggagttcattaaggccctcggggagcacaacctgtcccaggacgacctgaacgagatcgccaaagacatcaccctcatcaaggacgagatcaagctgaagaaggccctggccaagtacgacctcaaccagaaccagatcgacagcttatccaaacttgagttcaaggaccacctcaacatcagcttcaaggcgctaaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgtgcgatcaaggagtaccgcaaggtgctgaacgccctcctgaagaagtacggcaaggtgcacaaaatcaacatcgagctggcgcgggaggtcgggaagaaccactcccagcgcgccaagatcgagaaggagcagaacgagaactacaaggccaagaaagacgcggagctcgagtgtgagaagctgggcctgaagatcaacagcaagaacatcctcaagctgcggctgttcaaggagcagaaggagttctgtgcctactccggggagaaaatcaagatcagcgacctccaggacgagaagatgttagagatcgaccacatctacccatactcccgcagcttcgacgactcctacatgaacaaggtgctggtgttcaccaagcagaaccaggagaagctcaaccagacccccttcgaggccttcggcaacgacagcgcgaagtggcagaagatcgaggtcctggcaaagaacctacccaccaagaagcagaagcggatcctcgacaagaactacaaggacaaggagcagaagaacttcaaggaccgcaacctgaacgacacacggtacatagctcgcctggtgctcaactacaccaaggactacctggacttcctgccgctctccgacgacgagaacaccaagctgaacgacacccagaaggggagcaaggtgcacgtcgaggccaagtccggcatgctgacgagcgctctccggcacacctggggcttctccgccaaggaccgcaacaaccacctccaccacgccatcgatgcggtgataatcgcctacgccaacaacagcatcgtcaaggccttctccgacttcaaaaaggagcaggagagcaacagcgcggagctgtacgccaagaagatctccgagctggactacaagaacaagcggaagttcttcgagcccttcagcggtttccgccagaaggtgctggacaagatcgacgagatcttcgtgtccaaacccgagcggaagaagcccagcggtgccctgcacgaggagaccttccgtaaagaggaggagttctaccagtcctacgggggcaaggagggggtcctcaaggcgctggagctgggcaagatccggaaggtgaacgggaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttttgcttctccctctacaaggacagcctgatcctgatccagaccaaggacatgcaagagcccgagttcgtgtactacaacgccttcacctcctcaaccgtgtccctcatagttagcaagcacgacaacaagttcgagacgctgtccaagaaccagaagatcctgttcaaaaacgcaaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8287 - RNA, 3776 nt, synthetic construct
  misc_feature 1..3776: note = Cas9 variant mRNA product
  source 1..3776: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggcatccacggggtcccggccgcgtcggacctagttctcggcctggacatcgggattggctccgtgggggtcgggatcctgaacaaggtgaccggcgagatcatccacaagaacagccggatcttccccgccgcccaggccgagaacaacctagtgcgccggacgaaccgccagggccggcgcctggcccggcgcaagaagcaccggcgcgtccggctgaaccgcctcttcgaggagtccggcctgatcacggacttcaccaagatcagcataaacctgaacccctaccagttacgggtgaaggggctgaccgacgaactgtccaacgaggagctgttcatcgcgctgaagaatatggtgaagcaccgcggcatcagctacctggatgacgcctccgacgacgggaacagctccgtcggcgattacgcccagatcgtgaaggagaatagcaagcagctcgagaccaagacgcccggacagatccagctggagcggtaccagacctacgggcagctgcgcggcgatttcaccgtggagaaagacgggaagaagcaccgactcatcaacgtcttcccgacctccgcctaccgaagcgaggcgctgcggatcctgcaaactcagcaggagttcaacccccagatcaccgatgagttcatcaaccgctacctcgagatcctgaccggcaagcggaagtactaccacggccccgggaacgagaagtcccgcaccgactacggccgctatcggacgagcggggagaccctggacaacatcttcggcatcctcatcgggaagtgcaccttctaccccgacgagttccgcgccgccaaggcctcctacaccgcccaggagttcaaccttttaaatgacctcaacaacctgacggtgccgaccgaaaccaagaagctcagcaaggagcagaagaaccagatcatcaactacgtgaagaacgagaaggctatgggccccgccaagctgttcaagtacatcgccaagctcctgtcctgcgacgtcgccgacatcaagggctaccggatcgacaagagcgggaaggccgagatccataccttcgaggcgtaccgcaagatgaagacgctcgagaccctggacatcgagcagatggacagagagaccctggacaagctcgcctacgtactgaccctgaacacggagcgcgagggcatccaggaggccctcgagcacgagttcgccgacgggtccttcagccagaagcaggtcgacgagctggtgcagttccggaaggccaacagctccatcttcggcaaagggtggcacaactttagcgtgaagctgatgatggagctcatccccgagctgtacgagaccagcgaggagcagatgaccatcctgacccgcctcggcaagcagaagacaaccagctccagcaacaagactaagtacattgacgagaagctgctgaccgaggaaatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgcctcacagcgtgttccacggccacaagcagctggccaccaagatccggctgtggcaccagcagggcgagcgctgcctctataccggcaagaccatctccatccacgacctgatcaacaacagcaaccagttcgaggtcgaccacatcctgcccctctccatcacgttcgacgacagcctggccaacaaagtgctggtgtacgcgaccgccaaccaggagaaggggcagcggacgccctaccaggccctggactccatggacgacgcctggtcgttccgcgagctgaaggccttcgtccgggagtccaagaccctgagcaacaagaagaaggagtacctcttgaccgaggaggacatctccaagttcgacgtgcgcaagaagttcatcgagcggaacctcgtggacacgcgctacgcgagccgggtcgtgctcaacgccctgcaggagcacttccgcgcccataaaatcgacaccaaggtgtccgtggtgcgcggccagttcaccagccagttaagacgccactggggcatcgagaagacccgggacacgtaccaccaccatgcagtggacgccctcatcatcgcggcctcctcccagctgaacctgtggaagaagcagaagaacaccctcgtcagctactccgaggaccagctgctggacatcgagaccggggagctcatcagcgacgacgagtacaaggagtccgtgttcaaggccccctaccaacatttcgtggacaccttaaagagcaaggagttcgaggattccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctcgagaactaccccaacaagcagatcaacgagaagggcaaggaggttccctgcaacccgttcctcaagtacaaggaggagcacgggtacatccggaaatacagcaagaagggcaacgggcccgagatcaagtccctgaagtactacgacagcaagctgggcaaccacatcgacattacccccaaagactccaacaacaaggtggtcctccagagtgtgtccccctggcgcgccgacgtgtacttcaacaagaccaccgggaagtacgagatcttgggcctgaaatacgcggacctccagttcgagaagggcacggggacctacaagatcagccaggagaagtacaacgacatcaagaagaaagagggcgtcgacagcgactccgagttcaagttcaccctgtacaagaacgacctgctcctggtgaaggacaccgagacgaaggagcagcagctgttccggttcctcagccgcaccatgccaaagcagaagcactacgtggagctaaagccctacgacaagcagaagttcgagggcggagaggccctgatcaaggtcctcgggaacgtggccaactccggccagtgcaagaagggactgggcaagagcaacatctccatctacaaggtgcggaccgacgtcctggggaaccaacacatcattaagaacgagggggacaaacccaagctcgacttcaagcgccccgccgccaccaagaaggcgggccaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8288 - RNA, 4334 nt, synthetic construct
  misc_feature 1..4334: note = Cpf1 variant mRNA product
  source 1..4334: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaagaagcgcaaggtgggaatccacggcgtcccggccgcgacccagttcgagggcttcaccaacctgtaccaggtgagcaagacgctccggttcgagctgatcccccaggggaagaccctgaaacacatccaggagcagggcttcatcgaggaggacaaggcccgcaacgaccactacaaggaactcaaacccatcatcgaccggatctataagacctacgccgaccagtgcttgcagctggtgcagctcgactgggagaatctgtccgccgccatcgacagctaccgcaaggagaagaccgaggagacccgtaacgcgcttatcgaggagcaggccacctaccgcaacgctattcatgactacttcatcgggcggaccgataacctcaccgacgccataaacaagcgccacgctgaaatctacaagggcctcttcaaggccgagctattcaacggcaaggtactaaagcagttagggacggtgaccaccaccgagcacgagaatgccctactccggtccttcgacaaattcacgacctacttctcaggcttctacgaaaaccgcaagaacgtgttcagcgcagaggacatcagcaccgcaatcccccaccggatcgtccaggacaatttcccgaagtttaaggagaactgccatatcttcacccgtctgatcacggcggtgccgtccctgcgggaacacttcgaaaacgtgaagaaggccatcggaatttttgtcagcacctccatcgaggaggtgttcagtttccccttctacaaccagttgctgacccagacccagatcgacctgtacaaccagctcttgggcgggatctctcgcgaggccggcacggagaagataaagggcttaaatgaggtgctcaacctggccatacagaagaacgacgagacagcccacatcatagcgagcctgccccaccggttcatcccgttattcaaacagatcctgtctgaccgtaacacccttagcttcatcctcgaggagttcaagagtgacgaagaggtcatccagtcgttctgcaaatacaagacccttctgcggaacgagaatgtgctcgagacggccgaggcccttttcaacgaactgaactccatcgacctcacccacatcttcatcagccacaagaaactcgagaccatcagcagcgccctgtgcgaccactgggacaccctccgcaacgccctgtacgagcggcgcatcagtgagctgacgggcaagatcaccaagtccgcgaaggagaaggtgcagcggagcctcaagcatgaagacatcaacctgcaggagatcatctccgccgccggcaaggagctgagtgaggccttcaagcaaaagacctcagaaatcctatcccacgctcatgcggccctggaccagccgttgcccaccacgctcaagaagcaagaagagaaggagatcctgaaatcccagttagacagcctgctcgggctgtaccacctcctcgactggttcgcagtcgacgaatccaacgaggtggaccccgagtttagcgcccgcctgaccggcattaaactggagatggagccgtccctcagcttctacaacaaggcgcgcaactacgccaccaagaagccctactccgtggagaagttcaagctgaacttccagatgcccacgctggccagcggctgggatgtaaacaaggagaagaacaatggggccatactcttcgtgaagaacggcctgtactacctggggatcatgcctaagcaaaagggccggtacaaggccttatccttcgagcccacggagaagaccagcgaagggttcgacaagatgtactacgactacttccccgacgcggccaaaatgatccccaagtgctccacacagctgaaagcagtgaccgcccacttccagacccacacgaccccgattctgttgagtaacaacttcatcgagccgctggagatcaccaaagagatctacgatctgaacaaccccgagaaggagcccaaaaagttccagaccgcctatgcgaaaaagacgggagaccagaaaggctaccgcgaggccctgtgcaagtggatcgacttcacccgggatttcctatccaagtacaccaagaccacgagcatcgacctgagttcactccggccaagctcccagtacaaagatctgggggagtactacgccgagctgaatccgctcctgtatcacatctcattccaacggatcgccgagaaagagatcatggacgccgtagagacgggcaagctctacctcttccagatctacaacaaggacttcgcgaagggacaccacggcaagcctaacctgcacacattgtactggaccggcctcttctcccccgagaacctcgccaagacgagcatcaagctgaacgggcaggccgagctgttctacaggcccaagagccggatgaagcgcatggcccacaggctgggtgagaagatgctgaacaagaagctaaaggaccagaagaccccgatccccgacaccctgtaccaagagctgtatgactacgtgaaccatcgcttaagccacgacctctccgacgaggcgcgtgccttactccccaacgtgatcaccaaggaggtcagccatgagatcatcaaggaccgcagattcacgtccgacaagttcttcttccacgtgccgatcacactgaactaccaggccgctaacagcccctccaagttcaaccagcgcgtcaacgcctacctaaaggagcaccccgagacgcccatcattgggatagaccggggcgagcgcaacctgatctatatcaccgtgatcgacagcacggggaagatcctggagcaacgatccctgaacaccatccagcagttcgactaccagaagaaactcgacaaccgcgaaaaagagcgggtggcggcacgccaggcctggagcgtcgtgggcaccatcaaggacctgaagcaggggtacctgagccaggtgatccacgagatcgtcgacctcatgattcactaccaggccgtcgtggtcctggagaacttaaacttcggcttcaaatcgaaacgcaccggcatcgccgagaaagcggtgtaccagcagttcgagaagatgctcattgacaagttaaactgcctggtgctaaaagattacccggccgagaaggtcggaggcgtgctgaacccctaccagttgacggaccagttcaccagcttcgccaagatgggcacccagtctggcttcctcttctacgtgcccgccccctacaccagcaagatcgacccgctgacggggttcgtagaccccttcgtttggaagaccatcaagaaccatgagagtcggaagcacttccttgaggggtttgacttcctccactatgatgtgaagactggcgatttcatcctgcacttcaagatgaaccgcaacctgagcttccagcgggggctccccggtttcatgcccgcctgggacatcgtcttcgagaagaatgagacccagttcgacgcgaaggggacgcccttcatcgccggcaagcgcatagtccctgtgatcgagaaccaccggttcaccggccgctaccgggatctgtaccccgcaaacgagctgatcgccctcctggaggagaaggggatcgtctttcgagacggctccaacatcctgcccaagttgttagagaatgacgacagccacgcaatcgacaccatggtggccctgattcggtccgtgctccagatgcgcaacagcaacgcggccaccggggaggactacatcaactccccggtccgggacctgaacggcgtgtgctttgatagccgcttccagaaccccgagtggcccatggacgccgacgcgaacggggcctaccatatcgccctgaagggacaactcttgctgaaccacctcaaggagtctaaggacctcaagctgcaaaacggtatcagcaaccaggactggctcgcctatatacaagagctgcggaacaagcgccccgccgcgactaaaaaggctgggcaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8289 - RNA, 4313 nt, synthetic construct; identical to SEQ ID NO: 2489
  misc_feature 1..4313: note = Cpf1 variant mRNA product
  source 1..4313: mol_type = other RNA

SEQ ID NO: 8290 - RNA, 4466 nt, synthetic construct
  misc_feature 1..4466: note = Cas9 variant mRNA product
  source 1..4466: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaagtgggaatccacggggtgccggcggcggacaagaagtacagcatcggcctggacatcgggaccaactcagtgggctgggccgtaatcaccgacgaatacaaagtccccagcaagaagttcaaggtgctggggaacacggaccggcattccatcaagaagaacctgatcggtgccctgctgttcgactcgggcgagaccgccgaggccacccgcctgaagcgaaccgcgcgccggcgctacacgcggcgcaagaaccggatctgttacctgcaggagatcttctccaacgagatggccaaggtggacgacagcttcttccaccgcctcgaggagtccttcctggtcgaggaggacaagaagcacgagcggcaccccattttcgggaacattgtggacgaagtggcctaccacgagaagtaccccaccatctaccaccttcgcaagaagctcgtcgacagcaccgacaaggccgacctgcggctgatttacctcgcgctggcccacatgatcaagttccgcggccacttcctgatcgagggggacctcaacccggacaactccgacgtggacaagctgttcatccaactggtgcagacctacaaccagctgttcgaggagaaccccatcaacgccagcggcgtcgacgccaaagccatcctgtccgcgagacttagcaagagtcgcaggctcgagaacctgatcgcccagcttcccggggagaagaagaacggcctattcggcaacctgattgccctgagcctcggactgacacccaacttcaagtccaacttcgatctggccgaggatgccaaactccagttgagtaaggacacctacgacgacgacctggacaacctcctggcgcagatcggcgaccagtacgccgacctgttcctcgccgccaagaacctgtctgacgccatcctgctcagcgacatcctgcgcgtgaacaccgaaatcaccaaggcgccgctgtccgcctcaatgatcaagcggtacgacgagcaccaccaggatctcacgctgctgaaggcgctagtgcgccagcagttgcccgagaaatacaaggagatcttcttcgaccagagcaaaaacgggtacgctggctacatcgacggcggggcctcccaggaggagttctataagttcatcaagcccatactggagaagatggacggcaccgaggagttactggtcaagctgaaccgggaggacctgctccgcaagcagcgcaccttcgacaatgggagcatcccccaccagatccacctgggcgagctgcacgcgatcctccggcgccaggaggacttctacccgttcctgaaggacaaccgggagaagatcgagaagatcctcacctttcgcatcccctactacgtggggcccttggcccggggcaactcccgcttcgcctggatgacgcgcaagagcgaggagaccatcactccctggaatttcgaggaggtggtcgacaagggcgccagtgcgcagagcttcattgagaggatgaccaactttgacaagaacctgccgaacgagaaggtgctgcccaagcactccctcctgtacgagtacttcacggtgtataacgaactcaccaaggtcaagtacgtgaccgaggggatgcggaagcccgctttcctcagcggcgagcagaagaaggccatcgtggacttgctgttcaagaccaaccgcaaggtcacggtgaagcagctcaaggaggattacttcaagaagatcgagtgcttcgactccgtcgagatcagcggggttgaggaccggttcaacgcctccctgggcacctaccacgacctgctcaaaatcatcaaggacaaggactttctggacaacgaggagaacgaggacatcctggaggacattgtgctcaccctgaccctgttcgaggaccgcgagatgatagaggagcggctcaagacgtatgcccacctgttcgacgacaaggtcatgaagcaactgaagcgtcggcgctacaccgggtggggccggctcagccgcaagttgatcaacggaatccgagataaacagagtgggaagacaatcctggacttcctaaagagcgacggctttgcaaaccgcaacttcatgcagctgatccacgacgactccttgaccttcaaggaggacatccagaaggcccaagtatctgggcagggagactccctccacgagcacatcgccaacctggccgggtcccccgccatcaagaagggcatcctgcagacggtgaaggtcgtggacgagctagtcaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaagagcaccccgtggagaacacccagctccagaacgagaagctctacctgtactaccttcagaacggccgggatatgtacgtcgaccaggagctggacattaacaggctgagcgactatgacgtggaccacatcgtgccccagtccttcctcaaagacgacagcatcgacaacaaggtcctgacacggtccgacaagaaccggggcaagagcgacaacgtgccctccgaggaggtagtcaagaaaatgaaaaactattggagacagctgctcaacgctaagctgatcacccagcgcaaattcgacaacttgaccaaagccgaacgcgggggcctcagcgagctagacaaggccgggttcatcaagcggcagctggtggagacccggcagatcaccaagcacgtagcccagatcctcgactccaggatgaacacgaagtacgacgagaacgacaaactgatccgggaggtcaaggtgatcaccctcaagagcaaacttgtgtccgacttcagaaaggacttccagttctataaggttagggagatcaacaactaccaccacgcgcacgacgcatacctgaacgccgtggtgggcaccgccctgatcaagaagtacccgaaacttgagagcgagttcgtctacggggactacaaggtgtacgacgtgcgcaagatgatcgcgaagtccgagcaggagatcggaaaggctaccgccaagtacttcttctacagcaacatcatgaacttcttcaagacggagatcaccctggcaaacggcgaaatccggaagcgccccctaatcgaaacgaacggagagaccggcgaaatcgtctgggacaaggggcgggacttcgccacggtgcgcaaggtgctctccatgccccaggtcaatatcgtaaagaagaccgaggtgcagaccggcgggttcagcaaggagtccatcctgcccaagcgcaacagcgataagttaatcgcgcgtaagaaggactgggacccgaagaagtacggcggcttcgactcccccaccgtcgcgtacagcgtgctggtggtcgccaaggtggagaagggcaagagcaagaagttaaagtccgtgaaggagctgctcggtatcacgatcatggagcgcagttccttcgagaagaaccccatcgatttcctggaggccaagggatacaaggaggtcaagaaggacctgatcatcaagctccccaagtacagcctgttcgagctggagaacggccggaaacgcatgctcgcctccgcgggggagctgcagaagggcaacgaactggccctccccagcaagtacgtgaacttcctgtacctggcctcccactatgagaagttaaaaggcagccccgaggacaacgaacagaagcagctgttcgtggagcagcacaagcattatctggacgagatcatcgagcagatatccgagttcagcaaacgggtgatcctcgccgacgccaacctcgacaaggtgctctccgcgtacaacaagcaccgtgacaagcccatccgggagcaggccgagaacatcatccacctcttcaccctgaccaaccttggggcccctgccgcgttcaagtacttcgacaccacgatcgaccggaagcggtacaccagcaccaaggaggtgttagacgcgaccctgatacaccagagtatcacgggcctgtacgagacccgcatcgatctcagccagctcgggggcgataagcggcccgccgccaccaagaaggccgggcaggcgaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8291 - RNA, 5249 nt, synthetic construct; identical to SEQ ID NO: 2491
  misc_feature 1..5249: note = Cas9 variant mRNA product
  source 1..5249: mol_type = other RNA

SEQ ID NO: 8292 - RNA, 3521 nt, synthetic construct
  misc_feature 1..3521: note = Cas9 variant mRNA product
  source 1..3521: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaagtgggcatccacggggtcccggccgcgaagcggaactacatcctgggcctcgacatcgggatcaccagcgtgggctacgggatcatcgactacgaaacccgcgatgttatcgacgccggcgtccggctgttcaaggaggccaacgtggagaacaacgaaggccgccggtccaagcgcggggcccggcgcctgaagcggcgccggcgccaccggatccagcgcgtgaagaagctcctgttcgactacaacctgctcacggaccacagcgagctgtcgggcatcaacccctacgaggcccgggtcaagggtctcagccagaagctctccgaggaggagttcagcgcggccctgctgcacctcgccaagcgcaggggcgtgcacaacgtgaacgaggtcgaggaggacaccgggaacgagctctccaccaaggagcagatcagccgcaactccaaggccctggaggagaagtacgtggcggagctccagctcgagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaagacatcaaggagtggtacgagatgctgatgggccattgcacctacttcccggaggagctccgaagcgtgaagtacgcctacaacgccgacctgtacaacgcgctcaacgacctcaacaacctggtcatcacgcgcgacgagaacgagaagctggagtactacgagaagttccagatcatcgagaacgtgttcaagcagaagaagaagcccaccctcaagcagatagccaaggagatcttggtgaacgaggaggacatcaaggggtaccgggtcacctccaccggcaagcccgagttcacgaacctaaaggtgtaccacgacatcaaggacatcaccgcccgcaaggagatcatcgagaacgccgagctcctggaccagatcgccaaaatcctgaccatctaccagagctccgaggacatccaggaggagctcaccaacctgaacagcgagctgacacaggaggagatcgagcagatctccaacctcaaggggtacaccggcacccacaacctgagcctgaaggcgatcaacctcatcctggacgagctgtggcacaccaacgacaatcagatcgccatctttaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctacccaacgacataatcatcgagctggcccgggagaagaacagcaaggacgcccagaagatgatcaacgagatgcagaagcgcaaccggcagaccaacgagcgcatcgaggaaatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtggaccacatcatcccccgcagcgtgtccttcgataacagcttcaacaacaaggtgctggtcaagcaagaggagaactccaagaaggggaaccggacccccttccagtacctgagctccagcgactccaagatcagctacgagaccttcaagaagcacatcctcaacctggccaagggcaaagggcgcatctccaagaccaagaaggagtacctgctcgaggaacgggacattaaccgcttcagcgtgcagaaggacttcatcaaccggaacctggtggacacgcgctacgccacccggggcctgatgaacctcctgcgctcctactttcgcgtcaacaacctggacgtgaaggtcaagagcatcaacgggggcttcacctccttcctcaggcgcaaatggaagttcaagaaggagcggaacaagggctacaagcatcacgccgaggacgcgctgatcattgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcatatcaaggacttcaaggactacaagtacagccatcgcgtggacaagaagcccaatcgggagctcatcaacgacacactgtactccacccgcaaggacgacaaggggaacaccctgatcgtgaacaacctcaacggcctgtacgacaaggacaacgacaagctgaagaagctcatcaacaagagccccgagaagctcctgatgtaccaccacgacccccagacttaccagaagctcaagctgatcatggagcagtacggggacgagaagaacccgctgtacaaatactacgaggagaccggcaactacctcaccaagtactccaagaaggacaacgggcccgtcatcaagaagatcaagtactacggcaacaagctgaacgcccacttggacatcaccgacgactaccccaacagccggaacaaggtggtgaagctctccctgaagccctaccgcttcgacgtctacctggacaacggcgtgtacaagttcgtcaccgtcaagaacctcgacgtgatcaagaaggagaactactacgaggtgaacagcaagtgctacgaggaggctaagaagctgaagaagatctccaaccaggccgagttcatcgccagcttctacaacaacgacctgatcaagatcaatggtgagctctaccgggtcatcggcgtgaacaacgacctgctgaaccgcatcgaggtgaacatgatcgacatcacgtatcgggagtacttagagaacatgaacgacaagcgcccgcccagaatcatcaagaccatcgcgtccaagacccagagcatcaagaagtactcaaccgacatcctggggaacctgtacgaggtaaagagcaagaagcacccccagatcatcaagaagggcaagcgccccgccgccacgaagaaggccggtcaagccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8293 - RNA, 4589 nt, synthetic construct
  misc_feature 1..4589: note = Cas9 variant mRNA product
  source 1..4589: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcgctgttcaacaagtgcattatcatcagcatcaacctggacttctccaacaaggagaaatgcatgaccaagccctacagcataggcctggacatcgggacgaactccgtgggctgggccgtgatcacggacaactataaggtccccagcaagaagatgaaggtgctggggaacacttccaagaagtacattaagaagaacttactgggcgtgctgctgttcgacagcggcatcaccgccgaggggcggcgcctgaagcggaccgcgcgccggcgctacacgcggcgccggaaccgcatcctgtacctccaggagatcttctctaccgagatggccaccctggacgacgcgttcttccagcggctggacgacagcttcctcgtgcccgacgacaagcgcgactccaagtacccgatcttcggcaacctggtggaggagaaggtgtaccacgacgagttccccaccatctaccacctccggaagtacctcgccgacagcacgaagaaggccgacctgcgcctcgtctacctcgccttagcgcacatgattaagtaccggggccacttcctgatcgagggcgagtttaactccaagaacaacgacatccaaaagaacttccaggacttcctcgacacctacaacgccatcttcgagagcgacctgtccctggagaacagcaagcagctcgaggagatcgtgaaggacaagatttccaagctggagaagaaggaccgcatcctgaagctgttccccggggagaagaacagcggcatcttctctgagttcctgaagctgatcgtgggcaaccaggctgacttccggaagtgcttcaacctcgatgagaaggcaagccttcacttctccaaggagagctacgacgaggacctggagaccctcctgggatacatcggcgacgactatagcgatgtcttcctgaaggctaagaagctctacgacgcgatcctgctgtccgggtttctcaccgtgacggacaacgagaccgaggcgcccctgagctccgccatgatcaagcgctacaacgagcacaaggaggacctcgccctcctgaaggagtacatccggaacatcagcctgaagacctacaacgaggtgttcaaagacgacaccaagaacggatacgccggctacattgacgggaagacgaaccaggaggacttctacgtatacctcaagaacctgctggccgagttcgagggcgccgactatttcctcgagaaaatcgaccgcgaggacttcctgcgcaagcagcgcaccttcgacaacgggtccatcccgtaccagatccaccttcaggagatgcgcgccatcctggacaagcaggccaagttctaccctttcctagccaagaacaaggagcggatcgagaagatcctgaccttccgcatcccctactatgtgggcccgctggcgcgggggaacagcgacttcgcttggtccatccgcaagcggaacgagaagatcaccccgtggaacttcgaggacgtgatcgacaaggagagctccgctgaggccttcatcaaccgcatgacgagcttcgacctctacctgcccgaggagaaggtcctgcctaagcactccctcctgtacgagaccttcaacgtgtacaatgagctgaccaaggtgcggttcatcgccgagagcatgcgcgactaccaattccttgactccaagcagaagaaggacatcgtccggctttacttcaaggacaagcgcaaggtgaccgacaaggacatcatcgagtacctgcacgcgatctacggctacgacggcatcgaactcaaggggatcgagaagcagttcaacagcagcctgagcacgtaccacgacctgctcaacatcattaacgacaaagagttcctggacgactccagcaacgaggctatcatcgaggagatcatccacaccttaaccatcttcgaggaccgggagatgatcaagcaacgcctctccaagttcgagaacatcttcgacaagagcgtgctgaagaagctgagccgtcgccactataccggctgggggaagctctccgccaaacttatcaacggcatccgggacgagaagtccgggaatacaatcctggactacctcatcgatgacggcatcagcaatcgcaacttcatgcagctgatccacgacgacgccctgagcttcaagaagaagatccagaaggcgcagattatcggcgacgaggacaagggtaacatcaaggaagtcgtgaagtccctccccggcagcccggccatcaagaagggaatcctgcagtccatcaagatcgtagacgagctggtgaaggtgatgggcgggcggaagcccgagagcatcgtcgtggagatggcccgagagaaccagtacaccaaccagggcaagtccaacagccagcagaggctcaagcgcctggagaagtcactgaaggagctcggcagcaagatcctgaaggagaacatccccgccaagctgagtaagatcgacaacaacgccctacagaacgaccgcctgtatctgtactacctccagaacgggaaggacatgtataccggagacgacctggacatcgaccggctgagcaactacgacatcgaccacataatcccccaggcgttcctcaaggacaactccatcgacaacaaggtgctggtcagctccgccagcaaccgcggaaagtccgacgacttcccgagcctggaggtggttaagaagcggaagactttctggtaccagttgctcaagagcaagctgatttcccagcgcaagttcgacaacctgacgaaggccgaacggggcggcctgctgcccgaagacaaggcaggcttcatccaacgccagctcgtcgaaacccggcaaatcaccaaacacgtggcccgcctgctggacgagaagttcaacaacaagaaggacgagaacaaccgggcggtgaggaccgtaaagatcatcacgctcaagagcaccctggtgtcccaattccggaaagacttcgagttgtacaaggtgcgcgagatcaacgacttccaccatgcccacgacgcctacctcaacgccgtcatcgccagcgcgctgctgaagaagtaccccaagctcgagcctgagtttgtgtacggcgactacccgaaatacaactccttccgtgagcgcaagagcgccaccgagaaggtgtacttctattccaatatcatgaacatcttcaagaagtccatctccctggctgacgggcgggtgatcgagcgccccctgatcgaagtgaacgaggagacgggcgagagcgtgtggaacaaggagtccgacctcgccaccgtccggcgcgtgctgagctacccccaggtgaacgtcgtaaagaaggtggaggaacagaaccacgggctggaccggggcaagcccaagggcctcttcaacgcgaacctgtccagcaagccgaagcccaactccaacgagaacctggtcggggccaaggaatacctcgaccccaagaagtacggcgggtacgccggcatcagcaactccttcgccgtgctggtcaaggggacgatcgaaaagggagccaagaagaagatcaccaacgtcctggagttccagggcatcagcatcctcgaccgcatcaactaccggaaagacaagctgaacttcctgttagagaaggggtacaaggacatcgagctgatcatcgaactgccgaagtactcactcttcgagctgtccgacggcagccgccggatgctcgcgtcgatcctcagcaccaacaataagcgtggggagatacataagggcaaccagattttcctgtcccagaagttcgtgaagctgctctaccacgccaagcggatcagcaacaccatcaacgagaaccaccgaaaatacgtggagaaccacaagaaggagttcgaggagctgttctactacatcctggagttcaacgagaactacgtcggtgccaagaagaacggaaagctcctgaacagtgccttccagagctggcagaaccattcgatcgacgagctatgcagctccttcatcggccccacggggagcgagcgcaagggcctcttcgagctaacatcccgggggagcgccgcagactttgagttcctgggcgtgaagataccccgctaccgggactacaccccctccagcctcctgaaagacgccaccctgatccaccagtccgtgacggggctgtacgagacccgcatcgacctcgccaagctgggcgagggcaagaggccggccgccaccaagaaggcagggcaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8294 - RNA, 3665 nt, synthetic construct
  misc_feature 1..3665: note = Cas9 variant mRNA product
  source 1..3665: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcacccaaaaagaaacgcaaagtaggaatacacggagtgccggcagcatggtacgcgagccttatgagcgcccaccatctacgcgttggaatcgacgtaggcacccacagcgtaggactagccacactccgagtagacgaccacggaaccccaattgaattactatcggcactgagccacatccacgatagtggagtcgggaaagaaggaaagaaagaccacgacacacgaaagaaactgtcaggaatagcaagacgcgctcgaagactattacaccaccgacgaacacagctccaacaactagacgaagtcctacgagatctaggcttcccaatcccaacaccgggagagttcctagacttaaacgaacaaaccgacccataccgcgtgtggcgagtccgagcacgactcgtggaagagaaactcccagaggaattacgcggaccagccataagcatggcagtgaggcacatcgcccgacaccgagggtggaggaacccgtatagtaaagtagaatccctactaagccccgccgaggaaagcccattcatgaaagcactccgcgaacgaatcctcgcaaccaccggcgaagtactagacgatggcataacgccgggccaagctatggcccaagtcgcactgacccataacatctcaatgcgcggaccagaaggcatactaggaaaactacaccaatccgataacgcaaacgaaatccggaaaatatgtgcccgccagggggtcagccccgacgtttgcaaacagctactccgggccgtattcaaagccgactcacctagaggcagcgccgtgagtagagtagcacccgatccccttcccggtcaggggagcttccgcagagccccaaaatgcgacccagagttccagcgcttccgaataatatccatagtggcaaacctgcgaatatctgaaacgaaaggcgaaaacagaccactaaccgccgacgaacgcagacacgtcgtcaccttcctaacggaagacagtcaagccgatcttacttgggtggacgtcgcagaaaaactcggagttcaccgccgggacttaaggggaacagccgtacacaccgacgacggagaaagaagtgccgcccggcccccaatcgacgcaacggatagaatcatgagacagaccaaaatcagttccctcaaaacgtggtgggaagaagccgacagcgaacagagaggcgcaatgatcaggtacctgtacgaagacccaaccgattctgaatgcgcagaaatcatagctgaactcccagaagaagatcaagccaaactagactccctacacttacccgcaggacgcgccgcatacagcagagagagtctaacagccttaagcgaccacatgctcgcgacaaccgacgacctccacgaggcacgaaaacgccttttcggcgttgacgacagctgggccccacccgccgaagcaatcaacgcccccgtcgggaacccctcggtggaccgcacattaaaaatagtagggcgatacctctcagcagtcgaatctatgtggggcacgccagaagtcattcacgtagagcacgtccgagacgggttcacgagcgagcgcatggccgacgaacgagacaaggcaaaccgacgaagatataacgacaaccaagaagcaatgaagaaaatccagagagactacggaaaagaaggctacatatccagaggggacatagtaaggctggacgccctcgaactccagggatgtgcctgtctctactgcgggacaacaattggataccacacgtgccaactagaccacatcgtaccccaggcaggaccaggaagcaacaaccgccgagggaacctagtcgctgtatgcgaaagatgcaaccgctcgaaatcaaacaccccctttgcagtttgggcccaaaaatgcggcatcccccacgtcggagtaaaggaagcgatcggcagagtcaggggctggagaaagcaaacaccaaacacatcaagcgaagatcttacaaggctaaagaaggaggtcatcgcacgactaagacgaacacaggaggacccagaaatcgacgaaaggtccatggagagcgtagcctggatggcaaacgaactccaccacagaatcgcggccgcatacccagagacaaccgttatggtctatagaggtagtatcacagcggctgcacggaaagccgccggaatagactcccgcatcaatcttataggagagaagggacgaaaagacagaatcgaccgccggcaccacgccgtggatgcctccgtcgtcgcgctaatggaggcaagcgtcgcaaaaacactagccgaacgcagcagcctgcgcggcgaacagcgcctaaccggaaaagaacagacctggaaacaatatacaggcagtaccgtaggagccagagaacacttcgaaatgtggagaggccacatgctccacctcacggaactgttcaatgaaagactagccgaagacaaagtttacgtaacacagaacatacgcctgcgactcagcgacggcaatgcacacaccgtcaaccccagcaaactcgtatcacaccgactcggcgacggactcacagtacaacaaatcgaccgcgcgtgcactccagccctgtggtgtgccctaacccgagaaaaagacttcgacgagaaaaacggcctaccggcacgagaagaccgggccatccgagtgcatgggcacgaaataaaatcgtcagactacatacaagtgttctccaaaagaaagaaaaccgactcagaccgagatgagacaccgttcggagcaatagcggtacgtggagggttcgtcgagatcggacccagcatccaccacgccagaatatacagagtagaaggaaagaaaccagtctacgcaatgctcagggtgttcacacatgacctcttaagccagcgacatggcgacctatttagcgcggtgataccaccacaaagtatcagcatgagatgcgcggaacccaaactccgcaaagcgataacaacgggaaacgccacatatctagggtgggtcgtagtgggcgacgagcttgaaataaacgtagacagtttcaccaaatacgctattggacgcttcctcgaagacttcccaaacacaacacgatggcgcatctgcggttacgatacaaactcaaaactcacgctgaagccaatcgtcctggccgccgaaggactcgaaaacccgtcctcagccgtcaacgagatcgttgaactgaagggatggagagtagcgatcaacgtcctcacaaaagtccacccaacagtagtccgacgcgacgcactaggacgaccgcgctatagttcgagatcaaacctaccaacaagctggacgatcgagaaacgcccagccgcaacaaagaaagccggacaagcgaagaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8295 - RNA, 4526 nt, synthetic construct
  misc_feature 1..4526: note = Cas9 variant mRNA product
  source 1..4526: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtccctgccgcgaccaagccctacagcatcggcctggacatcgggaccaactccgtgggctgggccgtgacgaccgacaactacaaggttcccagcaagaagatgaaggtgctcgggaacactagcaagaagtacatcaagaagaacctattaggcgtgctcctgttcgacagcggcatcacggccgaggggcggcgcctgaagcggacggcccgcagacgctacacccggcgccggaatcgcatcctctatctgcaagagatcttctccaccgagatggccaccctagacgacgccttcttccaacggctagacgacagcttcctggtccccgacgacaagcgcgactccaaatacccgatcttcggcaacctggtggaggagaaggcctaccacgacgagttccccaccatctaccacctccggaagtacttggccgacagcaccaagaaggccgacctgcgcctcgtgtacctggcgctggcccacatgatcaagtaccgggggcactttctcatcgagggcgagttcaactccaagaacaacgacatccagaagaacttccaggacttccttgacacctacaacgccatcttcgaaagcgacctgtccttggagaatagcaagcagctggaggagatagtcaaggacaagatctccaagctggagaagaaggaccgcatcctcaagctgttccccggggagaagaacagcggcatcttctccgagttcctgaaactcatcgtgggcaaccaggccgacttccggaagtgcttcaacctggacgagaaggccagtctgcacttctccaaggagagctacgacgaggacctcgagaccctgctggggtacatcggcgacgactactccgacgtgttcctcaaggcgaagaagctgtacgacgccatcctgctcagtgggtttctgacggtcaccgacaacgagaccgaggcgcccctgagctccgccatgatcaagcgctacaacgagcacaaggaggacctcgcactgctgaaggagtacatccggaacatcagcctcaagacctacaacgaggtgttcaaggacgacacgaagaacggctacgccggctacatcgacggaaagaccaaccaggaggacttctacgtgtacctgaagaagctgctcgccgagttcgagggcgcagactacttccttgagaagatcgaccgcgaggacttcctgcggaagcagcgcaccttcgacaacggttccatcccgtaccaaatccacctccaggagatgcgcgccatcctggacaagcaggccaagttctaccccttcctggcgaagaacaaggaacggatcgaaaagatcctgaccttccgcatcccctactacgtcggccctctcgcccgggggaacagcgacttcgcctggtccatccgcaagagaaacgagaagatcacgccttggaacttcgaggacgtgatcgacaaggagagctccgccgaggccttcatcaatcgcatgaccagcttcgatctgtacctccccgaggagaaggttcttcccaagcactcgctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacattatcgagtacctccacgcaatctacggctacgacggcatcgagctgaaggggatcgagaagcagttcaacagctccctgagcacctaccacgacctcctgaacatcatcaacgacaaggagttcctggatgactccagcaacgaagccatcatcgaggagatcatccacaccctcaccatcttcgaggaccgggagatgatcaagcagcgcctgtcaaagttcgagaacatcttcgacaagagcgtgctgaagaagctctcccggcgccactacacgggctgggggaagctgagcgccaagctgatcaacggcatccgggacgagaagtccgggaacaccatcctcgattacctgatcgacgacggcatcagcaaccgcaacttcatgcagctgatccacgacgacgcgctcagcttcaagaagaagatccagaaagcacagatcatcggcgacgaggacaaggggaacatcaaggaggtggtcaagtccctgcccggcagcccggccatcaagaaagggatcctgcagtccatcaagatcgtggacgagctcgtcaaggtgatgggcgggcgaaagcccgagagcatcgtggtcgagatggcccgcgagaaccagtacaccaaccagggcaagtccaacagccagcagcggctgaagcgcctggagaagtccctcaaggagctgggcagcaagatactgaaggagaacatccccgccaagctctccaagatcgacaacaacgcgctgcagaacgaccgcctgtacttgtactacttgcagaacgggaaggacatgtacaccggcgacgacctggacatcgaccggctaagcaactacgacatcgaccacatcatcccccaggccttcctgaaggacaactccatcgacaacaaggtgctggtgagctccgcgagcaaccgcgggaagtccgacgacgtcccgagcctcgaggtggtgaagaaacggaagacgttctggtaccagctgctcaagagcaagctgatctcccagcgcaagtttgacaacctgaccaaagcagagcgtggcggcctgagccccgaggacaaggccgggttcatccaacgccagctcgtcgagacccggcagatcaccaagcacgtggcgcgcctgctggacgagaagttcaacaacaagaaggacgagaacaaccgggccgtgcgcacggtcaaaatcatcaccctcaagtccaccctggtgagccagttccgaaaggacttcgagctgtacaaggtgcgcgagatcaacgacttccaccacgcccacgacgcctacctcaacgccgtggtggcgtccgccctgctgaagaagtaccccaagctcgagcccgagttcgtgtacggcgactacccgaagtacaatagcttccgggaacgcaagtccgccaccgagaaggtctacttctacagcaatatcatgaacatattcaagaagtccatcagcctggccgacgggcgggtgatcgagcgccccctgatcgaggtgaacgaggagaccggcgaatccgtctggaacaaggagagcgacctcgcgacggtgcggcgcgtcctgtcctacccccaggtcaacgtggtgaagaaggtcgaggagcagaaccacgggctggaccgggggaagcccaagggcctcttcaacgccaacctgagctccaagccgaagcccaacagcaacgaaaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgatcgcatcaactaccggaaggacaagctgaacttcctgctcgagaaggggtacaaggacatcgagctgatcatcgagctgccaaagtacagcctcttcgagctgagtgacggctcccgccgcatgctggcgagcatcctctccacgaacaacaagcgcggggagatccacaagggcaaccagatcttcctgagccagaagttcgtgaagctgctctaccacgccaagcggatctccaacaccataaacgagaaccaccggaaatacgttgagaaccacaagaaggagttcgaggagctgttctactacatcctggagttcaacgagaactacgtcggggccaagaagaacgggaagctcctgaacagcgcctttcagtcctggcagaaccacagcatcgacgagctgtgctctagcttcatcggccccacagggtccgagcgcaagggcctcttcgaactgaccagccgggggtccgccgcggacttcgagttcctgggcgtgaagatcccccgctaccgggactacacgcccagctccctcctcaaggacgctaccctgatccaccagagcgtcacggggctctacgagacccgcatcgacctggccaagttgggagagggcaagcggccggccgccacgaagaaggcgggtcaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8296 - RNA, 3608 nt, synthetic construct
  misc_feature 1..3608: note = Cas9 variant mRNA product
  source 1..3608: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcaccgaaaaagaaacgcaaagtgggcatccacggagtaccagccgctgccgccttcaaaccaaacagcataaattatatcctcggcctagatatcggtatcgcctccgtagggtgggccatggtcgagattgatgaagaagaaaacccaatcaggctcatagacctaggcgtacgagtcttcgaacgcgccgaagtcccaaaaacaggagattccctcgctatggcacgaagactagcaagaagcgtgagacgacttacccgccgacgcgcccaccgcctcctccgaactcgtcgcctcctaaagcgcgaaggagtcctccaagccgccaatttcgacgaaaacggtctaatcaaaagcctccccaacacgccatggcaactccgagcagcggccctagaccggaaactaacacccctagaatggtccgctgtcctactgcacctcatcaaacaccgcggatacctaagccagaggaaaaacgaaggagagaccgccgacaaagaactaggcgcgctactgaaaggtgtagcaggcaacgcacatgccctacagacgggtgactttcgaacaccggcagagctcgcacttaacaaattcgaaaaagaatctggacatatccgaaatcaaagatccgactacagccacacattcagccgaaaagatctacaagccgaactcatccttctattcgaaaaacaaaaagagttcggaaatccccacgtatcgggcggactgaaggaagggatcgaaaccctactcatgacacaacggcccgccctatcaggcgatgccgttcagaaaatgctaggccactgcacattcgaaccagccgaaccaaaggcggccaaaaacacctacacagcggaacgcttcatctggttaactaaactgaataacttacgcatactcgaacaaggctctgaacgacccctcacggatacagaacgcgcaaccctaatggacgagccctaccgcaaaagcaaactgacctatgcacaagcgagaaaactcctaggactcgaagacacagccttcttcaaaggtctcaggtacggaaaagataacgccgaggccagcacactcatggaaatgaaagcctaccatgccatcagccgagccctggaaaaagagggcctcaaagataagaaaagccctctcaaccttagccccgaacttcaagatgaaatcggaaccgcatttagcctcttcaaaacagacgaagacatcaccggacgactgaaagaccgcatccaaccagagatactcgaggcgctgctaaaacacatatccttcgacaaattcgtacaaatcagcttaaaggcactacgccggatagtacccctaatggaacaagggaaacgatacgacgaagcatgtgccgaaatatacggtgatcactacggaaagaaaaacactgaagaaaagatctacctcccaccaatacccgccgacgaaataaggaaccccgtagtactacgtgccctctcacaagcacgcaaagtcattaacggagtagtcagaagatatggcagccccgcgcggatccacatcgaaacagcccgcgaagtaggcaaatctttcaaagatcgcaaagaaatcgagaaaagacaagaagagaatagaaaagatcgagagaaagccgccgcaaaattccgagaatatttccccaacttcgtcggtgaaccaaaaagtaaagacatcctcaaactccgcctctatgagcaacagcacggaaaatgcctatacagcggaaaagaaatcaacctcggccggctaaacgagaagggatacgtagaaatagaccacgccctcccattctcgcgaacatgggacgactcttttaataacaaagtcttagtcctcggatcagagaaccaaaacaaaggaaatcaaacgccatacgagtacttcaacggcaaggacaacagcagagaatggcaagagttcaaagcacgagtggaaacctcccgattcccacgctccaagaaacaaagaatcctactccagaaattcgacgaagacgggttcaaagaacgcaacctgaacgatacacggtacgtcaaccgcttcttatgccaattcgtggcggaccgcatgcgcctcacgggaaaaggtaagaaacgggtattcgccagcaacggacagataacgaacctcctccggggattctggggcctccgaaaagtccgggcagaaaacgaccgacaccacgcgctagacgcggttgtcgttgcttgcagcaccgtcgccatgcagcagaaaataaccagatttgtcagatacaaagagatgaacgcctttgacggaaaaactatcgacaaagagacaggcgaagtactacaccaaaagacacacttcccgcaaccatgggagttcttcgcccaagaagtcatgataagggtattcgggaaaccagacggcaaaccagagttcgaagaagcagacaccctagaaaagctccgcaccctactggcagaaaagttgagcagccgccccgaagccgtacacgaatacgtaacaccactcttcgtctcccgagcacccaaccgaaaaatgagcggccaaggccacatggaaaccgtaaaatccgccaagcgcctggacgaaggcgtctccgtactaagagtacccctcacccaactcaagctaaaagacctggagaaaatggttaacagagaaagagaaccaaagctatatgaggccctcaaggcgcgcctcgaggcacacaaagacgacccagcaaaagcattcgctgaacccttctataaatacgataaagccgggaacagaacacaacaggtaaaggccgtccgggtagaacaggtacagaagaccggagtctgggtccgaaaccataatggcatcgcagacaacgcaacaatggtacgcgtcgatgtgttcgaaaaaggcgacaagtactacctagtacccatatacagctggcaggtcgcgaaaggcatcctaccggacagggccgtagtccagggcaaagatgaagaagactggcagctaatcgatgattccttcaactttaaattcagcctacacccaaatgacctcgtagaagtaatcaccaaaaaggcaagaatgttcggatacttcgccagctgccacagaggaaccggaaacatcaacattcggatacacgacctcgatcacaaaataggcaagaatggcatactcgagggcataggggtcaaaaccgcactatccttccagaagtaccaaatcgacgagcttggaaaagaaatccggccctgtcgactgaagaaaaggccaccagttcggaagagaccggccgccaccaaaaaggcaggtcaagccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8297 - RNA, 4364 nt, synthetic construct
  misc_feature 1..4364: note = Cas9 variant mRNA product
  source 1..4364: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcgaagaagccatacaccatcggcctggacatcgggaccaacagcgtgggctgggccgtgctcaccgaccagtacgacctggtcaagcggaagatgaagatcgccggggactccgagaagaagcagatcaagaagaacttctggggcgtgcgcctgttcgacgagggccagaccgccgctgaccggcgcatggcgcggaccgcccgccggcgcattgagcggcgccggaaccgcatcagctacctccagggaatcttcgccgaggagatgtccaagaccgatgccaacttcttctgccggctgagcgactccttctacgttgacaacgagaagcgcaacagccggcaccccttcttcgcgacgatagaggaggaggtcgagtatcacaagaactaccccacaatctaccacctccgcgaggaactcgtgaactccagcgaaaaggccgacctgcgtctagtgtacctcgccctggcccacatcatcaagtaccgcggcaacttcctgatcgagggggccctcgacacccagaacacctccgtcgacggcatctacaagcagttcatccagacgtacaaccaggtgttcgcgtccgggatcgaggacggctcccttaagaagctggaggacaataaggacgtggccaagatcctcgtcgagaaggtgacccggaaggagaagctggagcgcatcttaaagctctacccgggcgagaagtccgccgggatgttcgcccagttcatcagcctaatcgtgggcagcaaggggaacttccagaagcccttcgacctgatcgagaagtccgacatcgagtgcgccaaggactcgtacgaggaggacctcgagtccctgctggcgctcatcggggacgagtacgccgagctgttcgtcgccgccaagaatgcctacagcgcggtggtgctgagtagcatcatcaccgtcgccgagaccgagacgaacgccaagctcagcgcctccatgatcgagcggttcgacacccacgaggaggacctgggcgagctgaaggcattcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaagagaacttcctgcgcaagcagcgcacattcgacaacggggcgattccccaccaactgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgattttggcaagtccgccgtagacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcgtatttcagcggccaggagaaggagcagatcttcaacgacctgttcaagcagaagcggaaggtcaagaagaaggacctcgagctgttcctgcgtaacatgtcccacgtggagagccccacgatcgaggggctggaggactccttcaacagctcctacagcacctaccacgacctcctgaaggtgggcatcaagcaggagatcctggacaaccccgtcaacacagagatgctcgagaatatcgtgaagatcctgacagtgttcgaggacaagcggatgatcaaggagcagctgcagcagttctccgacgttctcgacggcgtggtgctgaagaagctggagcgccggcactacacggggtggggccgcctcagcgccaagctgctgatggggatccgggacaaacagtcccacctcaccatcctggactacctgatgaacgacgacggcctcaatcgcaacctgatgcagctgatcaacgacagcaacctttcattcaagagcatcatcgagaaggagcaggtcaccaccgccgacaaggatatccagagcatcgtggccgacctggcgggatccccggccatcaagaagggcatcctgcagagcctcaagatcgtggacgaactggtctccgtgatgggctacccgccccagacgatcgtggtcgagatggcccgggagaaccagactaccgggaagggcaagaataacagccgcccccggtacaagtccctggagaaggccatcaaggagttcgggagccagatccttaaggagcaccccaccgataatcaggagctgcgcaacaaccgactgtacctctactacctgcagaacggcaaggacatgtacacgggccaggaccttgacatccacaacctctccaactacgacatcgaccatatcgtgccccagagcttcatcaccgacaactccatcgacaacctggtgctgaccagctccgccgggaaccgcgaaaagggcgacgacgtcccgcccctcgagatcgtgcgcaagcgcaaggtgttctgggagaagctgtaccaggggaacctgatgagcaagcgcaagttcgactacctgaccaaggcggagcggggcgggctgaccgaagccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccaactctacaaggtgcgcgacgtcaacgactaccaccacgcccacgacgcctacctgaacggcgttgtggcgaacactctgctcaaggtctacccccagctggagcccgagttcgtgtacggggactaccaccagttcgactggttcaaggccaacaaggcgaccgccaagaagcagttctacaccaacatcatgttgttcttcgcccagaaggaccggatcatcgacgaaaacggtgagatcctctgggataagaagtacctggacaccgtgaagaaggtcatgtcctaccgccagatgaacatcgtgaagaagacggagatccagaagggggagttctcgaaggccaccatcaagcccaagggcaactccagcaagttaatcccccggaagaccaactgggacccgatgaagtacgggggcctcgacagccccaacatggcctacgcggttgtcatcgaatacgccaagggcaagaacaagctggtgttcgagaagaagatcatccgcgtgaccatcatggagcggaaggccttcgagaaggacgagaaggccttcctggaggagcaggggtaccgccagccgaaggtcctcgccaagctgccgaagtacacgctgtacgagtgcgaggagggccggcgccggatgctcgcgtccgcaaacgaggcccagaaggggaaccagcaggtcctgcccaaccacctggtgaccctcctgcaccacgccgcgaactgcgaggtgagcgacggcaagtccctggactacatcgagagcaaccgcgagatgttcgcggaactcctggcccatgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaaattcttcgagaccacgatcgagcgcaagcggtacaacaacctcaaggagctgctgaacagcaccatcatctaccaatccatcaccggcctctacgagtctcgcaagcgcctcgacgacaagcggcccgccgccaccaagaaggcagggcaggcgaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8298 - RNA, 4397 nt, synthetic construct
  misc_feature 1..4397: note = Cas9 variant mRNA product
  source 1..4397: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggctcccaagaagaaacgcaaggtgggcatccacggggtcccggcagcgaagaagccctacagcatcggcctggacatcggcaccaattccgtgggttgggccgtggtaaccgacgactacaaggtgcccgccaagaagatgaaggtgctcgggaacacggacaagagccacatcgagaagaacctgctgggcgccctactgttcgactccggcaataccgccgaggatcggcgcctaaagcggaccgcgcgcagacgatacacccggcgccggaaccgcatcctctaccttcaggaaatcttctcagaggagatgggaaaggtcgacgactccttcttccaccggctggaggacagcttcctcgtgacggaagacaagcgaggcgagcggcaccccatcttcgggaacctggaggaggaagtgaagtaccatgagaacttcccgaccatctaccacctccgccagtacctggccgacaatcccgagaaggttgacctgcggctggtgtacctcgccctggcccacatcatcaagttccgcgggcacttcctgattgaggggaagttcgacacgcggaacaacgacgtgcaacgcctctttcaggagttcctggcggtctatgataacacgttcgagaactccagccttcaggagcagaacgtccaggtggaggagatcctcaccgacaagatctctaaaagcgccaagaaggaccgggtgctgaagctgttccccaacgaaaagtccaacggccgcttcgccgagttcctcaagctgatcgtgggcaaccaggccgacttcaagaagcatttcgagctggaggaaaaggccccgctacagttcagtaaggacacctacgaggaggagctggaggtgctgctcgcgcagataggtgataattacgccgagctgttcctgtccgccaaaaagctgtacgacagcatcctgctgtccggcattctaacagtcaccgacgtgggaacgaaggccccgcttagtgcttcaatgatccagcggtataacgaacaccagatggacctggcgcagctaaagcagttcataagacagaagctgagcgacaagtacaacgaagtgttctccgacgtcagcaaggacggctatgccggctacatcgacgggaagaccaaccaggaggccttctacaagtacctgaaggggctcctgaacaagatagaggggagcggctacttcctggacaagatagagcgcgaggacttcctacggaagcagcgtactttcgacaacgggtccataccccaccagatccacctccaggagatgcgggccatcatccgccgtcaggcagagttctaccccttcctcgcggacaaccaggaccgcatcgagaagctgctgaccttcagaatcccctactacgtggggccgctggcccgcggcaagagcgactttgcctggctgtcccgtaagagcgccgacaagataacgccctggaacttcgacgagatcgttgacaaggagagcagcgccgaggcgttcatcaacagaatgaccaactatgacctctacctccccaaccagaaggtcctgcccaagcactccctcctatacgagaagttcaccgtctacaatgagctgaccaaggtgaagtacaaaacggagcaagggaagaccgcgttcttcgacgctaacatgaagcaagagatcttcgacggcgttttcaaagtgtaccggaaggtcactaaagataagctcatggacttcctggagaaggagttcgacgagttccgcatcgtggacctgaccggtctggacaaggaaaacaaggtgtttaacgccagctacggcacgtaccacgacctgtgcaagatactcgataaggacttcttagataactccaagaacgagaagatcctggaggacatcgtcctgaccctcactctgttcgaggaccgggagatgatccgcaagcggctggagaactatagcgacctcctgacaaaggagcaggtcaagaagctggagcgccggcactacactgggtggggtcgcttgtccgcggagctaatccacggcatccggaacaaggagagcaggaagaccatcctagactacttaatcgacgacgggaactccaacaggaacttcatgcagctgatcaacgacgacgccttgtcttttaaggaggaaatcgccaaggcccaggtgatcggcgagaccgacaacctcaaccaagtggtgtccgacatcgccgggtctccggcgatcaagaagggcatcctgcagtccctgaaaatcgtggacgagctcgtcaagatcatgggccaccaacccgagaacatcgtggtggaaatggcccgtgaaaaccagttcaccaatcagggtcgccggaacagccagcagcgactgaagggcctgacggactccatcaaggagttcgggagccagatcctcaaagaacacccagtcgagaacagccaactgcagaatgaccgactgttcctctactacctgcaaaacgggcgcgacatgtacaccggggaggagctggacatcgactacctctcccagtacgatatcgaccacataatcccccaagccttcatcaaagacaacagcatcgataaccgggtgctgacctccagcaaagagaacaggggcaagtccgatgacgtacccagcaaggacgtcgtgcggaagatgaagtcctactggagcaagctgctctccgccaagctgatcacccagcgcaagttcgacaacttgacgaaggctgagcggggcgggctcaccgacgacgacaaggcgggcttcatcaagcgccagcttgtggagacccggcagatcaccaagcacgttgcccggatcctggacgagcggttcaacaccgagacggacgagaacaataagaaaatccgccaggtgaagatcgtgaccctcaagagcaacctggtctccaacttccggaaggagttcgaactgtacaaggtccgagagataaatgactaccaccacgcccacgacgcctacctcaacgccgtgatcgggaaggcgctgctgggcgtctacccccagctcgagcccgagttcgtttacggggactacccccacttccacggccacaaggagaacaaggccaccgccaagaagttcttctacagcaacatcatgaactttttcaagaaggacgatgtgcggactgacaagaacggcgagatcatctggaagaaagacgaacacataagtaacatcaagaaggtcctgagctacccccaggtgaacatcgttaaaaaggtcgaggagcagaccggaggcttctccaaagagtcgatcctccccaaggggaactccgacaaacttatcccccgcaagacgaagaagttctactgggacaccaagaagtacggcgggttcgacagccccatagtggcctacagcatcctggtgatcgcagacatcgagaagggcaagtccaagaaactgaagaccgtcaaggcactcgtgggcgtaacgataatggaaaagatgaccttcgagcgggacccggtcgccttcttggagcgcaaggggtatcgcaatgtgcaggaggagaacatcatcaagctgcccaagtatagcctcttcaagctcgagaacgggcggaagcgcctgctagcctccgccagggagctgcagaaggggaacgaaatcgtgctgcccaaccaccttggaaccctgttataccacgcgaagaacatccacaaggtcgatgagccgaagcatctcgactacgtggacaaacacaaggatgagtttaaggaactgctggacgtggtctcaaacttctccaagaagtacaccctcgccgagggtaatctagagaagatcaaggagctgtatgcccagaacaacggcgaggacctcaaggagctcgctagcagtttcatcaaccttctcactttcacggccatcggggcgcccgccaccttcaagttcttcgataagaacatcgaccgcaagcggtacaccagcacgaccgagatcctgaacgccacgcttatccaccagtccataaccggactctacgagacgcgcatcgacctgaacaagctgggcggggacaagcggcccgccgccaccaagaaggcgggccaagccaaaaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8299 - RNA, 3530 nt, synthetic construct
  misc_feature 1..3530: note = Cas9 variant mRNA product
  source 1..3530: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcacctaaaaagaaacggaaagtgggcatacacggcgttccagccgcacaaacaaccaacctcagttacatactaggtctagacctcggtatcgcatcagtcggctgggccgtcgtcgaaatcaacgaaaacgaagaccccatcggactaatagacgtcggcgtaaggatattcgaacgcgccgaagtcccaaaaaccggagaaagcctagcactgtccaggagactcgcgcggagtacccgccgcctaatacgccgccgagcccaccgcctactcctcgcgaaacgcttcctcaagagagaaggcatactgagcaccatagacctcgagaaaggcctgccaaaccaggcctgggagctaagagtcgccggcctcgaaaggcgactatcggccatcgaatggggagccgttctcctgcacctaataaaacacagggggtacctatcgaaaagaaagaacgagagtcaaacgaacaacaaggagctgggcgccctgctaagcggagtggcgcaaaaccaccagctcctacaatccgacgactaccgaacacccgcagaattagccctcaagaaatttgcaaaagaagaggggcacataagaaaccaacgcggcgcttacacacacaccttcaatagattagacctcttagcagaactgaacctgctattcgcacaacagcatcaattcggaaacccacactgtaaagagcacatccagcaatacatgactgaactcctaatgtggcagaaacccgcactcagtggcgaggccatcctaaaaatgctcggaaaatgcacacacgagaaaaacgagttcaaagccgcgaaacatacctacagcgccgaacgttttgtttggctcaccaaactcaataaccttcgaatactcgaagacggggccgaacgggcactaaacgaagaagaaagacaactactaatcaaccacccgtacgaaaagagcaaactaacatacgcgcaggtacgaaaattactaggcctctccgaacaagctattttcaagcacctacgctacagtaaagaaaacgcagagtcagccaccttcatggagctcaaagcctggcacgccatacgaaaagcactcgaaaaccagggcctgaaggacacctggcaggacctcgccaagaaacccgatctcctcgacgaaatcggaaccgccttctcactctacaaaacagatgaagacatccaacaatacctaacgaacaaagtacccaacagcgtaataaacgcactactcgtatccctgaacttcgataagttcatcgaactcagcctgaaaagcctgagaaaaatacttcctctaatggaacaaggcaaacgctacgatcaggcctgccgcgagatctacggacatcactacggggaggccaaccaaaagacgtcacaactcctgcccgccattccagcccaagaaatacgcaaccccgtagtcctgcgaacgctgtcccaagcaagaaaagtaataaacgccatcatacgacaatacggctcccccgcccgagtccacatagaaacgggtcgagaactagggaaatccttcaaagaacgacgcgaaatccaaaaacagcaggaggataatcgaaccaaacgcgagtcagcggttcaaaagttcaaggaactcttctccgacttcagcagcgaaccaaaatctaaagacatactcaagttccgcctttacgagcaacaacacggtaaatgcctatactcgggcaaagaaatcaacatacacaggctgaacgaaaaaggatacgtcgagatcgaccacgcactacccttcagtcggacctgggacgactcattcaacaataaagtacttgtcctagcaagcgagaaccaaaacaaaggcaaccagacaccatacgagtggctacaagggaaaataaactccgaacgctggaaaaacttcgtcgcactggtactcggcagccagtgctcagccgcgaagaaacaacgcctcttgacccaggtcattgacgacaacaaatttatcgaccgcaaccttaacgacactcgatacatcgcacgcttcctatcaaactacatccaggaaaacctcctactcgtcggcaaaaacaaaaagaacgtattcacgccaaacggccaaatcacagccctgctccggtcgcgatggggactaatcaaagctcgagaaaacaacaaccgacaccatgccctagatgcgatcgtggtcgcttgcgcgaccccctcaatgcaacagaaaataacccgcttcatccgatttaaagaagtccacccctacaaaatagaaaaccgatacgaaatggtcgaccaagagagtggagaaattataagcccccacttccccgagccatgggcatacttcaggcaagaggtaaacatccgagtattcgacaaccaccccgacacggtgctaaaagagatgctcccggaccggccacaggcaaaccaccaattcgtacaacctctattcgtctcccgagcgcccaccagaaaaatgtccggccaaggccacatggaaaccatcaagtccgccaaacggctggcagaaggcatctccgtactccgaatacccctaactcaactcaaacccaatctcctggaaaacatggtaaataaggagcgcgaacccgccctgtacgcaggccttaaagcccgactcgccgagttcaaccaggaccccgcaaaagccttcgccacaccattctacaaacaaggcggccagcaggtaaaagcaatccgagtagagcaagtacaaaaatcaggagtcctagtacgcgaaaacaacggagtcgccgacaatgcctcaatcgtacgaaccgacgtattcatcaaaaacaacaaattctttctcgtccccatctacacgtggcaagtagcaaagggaatcctaccaaacaaggcaatcgtcgcacacaaaaatgaagacgaatgggaagaaatggacgaaggtgccaaattcaagttctctctcttccccaacgaccttgtcgaactaaaaaccaagaaagaatacttcttcggctactacatcggactggaccgggcaacagggaacataagcctaaaagagcacgacggcgaaatctccaaaggcaaagacggagtctacagggtaggcgtcaaacttgcactgagctttgaaaaataccaagtagatgagcttgggaaaaaccgacaaatctgccgaccccaacaaagacaacctgtcagaaagagaccagccgcaactaaaaaggcaggacaagccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8300 - RNA, 3608 nt, synthetic construct
  misc_feature 1..3608: note = Cas9 variant mRNA product
  source 1..3608: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcacccaaaaagaaacgcaaagtcggaatccacggagtaccagcagcagccgcctttaaaccaaacccaatcaactacatactcggattagacatagggatagcatcagtcggatgggccatggtcgagatcgacgaggacgaaaaccccatatgcctcatagacctgggggttagggttttcgagcgtgcagaggttccaaaaacaggcgacagcctagcaatggcacgtagactagcgcgctctgtccgcagactcacgagacgacgggcccacagactgctaagagcccgccgcctgctcaaaagagaaggagtcctacaagccgccgactttgacgaaaacggactcataaaaagcctccccaacacaccctggcaacttcgggcggccgccttagaccgaaaactcacacccctcgagtggtccgccgtgctactgcacctgatcaaacatcgaggatacctcagccaacgcaaaaacgagggagaaacggcagacaaagagctcggcgcactgcttaaaggcgtagcggacaacgcacacgcactacagacgggggacttccgcacgccagccgagctcgcactcaacaaattcgagaaagaaagcggtcacatccgaaaccagcgcggagactactcccacacattctcccgaaaagacctgcaagccgaactcatcctactattcgaaaaacagaaagagttcggcaacccacacgtatcaggcggtctaaaagaaggtatagaaacactcctcatgacccaaagaccggccctgtcaggagacgcagtccagaaaatgctcgggcattgcacattcgaaccagcagagcccaaggcagctaaaaacacatacaccgcagaacgattcatctggctgaccaagctcaacaacctcagaatattagaacaagggtctgaacgccccctgactgacacggaacgcgcaacactcatggacgaaccgtaccgcaaaagcaaactcacctacgcacaagcccgtaaactactgggcctcgaagacacagctttcttcaagggtctgcgatacggaaaagacaacgcagaagcatcaacattaatggaaatgaaggcttaccatgccatcagccgagccctagaaaaggaaggcctaaaagataagaaaagtcccctaaacctgtcgcccgagctacaagatgaaatcggcacagccttctcgctttttaaaaccgacgaggacatcacagggcgactcaaagaccgaatacaacccgagattctggaggcgctcctcaaacacatatcattcgacaaattcgtccaaatatccctcaaagcactacgcagaatcgttcctctcatggaacaaggcaaacgctacgatgaagcctgcgcagaaatatatggagaccattacgggaaaaagaacaccgaagagaaaatctatctgcccccgatcccagcggacgaaatacggaatcccgtcgttctgcgagcgctatcccaagcgagaaaagtaatcaacggggtcgtcagacgctacggcagtcccgcaagaatacacatagaaaccgcccgagaggtcggcaaatccttcaaagaccgcaaagagatcgaaaaacgccaagaagaaaatcgcaaggaccgagaaaaagcggcagcgaaattcagagaatacttcccaaacttcgtcggggaacccaaatccaaagatatcctaaaactccgcctatatgaacaacagcatggcaaatgcctctacagcggtaaggaaatcaacttaggaagactgaacgaaaaaggctacgtggaaatagaccacgcgctcccattcagccgcacttgggacgactcattcaacaacaaagtgctggtcctcggctcagagaaccagaataaagggaatcaaaccccctacgaatacttcaacggcaaagacaacagccgcgaatggcaagagttcaaggcacgagtggagacctcgcgcttccccagaagcaagaaacagcgaatactcctacagaaattcgacgaagatggcttcaaagaaaggaacctaaatgacacacgctacgtaaaccgctttctttgccaattcgtagcagaccggatgcggctcactggaaagggcaaaaagagagtcttcgcatccaacggacaaatcactaacctgctgaggggattctggggattacgcaaagtccgggcagagaacgaccgacaccatgcgctcgacgccgtagtcgtagcatgcagcaccgtagccatgcaacagaaaatcacgcgcttcgtgagatacaaggaaatgaacgcattcgacggaaagaccatcgacaaagagaccggagaagtcctacaccagaagacccatttcccccaaccctgggagttcttcgcccaggaagtcatgatacgcgtcttcggcaaacccgacggaaagccagagttcgaagaagcggacacgccagaaaaactaagaacgctgctcgccgagaaacttagctccagacctgaagcagtacatgaatatgtaaccccactcttcgtaagccgagccccgaaccgcaaaatgtccggccaggggcacatggaaacagtaaaatcagccaaacgcctagacgagggcgtgagcgtactaagggtaccgcttacacaactcaagctaaaagacctagagaaaatggtcaaccgcgagcgcgaaccaaagctctacgaggcccttaaggctcggctagaggcacacaaagacgacccagccaaagccttcgcggaaccgttttacaaatacgacaaggccggcaatcggactcaacaagtcaaagccgtaagagtagagcaggtccagaaaacaggcgtctgggtacgtaaccacaacggcatagcagacaacgccactatggtacgcgtcgacgtgttcgaaaaaggcgacaaatattatctagtgcccatatacagctggcaagtcgcaaaaggaatcctaccagaccgcgcggtggtccaaggaaaggacgaagaagactggcaactcatcgacgacagcttcaacttcaaattcagcctacaccccaacgacctagtcgaagtcatcacaaagaaggcccggatgttcgggtacttcgcctcctgccaccgcggcaccggtaacataaacataaggatccatgacctcgaccacaaaataggcaaaaacggaatattagaaggcatcggggtaaaaacagcccttagcttccaaaaataccaaatagacgagctaggaaaagaaataaggccctgccgactcaaaaagagaccaccagtgcgcaaaaggcccgcagcaacgaagaaagccggccaagccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8301 - RNA, 3614 nt, synthetic construct
  misc_feature 1..3614: note = Cas9 variant mRNA product
  source 1..3614: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcaccgaagaagaaaaggaaagtcggcattcacggagtcccagccgcaaaataccatgtaggcatagacgtaggaacattcagcgtagggctcgcggcaatagaggtagacgacgcaggtatgcccatcaaaaccctaagccttgtgtcacacatccacgacagcggcctcgatccagatgaaatcaaatcggcggtcacgcgactagcaagcagcggtatcgccagacgaacgcgcagactgtaccgaaggaaaaggagaagactccagcaactggacaaattcatacaacggcaaggatggccagtgatagaattagaggactacagcgacccactatacccctggaaagtaagagccgagctcgcagcaagttacattgcggatgagaaagaacgaggcgagaaattgagcgtggcactgagacatatcgccagacacagaggatggcgcaacccatacgcaaaagtaagcagcctatacctcccagacgggccgtccgacgcattcaaagcgatcagagaagagataaagagggcgagtgggcaaccagtgccagaaacagccacggtgggacaaatggtgaccctatgcgaactaggcacgctgaagctaagaggagaaggcggagtcctgagtgcacggttgcagcaaagcgactacgcccgcgaaatacaagaaatatgccgcatgcaagaaatagggcaagaactctacagaaaaataatcgacgtagtattcgcagctgaaagcccaaaggggagcgccagcagccgagtaggaaaagaccccttacaacccgggaaaaaccgcgcgctaaaggccagcgacgcattccaacgatacaggatagcagccttaataggaaacctaagagtccgagtagatggagagaaacgcatcctcagcgtagaggagaagaacctcgtgttcgaccatctggtcaatctaaccccaaagaaagaaccagaatgggtaacgatcgcagaaatactgggcatagacagagggcagctaataggaaccgccacgatgacggacgacggagaacgcgcgggagcccgaccacctacgcacgacacgaacagatccatcgtgaacagccgaatagccccgctagtcgactggtggaaaacagcgagcgccctcgaacaacatgcaatggtcaaggctctaagcaacgcggaagtagacgacttcgactcaccagagggagcaaaagtccaagcattcttcgccgacctagacgacgacgtccacgcaaaactcgactcccttcatctgccagtcggacgagcggcgtacagcgaagacaccctagtacgattaacacgacgcatgctaagcgacggagtagatctgtacaccgcaagactacaggagttcggcattgaaccaagctggacgccaccaacccccaggatcggagaaccagttggtaacccagctgtagaccgagtactaaaaacagtcagtcgatggcttgaaagtgcgaccaagacttggggagcaccagaacgggtcataatagaacacgtaagggagggatttgtaacagaaaaacgggcgcgagaaatggacggggacatgcgtagacgagcagcaaggaacgcaaaactgttccaggaaatgcaggagaaactaaacgtacaaggaaaaccctctagagcagatctctggcggtaccagagcgtccaaagacaaaactgccaatgcgcatactgcggcagcccaatcacgttcagcaactcagaaatggaccacatcgtgccaagggctgggcagggatccaccaacacgcgcgagaacctagtggcggtgtgccacaggtgtaaccaaagcaaaggaaacaccccgttcgcgatatgggcgaaaaacacctccatagagggcgtaagcgtaaaggaagctgtggaaagaacacgacactgggtcacggacacaggaatgcgctcaaccgactttaagaaatttacaaaggctgtcgtcgagaggttccaaagagcaacgatggacgaagagatagacgcaaggagcatggaatcggtcgcatggatggcaaacgaattgcgcagtcgggtagcacagcacttcgctagccacggaacaacggtacgagtctaccgcggaagcctcacagcggaagcacggagggccagcggcataagcggcaaactaaagttcttcgacggagtcgggaaatctcgcctagaccgcagacaccatgccatagacgcggccgtgatcgcattcacaagtgactacgtggccgagaccctagcagtacgaagcaatttgaagcaaagccaagcgcacagacaggaagccccgcaatggcgagagttcacaggaaaagacgcagaacacagagcggcatggagggtatggtgccagaaaatggaaaaactaagcgcattgctcaccgaagacctcagggacgacagagtcgtcgttatgagcaacgtgcggctacgcctcggcaacggctcggcccacaaagaaacaataggaaaactcagcaaggtcaaactaagctcacaactgtccgtatccgacatagacaaagcgtcgagcgaagcactctggtgcgcgctaacgcgagaacccggatttgaccccaaggaaggcctccctgcaaacccagaacggcacatacgagtaaacggtacacacgtgtatgctggtgacaacatcggattattcccagtctcagcaggaagtattgcgctgcggggaggatacgcagaactcggctcaagttttcaccacgcaagggtatataaaataacaagcgggaagaaaccagcattcgctatgttgagagtatacacgatagacctgctcccctaccgcaaccaagacctattcagcgttgaactaaaaccacaaacaatgtcaatgaggcaagccgaaaagaaactgcgagacgccctcgccaccgggaacgccgaatacctcggctggttagtcgtcgacgacgagctcgtagtagacaccagcaaaatagcaacggaccaagtaaaagcagtcgaagcggagctaggaacgataagacgatggagggtagatggatttttcagcccaagcaaactacgcctaagaccgcttcaaatgtcaaaagaaggcatcaaaaaggaaagcgcaccagagctgagcaagataatcgacagacccggctggctaccagcagttaataaactcttcagcgacggcaacgtcacagtcgtgcgaagggactcgttggggcgggtacggctagaaagcacagcgcacctacccgtcacatggaaggtacaaaagagaccagccgcgacgaagaaggcaggccaggcgaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8302 - RNA, 3314 nt, synthetic construct
  misc_feature 1..3314: note = Cas9 variant mRNA product
  source 1..3314: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaaacgcaaggtgggcatccacggggtcccggccgcggcccggatactggccttcgacatcggcatcagctccatagggtgggccttcagcgagaacgacgagctcaaggactgcggcgtgcgcatcttcactaaggtggagaaccccaagacaggagagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgatgagagcctcgccaaggcctacaaaggctccctgatcagcccctacgagctgcggttccgcgcactcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacttgtacaaggagtacttccagaaattcaaggagaacagcaaggagttcacgaacgtgcgcaacaagaaggagtcctacgagcggtgcatcgcccagagcttcctgaaggacgagctgaagctcatctttaaaaagcagcgcgagttcgggttctccttcagcaagaagttcgaagaggaggtcctttccgtggcgttctacaagcgggctctgaaggacttcagccacctcgtgggcaactgctccttcttcaccgacgagaagcgcgccccgaagaacagccccctggccttcatgtttgtcgccctgacccggatcatcaatctcctgaacaacctgaagaacaccgagggcatcctctacacgaaggacgacctgaacgcgctgcttaacgaggtgctgaagaacggcaccctgacctacaagcagaccaagaagctcctggggctgagcgacgactacgagttcaaaggggaaaagggcacgtacttcatcgagttcaagaagtacaaggagttcattaaggccctcggggagcacaacctgtcccaggacgacctgaacgagatcgccaaagacatcaccctcatcaaggacgagatcaagctgaagaaggccctggccaagtacgacctcaaccagaaccagatcgacagcttatccaaacttgagttcaaggaccacctcaacatcagcttcaaggcgctaaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgtgcgatcaaggagtaccgcaaggtgctgaacgccctcctgaagaagtacggcaaggtgcacaaaatcaacatcgagctggcgcgggaggtcgggaagaaccactcccagcgcgccaagatcgagaaggagcagaacgagaactacaaggccaagaaagacgcggagctcgagtgtgagaagctgggcctgaagatcaacagcaagaacatcctcaagctgcggctgttcaaggagcagaaggagttctgtgcctactccggggagaaaatcaagatcagcgacctccaggacgagaagatgttagagatcgaccacatctacccatactcccgcagcttcgacgactcctacatgaacaaggtgctggtgttcaccaagcagaaccaggagaagctcaaccagacccccttcgaggccttcggcaacgacagcgcgaagtggcagaagatcgaggtcctggcaaagaacctacccaccaagaagcagaagcggatcctcgacaagaactacaaggacaaggagcagaagaacttcaaggaccgcaacctgaacgacacacggtacatagctcgcctggtgctcaactacaccaaggactacctggacttcctgccgctctccgacgacgagaacaccaagctgaacgacacccagaaggggagcaaggtgcacgtcgaggccaagtccggcatgctgacgagcgctctccggcacacctggggcttctccgccaaggaccgcaacaaccacctccaccacgccatcgatgcggtgataatcgcctacgccaacaacagcatcgtcaaggccttctccgacttcaaaaaggagcaggagagcaacagcgcggagctgtacgccaagaagatctccgagctggactacaagaacaagcggaagttcttcgagcccttcagcggtttccgccagaaggtgctggacaagatcgacgagatcttcgtgtccaaacccgagcggaagaagcccagcggtgccctgcacgaggagaccttccgtaaagaggaggagttctaccagtcctacgggggcaaggagggggtcctcaaggcgctggagctgggcaagatccggaaggtgaacgggaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttttgcttctccctctacaaggacagcctgatcctgatccagaccaaggacatgcaagagcccgagttcgtgtactacaacgccttcacctcctcaaccgtgtccctcatagttagcaagcacgacaacaagttcgagacgctgtccaagaaccagaagatcctgttcaaaaacgcaaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8303 - RNA, 3725 nt, synthetic construct
  misc_feature 1..3725: note = Cas9 variant mRNA product
  source 1..3725: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggcatccacggggtcccggccgcgtcggacctagttctcggcctggacatcgggattggctccgtgggggtcgggatcctgaacaaggtgaccggcgagatcatccacaagaacagccggatcttccccgccgcccaggccgagaacaacctagtgcgccggacgaaccgccagggccggcgcctggcccggcgcaagaagcaccggcgcgtccggctgaaccgcctcttcgaggagtccggcctgatcacggacttcaccaagatcagcataaacctgaacccctaccagttacgggtgaaggggctgaccgacgaactgtccaacgaggagctgttcatcgcgctgaagaatatggtgaagcaccgcggcatcagctacctggatgacgcctccgacgacgggaacagctccgtcggcgattacgcccagatcgtgaaggagaatagcaagcagctcgagaccaagacgcccggacagatccagctggagcggtaccagacctacgggcagctgcgcggcgatttcaccgtggagaaagacgggaagaagcaccgactcatcaacgtcttcccgacctccgcctaccgaagcgaggcgctgcggatcctgcaaactcagcaggagttcaacccccagatcaccgatgagttcatcaaccgctacctcgagatcctgaccggcaagcggaagtactaccacggccccgggaacgagaagtcccgcaccgactacggccgctatcggacgagcggggagaccctggacaacatcttcggcatcctcatcgggaagtgcaccttctaccccgacgagttccgcgccgccaaggcctcctacaccgcccaggagttcaaccttttaaatgacctcaacaacctgacggtgccgaccgaaaccaagaagctcagcaaggagcagaagaaccagatcatcaactacgtgaagaacgagaaggctatgggccccgccaagctgttcaagtacatcgccaagctcctgtcctgcgacgtcgccgacatcaagggctaccggatcgacaagagcgggaaggccgagatccataccttcgaggcgtaccgcaagatgaagacgctcgagaccctggacatcgagcagatggacagagagaccctggacaagctcgcctacgtactgaccctgaacacggagcgcgagggcatccaggaggccctcgagcacgagttcgccgacgggtccttcagccagaagcaggtcgacgagctggtgcagttccggaaggccaacagctccatcttcggcaaagggtggcacaactttagcgtgaagctgatgatggagctcatccccgagctgtacgagaccagcgaggagcagatgaccatcctgacccgcctcggcaagcagaagacaaccagctccagcaacaagactaagtacattgacgagaagctgctgaccgaggaaatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgcctcacagcgtgttccacggccacaagcagctggccaccaagatccggctgtggcaccagcagggcgagcgctgcctctataccggcaagaccatctccatccacgacctgatcaacaacagcaaccagttcgaggtcgaccacatcctgcccctctccatcacgttcgacgacagcctggccaacaaagtgctggtgtacgcgaccgccaaccaggagaaggggcagcggacgccctaccaggccctggactccatggacgacgcctggtcgttccgcgagctgaaggccttcgtccgggagtccaagaccctgagcaacaagaagaaggagtacctcttgaccgaggaggacatctccaagttcgacgtgcgcaagaagttcatcgagcggaacctcgtggacacgcgctacgcgagccgggtcgtgctcaacgccctgcaggagcacttccgcgcccataaaatcgacaccaaggtgtccgtggtgcgcggccagttcaccagccagttaagacgccactggggcatcgagaagacccgggacacgtaccaccaccatgcagtggacgccctcatcatcgcggcctcctcccagctgaacctgtggaagaagcagaagaacaccctcgtcagctactccgaggaccagctgctggacatcgagaccggggagctcatcagcgacgacgagtacaaggagtccgtgttcaaggccccctaccaacatttcgtggacaccttaaagagcaaggagttcgaggattccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctcgagaactaccccaacaagcagatcaacgagaagggcaaggaggttccctgcaacccgttcctcaagtacaaggaggagcacgggtacatccggaaatacagcaagaagggcaacgggcccgagatcaagtccctgaagtactacgacagcaagctgggcaaccacatcgacattacccccaaagactccaacaacaaggtggtcctccagagtgtgtccccctggcgcgccgacgtgtacttcaacaagaccaccgggaagtacgagatcttgggcctgaaatacgcggacctccagttcgagaagggcacggggacctacaagatcagccaggagaagtacaacgacatcaagaagaaagagggcgtcgacagcgactccgagttcaagttcaccctgtacaagaacgacctgctcctggtgaaggacaccgagacgaaggagcagcagctgttccggttcctcagccgcaccatgccaaagcagaagcactacgtggagctaaagccctacgacaagcagaagttcgagggcggagaggccctgatcaaggtcctcgggaacgtggccaactccggccagtgcaagaagggactgggcaagagcaacatctccatctacaaggtgcggaccgacgtcctggggaaccaacacatcattaagaacgagggggacaaacccaagctcgacttcaagcgccccgccgccaccaagaaggcgggccaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8304 - RNA, 4283 nt, synthetic construct
  misc_feature 1..4283: note = Cpf1 variant mRNA product
  source 1..4283: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaagaagcgcaaggtgggaatccacggcgtcccggccgcgacccagttcgagggcttcaccaacctgtaccaggtgagcaagacgctccggttcgagctgatcccccaggggaagaccctgaaacacatccaggagcagggcttcatcgaggaggacaaggcccgcaacgaccactacaaggaactcaaacccatcatcgaccggatctataagacctacgccgaccagtgcttgcagctggtgcagctcgactgggagaatctgtccgccgccatcgacagctaccgcaaggagaagaccgaggagacccgtaacgcgcttatcgaggagcaggccacctaccgcaacgctattcatgactacttcatcgggcggaccgataacctcaccgacgccataaacaagcgccacgctgaaatctacaagggcctcttcaaggccgagctattcaacggcaaggtactaaagcagttagggacggtgaccaccaccgagcacgagaatgccctactccggtccttcgacaaattcacgacctacttctcaggcttctacgaaaaccgcaagaacgtgttcagcgcagaggacatcagcaccgcaatcccccaccggatcgtccaggacaatttcccgaagtttaaggagaactgccatatcttcacccgtctgatcacggcggtgccgtccctgcgggaacacttcgaaaacgtgaagaaggccatcggaatttttgtcagcacctccatcgaggaggtgttcagtttccccttctacaaccagttgctgacccagacccagatcgacctgtacaaccagctcttgggcgggatctctcgcgaggccggcacggagaagataaagggcttaaatgaggtgctcaacctggccatacagaagaacgacgagacagcccacatcatagcgagcctgccccaccggttcatcccgttattcaaacagatcctgtctgaccgtaacacccttagcttcatcctcgaggagttcaagagtgacgaagaggtcatccagtcgttctgcaaatacaagacccttctgcggaacgagaatgtgctcgagacggccgaggcccttttcaacgaactgaactccatcgacctcacccacatcttcatcagccacaagaaactcgagaccatcagcagcgccctgtgcgaccactgggacaccctccgcaacgccctgtacgagcggcgcatcagtgagctgacgggcaagatcaccaagtccgcgaaggagaaggtgcagcggagcctcaagcatgaagacatcaacctgcaggagatcatctccgccgccggcaaggagctgagtgaggccttcaagcaaaagacctcagaaatcctatcccacgctcatgcggccctggaccagccgttgcccaccacgctcaagaagcaagaagagaaggagatcctgaaatcccagttagacagcctgctcgggctgtaccacctcctcgactggttcgcagtcgacgaatccaacgaggtggaccccgagtttagcgcccgcctgaccggcattaaactggagatggagccgtccctcagcttctacaacaaggcgcgcaactacgccaccaagaagccctactccgtggagaagttcaagctgaacttccagatgcccacgctggccagcggctgggatgtaaacaaggagaagaacaatggggccatactcttcgtgaagaacggcctgtactacctggggatcatgcctaagcaaaagggccggtacaaggccttatccttcgagcccacggagaagaccagcgaagggttcgacaagatgtactacgactacttccccgacgcggccaaaatgatccccaagtgctccacacagctgaaagcagtgaccgcccacttccagacccacacgaccccgattctgttgagtaacaacttcatcgagccgctggagatcaccaaagagatctacgatctgaacaaccccgagaaggagcccaaaaagttccagaccgcctatgcgaaaaagacgggagaccagaaaggctaccgcgaggccctgtgcaagtggatcgacttcacccgggatttcctatccaagtacaccaagaccacgagcatcgacctgagttcactccggccaagctcccagtacaaagatctgggggagtactacgccgagctgaatccgctcctgtatcacatctcattccaacggatcgccgagaaagagatcatggacgccgtagagacgggcaagctctacctcttccagatctacaacaaggacttcgcgaagggacaccacggcaagcctaacctgcacacattgtactggaccggcctcttctcccccgagaacctcgccaagacgagcatcaagctgaacgggcaggccgagctgttctacaggcccaagagccggatgaagcgcatggcccacaggctgggtgagaagatgctgaacaagaagctaaaggaccagaagaccccgatccccgacaccctgtaccaagagctgtatgactacgtgaaccatcgcttaagccacgacctctccgacgaggcgcgtgccttactccccaacgtgatcaccaaggaggtcagccatgagatcatcaaggaccgcagattcacgtccgacaagttcttcttccacgtgccgatcacactgaactaccaggccgctaacagcccctccaagttcaaccagcgcgtcaacgcctacctaaaggagcaccccgagacgcccatcattgggatagaccggggcgagcgcaacctgatctatatcaccgtgatcgacagcacggggaagatcctggagcaacgatccctgaacaccatccagcagttcgactaccagaagaaactcgacaaccgcgaaaaagagcgggtggcggcacgccaggcctggagcgtcgtgggcaccatcaaggacctgaagcaggggtacctgagccaggtgatccacgagatcgtcgacctcatgattcactaccaggccgtcgtggtcctggagaacttaaacttcggcttcaaatcgaaacgcaccggcatcgccgagaaagcggtgtaccagcagttcgagaagatgctcattgacaagttaaactgcctggtgctaaaagattacccggccgagaaggtcggaggcgtgctgaacccctaccagttgacggaccagttcaccagcttcgccaagatgggcacccagtctggcttcctcttctacgtgcccgccccctacaccagcaagatcgacccgctgacggggttcgtagaccccttcgtttggaagaccatcaagaaccatgagagtcggaagcacttccttgaggggtttgacttcctccactatgatgtgaagactggcgatttcatcctgcacttcaagatgaaccgcaacctgagcttccagcgggggctccccggtttcatgcccgcctgggacatcgtcttcgagaagaatgagacccagttcgacgcgaaggggacgcccttcatcgccggcaagcgcatagtccctgtgatcgagaaccaccggttcaccggccgctaccgggatctgtaccccgcaaacgagctgatcgccctcctggaggagaaggggatcgtctttcgagacggctccaacatcctgcccaagttgttagagaatgacgacagccacgcaatcgacaccatggtggccctgattcggtccgtgctccagatgcgcaacagcaacgcggccaccggggaggactacatcaactccccggtccgggacctgaacggcgtgtgctttgatagccgcttccagaaccccgagtggcccatggacgccgacgcgaacggggcctaccatatcgccctgaagggacaactcttgctgaaccacctcaaggagtctaaggacctcaagctgcaaaacggtatcagcaaccaggactggctcgcctatatacaagagctgcggaacaagcgccccgccgcgactaaaaaggctgggcaggccaagaagaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 8305 - RNA, 4262 nt, synthetic construct; identical to SEQ ID NO: 2505
  misc_feature 1..4262: note = Cpf1 variant mRNA product
  source 1..4262: mol_type = other RNA

SEQ ID NO: 8306 - RNA, 4452 nt, synthetic construct
  misc_feature 1..4452: note = Cas9 variant mRNA product
  source 1..4452: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaagtgggaatccacggggtgccggcggcggacaagaagtacagcatcggcctggacatcgggaccaactcagtgggctgggccgtaatcaccgacgaatacaaagtccccagcaagaagttcaaggtgctggggaacacggaccggcattccatcaagaagaacctgatcggtgccctgctgttcgactcgggcgagaccgccgaggccacccgcctgaagcgaaccgcgcgccggcgctacacgcggcgcaagaaccggatctgttacctgcaggagatcttctccaacgagatggccaaggtggacgacagcttcttccaccgcctcgaggagtccttcctggtcgaggaggacaagaagcacgagcggcaccccattttcgggaacattgtggacgaagtggcctaccacgagaagtaccccaccatctaccaccttcgcaagaagctcgtcgacagcaccgacaaggccgacctgcggctgatttacctcgcgctggcccacatgatcaagttccgcggccacttcctgatcgagggggacctcaacccggacaactccgacgtggacaagctgttcatccaactggtgcagacctacaaccagctgttcgaggagaaccccatcaacgccagcggcgtcgacgccaaagccatcctgtccgcgagacttagcaagagtcgcaggctcgagaacctgatcgcccagcttcccggggagaagaagaacggcctattcggcaacctgattgccctgagcctcggactgacacccaacttcaagtccaacttcgatctggccgaggatgccaaactccagttgagtaaggacacctacgacgacgacctggacaacctcctggcgcagatcggcgaccagtacgccgacctgttcctcgccgccaagaacctgtctgacgccatcctgctcagcgacatcctgcgcgtgaacaccgaaatcaccaaggcgccgctgtccgcctcaatgatcaagcggtacgacgagcaccaccaggatctcacgctgctgaaggcgctagtgcgccagcagttgcccgagaaatacaaggagatcttcttcgaccagagcaaaaacgggtacgctggctacatcgacggcggggcctcccaggaggagttctataagttcatcaagcccatactggagaagatggacggcaccgaggagttactggtcaagctgaaccgggaggacctgctccgcaagcagcgcaccttcgacaatgggagcatcccccaccagatccacctgggcgagctgcacgcgatcctccggcgccaggaggacttctacccgttcctgaaggacaaccgggagaagatcgagaagatcctcacctttcgcatcccctactacgtggggcccttggcccggggcaactcccgcttcgcctggatgacgcgcaagagcgaggagaccatcactccctggaatttcgaggaggtggtcgacaagggcgccagtgcgcagagcttcattgagaggatgaccaactttgacaagaacctgccgaacgagaaggtgctgcccaagcactccctcctgtacgagtacttcacggtgtataacgaactcaccaaggtcaagtacgtgaccgaggggatgcggaagcccgctttcctcagcggcgagcagaagaaggccatcgtggacttgctgttcaagaccaaccgcaaggtcacggtgaagcagctcaaggaggattacttcaagaagatcgagtgcttcgactccgtcgagatcagcggggttgaggaccggttcaacgcctccctgggcacctaccacgacctgctcaaaatcatcaaggacaaggactttctggacaacgaggagaacgaggacatcctggaggacattgtgctcaccctgaccctgttcgaggaccgcgagatgatagaggagcggctcaagacgtatgcccacctgttcgacgacaaggtcatgaagcaactgaagcgtcggcgctacaccgggtggggccggctcagccgcaagttgatcaacggaatccgagataaacagagtgggaagacaatcctggacttcctaaagagcgacggctttgcaaaccgcaacttcatgcagctgatccacgacgactccttgaccttcaaggaggacatccagaaggcccaagtatctgggcagggagactccctccacgagcacatcgccaacctggccgggtcccccgccatcaagaagggcatcctgcagacggtgaaggtcgtggacgagctagtcaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaagagcaccccgtggagaacacccagctccagaacgagaagctctacctgtactaccttcagaacggccgggatatgtacgtcgaccaggagctggacattaacaggctgagcgactatgacgtggaccacatcgtgccccagtccttcctcaaagacgacagcatcgacaacaaggtcctgacacggtccgacaagaaccggggcaagagcgacaacgtgccctccgaggaggtagtcaagaaaatgaaaaactattggagacagctgctcaacgctaagctgatcacccagcgcaaattcgacaacttgaccaaagccgaacgcgggggcctcagcgagctagacaaggccgggttcatcaagcggcagctggtggagacccggcagatcaccaagcacgtagcccagatcctcgactccaggatgaacacgaagtacgacgagaacgacaaactgatccgggaggtcaaggtgatcaccctcaagagcaaacttgtgtccgacttcagaaaggacttccagttctataaggttagggagatcaacaactaccaccacgcgcacgacgcatacctgaacgccgtggtgggcaccgccctgatcaagaagtacccgaaacttgagagcgagttcgtctacggggactacaaggtgtacgacgtgcgcaagatgatcgcgaagtccgagcaggagatcggaaaggctaccgccaagtacttcttctacagcaacatcatgaacttcttcaagacggagatcaccctggcaaacggcgaaatccggaagcgccccctaatcgaaacgaacggagagaccggcgaaatcgtctgggacaaggggcgggacttcgccacggtgcgcaaggtgctctccatgccccaggtcaatatcgtaaagaagaccgaggtgcagaccggcgggttcagcaaggagtccatcctgcccaagcgcaacagcgataagttaatcgcgcgtaagaaggactgggacccgaagaagtacggcggcttcgactcccccaccgtcgcgtacagcgtgctggtggtcgccaaggtggagaagggcaagagcaagaagttaaagtccgtgaaggagctgctcggtatcacgatcatggagcgcagttccttcgagaagaaccccatcgatttcctggaggccaagggatacaaggaggtcaagaaggacctgatcatcaagctccccaagtacagcctgttcgagctggagaacggccggaaacgcatgctcgcctccgcgggggagctgcagaagggcaacgaactggccctccccagcaagtacgtgaacttcctgtacctggcctcccactatgagaagttaaaaggcagccccgaggacaacgaacagaagcagctgttcgtggagcagcacaagcattatctggacgagatcatcgagcagatatccgagttcagcaaacgggtgatcctcgccgacgccaacctcgacaaggtgctctccgcgtacaacaagcaccgtgacaagcccatccgggagcaggccgagaacatcatccacctcttcaccctgaccaaccttggggcccctgccgcgttcaagtacttcgacaccacgatcgaccggaagcggtacaccagcaccaaggaggtgttagacgcgaccctgatacaccagagtatcacgggcctgtacgagacccgcatcgatctcagccagctcgggggcgataagcggcccgccgccaccaagaaggccgggcaggcgaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 8307 - RNA, 5235 nt, synthetic construct; identical to SEQ ID NO: 2507
  misc_feature 1..5235: note = Cas9 variant mRNA product
  source 1..5235: mol_type = other RNA

SEQ ID NO: 8308 - RNA, 3507 nt, synthetic construct
  misc_feature 1..3507: note = Cas9 variant mRNA product
  source 1..3507: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaagtgggcatccacggggtcccggccgcgaagcggaactacatcctgggcctcgacatcgggatcaccagcgtgggctacgggatcatcgactacgaaacccgcgatgttatcgacgccggcgtccggctgttcaaggaggccaacgtggagaacaacgaaggccgccggtccaagcgcggggcccggcgcctgaagcggcgccggcgccaccggatccagcgcgtgaagaagctcctgttcgactacaacctgctcacggaccacagcgagctgtcgggcatcaacccctacgaggcccgggtcaagggtctcagccagaagctctccgaggaggagttcagcgcggccctgctgcacctcgccaagcgcaggggcgtgcacaacgtgaacgaggtcgaggaggacaccgggaacgagctctccaccaaggagcagatcagccgcaactccaaggccctggaggagaagtacgtggcggagctccagctcgagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaagacatcaaggagtggtacgagatgctgatgggccattgcacctacttcccggaggagctccgaagcgtgaagtacgcctacaacgccgacctgtacaacgcgctcaacgacctcaacaacctggtcatcacgcgcgacgagaacgagaagctggagtactacgagaagttccagatcatcgagaacgtgttcaagcagaagaagaagcccaccctcaagcagatagccaaggagatcttggtgaacgaggaggacatcaaggggtaccgggtcacctccaccggcaagcccgagttcacgaacctaaaggtgtaccacgacatcaaggacatcaccgcccgcaaggagatcatcgagaacgccgagctcctggaccagatcgccaaaatcctgaccatctaccagagctccgaggacatccaggaggagctcaccaacctgaacagcgagctgacacaggaggagatcgagcagatctccaacctcaaggggtacaccggcacccacaacctgagcctgaaggcgatcaacctcatcctggacgagctgtggcacaccaacgacaatcagatcgccatctttaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctacccaacgacataatcatcgagctggcccgggagaagaacagcaaggacgcccagaagatgatcaacgagatgcagaagcgcaaccggcagaccaacgagcgcatcgaggaaatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtggaccacatcatcccccgcagcgtgtccttcgataacagcttcaacaacaaggtgctggtcaagcaagaggagaactccaagaaggggaaccggacccccttccagtacctgagctccagcgactccaagatcagctacgagaccttcaagaagcacatcctcaacctggccaagggcaaagggcgcatctccaagaccaagaaggagtacctgctcgaggaacgggacattaaccgcttcagcgtgcagaaggacttcatcaaccggaacctggtggacacgcgctacgccacccggggcctgatgaacctcctgcgctcctactttcgcgtcaacaacctggacgtgaaggtcaagagcatcaacgggggcttcacctccttcctcaggcgcaaatggaagttcaagaaggagcggaacaagggctacaagcatcacgccgaggacgcgctgatcattgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcatatcaaggacttcaaggactacaagtacagccatcgcgtggacaagaagcccaatcgggagctcatcaacgacacactgtactccacccgcaaggacgacaaggggaacaccctgatcgtgaacaacctcaacggcctgtacgacaaggacaacgacaagctgaagaagctcatcaacaagagccccgagaagctcctgatgtaccaccacgacccccagacttaccagaagctcaagctgatcatggagcagtacggggacgagaagaacccgctgtacaaatactacgaggagaccggcaactacctcaccaagtactccaagaaggacaacgggcccgtcatcaagaagatcaagtactacggcaacaagctgaacgcccacttggacatcaccgacgactaccccaacagccggaacaaggtggtgaagctctccctgaagccctaccgcttcgacgtctacctggacaacggcgtgtacaagttcgtcaccgtcaagaacctcgacgtgatcaagaaggagaactactacgaggtgaacagcaagtgctacgaggaggctaagaagctgaagaagatctccaaccaggccgagttcatcgccagcttctacaacaacgacctgatcaagatcaatggtgagctctaccgggtcatcggcgtgaacaacgacctgctgaaccgcatcgaggtgaacatgatcgacatcacgtatcgggagtacttagagaacatgaacgacaagcgcccgcccagaatcatcaagaccatcgcgtccaagacccagagcatcaagaagtactcaaccgacatcctggggaacctgtacgaggtaaagagcaagaagcacccccagatcatcaagaagggcaagcgccccgccgccacgaagaaggccggtcaagccaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 8309 - RNA, 4575 nt, synthetic construct
  misc_feature 1..4575: note = Cas9 variant mRNA product
  source 1..4575: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgctgttcaacaagtgcattatcatcagcatcaacctggacttctccaacaaggagaaatgcatgaccaagccctacagcataggcctggacatcgggacgaactccgtgggctgggccgtgatcacggacaactataaggtccccagcaagaagatgaaggtgctggggaacacttccaagaagtacattaagaagaacttactgggcgtgctgctgttcgacagcggcatcaccgccgaggggcggcgcctgaagcggaccgcgcgccggcgctacacgcggcgccggaaccgcatcctgtacctccaggagatcttctctaccgagatggccaccctggacgacgcgttcttccagcggctggacgacagcttcctcgtgcccgacgacaagcgcgactccaagtacccgatcttcggcaacctggtggaggagaaggtgtaccacgacgagttccccaccatctaccacctccggaagtacctcgccgacagcacgaagaaggccgacctgcgcctcgtctacctcgccttagcgcacatgattaagtaccggggccacttcctgatcgagggcgagtttaactccaagaacaacgacatccaaaagaacttccaggacttcctcgacacctacaacgccatcttcgagagcgacctgtccctggagaacagcaagcagctcgaggagatcgtgaaggacaagatttccaagctggagaagaaggaccgcatcctgaagctgttccccggggagaagaacagcggcatcttctctgagttcctgaagctgatcgtgggcaaccaggctgacttccggaagtgcttcaacctcgatgagaaggcaagccttcacttctccaaggagagctacgacgaggacctggagaccctcctgggatacatcggcgacgactatagcgatgtcttcctgaaggctaagaagctctacgacgcgatcctgctgtccgggtttctcaccgtgacggacaacgagaccgaggcgcccctgagctccgccatgatcaagcgctacaacgagcacaaggaggacctcgccctcctgaaggagtacatccggaacatcagcctgaagacctacaacgaggtgttcaaagacgacaccaagaacggatacgccggctacattgacgggaagacgaaccaggaggacttctacgtatacctcaagaacctgctggccgagttcgagggcgccgactatttcctcgagaaaatcgaccgcgaggacttcctgcgcaagcagcgcaccttcgacaacgggtccatcccgtaccagatccaccttcaggagatgcgcgccatcctggacaagcaggccaagttctaccctttcctagccaagaacaaggagcggatcgagaagatcctgaccttccgcatcccctactatgtgggcccgctggcgcgggggaacagcgacttcgcttggtccatccgcaagcggaacgagaagatcaccccgtggaacttcgaggacgtgatcgacaaggagagctccgctgaggccttcatcaaccgcatgacgagcttcgacctctacctgcccgaggagaaggtcctgcctaagcactccctcctgtacgagaccttcaacgtgtacaatgagctgaccaaggtgcggttcatcgccgagagcatgcgcgactaccaattccttgactccaagcagaagaaggacatcgtccggctttacttcaaggacaagcgcaaggtgaccgacaaggacatcatcgagtacctgcacgcgatctacggctacgacggcatcgaactcaaggggatcgagaagcagttcaacagcagcctgagcacgtaccacgacctgctcaacatcattaacgacaaagagttcctggacgactccagcaacgaggctatcatcgaggagatcatccacaccttaaccatcttcgaggaccgggagatgatcaagcaacgcctctccaagttcgagaacatcttcgacaagagcgtgctgaagaagctgagccgtcgccactataccggctgggggaagctctccgccaaacttatcaacggcatccgggacgagaagtccgggaatacaatcctggactacctcatcgatgacggcatcagcaatcgcaacttcatgcagctgatccacgacgacgccctgagcttcaagaagaagatccagaaggcgcagattatcggcgacgaggacaagggtaacatcaaggaagtcgtgaagtccctccccggcagcccggccatcaagaagggaatcctgcagtccatcaagatcgtagacgagctggtgaaggtgatgggcgggcggaagcccgagagcatcgtcgtggagatggcccgagagaaccagtacaccaaccagggcaagtccaacagccagcagaggctcaagcgcctggagaagtcactgaaggagctcggcagcaagatcctgaaggagaacatccccgccaagctgagtaagatcgacaacaacgccctacagaacgaccgcctgtatctgtactacctccagaacgggaaggacatgtataccggagacgacctggacatcgaccggctgagcaactacgacatcgaccacataatcccccaggcgttcctcaaggacaactccatcgacaacaaggtgctggtcagctccgccagcaaccgcggaaagtccgacgacttcccgagcctggaggtggttaagaagcggaagactttctggtaccagttgctcaagagcaagctgatttcccagcgcaagttcgacaacctgacgaaggccgaacggggcggcctgctgcccgaagacaaggcaggcttcatccaacgccagctcgtcgaaacccggcaaatcaccaaacacgtggcccgcctgctggacgagaagttcaacaacaagaaggacgagaacaaccgggcggtgaggaccgtaaagatcatcacgctcaagagcaccctggtgtcccaattccggaaagacttcgagttgtacaaggtgcgcgagatcaacgacttccaccatgcccacgacgcctacctcaacgccgtcatcgccagcgcgctgctgaagaagtaccccaagctcgagcctgagtttgtgtacggcgactacccgaaatacaactccttccgtgagcgcaagagcgccaccgagaaggtgtacttctattccaatatcatgaacatcttcaagaagtccatctccctggctgacgggcgggtgatcgagcgccccctgatcgaagtgaacgaggagacgggcgagagcgtgtggaacaaggagtccgacctcgccaccgtccggcgcgtgctgagctacccccaggtgaacgtcgtaaagaaggtggaggaacagaaccacgggctggaccggggcaagcccaagggcctcttcaacgcgaacctgtccagcaagccgaagcccaactccaacgagaacctggtcggggccaaggaatacctcgaccccaagaagtacggcgggtacgccggcatcagcaactccttcgccgtgctggtcaaggggacgatcgaaaagggagccaagaagaagatcaccaacgtcctggagttccagggcatcagcatcctcgaccgcatcaactaccggaaagacaagctgaacttcctgttagagaaggggtacaaggacatcgagctgatcatcgaactgccgaagtactcactcttcgagctgtccgacggcagccgccggatgctcgcgtcgatcctcagcaccaacaataagcgtggggagatacataagggcaaccagattttcctgtcccagaagttcgtgaagctgctctaccacgccaagcggatcagcaacaccatcaacgagaaccaccgaaaatacgtggagaaccacaagaaggagttcgaggagctgttctactacatcctggagttcaacgagaactacgtcggtgccaagaagaacggaaagctcctgaacagtgccttccagagctggcagaaccattcgatcgacgagctatgcagctccttcatcggccccacggggagcgagcgcaagggcctcttcgagctaacatcccgggggagcgccgcagactttgagttcctgggcgtgaagataccccgctaccgggactacaccccctccagcctcctgaaagacgccaccctgatccaccagtccgtgacggggctgtacgagacccgcatcgacctcgccaagctgggcgagggcaagaggccggccgccaccaagaaggcagggcaggccaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 8310 - RNA, 3651 nt, synthetic construct
  misc_feature 1..3651: note = Cas9 variant mRNA product
  source 1..3651: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaacgcaaagtaggaatacacggagtgccggcagcatggtacgcgagccttatgagcgcccaccatctacgcgttggaatcgacgtaggcacccacagcgtaggactagccacactccgagtagacgaccacggaaccccaattgaattactatcggcactgagccacatccacgatagtggagtcgggaaagaaggaaagaaagaccacgacacacgaaagaaactgtcaggaatagcaagacgcgctcgaagactattacaccaccgacgaacacagctccaacaactagacgaagtcctacgagatctaggcttcccaatcccaacaccgggagagttcctagacttaaacgaacaaaccgacccataccgcgtgtggcgagtccgagcacgactcgtggaagagaaactcccagaggaattacgcggaccagccataagcatggcagtgaggcacatcgcccgacaccgagggtggaggaacccgtatagtaaagtagaatccctactaagccccgccgaggaaagcccattcatgaaagcactccgcgaacgaatcctcgcaaccaccggcgaagtactagacgatggcataacgccgggccaagctatggcccaagtcgcactgacccataacatctcaatgcgcggaccagaaggcatactaggaaaactacaccaatccgataacgcaaacgaaatccggaaaatatgtgcccgccagggggtcagccccgacgtttgcaaacagctactccgggccgtattcaaagccgactcacctagaggcagcgccgtgagtagagtagcacccgatccccttcccggtcaggggagcttccgcagagccccaaaatgcgacccagagttccagcgcttccgaataatatccatagtggcaaacctgcgaatatctgaaacgaaaggcgaaaacagaccactaaccgccgacgaacgcagacacgtcgtcaccttcctaacggaagacagtcaagccgatcttacttgggtggacgtcgcagaaaaactcggagttcaccgccgggacttaaggggaacagccgtacacaccgacgacggagaaagaagtgccgcccggcccccaatcgacgcaacggatagaatcatgagacagaccaaaatcagttccctcaaaacgtggtgggaagaagccgacagcgaacagagaggcgcaatgatcaggtacctgtacgaagacccaaccgattctgaatgcgcagaaatcatagctgaactcccagaagaagatcaagccaaactagactccctacacttacccgcaggacgcgccgcatacagcagagagagtctaacagccttaagcgaccacatgctcgcgacaaccgacgacctccacgaggcacgaaaacgccttttcggcgttgacgacagctgggccccacccgccgaagcaatcaacgcccccgtcgggaacccctcggtggaccgcacattaaaaatagtagggcgatacctctcagcagtcgaatctatgtggggcacgccagaagtcattcacgtagagcacgtccgagacgggttcacgagcgagcgcatggccgacgaacgagacaaggcaaaccgacgaagatataacgacaaccaagaagcaatgaagaaaatccagagagactacggaaaagaaggctacatatccagaggggacatagtaaggctggacgccctcgaactccagggatgtgcctgtctctactgcgggacaacaattggataccacacgtgccaactagaccacatcgtaccccaggcaggaccaggaagcaacaaccgccgagggaacctagtcgctgtatgcgaaagatgcaaccgctcgaaatcaaacaccccctttgcagtttgggcccaaaaatgcggcatcccccacgtcggagtaaaggaagcgatcggcagagtcaggggctggagaaagcaaacaccaaacacatcaagcgaagatcttacaaggctaaagaaggaggtcatcgcacgactaagacgaacacaggaggacccagaaatcgacgaaaggtccatggagagcgtagcctggatggcaaacgaactccaccacagaatcgcggccgcatacccagagacaaccgttatggtctatagaggtagtatcacagcggctgcacggaaagccgccggaatagactcccgcatcaatcttataggagagaagggacgaaaagacagaatcgaccgccggcaccacgccgtggatgcctccgtcgtcgcgctaatggaggcaagcgtcgcaaaaacactagccgaacgcagcagcctgcgcggcgaacagcgcctaaccggaaaagaacagacctggaaacaatatacaggcagtaccgtaggagccagagaacacttcgaaatgtggagaggccacatgctccacctcacggaactgttcaatgaaagactagccgaagacaaagtttacgtaacacagaacatacgcctgcgactcagcgacggcaatgcacacaccgtcaaccccagcaaactcgtatcacaccgactcggcgacggactcacagtacaacaaatcgaccgcgcgtgcactccagccctgtggtgtgccctaacccgagaaaaagacttcgacgagaaaaacggcctaccggcacgagaagaccgggccatccgagtgcatgggcacgaaataaaatcgtcagactacatacaagtgttctccaaaagaaagaaaaccgactcagaccgagatgagacaccgttcggagcaatagcggtacgtggagggttcgtcgagatcggacccagcatccaccacgccagaatatacagagtagaaggaaagaaaccagtctacgcaatgctcagggtgttcacacatgacctcttaagccagcgacatggcgacctatttagcgcggtgataccaccacaaagtatcagcatgagatgcgcggaacccaaactccgcaaagcgataacaacgggaaacgccacatatctagggtgggtcgtagtgggcgacgagcttgaaataaacgtagacagtttcaccaaatacgctattggacgcttcctcgaagacttcccaaacacaacacgatggcgcatctgcggttacgatacaaactcaaaactcacgctgaagccaatcgtcctggccgccgaaggactcgaaaacccgtcctcagccgtcaacgagatcgttgaactgaagggatggagagtagcgatcaacgtcctcacaaaagtccacccaacagtagtccgacgcgacgcactaggacgaccgcgctatagttcgagatcaaacctaccaacaagctggacgatcgagaaacgcccagccgcaacaaagaaagccggacaagcgaagaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 8311 - RNA, 4512 nt, synthetic construct
  misc_feature 1..4512: note = Cas9 variant mRNA product
  source 1..4512: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtccctgccgcgaccaagccctacagcatcggcctggacatcgggaccaactccgtgggctgggccgtgacgaccgacaactacaaggttcccagcaagaagatgaaggtgctcgggaacactagcaagaagtacatcaagaagaacctattaggcgtgctcctgttcgacagcggcatcacggccgaggggcggcgcctgaagcggacggcccgcagacgctacacccggcgccggaatcgcatcctctatctgcaagagatcttctccaccgagatggccaccctagacgacgccttcttccaacggctagacgacagcttcctggtccccgacgacaagcgcgactccaaatacccgatcttcggcaacctggtggaggagaaggcctaccacgacgagttccccaccatctaccacctccggaagtacttggccgacagcaccaagaaggccgacctgcgcctcgtgtacctggcgctggcccacatgatcaagtaccgggggcactttctcatcgagggcgagttcaactccaagaacaacgacatccagaagaacttccaggacttccttgacacctacaacgccatcttcgaaagcgacctgtccttggagaatagcaagcagctggaggagatagtcaaggacaagatctccaagctggagaagaaggaccgcatcctcaagctgttccccggggagaagaacagcggcatcttctccgagttcctgaaactcatcgtgggcaaccaggccgacttccggaagtgcttcaacctggacgagaaggccagtctgcacttctccaaggagagctacgacgaggacctcgagaccctgctggggtacatcggcgacgactactccgacgtgttcctcaaggcgaagaagctgtacgacgccatcctgctcagtgggtttctgacggtcaccgacaacgagaccgaggcgcccctgagctccgccatgatcaagcgctacaacgagcacaaggaggacctcgcactgctgaaggagtacatccggaacatcagcctcaagacctacaacgaggtgttcaaggacgacacgaagaacggctacgccggctacatcgacggaaagaccaaccaggaggacttctacgtgtacctgaagaagctgctcgccgagttcgagggcgcagactacttccttgagaagatcgaccgcgaggacttcctgcggaagcagcgcaccttcgacaacggttccatcccgtaccaaatccacctccaggagatgcgcgccatcctggacaagcaggccaagttctaccccttcctggcgaagaacaaggaacggatcgaaaagatcctgaccttccgcatcccctactacgtcggccctctcgcccgggggaacagcgacttcgcctggtccatccgcaagagaaacgagaagatcacgccttggaacttcgaggacgtgatcgacaaggagagctccgccgaggccttcatcaatcgcatgaccagcttcgatctgtacctccccgaggagaaggttcttcccaagcactcgctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacattatcgagtacctccacgcaatctacggctacgacggcatcgagctgaaggggatcgagaagcagttcaacagctccctgagcacctaccacgacctcctgaacatcatcaacgacaaggagttcctggatgactccagcaacgaagccatcatcgaggagatcatccacaccctcaccatcttcgaggaccgggagatgatcaagcagcgcctgtcaaagttcgagaacatcttcgacaagagcgtgctgaagaagctctcccggcgccactacacgggctgggggaagctgagcgccaagctgatcaacggcatccgggacgagaagtccgggaacaccatcctcgattacctgatcgacgacggcatcagcaaccgcaacttcatgcagctgatccacgacgacgcgctcagcttcaagaagaagatccagaaagcacagatcatcggcgacgaggacaaggggaacatcaaggaggtggtcaagtccctgcccggcagcccggccatcaagaaagggatcctgcagtccatcaagatcgtggacgagctcgtcaaggtgatgggcgggcgaaagcccgagagcatcgtggtcgagatggcccgcgagaaccagtacaccaaccagggcaagtccaacagccagcagcggctgaagcgcctggagaagtccctcaaggagctgggcagcaagatactgaaggagaacatccccgccaagctctccaagatcgacaacaacgcgctgcagaacgaccgcctgtacttgtactacttgcagaacgggaaggacatgtacaccggcgacgacctggacatcgaccggctaagcaactacgacatcgaccacatcatcccccaggccttcctgaaggacaactccatcgacaacaaggtgctggtgagctccgcgagcaaccgcgggaagtccgacgacgtcccgagcctcgaggtggtgaagaaacggaagacgttctggtaccagctgctcaagagcaagctgatctcccagcgcaagtttgacaacctgaccaaagcagagcgtggcggcctgagccccgaggacaaggccgggttcatccaacgccagctcgtcgagacccggcagatcaccaagcacgtggcgcgcctgctggacgagaagttcaacaacaagaaggacgagaacaaccgggccgtgcgcacggtcaaaatcatcaccctcaagtccaccctggtgagccagttccgaaaggacttcgagctgtacaaggtgcgcgagatcaacgacttccaccacgcccacgacgcctacctcaacgccgtggtggcgtccgccctgctgaagaagtaccccaagctcgagcccgagttcgtgtacggcgactacccgaagtacaatagcttccgggaacgcaagtccgccaccgagaaggtctacttctacagcaatatcatgaacatattcaagaagtccatcagcctggccgacgggcgggtgatcgagcgccccctgatcgaggtgaacgaggagaccggcgaatccgtctggaacaaggagagcgacctcgcgacggtgcggcgcgtcctgtcctacccccaggtcaacgtggtgaagaaggtcgaggagcagaaccacgggctggaccgggggaagcccaagggcctcttcaacgccaacctgagctccaagccgaagcccaacagcaacgaaaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgatcgcatcaactaccggaaggacaagctgaacttcctgctcgagaaggggtacaaggacatcgagctgatcatcgagctgccaaagtacagcctcttcgagctgagtgacggctcccgccgcatgctggcgagcatcctctccacgaacaacaagcgcggggagatccacaagggcaaccagatcttcctgagccagaagttcgtgaagctgctctaccacgccaagcggatctccaacaccataaacgagaaccaccggaaatacgttgagaaccacaagaaggagttcgaggagctgttctactacatcctggagttcaacgagaactacgtcggggccaagaagaacgggaagctcctgaacagcgcctttcagtcctggcagaaccacagcatcgacgagctgtgctctagcttcatcggccccacagggtccgagcgcaagggcctcttcgaactgaccagccgggggtccgccgcggacttcgagttcctgggcgtgaagatcccccgctaccgggactacacgcccagctccctcctcaaggacgctaccctgatccaccagagcgtcacggggctctacgagacccgcatcgacctggccaagttgggagagggcaagcggccggccgccacgaagaaggcgggtcaggccaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 8312 - RNA, 3594 nt, synthetic construct
  misc_feature 1..3594: note = Cas9 variant mRNA product
  source 1..3594: mol_type = other RNA
gggagagtccgctcagccaggttgcagaagcggcttagcgtgtgtcctaatcttctctctgcgtgtaggtaggcctgtgccgcaaacaagcttaccatggcaccgaaaaagaaacgcaaagtgggcatccacggagtaccagccgctgccgccttcaaaccaaacagcataaattatatcctcggcctagatatcggtatcgcctccgtagggtgggccatggtcgagattgatgaagaagaaaacccaatcaggctcatagacctaggcgtacgagtcttcgaacgcgccgaagtcccaaaaacaggagattccctcgctatggcacgaagactagcaagaagcgtgagacgacttacccgccgacgcgcccaccgcctcctccgaactcgtcgcctcctaaagcgcgaaggagtcctccaagccgccaatttcgacgaaaacggtctaatcaaaagcctccccaacacgccatggcaactccgagcagcggccctagaccggaaactaacacccctagaatggtccgctgtcctactgcacctcatcaaacaccgcggatacctaagccagaggaaaaacgaaggagagaccgccgacaaagaactaggcgcgctactgaaaggtgtagcaggcaacgcacatgccctacagacgggtgactttcgaacaccggcagagctcgcacttaacaaattcgaaaaagaatctggacatatccgaaatcaaagatccgactacagccacacattcagccgaaaagatctacaagccgaactcatccttctattcgaaaaacaaaaagagttcggaaatccccacgtatcgggcggactgaaggaagggatcgaaaccctactcatgacacaacggcccgccctatcaggcgatgccgttcagaaaatgctaggccactgcacattcgaaccagccgaaccaaaggcggccaaaaacacctacacagcggaacgcttcatctggttaactaaactgaataacttacgcatactcgaacaaggctctgaacgacccctcacggatacagaacgcgcaaccctaatggacgagccctaccgcaaaagcaaactgacctatgcacaagcgagaaaactcctaggactcgaagacacagccttcttcaaaggtctcaggtacggaaaagataacgccgaggccagcacactcatggaaatgaaagcctaccatgccatcagccgagccctggaaaaagagggcctcaaagataagaaaagccctctcaaccttagccccgaacttcaagatgaaatcggaaccgcatttagcctcttcaaaacagacgaagacatcaccggacgactgaaagaccgcatccaaccagagatactcgaggcgctgctaaaacacatatccttcgacaaattcgtacaaatcagcttaaaggcactacgccggatagtacccctaatggaacaagggaaacgatacgacgaagcatgtgccgaaatatacggtgatcactacggaaagaaaaacactgaagaaaagatctacctcccaccaatacccgccgacgaaataaggaaccccgtagtactacgtgccctctcacaagcacgcaaagtcattaacggagtagtcagaagatatggcagccccgcgcggatccacatcgaaacagcccgcgaagtaggcaaatctttcaaagatcgcaaagaaatcgagaaaagacaagaagagaatagaaaagatcgagagaaagccgccgcaaaattccgagaatatttccccaacttcgtcggtgaaccaaaaagtaaagacatcctcaaactccgcctctatgagcaacagcacggaaaatgcctatacagcggaaaagaaatcaacctcggccggctaaacgagaagggatacgtagaaatagaccacgccctcccattctcgcgaacatgggacgactcttttaataacaaagtcttagtcctcggatcagagaaccaaaacaaaggaaatcaaacgccatacgagtacttcaacggcaaggacaacagcagagaatggcaagagttcaaagcacgagtggaaacctcccgattcccacgctccaagaaacaaagaatcctactccagaaattcgacgaagacgggttcaaagaacgcaacctgaacgatacacggtacgtcaaccgcttcttatgccaattcgtggcggaccgcatgcgcctcacgggaaaaggtaagaaacgggtattcgccagcaacggacagataacgaacctcctccggggattctggggcctccgaaaagtccgggcagaaaacgaccgacaccacgcgctagacgcggttgtcgttgcttgcagcaccgtcgccatgcagcagaaaataaccagatttgtcagatacaaagagatgaacgcctttgacggaaaaactatcgacaaagagacaggcgaagtactacaccaaaagacacacttcccgcaaccatgggagttcttcgcccaagaagtcatgataagggtattcgggaaaccagacggcaaaccagagttcgaagaagcagacaccctagaaaagctccgcaccctactggcagaaaagttgagcagccgccccgaagccgtacacgaatacgtaacaccactcttcgtctcccgagcacccaaccgaaaaatgagcggccaaggccacatggaaaccgtaaaatccgccaagcgcctggacgaaggcgtctccgtactaagagtacccctcacccaactcaagctaaaagacctggagaaaatggttaacagagaaagagaaccaaagctatatgaggccctcaaggcgcgcctcgaggcacacaaagacgacccagcaaaagcattcgctgaacccttctataaatacgataaagccgggaacagaacacaacaggtaaaggccgtccgggtagaacaggtacagaagaccggagtctgggtccgaaaccataatggcatcgcagacaacgcaacaatggtacgcgtcgatgtgttcgaaaaaggcgacaagtactacctagtacccatatacagctggcaggtcgcgaaaggcatcctaccggacagggccgtagtccagggcaaagatgaagaagactggcagctaatcgatgattccttcaactttaaattcagcctacacccaaatgacctcgtagaagtaatcaccaaaaaggcaagaatgttcggatacttcgccagctgccacagaggaaccggaaacatcaacattcggatacacgacctcgatcacaaaataggcaagaatggcatactcgagggcataggggtcaaaaccgcactatccttccagaagtaccaaatcgacgagcttggaaaagaaatccggccctgtcgactgaagaaaaggccaccagttcggaagagaccggccgccaccaaaaaggcaggtcaagccaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 8313 - RNA, 4350 nt, synthetic construct
  misc_feature 1..4350: note = Cas9 variant mRNA product
  source 1..4350: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgaagaagccatacaccatcggcctggacatcgggaccaacagcgtgggctgggccgtgctcaccgaccagtacgacctggtcaagcggaagatgaagatcgccggggactccgagaagaagcagatcaagaagaacttctggggcgtgcgcctgttcgacgagggccagaccgccgctgaccggcgcatggcgcggaccgcccgccggcgcattgagcggcgccggaaccgcatcagctacctccagggaatcttcgccgaggagatgtccaagaccgatgccaacttcttctgccggctgagcgactccttctacgttgacaacgagaagcgcaacagccggcaccccttcttcgcgacgatagaggaggaggtcgagtatcacaagaactaccccacaatctaccacctccgcgaggaactcgtgaactccagcgaaaaggccgacctgcgtctagtgtacctcgccctggcccacatcatcaagtaccgcggcaacttcctgatcgagggggccctcgacacccagaacacctccgtcgacggcatctacaagcagttcatccagacgtacaaccaggtgttcgcgtccgggatcgaggacggctcccttaagaagctggaggacaataaggacgtggccaagatcctcgtcgagaaggtgacccggaaggagaagctggagcgcatcttaaagctctacccgggcgagaagtccgccgggatgttcgcccagttcatcagcctaatcgtgggcagcaaggggaacttccagaagcccttcgacctgatcgagaagtccgacatcgagtgcgccaaggactcgtacgaggaggacctcgagtccctgctggcgctcatcggggacgagtacgccgagctgttcgtcgccgccaagaatgcctacagcgcggtggtgctgagtagcatcatcaccgtcgccgagaccgagacgaacgccaagctcagcgcctccatgatcgagcggttcgacacccacgaggaggacctgggcgagctgaaggcattcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaagagaacttcctgcgcaagcagcgcacattcgacaacggggcgattccccaccaactgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgattttggcaagtccgccgtagacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcgtatttcagcggccaggagaaggagcagatcttcaacgacctgttcaagcagaagcggaaggtcaagaagaaggacctcgagctgttcctgcgtaacatgtcccacgtggagagccccacgatcgaggggctggaggactccttcaacagctcctacagcacctaccacgacctcctgaaggtgggcatcaagcaggagatcctggacaaccccgtcaacacagagatgctcgagaatatcgtgaagatcctgacagtgttcgaggacaagcggatgatcaaggagcagctgcagcagttctccgacgttctcgacggcgtggtgctgaagaagctggagcgccggcactacacggggtggggccgcctcagcgccaagctgctgatggggatccgggacaaacagtcccacctcaccatcctggactacctgatgaacgacgacggcctcaatcgcaacctgatgcagctgatcaacgacagcaacctttcattcaagagcatcatcgagaaggagcaggtcaccaccgccgacaaggatatccagagcatcgtggccgacctggcgggatccccggccatcaagaagggcatcctgcagagcctcaagatcgtggacgaactggtctccgtgatgggctacccgccccagacgatcgtggtcgagatggcccgggagaaccagactaccgggaagggcaagaataacagccgcccccggtacaagtccctggagaaggccatcaaggagttcgggagccagatccttaaggagcaccccaccgataatcaggagctgcgcaacaaccgactgtacctctactacctgcagaacggcaaggacatgtacacgggccaggaccttgacatccacaacctctccaactacgacatcgaccatatcgtgccccagagcttcatcaccgacaactccatcgacaacctggtgctgaccagctccgccgggaaccgcgaaaagggcgacgacgtcccgcccctcgagatcgtgcgcaagcgcaaggtgttctgggagaagctgtaccaggggaacctgatgagcaagcgcaagttcgactacctgaccaaggcggagcggggcgggctgaccgaagccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccaactctacaaggtgcgcgacgtcaacgactaccaccacgcccacgacgcctacctgaacggcgttgtggcgaacactctgctcaaggtctacccccagctggagcccgagttcgtgtacggggactaccaccagttcgactggttcaaggccaacaaggcgaccgccaagaagcagttctacaccaacatcatgttgttcttcgcccagaaggaccggatcatcgacgaaaacggtgagatcctctgggataagaagtacctggacaccgtgaagaaggtcatgtcctaccgccagatgaacatcgtgaagaagacggagatccagaagggggagttctcgaaggccaccatcaagcccaagggcaactccagcaagttaatcccccggaagaccaactgggacccgatgaagtacgggggcctcgacagccccaacatggcctacgcggttgtcatcgaatacgccaagggcaagaacaagctggtgttcgagaagaagatcatccgcgtgaccatcatggagcggaaggccttcgagaaggacgagaaggccttcctggaggagcaggggtaccgccagccgaaggtcctcgccaagctgccgaagtacacgctgtacgagtgcgaggagggccggcgccggatgctcgcgtccgcaaacgaggcccagaaggggaaccagcaggtcctgcccaaccacctggtgaccctcctgcaccacgccgcgaactgcgaggtgagcgacggcaagtccctggactacatcgagagcaaccgcgagatgttcgcggaactcctggcccatgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaaattcttcgagaccacgatcgagcgcaagcggtacaacaacctcaaggagctgctgaacagcaccatcatctaccaatccatcaccggcctctacgagtctcgcaagcgcctcgacgacaagcggcccgccgccaccaagaaggcagggcaggcgaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 8314 - RNA, 4383 nt, synthetic construct
  misc_feature 1..4383: note = Cas9 variant mRNA product
  source 1..4383: mol_type = other RNA
gggagagtccgctcagccaggttgcagaagcggcttagcgtgtgtcctaatcttctctctgcgtgtaggtaggcctgtgccgcaaacaagcttaccatggctcccaagaagaaacgcaaggtgggcatccacggggtcccggcagcgaagaagccctacagcatcggcctggacatcggcaccaattccgtgggttgggccgtggtaaccgacgactacaaggtgcccgccaagaagatgaaggtgctcgggaacacggacaagagccacatcgagaagaacctgctgggcgccctactgttcgactccggcaataccgccgaggatcggcgcctaaagcggaccgcgcgcagacgatacacccggcgccggaaccgcatcctctaccttcaggaaatcttctcagaggagatgggaaaggtcgacgactccttcttccaccggctggaggacagcttcctcgtgacggaagacaagcgaggcgagcggcaccccatcttcgggaacctggaggaggaagtgaagtaccatgagaacttcccgaccatctaccacctccgccagtacctggccgacaatcccgagaaggttgacctgcggctggtgtacctcgccctggcccacatcatcaagttccgcgggcacttcctgattgaggggaagttcgacacgcggaacaacgacgtgcaacgcctctttcaggagttcctggcggtctatgataacacgttcgagaactccagccttcaggagcagaacgtccaggtggaggagatcctcaccgacaagatctctaaaagcgccaagaaggaccgggtgctgaagctgttccccaacgaaaagtccaacggccgcttcgccgagttcctcaagctgatcgtgggcaaccaggccgacttcaagaagcatttcgagctggaggaaaaggccccgctacagttcagtaaggacacctacgaggaggagctggaggtgctgctcgcgcagataggtgataattacgccgagctgttcctgtccgccaaaaagctgtacgacagcatcctgctgtccggcattctaacagtcaccgacgtgggaacgaaggccccgcttagtgcttcaatgatccagcggtataacgaacaccagatggacctggcgcagctaaagcagttcataagacagaagctgagcgacaagtacaacgaagtgttctccgacgtcagcaaggacggctatgccggctacatcgacgggaagaccaaccaggaggccttctacaagtacctgaaggggctcctgaacaagatagaggggagcggctacttcctggacaagatagagcgcgaggacttcctacggaagcagcgtactttcgacaacgggtccataccccaccagatccacctccaggagatgcgggccatcatccgccgtcaggcagagttctaccccttcctcgcggacaaccaggaccgcatcgagaagctgctgaccttcagaatcccctactacgtggggccgctggcccgcggcaagagcgactttgcctggctgtcccgtaagagcgccgacaagataacgccctggaacttcgacgagatcgttgacaaggagagcagcgccgaggcgttcatcaacagaatgaccaactatgacctctacctccccaaccagaaggtcctgcccaagcactccctcctatacgagaagttcaccgtctacaatgagctgaccaaggtgaagtacaaaacggagcaagggaagaccgcgttcttcgacgctaacatgaagcaagagatcttcgacggcgttttcaaagtgtaccggaaggtcactaaagataagctcatggacttcctggagaaggagttcgacgagttccgcatcgtggacctgaccggtctggacaaggaaaacaaggtgtttaacgccagctacggcacgtaccacgacctgtgcaagatactcgataaggacttcttagataactccaagaacgagaagatcctggaggacatcgtcctgaccctcactctgttcgaggaccgggagatgatccgcaagcggctggagaactatagcgacctcctgacaaaggagcaggtcaagaagctggagcgccggcactacactgggtggggtcgcttgtccgcggagctaatccacggcatccggaacaaggagagcaggaagaccatcctagactacttaatcgacgacgggaactccaacaggaacttcatgcagctgatcaacgacgacgccttgtcttttaaggaggaaatcgccaaggcccaggtgatcggcgagaccgacaacctcaaccaagtggtgtccgacatcgccgggtctccggcgatcaagaagggcatcctgcagtccctgaaaatcgtggacgagctcgtcaagatcatgggccaccaacccgagaacatcgtggtggaaatggcccgtgaaaaccagttcaccaatcagggtcgccggaacagccagcagcgactgaagggcctgacggactccatcaaggagttcgggagccagatcctcaaagaacacccagtcgagaacagccaactgcagaatgaccgactgttcctctactacctgcaaaacgggcgcgacatgtacaccggggaggagctggacatcgactacctctcccagtacgatatcgaccacataatcccccaagccttcatcaaagacaacagcatcgataaccgggtgctgacctccagcaaagagaacaggggcaagtccgatgacgtacccagcaaggacgtcgtgcggaagatgaagtcctactggagcaagctgctctccgccaagctgatcacccagcgcaagttcgacaacttgacgaaggctgagcggggcgggctcaccgacgacgacaaggcgggcttcatcaagcgccagcttgtggagacccggcagatcaccaagcacgttgcccggatcctggacgagcggttcaacaccgagacggacgagaacaataagaaaatccgccaggtgaagatcgtgaccctcaagagcaacctggtctccaacttccggaaggagttcgaactgtacaaggtccgagagataaatgactaccaccacgcccacgacgcctacctcaacgccgtgatcgggaaggcgctgctgggcgtctacccccagctcgagcccgagttcgtttacggggactacccccacttccacggccacaaggagaacaaggccaccgccaagaagttcttctacagcaacatcatgaactttttcaagaaggacgatgtgcggactgacaagaacggcgagatcatctggaagaaagacgaacacataagtaacatcaagaaggtcctgagctacccccaggtgaacatcgttaaaaaggtcgaggagcagaccggaggcttctccaaagagtcgatcctccccaaggggaactccgacaaacttatcccccgcaagacgaagaagttctactgggacaccaagaagtacggcgggttcgacagccccatagtggcctacagcatcctggtgatcgcagacatcgagaagggcaagtccaagaaactgaagaccgtcaaggcactcgtgggcgtaacgataatggaaaagatgaccttcgagcgggacccggtcgccttcttggagcgcaaggggtatcgcaatgtgcaggaggagaacatcatcaagctgcccaagtatagcctcttcaagctcgagaacgggcggaagcgcctgctagcctccgccagggagctgcagaaggggaacgaaatcgtgctgcccaaccaccttggaaccctgttataccacgcgaagaacatccacaaggtcgatgagccgaagcatctcgactacgtggacaaacacaaggatgagtttaaggaactgctggacgtggtctcaaacttctccaagaagtacaccctcgccgagggtaatctagagaagatcaaggagctgtatgcccagaacaacggcgaggacctcaaggagctcgctagcagtttcatcaaccttctcactttcacggccatcggggcgcccgccaccttcaagttcttcgataagaacatcgaccgcaagcggtacaccagcacgaccgagatcctgaacgccacgcttatccaccagtccataaccggactctacgagacgcgcatcgacctgaacaagctgggcggggacaagcggcccgccgccaccaagaaggcgggccaagccaaaaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 8315 - RNA, 3516 nt, synthetic construct
  misc_feature 1..3516: note = Cas9 variant mRNA product
  source 1..3516: mol_type = other RNA
gggagagtccgctcagccaggttgcagaagcggcttagcgtgtgtcctaatcttctctctgcgtgtaggtaggcctgtgccgcaaacaagcttaccatggcacctaaaaagaaacggaaagtgggcatacacggcgttccagccgcacaaacaaccaacctcagttacatactaggtctagacctcggtatcgcatcagtcggctgggccgtcgtcgaaatcaacgaaaacgaagaccccatcggactaatagacgtcggcgtaaggatattcgaacgcgccgaagtcccaaaaaccggagaaagcctagcactgtccaggagactcgcgcggagtacccgccgcctaatacgccgccgagcccaccgcctactcctcgcgaaacgcttcctcaagagagaaggcatactgagcaccatagacctcgagaaaggcctgccaaaccaggcctgggagctaagagtcgccggcctcgaaaggcgactatcggccatcgaatggggagccgttctcctgcacctaataaaacacagggggtacctatcgaaaagaaagaacgagagtcaaacgaacaacaaggagctgggcgccctgctaagcggagtggcgcaaaaccaccagctcctacaatccgacgactaccgaacacccgcagaattagccctcaagaaatttgcaaaagaagaggggcacataagaaaccaacgcggcgcttacacacacaccttcaatagattagacctcttagcagaactgaacctgctattcgcacaacagcatcaattcggaaacccacactgtaaagagcacatccagcaatacatgactgaactcctaatgtggcagaaacccgcactcagtggcgaggccatcctaaaaatgctcggaaaatgcacacacgagaaaaacgagttcaaagccgcgaaacatacctacagcgccgaacgttttgtttggctcaccaaactcaataaccttcgaatactcgaagacggggccgaacgggcactaaacgaagaagaaagacaactactaatcaaccacccgtacgaaaagagcaaactaacatacgcgcaggtacgaaaattactaggcctctccgaacaagctattttcaagcacctacgctacagtaaagaaaacgcagagtcagccaccttcatggagctcaaagcctggcacgccatacgaaaagcactcgaaaaccagggcctgaaggacacctggcaggacctcgccaagaaacccgatctcctcgacgaaatcggaaccgccttctcactctacaaaacagatgaagacatccaacaatacctaacgaacaaagtacccaacagcgtaataaacgcactactcgtatccctgaacttcgataagttcatcgaactcagcctgaaaagcctgagaaaaatacttcctctaatggaacaaggcaaacgctacgatcaggcctgccgcgagatctacggacatcactacggggaggccaaccaaaagacgtcacaactcctgcccgccattccagcccaagaaatacgcaaccccgtagtcctgcgaacgctgtcccaagcaagaaaagtaataaacgccatcatacgacaatacggctcccccgcccgagtccacatagaaacgggtcgagaactagggaaatccttcaaagaacgacgcgaaatccaaaaacagcaggaggataatcgaaccaaacgcgagtcagcggttcaaaagttcaaggaactcttctccgacttcagcagcgaaccaaaatctaaagacatactcaagttccgcctttacgagcaacaacacggtaaatgcctatactcgggcaaagaaatcaacatacacaggctgaacgaaaaaggatacgtcgagatcgaccacgcactacccttcagtcggacctgggacgactcattcaacaataaagtacttgtcctagcaagcgagaaccaaaacaaaggcaaccagacaccatacgagtggctacaagggaaaataaactccgaacgctggaaaaacttcgtcgcactggtactcggcagccagtgctcagccgcgaagaaacaacgcctcttgacccaggtcattgacgacaacaaatttatcgaccgcaaccttaacgacactcgatacatcgcacgcttcctatcaaactacatccaggaaaacctcctactcgtcggcaaaaacaaaaagaacgtattcacgccaaacggccaaatcacagccctgctccggtcgcgatggggactaatcaaagctcgagaaaacaacaaccgacaccatgccctagatgcgatcgtggtcgcttgcgcgaccccctcaatgcaacagaaaataacccgcttcatccgatttaaagaagtccacccctacaaaatagaaaaccgatacgaaatggtcgaccaagagagtggagaaattataagcccccacttccccgagccatgggcatacttcaggcaagaggtaaacatccgagtattcgacaaccaccccgacacggtgctaaaagagatgctcccggaccggccacaggcaaaccaccaattcgtacaacctctattcgtctcccgagcgcccaccagaaaaatgtccggccaaggccacatggaaaccatcaagtccgccaaacggctggcagaaggcatctccgtactccgaatacccctaactcaactcaaacccaatctcctggaaaacatggtaaataaggagcgcgaacccgccctgtacgcaggccttaaagcccgactcgccgagttcaaccaggaccccgcaaaagccttcgccacaccattctacaaacaaggcggccagcaggtaaaagcaatccgagtagagcaagtacaaaaatcaggagtcctagtacgcgaaaacaacggagtcgccgacaatgcctcaatcgtacgaaccgacgtattcatcaaaaacaacaaattctttctcgtccccatctacacgtggcaagtagcaaagggaatcctaccaaacaaggcaatcgtcgcacacaaaaatgaagacgaatgggaagaaatggacgaaggtgccaaattcaagttctctctcttccccaacgaccttgtcgaactaaaaaccaagaaagaatacttcttcggctactacatcggactggaccgggcaacagggaacataagcctaaaagagcacgacggcgaaatctccaaaggcaaagacggagtctacagggtaggcgtcaaacttgcactgagctttgaaaaataccaagtagatgagcttgggaaaaaccgacaaatctgccgaccccaacaaagacaacctgtcagaaagagaccagccgcaactaaaaaggcaggacaagccaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 8316 - RNA, 3594 nt, synthetic construct
  misc_feature 1..3594: note = Cas9 variant mRNA product
  source 1..3594: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaacgcaaagtcggaatccacggagtaccagcagcagccgcctttaaaccaaacccaatcaactacatactcggattagacatagggatagcatcagtcggatgggccatggtcgagatcgacgaggacgaaaaccccatatgcctcatagacctgggggttagggttttcgagcgtgcagaggttccaaaaacaggcgacagcctagcaatggcacgtagactagcgcgctctgtccgcagactcacgagacgacgggcccacagactgctaagagcccgccgcctgctcaaaagagaaggagtcctacaagccgccgactttgacgaaaacggactcataaaaagcctccccaacacaccctggcaacttcgggcggccgccttagaccgaaaactcacacccctcgagtggtccgccgtgctactgcacctgatcaaacatcgaggatacctcagccaacgcaaaaacgagggagaaacggcagacaaagagctcggcgcactgcttaaaggcgtagcggacaacgcacacgcactacagacgggggacttccgcacgccagccgagctcgcactcaacaaattcgagaaagaaagcggtcacatccgaaaccagcgcggagactactcccacacattctcccgaaaagacctgcaagccgaactcatcctactattcgaaaaacagaaagagttcggcaacccacacgtatcaggcggtctaaaagaaggtatagaaacactcctcatgacccaaagaccggccctgtcaggagacgcagtccagaaaatgctcgggcattgcacattcgaaccagcagagcccaaggcagctaaaaacacatacaccgcagaacgattcatctggctgaccaagctcaacaacctcagaatattagaacaagggtctgaacgccccctgactgacacggaacgcgcaacactcatggacgaaccgtaccgcaaaagcaaactcacctacgcacaagcccgtaaactactgggcctcgaagacacagctttcttcaagggtctgcgatacggaaaagacaacgcagaagcatcaacattaatggaaatgaaggcttaccatgccatcagccgagccctagaaaaggaaggcctaaaagataagaaaagtcccctaaacctgtcgcccgagctacaagatgaaatcggcacagccttctcgctttttaaaaccgacgaggacatcacagggcgactcaaagaccgaatacaacccgagattctggaggcgctcctcaaacacatatcattcgacaaattcgtccaaatatccctcaaagcactacgcagaatcgttcctctcatggaacaaggcaaacgctacgatgaagcctgcgcagaaatatatggagaccattacgggaaaaagaacaccgaagagaaaatctatctgcccccgatcccagcggacgaaatacggaatcccgtcgttctgcgagcgctatcccaagcgagaaaagtaatcaacggggtcgtcagacgctacggcagtcccgcaagaatacacatagaaaccgcccgagaggtcggcaaatccttcaaagaccgcaaagagatcgaaaaacgccaagaagaaaatcgcaaggaccgagaaaaagcggcagcgaaattcagagaatacttcccaaacttcgtcggggaacccaaatccaaagatatcctaaaactccgcctatatgaacaacagcatggcaaatgcctctacagcggtaaggaaatcaacttaggaagactgaacgaaaaaggctacgtggaaatagaccacgcgctcccattcagccgcacttgggacgactcattcaacaacaaagtgctggtcctcggctcagagaaccagaataaagggaatcaaaccccctacgaatacttcaacggcaaagacaacagccgcgaatggcaagagttcaaggcacgagtggagacctcgcgcttccccagaagcaagaaacagcgaatactcctacagaaattcgacgaagatggcttcaaagaaaggaacctaaatgacacacgctacgtaaaccgctttctttgccaattcgtagcagaccggatgcggctcactggaaagggcaaaaagagagtcttcgcatccaacggacaaatcactaacctgctgaggggattctggggattacgcaaagtccgggcagagaacgaccgacaccatgcgctcgacgccgtagtcgtagcatgcagcaccgtagccatgcaacagaaaatcacgcgcttcgtgagatacaaggaaatgaacgcattcgacggaaagaccatcgacaaagagaccggagaagtcctacaccagaagacccatttcccccaaccctgggagttcttcgcccaggaagtcatgatacgcgtcttcggcaaacccgacggaaagccagagttcgaagaagcggacacgccagaaaaactaagaacgctgctcgccgagaaacttagctccagacctgaagcagtacatgaatatgtaaccccactcttcgtaagccgagccccgaaccgcaaaatgtccggccaggggcacatggaaacagtaaaatcagccaaacgcctagacgagggcgtgagcgtactaagggtaccgcttacacaactcaagctaaaagacctagagaaaatggtcaaccgcgagcgcgaaccaaagctctacgaggcccttaaggctcggctagaggcacacaaagacgacccagccaaagccttcgcggaaccgttttacaaatacgacaaggccggcaatcggactcaacaagtcaaagccgtaagagtagagcaggtccagaaaacaggcgtctgggtacgtaaccacaacggcatagcagacaacgccactatggtacgcgtcgacgtgttcgaaaaaggcgacaaatattatctagtgcccatatacagctggcaagtcgcaaaaggaatcctaccagaccgcgcggtggtccaaggaaaggacgaagaagactggcaactcatcgacgacagcttcaacttcaaattcagcctacaccccaacgacctagtcgaagtcatcacaaagaaggcccggatgttcgggtacttcgcctcctgccaccgcggcaccggtaacataaacataaggatccatgacctcgaccacaaaataggcaaaaacggaatattagaaggcatcggggtaaaaacagcccttagcttccaaaaataccaaatagacgagctaggaaaagaaataaggccctgccgactcaaaaagagaccaccagtgcgcaaaaggcccgcagcaacgaagaaagccggccaagccaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 8317 - RNA, 3600 nt, synthetic construct
  misc_feature 1..3600: note = Cas9 variant mRNA product
  source 1..3600: mol_type = other RNA
gggagagtccgctcagccaggttgcagaagcggcttagcgtgtgtcctaatcttctctctgcgtgtaggtaggcctgtgccgcaaacaagcttaccatggcaccgaagaagaaaaggaaagtcggcattcacggagtcccagccgcaaaataccatgtaggcatagacgtaggaacattcagcgtagggctcgcggcaatagaggtagacgacgcaggtatgcccatcaaaaccctaagccttgtgtcacacatccacgacagcggcctcgatccagatgaaatcaaatcggcggtcacgcgactagcaagcagcggtatcgccagacgaacgcgcagactgtaccgaaggaaaaggagaagactccagcaactggacaaattcatacaacggcaaggatggccagtgatagaattagaggactacagcgacccactatacccctggaaagtaagagccgagctcgcagcaagttacattgcggatgagaaagaacgaggcgagaaattgagcgtggcactgagacatatcgccagacacagaggatggcgcaacccatacgcaaaagtaagcagcctatacctcccagacgggccgtccgacgcattcaaagcgatcagagaagagataaagagggcgagtgggcaaccagtgccagaaacagccacggtgggacaaatggtgaccctatgcgaactaggcacgctgaagctaagaggagaaggcggagtcctgagtgcacggttgcagcaaagcgactacgcccgcgaaatacaagaaatatgccgcatgcaagaaatagggcaagaactctacagaaaaataatcgacgtagtattcgcagctgaaagcccaaaggggagcgccagcagccgagtaggaaaagaccccttacaacccgggaaaaaccgcgcgctaaaggccagcgacgcattccaacgatacaggatagcagccttaataggaaacctaagagtccgagtagatggagagaaacgcatcctcagcgtagaggagaagaacctcgtgttcgaccatctggtcaatctaaccccaaagaaagaaccagaatgggtaacgatcgcagaaatactgggcatagacagagggcagctaataggaaccgccacgatgacggacgacggagaacgcgcgggagcccgaccacctacgcacgacacgaacagatccatcgtgaacagccgaatagccccgctagtcgactggtggaaaacagcgagcgccctcgaacaacatgcaatggtcaaggctctaagcaacgcggaagtagacgacttcgactcaccagagggagcaaaagtccaagcattcttcgccgacctagacgacgacgtccacgcaaaactcgactcccttcatctgccagtcggacgagcggcgtacagcgaagacaccctagtacgattaacacgacgcatgctaagcgacggagtagatctgtacaccgcaagactacaggagttcggcattgaaccaagctggacgccaccaacccccaggatcggagaaccagttggtaacccagctgtagaccgagtactaaaaacagtcagtcgatggcttgaaagtgcgaccaagacttggggagcaccagaacgggtcataatagaacacgtaagggagggatttgtaacagaaaaacgggcgcgagaaatggacggggacatgcgtagacgagcagcaaggaacgcaaaactgttccaggaaatgcaggagaaactaaacgtacaaggaaaaccctctagagcagatctctggcggtaccagagcgtccaaagacaaaactgccaatgcgcatactgcggcagcccaatcacgttcagcaactcagaaatggaccacatcgtgccaagggctgggcagggatccaccaacacgcgcgagaacctagtggcggtgtgccacaggtgtaaccaaagcaaaggaaacaccccgttcgcgatatgggcgaaaaacacctccatagagggcgtaagcgtaaaggaagctgtggaaagaacacgacactgggtcacggacacaggaatgcgctcaaccgactttaagaaatttacaaaggctgtcgtcgagaggttccaaagagcaacgatggacgaagagatagacgcaaggagcatggaatcggtcgcatggatggcaaacgaattgcgcagtcgggtagcacagcacttcgctagccacggaacaacggtacgagtctaccgcggaagcctcacagcggaagcacggagggccagcggcataagcggcaaactaaagttcttcgacggagtcgggaaatctcgcctagaccgcagacaccatgccatagacgcggccgtgatcgcattcacaagtgactacgtggccgagaccctagcagtacgaagcaatttgaagcaaagccaagcgcacagacaggaagccccgcaatggcgagagttcacaggaaaagacgcagaacacagagcggcatggagggtatggtgccagaaaatggaaaaactaagcgcattgctcaccgaagacctcagggacgacagagtcgtcgttatgagcaacgtgcggctacgcctcggcaacggctcggcccacaaagaaacaataggaaaactcagcaaggtcaaactaagctcacaactgtccgtatccgacatagacaaagcgtcgagcgaagcactctggtgcgcgctaacgcgagaacccggatttgaccccaaggaaggcctccctgcaaacccagaacggcacatacgagtaaacggtacacacgtgtatgctggtgacaacatcggattattcccagtctcagcaggaagtattgcgctgcggggaggatacgcagaactcggctcaagttttcaccacgcaagggtatataaaataacaagcgggaagaaaccagcattcgctatgttgagagtatacacgatagacctgctcccctaccgcaaccaagacctattcagcgttgaactaaaaccacaaacaatgtcaatgaggcaagccgaaaagaaactgcgagacgccctcgccaccgggaacgccgaatacctcggctggttagtcgtcgacgacgagctcgtagtagacaccagcaaaatagcaacggaccaagtaaaagcagtcgaagcggagctaggaacgataagacgatggagggtagatggatttttcagcccaagcaaactacgcctaagaccgcttcaaatgtcaaaagaaggcatcaaaaaggaaagcgcaccagagctgagcaagataatcgacagacccggctggctaccagcagttaataaactcttcagcgacggcaacgtcacagtcgtgcgaagggactcgttggggcgggtacggctagaaagcacagcgcacctacccgtcacatggaaggtacaaaagagaccagccgcgacgaagaaggcaggccaggcgaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 8318 - RNA, 3300 nt, synthetic construct
  misc_feature 1..3300: note = Cas9 variant mRNA product
  source 1..3300: mol_type = other RNA
gggagagtccgctcagccaggttgcagaagcggcttagcgtgtgtcctaatcttctctctgcgtgtaggtaggcctgtgccgcaaacaagcttaccatggcccccaagaagaaacgcaaggtgggcatccacggggtcccggccgcggcccggatactggccttcgacatcggcatcagctccatagggtgggccttcagcgagaacgacgagctcaaggactgcggcgtgcgcatcttcactaaggtggagaaccccaagacaggagagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgatgagagcctcgccaaggcctacaaaggctccctgatcagcccctacgagctgcggttccgcgcactcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacttgtacaaggagtacttccagaaattcaaggagaacagcaaggagttcacgaacgtgcgcaacaagaaggagtcctacgagcggtgcatcgcccagagcttcctgaaggacgagctgaagctcatctttaaaaagcagcgcgagttcgggttctccttcagcaagaagttcgaagaggaggtcctttccgtggcgttctacaagcgggctctgaaggacttcagccacctcgtgggcaactgctccttcttcaccgacgagaagcgcgccccgaagaacagccccctggccttcatgtttgtcgccctgacccggatcatcaatctcctgaacaacctgaagaacaccgagggcatcctctacacgaaggacgacctgaacgcgctgcttaacgaggtgctgaagaacggcaccctgacctacaagcagaccaagaagctcctggggctgagcgacgactacgagttcaaaggggaaaagggcacgtacttcatcgagttcaagaagtacaaggagttcattaaggccctcggggagcacaacctgtcccaggacgacctgaacgagatcgccaaagacatcaccctcatcaaggacgagatcaagctgaagaaggccctggccaagtacgacctcaaccagaaccagatcgacagcttatccaaacttgagttcaaggaccacctcaacatcagcttcaaggcgctaaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgtgcgatcaaggagtaccgcaaggtgctgaacgccctcctgaagaagtacggcaaggtgcacaaaatcaacatcgagctggcgcgggaggtcgggaagaaccactcccagcgcgccaagatcgagaaggagcagaacgagaactacaaggccaagaaagacgcggagctcgagtgtgagaagctgggcctgaagatcaacagcaagaacatcctcaagctgcggctgttcaaggagcagaaggagttctgtgcctactccggggagaaaatcaagatcagcgacctccaggacgagaagatgttagagatcgaccacatctacccatactcccgcagcttcgacgactcctacatgaacaaggtgctggtgttcaccaagcagaaccaggagaagctcaaccagacccccttcgaggccttcggcaacgacagcgcgaagtggcagaagatcgaggtcctggcaaagaacctacccaccaagaagcagaagcggatcctcgacaagaactacaaggacaaggagcagaagaacttcaaggaccgcaacctgaacgacacacggtacatagctcgcctggtgctcaactacaccaaggactacctggacttcctgccgctctccgacgacgagaacaccaagctgaacgacacccagaaggggagcaaggtgcacgtcgaggccaagtccggcatgctgacgagcgctctccggcacacctggggcttctccgccaaggaccgcaacaaccacctccaccacgccatcgatgcggtgataatcgcctacgccaacaacagcatcgtcaaggccttctccgacttcaaaaaggagcaggagagcaacagcgcggagctgtacgccaagaagatctccgagctggactacaagaacaagcggaagttcttcgagcccttcagcggtttccgccagaaggtgctggacaagatcgacgagatcttcgtgtccaaacccgagcggaagaagcccagcggtgccctgcacgaggagaccttccgtaaagaggaggagttctaccagtcctacgggggcaaggagggggtcctcaaggcgctggagctgggcaagatccggaaggtgaacgggaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttttgcttctccctctacaaggacagcctgatcctgatccagaccaaggacatgcaagagcccgagttcgtgtactacaacgccttcacctcctcaaccgtgtccctcatagttagcaagcacgacaacaagttcgagacgctgtccaagaaccagaagatcctgttcaaaaacgcaaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 8319 - RNA, 3711 nt, synthetic construct
  misc_feature 1..3711: note = Cas9 variant mRNA product
  source 1..3711: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggcatccacggggtcccggccgcgtcggacctagttctcggcctggacatcgggattggctccgtgggggtcgggatcctgaacaaggtgaccggcgagatcatccacaagaacagccggatcttccccgccgcccaggccgagaacaacctagtgcgccggacgaaccgccagggccggcgcctggcccggcgcaagaagcaccggcgcgtccggctgaaccgcctcttcgaggagtccggcctgatcacggacttcaccaagatcagcataaacctgaacccctaccagttacgggtgaaggggctgaccgacgaactgtccaacgaggagctgttcatcgcgctgaagaatatggtgaagcaccgcggcatcagctacctggatgacgcctccgacgacgggaacagctccgtcggcgattacgcccagatcgtgaaggagaatagcaagcagctcgagaccaagacgcccggacagatccagctggagcggtaccagacctacgggcagctgcgcggcgatttcaccgtggagaaagacgggaagaagcaccgactcatcaacgtcttcccgacctccgcctaccgaagcgaggcgctgcggatcctgcaaactcagcaggagttcaacccccagatcaccgatgagttcatcaaccgctacctcgagatcctgaccggcaagcggaagtactaccacggccccgggaacgagaagtcccgcaccgactacggccgctatcggacgagcggggagaccctggacaacatcttcggcatcctcatcgggaagtgcaccttctaccccgacgagttccgcgccgccaaggcctcctacaccgcccaggagttcaaccttttaaatgacctcaacaacctgacggtgccgaccgaaaccaagaagctcagcaaggagcagaagaaccagatcatcaactacgtgaagaacgagaaggctatgggccccgccaagctgttcaagtacatcgccaagctcctgtcctgcgacgtcgccgacatcaagggctaccggatcgacaagagcgggaaggccgagatccataccttcgaggcgtaccgcaagatgaagacgctcgagaccctggacatcgagcagatggacagagagaccctggacaagctcgcctacgtactgaccctgaacacggagcgcgagggcatccaggaggccctcgagcacgagttcgccgacgggtccttcagccagaagcaggtcgacgagctggtgcagttccggaaggccaacagctccatcttcggcaaagggtggcacaactttagcgtgaagctgatgatggagctcatccccgagctgtacgagaccagcgaggagcagatgaccatcctgacccgcctcggcaagcagaagacaaccagctccagcaacaagactaagtacattgacgagaagctgctgaccgaggaaatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgcctcacagcgtgttccacggccacaagcagctggccaccaagatccggctgtggcaccagcagggcgagcgctgcctctataccggcaagaccatctccatccacgacctgatcaacaacagcaaccagttcgaggtcgaccacatcctgcccctctccatcacgttcgacgacagcctggccaacaaagtgctggtgtacgcgaccgccaaccaggagaaggggcagcggacgccctaccaggccctggactccatggacgacgcctggtcgttccgcgagctgaaggccttcgtccgggagtccaagaccctgagcaacaagaagaaggagtacctcttgaccgaggaggacatctccaagttcgacgtgcgcaagaagttcatcgagcggaacctcgtggacacgcgctacgcgagccgggtcgtgctcaacgccctgcaggagcacttccgcgcccataaaatcgacaccaaggtgtccgtggtgcgcggccagttcaccagccagttaagacgccactggggcatcgagaagacccgggacacgtaccaccaccatgcagtggacgccctcatcatcgcggcctcctcccagctgaacctgtggaagaagcagaagaacaccctcgtcagctactccgaggaccagctgctggacatcgagaccggggagctcatcagcgacgacgagtacaaggagtccgtgttcaaggccccctaccaacatttcgtggacaccttaaagagcaaggagttcgaggattccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctcgagaactaccccaacaagcagatcaacgagaagggcaaggaggttccctgcaacccgttcctcaagtacaaggaggagcacgggtacatccggaaatacagcaagaagggcaacgggcccgagatcaagtccctgaagtactacgacagcaagctgggcaaccacatcgacattacccccaaagactccaacaacaaggtggtcctccagagtgtgtccccctggcgcgccgacgtgtacttcaacaagaccaccgggaagtacgagatcttgggcctgaaatacgcggacctccagttcgagaagggcacggggacctacaagatcagccaggagaagtacaacgacatcaagaagaaagagggcgtcgacagcgactccgagttcaagttcaccctgtacaagaacgacctgctcctggtgaaggacaccgagacgaaggagcagcagctgttccggttcctcagccgcaccatgccaaagcagaagcactacgtggagctaaagccctacgacaagcagaagttcgagggcggagaggccctgatcaaggtcctcgggaacgtggccaactccggccagtgcaagaagggactgggcaagagcaacatctccatctacaaggtgcggaccgacgtcctggggaaccaacacatcattaagaacgagggggacaaacccaagctcgacttcaagcgccccgccgccaccaagaaggcgggccaggccaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 8320 - RNA, 4269 nt, synthetic construct
  misc_feature 1..4269: note = Cpf1 variant mRNA product
  source 1..4269: mol_type = other RNA
gggagagtccgctcagccaggttgcagaagcggcttagcgtgtgtcctaatcttctctctgcgtgtaggtaggcctgtgccgcaaacaagcttaccatggcccccaagaagaagcgcaaggtgggaatccacggcgtcccggccgcgacccagttcgagggcttcaccaacctgtaccaggtgagcaagacgctccggttcgagctgatcccccaggggaagaccctgaaacacatccaggagcagggcttcatcgaggaggacaaggcccgcaacgaccactacaaggaactcaaacccatcatcgaccggatctataagacctacgccgaccagtgcttgcagctggtgcagctcgactgggagaatctgtccgccgccatcgacagctaccgcaaggagaagaccgaggagacccgtaacgcgcttatcgaggagcaggccacctaccgcaacgctattcatgactacttcatcgggcggaccgataacctcaccgacgccataaacaagcgccacgctgaaatctacaagggcctcttcaaggccgagctattcaacggcaaggtactaaagcagttagggacggtgaccaccaccgagcacgagaatgccctactccggtccttcgacaaattcacgacctacttctcaggcttctacgaaaaccgcaagaacgtgttcagcgcagaggacatcagcaccgcaatcccccaccggatcgtccaggacaatttcccgaagtttaaggagaactgccatatcttcacccgtctgatcacggcggtgccgtccctgcgggaacacttcgaaaacgtgaagaaggccatcggaatttttgtcagcacctccatcgaggaggtgttcagtttccccttctacaaccagttgctgacccagacccagatcgacctgtacaaccagctcttgggcgggatctctcgcgaggccggcacggagaagataaagggcttaaatgaggtgctcaacctggccatacagaagaacgacgagacagcccacatcatagcgagcctgccccaccggttcatcccgttattcaaacagatcctgtctgaccgtaacacccttagcttcatcctcgaggagttcaagagtgacgaagaggtcatccagtcgttctgcaaatacaagacccttctgcggaacgagaatgtgctcgagacggccgaggcccttttcaacgaactgaactccatcgacctcacccacatcttcatcagccacaagaaactcgagaccatcagcagcgccctgtgcgaccactgggacaccctccgcaacgccctgtacgagcggcgcatcagtgagctgacgggcaagatcaccaagtccgcgaaggagaaggtgcagcggagcctcaagcatgaagacatcaacctgcaggagatcatctccgccgccggcaaggagctgagtgaggccttcaagcaaaagacctcagaaatcctatcccacgctcatgcggccctggaccagccgttgcccaccacgctcaagaagcaagaagagaaggagatcctgaaatcccagttagacagcctgctcgggctgtaccacctcctcgactggttcgcagtcgacgaatccaacgaggtggaccccgagtttagcgcccgcctgaccggcattaaactggagatggagccgtccctcagcttctacaacaaggcgcgcaactacgccaccaagaagccctactccgtggagaagttcaagctgaacttccagatgcccacgctggccagcggctgggatgtaaacaaggagaagaacaatggggccatactcttcgtgaagaacggcctgtactacctggggatcatgcctaagcaaaagggccggtacaaggccttatccttcgagcccacggagaagaccagcgaagggttcgacaagatgtactacgactacttccccgacgcggccaaaatgatccccaagtgctccacacagctgaaagcagtgaccgcccacttccagacccacacgaccccgattctgttgagtaacaacttcatcgagccgctggagatcaccaaagagatctacgatctgaacaaccccgagaaggagcccaaaaagttccagaccgcctatgcgaaaaagacgggagaccagaaaggctaccgcgaggccctgtgcaagtggatcgacttcacccgggatttcctatccaagtacaccaagaccacgagcatcgacctgagttcactccggccaagctcccagtacaaagatctgggggagtactacgccgagctgaatccgctcctgtatcacatctcattccaacggatcgccgagaaagagatcatggacgccgtagagacgggcaagctctacctcttccagatctacaacaaggacttcgcgaagggacaccacggcaagcctaacctgcacacattgtactggaccggcctcttctcccccgagaacctcgccaagacgagcatcaagctgaacgggcaggccgagctgttctacaggcccaagagccggatgaagcgcatggcccacaggctgggtgagaagatgctgaacaagaagctaaaggaccagaagaccccgatccccgacaccctgtaccaagagctgtatgactacgtgaaccatcgcttaagccacgacctctccgacgaggcgcgtgccttactccccaacgtgatcaccaaggaggtcagccatgagatcatcaaggaccgcagattcacgtccgacaagttcttcttccacgtgccgatcacactgaactaccaggccgctaacagcccctccaagttcaaccagcgcgtcaacgcctacctaaaggagcaccccgagacgcccatcattgggatagaccggggcgagcgcaacctgatctatatcaccgtgatcgacagcacggggaagatcctggagcaacgatccctgaacaccatccagcagttcgactaccagaagaaactcgacaaccgcgaaaaagagcgggtggcggcacgccaggcctggagcgtcgtgggcaccatcaaggacctgaagcaggggtacctgagccaggtgatccacgagatcgtcgacctcatgattcactaccaggccgtcgtggtcctggagaacttaaacttcggcttcaaatcgaaacgcaccggcatcgccgagaaagcggtgtaccagcagttcgagaagatgctcattgacaagttaaactgcctggtgctaaaagattacccggccgagaaggtcggaggcgtgctgaacccctaccagttgacggaccagttcaccagcttcgccaagatgggcacccagtctggcttcctcttctacgtgcccgccccctacaccagcaagatcgacccgctgacggggttcgtagaccccttcgtttggaagaccatcaagaaccatgagagtcggaagcacttccttgaggggtttgacttcctccactatgatgtgaagactggcgatttcatcctgcacttcaagatgaaccgcaacctgagcttccagcgggggctccccggtttcatgcccgcctgggacatcgtcttcgagaagaatgagacccagttcgacgcgaaggggacgcccttcatcgccggcaagcgcatagtccctgtgatcgagaaccaccggttcaccggccgctaccgggatctgtaccccgcaaacgagctgatcgccctcctggaggagaaggggatcgtctttcgagacggctccaacatcctgcccaagttgttagagaatgacgacagccacgcaatcgacaccatggtggccctgattcggtccgtgctccagatgcgcaacagcaacgcggccaccggggaggactacatcaactccccggtccgggacctgaacggcgtgtgctttgatagccgcttccagaaccccgagtggcccatggacgccgacgcgaacggggcctaccatatcgccctgaagggacaactcttgctgaaccacctcaaggagtctaaggacctcaagctgcaaaacggtatcagcaaccaggactggctcgcctatatacaagagctgcggaacaagcgccccgccgcgactaaaaaggctgggcaggccaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 8321 - RNA, 4248 nt, synthetic construct; identical to SEQ ID NO: 2521
  misc_feature 1..4248: note = Cpf1 variant mRNA product
  source 1..4248: mol_type = other RNA

SEQ ID NO: 8322 - RNA, 4433 nt, synthetic construct
  misc_feature 1..4433: note = Cas9 variant mRNA product
  source 1..4433: mol_type = other RNA
gggagagtcccgcagtcggcgtccagcggctctgcttgttcgtgtgtgtgtcgttgcaggccttattcaagcttaccatggcccccaagaagaagcgcaaagtgggaatccacggggtgccggcggcggacaagaagtacagcatcggcctggacatcgggaccaactcagtgggctgggccgtaatcaccgacgaatacaaagtccccagcaagaagttcaaggtgctggggaacacggaccggcattccatcaagaagaacctgatcggtgccctgctgttcgactcgggcgagaccgccgaggccacccgcctgaagcgaaccgcgcgccggcgctacacgcggcgcaagaaccggatctgttacctgcaggagatcttctccaacgagatggccaaggtggacgacagcttcttccaccgcctcgaggagtccttcctggtcgaggaggacaagaagcacgagcggcaccccattttcgggaacattgtggacgaagtggcctaccacgagaagtaccccaccatctaccaccttcgcaagaagctcgtcgacagcaccgacaaggccgacctgcggctgatttacctcgcgctggcccacatgatcaagttccgcggccacttcctgatcgagggggacctcaacccggacaactccgacgtggacaagctgttcatccaactggtgcagacctacaaccagctgttcgaggagaaccccatcaacgccagcggcgtcgacgccaaagccatcctgtccgcgagacttagcaagagtcgcaggctcgagaacctgatcgcccagcttcccggggagaagaagaacggcctattcggcaacctgattgccctgagcctcggactgacacccaacttcaagtccaacttcgatctggccgaggatgccaaactccagttgagtaaggacacctacgacgacgacctggacaacctcctggcgcagatcggcgaccagtacgccgacctgttcctcgccgccaagaacctgtctgacgccatcctgctcagcgacatcctgcgcgtgaacaccgaaatcaccaaggcgccgctgtccgcctcaatgatcaagcggtacgacgagcaccaccaggatctcacgctgctgaaggcgctagtgcgccagcagttgcccgagaaatacaaggagatcttcttcgaccagagcaaaaacgggtacgctggctacatcgacggcggggcctcccaggaggagttctataagttcatcaagcccatactggagaagatggacggcaccgaggagttactggtcaagctgaaccgggaggacctgctccgcaagcagcgcaccttcgacaatgggagcatcccccaccagatccacctgggcgagctgcacgcgatcctccggcgccaggaggacttctacccgttcctgaaggacaaccgggagaagatcgagaagatcctcacctttcgcatcccctactacgtggggcccttggcccggggcaactcccgcttcgcctggatgacgcgcaagagcgaggagaccatcactccctggaatttcgaggaggtggtcgacaagggcgccagtgcgcagagcttcattgagaggatgaccaactttgacaagaacctgccgaacgagaaggtgctgcccaagcactccctcctgtacgagtacttcacggtgtataacgaactcaccaaggtcaagtacgtgaccgaggggatgcggaagcccgctttcctcagcggcgagcagaagaaggccatcgtggacttgctgttcaagaccaaccgcaaggtcacggtgaagcagctcaaggaggattacttcaagaagatcgagtgcttcgactccgtcgagatcagcggggttgaggaccggttcaacgcctccctgggcacctaccacgacctgctcaaaatcatcaaggacaaggactttctggacaacgaggagaacgaggacatcctggaggacattgtgctcaccctgaccctgttcgaggaccgcgagatgatagaggagcggctcaagacgtatgcccacctgttcgacgacaaggtcatgaagcaactgaagcgtcggcgctacaccgggtggggccggctcagccgcaagttgatcaacggaatccgagataaacagagtgggaagacaatcctggacttcctaaagagcgacggctttgcaaaccgcaacttcatgcagctgatccacgacgactccttgaccttcaaggaggacatccagaaggcccaagtatctgggcagggagactccctccacgagcacatcgccaacctggccgggtcccccgccatcaagaagggcatcctgcagacggtgaaggtcgtggacgagctagtcaaggtcatgggccgccacaagccggagaacatcgtgatcgagatggcgcgggagaaccagaccacccagaaggggcagaagaactcccgcgagcggatgaagcgcatcgaggagggcatcaaggagctggggagccagatcctgaaagagcaccccgtggagaacacccagctccagaacgagaagctctacctgtactaccttcagaacggccgggatatgtacgtcgaccaggagctggacattaacaggctgagcgactatgacgtggaccacatcgtgccccagtccttcctcaaagacgacagcatcgacaacaaggtcctgacacggtccgacaagaaccggggcaagagcgacaacgtgccctccgaggaggtagtcaagaaaatgaaaaactattggagacagctgctcaacgctaagctgatcacccagcgcaaattcgacaacttgaccaaagccgaacgcgggggcctcagcgagctagacaaggccgggttcatcaagcggcagctggtggagacccggcagatcaccaagcacgtagcccagatcctcgactccaggatgaacacgaagtacgacgagaacgacaaactgatccgggaggtcaaggtgatcaccctcaagagcaaacttgtgtccgacttcagaaaggacttccagttctataaggttagggagatcaacaactaccaccacgcgcacgacgcatacctgaacgccgtggtgggcaccgccctgatcaagaagtacccgaaacttgagagcgagttcgtctacggggactacaaggtgtacgacgtgcgcaagatgatcgcgaagtccgagcaggagatcggaaaggctaccgccaagtacttcttctacagcaacatcatgaacttcttcaagacggagatcaccctggcaaacggcgaaatccggaagcgccccctaatcgaaacgaacggagagaccggcgaaatcgtctgggacaaggggcgggacttcgccacggtgcgcaaggtgctctccatgccccaggtcaatatcgtaaagaagaccgaggtgcagaccggcgggttcagcaaggagtccatcctgcccaagcgcaacagcgataagttaatcgcgcgtaagaaggactgggacccgaagaagtacggcggcttcgactcccccaccgtcgcgtacagcgtgctggtggtcgccaaggtggagaagggcaagagcaagaagttaaagtccgtgaaggagctgctcggtatcacgatcatggagcgcagttccttcgagaagaaccccatcgatttcctggaggccaagggatacaaggaggtcaagaaggacctgatcatcaagctccccaagtacagcctgttcgagctggagaacggccggaaacgcatgctcgcctccgcgggggagctgcagaagggcaacgaactggccctccccagcaagtacgtgaacttcctgtacctggcctcccactatgagaagttaaaaggcagccccgaggacaacgaacagaagcagctgttcgtggagcagcacaagcattatctggacgagatcatcgagcagatatccgagttcagcaaacgggtgatcctcgccgacgccaacctcgacaaggtgctctccgcgtacaacaagcaccgtgacaagcccatccgggagcaggccgagaacatcatccacctcttcaccctgaccaaccttggggcccctgccgcgttcaagtacttcgacaccacgatcgaccggaagcggtacaccagcaccaaggaggtgttagacgcgaccctgatacaccagagtatcacgggcctgtacgagacccgcatcgatctcagccagctcgggggcgataagcggcccgccgccaccaagaaggccgggcaggcgaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 8323 - RNA, 5216 nt, synthetic construct; identical to SEQ ID NO: 2523
  misc_feature 1..5216: note = Cas9 variant mRNA product
  source 1..5216: mol_type = other RNA

SEQ ID NO: 8324 - RNA, 3488 nt, synthetic construct
  misc_feature 1..3488: note = Cas9 variant mRNA product
  source 1..3488: mol_type = other RNA
gggagagtcccgcagtcggcgtccagcggctctgcttgttcgtgtgtgtgtcgttgcaggccttattcaagcttaccatggcccccaagaagaagcgcaaagtgggcatccacggggtcccggccgcgaagcggaactacatcctgggcctcgacatcgggatcaccagcgtgggctacgggatcatcgactacgaaacccgcgatgttatcgacgccggcgtccggctgttcaaggaggccaacgtggagaacaacgaaggccgccggtccaagcgcggggcccggcgcctgaagcggcgccggcgccaccggatccagcgcgtgaagaagctcctgttcgactacaacctgctcacggaccacagcgagctgtcgggcatcaacccctacgaggcccgggtcaagggtctcagccagaagctctccgaggaggagttcagcgcggccctgctgcacctcgccaagcgcaggggcgtgcacaacgtgaacgaggtcgaggaggacaccgggaacgagctctccaccaaggagcagatcagccgcaactccaaggccctggaggagaagtacgtggcggagctccagctcgagcggctgaagaaggacggcgaggtgcgcggcagcatcaaccggttcaagacctccgactacgtcaaggaggccaagcagctcctgaaggtgcagaaggcctaccaccagctggaccagagcttcatcgacacgtacatcgacctcctggagacccgccgcacctactacgaggggcccggcgaggggtcccccttcggctggaaagacatcaaggagtggtacgagatgctgatgggccattgcacctacttcccggaggagctccgaagcgtgaagtacgcctacaacgccgacctgtacaacgcgctcaacgacctcaacaacctggtcatcacgcgcgacgagaacgagaagctggagtactacgagaagttccagatcatcgagaacgtgttcaagcagaagaagaagcccaccctcaagcagatagccaaggagatcttggtgaacgaggaggacatcaaggggtaccgggtcacctccaccggcaagcccgagttcacgaacctaaaggtgtaccacgacatcaaggacatcaccgcccgcaaggagatcatcgagaacgccgagctcctggaccagatcgccaaaatcctgaccatctaccagagctccgaggacatccaggaggagctcaccaacctgaacagcgagctgacacaggaggagatcgagcagatctccaacctcaaggggtacaccggcacccacaacctgagcctgaaggcgatcaacctcatcctggacgagctgtggcacaccaacgacaatcagatcgccatctttaaccggctcaagctggtgcccaagaaggtcgacctgagccagcagaaggagatcccgacgaccctcgtggacgacttcatcctgtcccccgtggtcaagcgcagcttcatccagtccatcaaggtgatcaacgccatcatcaagaagtacgggctacccaacgacataatcatcgagctggcccgggagaagaacagcaaggacgcccagaagatgatcaacgagatgcagaagcgcaaccggcagaccaacgagcgcatcgaggaaatcatccggaccacgggcaaggagaacgcgaagtacctcatcgagaagatcaagctgcacgacatgcaggagggcaagtgcctgtactccctcgaggccatccccctggaggacctgctcaacaacccgttcaactacgaggtggaccacatcatcccccgcagcgtgtccttcgataacagcttcaacaacaaggtgctggtcaagcaagaggagaactccaagaaggggaaccggacccccttccagtacctgagctccagcgactccaagatcagctacgagaccttcaagaagcacatcctcaacctggccaagggcaaagggcgcatctccaagaccaagaaggagtacctgctcgaggaacgggacattaaccgcttcagcgtgcagaaggacttcatcaaccggaacctggtggacacgcgctacgccacccggggcctgatgaacctcctgcgctcctactttcgcgtcaacaacctggacgtgaaggtcaagagcatcaacgggggcttcacctccttcctcaggcgcaaatggaagttcaagaaggagcggaacaagggctacaagcatcacgccgaggacgcgctgatcattgccaacgccgacttcatcttcaaggagtggaagaagctggacaaggccaagaaggtgatggagaaccagatgttcgaggagaagcaggcggagagcatgcccgagatcgagaccgagcaggagtacaaggagatcttcatcacgccgcaccagatcaagcatatcaaggacttcaaggactacaagtacagccatcgcgtggacaagaagcccaatcgggagctcatcaacgacacactgtactccacccgcaaggacgacaaggggaacaccctgatcgtgaacaacctcaacggcctgtacgacaaggacaacgacaagctgaagaagctcatcaacaagagccccgagaagctcctgatgtaccaccacgacccccagacttaccagaagctcaagctgatcatggagcagtacggggacgagaagaacccgctgtacaaatactacgaggagaccggcaactacctcaccaagtactccaagaaggacaacgggcccgtcatcaagaagatcaagtactacggcaacaagctgaacgcccacttggacatcaccgacgactaccccaacagccggaacaaggtggtgaagctctccctgaagccctaccgcttcgacgtctacctggacaacggcgtgtacaagttcgtcaccgtcaagaacctcgacgtgatcaagaaggagaactactacgaggtgaacagcaagtgctacgaggaggctaagaagctgaagaagatctccaaccaggccgagttcatcgccagcttctacaacaacgacctgatcaagatcaatggtgagctctaccgggtcatcggcgtgaacaacgacctgctgaaccgcatcgaggtgaacatgatcgacatcacgtatcgggagtacttagagaacatgaacgacaagcgcccgcccagaatcatcaagaccatcgcgtccaagacccagagcatcaagaagtactcaaccgacatcctggggaacctgtacgaggtaaagagcaagaagcacccccagatcatcaagaagggcaagcgccccgccgccacgaagaaggccggtcaagccaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 8325 - RNA, 4556 nt, synthetic construct
  misc_feature 1..4556: note = Cas9 variant mRNA product
  source 1..4556: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgctgttcaacaagtgcattatcatcagcatcaacctggacttctccaacaaggagaaatgcatgaccaagccctacagcataggcctggacatcgggacgaactccgtgggctgggccgtgatcacggacaactataaggtccccagcaagaagatgaaggtgctggggaacacttccaagaagtacattaagaagaacttactgggcgtgctgctgttcgacagcggcatcaccgccgaggggcggcgcctgaagcggaccgcgcgccggcgctacacgcggcgccggaaccgcatcctgtacctccaggagatcttctctaccgagatggccaccctggacgacgcgttcttccagcggctggacgacagcttcctcgtgcccgacgacaagcgcgactccaagtacccgatcttcggcaacctggtggaggagaaggtgtaccacgacgagttccccaccatctaccacctccggaagtacctcgccgacagcacgaagaaggccgacctgcgcctcgtctacctcgccttagcgcacatgattaagtaccggggccacttcctgatcgagggcgagtttaactccaagaacaacgacatccaaaagaacttccaggacttcctcgacacctacaacgccatcttcgagagcgacctgtccctggagaacagcaagcagctcgaggagatcgtgaaggacaagatttccaagctggagaagaaggaccgcatcctgaagctgttccccggggagaagaacagcggcatcttctctgagttcctgaagctgatcgtgggcaaccaggctgacttccggaagtgcttcaacctcgatgagaaggcaagccttcacttctccaaggagagctacgacgaggacctggagaccctcctgggatacatcggcgacgactatagcgatgtcttcctgaaggctaagaagctctacgacgcgatcctgctgtccgggtttctcaccgtgacggacaacgagaccgaggcgcccctgagctccgccatgatcaagcgctacaacgagcacaaggaggacctcgccctcctgaaggagtacatccggaacatcagcctgaagacctacaacgaggtgttcaaagacgacaccaagaacggatacgccggctacattgacgggaagacgaaccaggaggacttctacgtatacctcaagaacctgctggccgagttcgagggcgccgactatttcctcgagaaaatcgaccgcgaggacttcctgcgcaagcagcgcaccttcgacaacgggtccatcccgtaccagatccaccttcaggagatgcgcgccatcctggacaagcaggccaagttctaccctttcctagccaagaacaaggagcggatcgagaagatcctgaccttccgcatcccctactatgtgggcccgctggcgcgggggaacagcgacttcgcttggtccatccgcaagcggaacgagaagatcaccccgtggaacttcgaggacgtgatcgacaaggagagctccgctgaggccttcatcaaccgcatgacgagcttcgacctctacctgcccgaggagaaggtcctgcctaagcactccctcctgtacgagaccttcaacgtgtacaatgagctgaccaaggtgcggttcatcgccgagagcatgcgcgactaccaattccttgactccaagcagaagaaggacatcgtccggctttacttcaaggacaagcgcaaggtgaccgacaaggacatcatcgagtacctgcacgcgatctacggctacgacggcatcgaactcaaggggatcgagaagcagttcaacagcagcctgagcacgtaccacgacctgctcaacatcattaacgacaaagagttcctggacgactccagcaacgaggctatcatcgaggagatcatccacaccttaaccatcttcgaggaccgggagatgatcaagcaacgcctctccaagttcgagaacatcttcgacaagagcgtgctgaagaagctgagccgtcgccactataccggctgggggaagctctccgccaaacttatcaacggcatccgggacgagaagtccgggaatacaatcctggactacctcatcgatgacggcatcagcaatcgcaacttcatgcagctgatccacgacgacgccctgagcttcaagaagaagatccagaaggcgcagattatcggcgacgaggacaagggtaacatcaaggaagtcgtgaagtccctccccggcagcccggccatcaagaagggaatcctgcagtccatcaagatcgtagacgagctggtgaaggtgatgggcgggcggaagcccgagagcatcgtcgtggagatggcccgagagaaccagtacaccaaccagggcaagtccaacagccagcagaggctcaagcgcctggagaagtcactgaaggagctcggcagcaagatcctgaaggagaacatccccgccaagctgagtaagatcgacaacaacgccctacagaacgaccgcctgtatctgtactacctccagaacgggaaggacatgtataccggagacgacctggacatcgaccggctgagcaactacgacatcgaccacataatcccccaggcgttcctcaaggacaactccatcgacaacaaggtgctggtcagctccgccagcaaccgcggaaagtccgacgacttcccgagcctggaggtggttaagaagcggaagactttctggtaccagttgctcaagagcaagctgatttcccagcgcaagttcgacaacctgacgaaggccgaacggggcggcctgctgcccgaagacaaggcaggcttcatccaacgccagctcgtcgaaacccggcaaatcaccaaacacgtggcccgcctgctggacgagaagttcaacaacaagaaggacgagaacaaccgggcggtgaggaccgtaaagatcatcacgctcaagagcaccctggtgtcccaattccggaaagacttcgagttgtacaaggtgcgcgagatcaacgacttccaccatgcccacgacgcctacctcaacgccgtcatcgccagcgcgctgctgaagaagtaccccaagctcgagcctgagtttgtgtacggcgactacccgaaatacaactccttccgtgagcgcaagagcgccaccgagaaggtgtacttctattccaatatcatgaacatcttcaagaagtccatctccctggctgacgggcgggtgatcgagcgccccctgatcgaagtgaacgaggagacgggcgagagcgtgtggaacaaggagtccgacctcgccaccgtccggcgcgtgctgagctacccccaggtgaacgtcgtaaagaaggtggaggaacagaaccacgggctggaccggggcaagcccaagggcctcttcaacgcgaacctgtccagcaagccgaagcccaactccaacgagaacctggtcggggccaaggaatacctcgaccccaagaagtacggcgggtacgccggcatcagcaactccttcgccgtgctggtcaaggggacgatcgaaaagggagccaagaagaagatcaccaacgtcctggagttccagggcatcagcatcctcgaccgcatcaactaccggaaagacaagctgaacttcctgttagagaaggggtacaaggacatcgagctgatcatcgaactgccgaagtactcactcttcgagctgtccgacggcagccgccggatgctcgcgtcgatcctcagcaccaacaataagcgtggggagatacataagggcaaccagattttcctgtcccagaagttcgtgaagctgctctaccacgccaagcggatcagcaacaccatcaacgagaaccaccgaaaatacgtggagaaccacaagaaggagttcgaggagctgttctactacatcctggagttcaacgagaactacgtcggtgccaagaagaacggaaagctcctgaacagtgccttccagagctggcagaaccattcgatcgacgagctatgcagctccttcatcggccccacggggagcgagcgcaagggcctcttcgagctaacatcccgggggagcgccgcagactttgagttcctgggcgtgaagataccccgctaccgggactacaccccctccagcctcctgaaagacgccaccctgatccaccagtccgtgacggggctgtacgagacccgcatcgacctcgccaagctgggcgagggcaagaggccggccgccaccaagaaggcagggcaggccaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 8326 - RNA, 3632 nt, synthetic construct
  misc_feature 1..3632: note = Cas9 variant mRNA product
  source 1..3632: mol_type = other RNA
gggagagtcccgcagtcggcgtccagcggctctgcttgttcgtgtgtgtgtcgttgcaggccttattcaagcttaccatggcacccaaaaagaaacgcaaagtaggaatacacggagtgccggcagcatggtacgcgagccttatgagcgcccaccatctacgcgttggaatcgacgtaggcacccacagcgtaggactagccacactccgagtagacgaccacggaaccccaattgaattactatcggcactgagccacatccacgatagtggagtcgggaaagaaggaaagaaagaccacgacacacgaaagaaactgtcaggaatagcaagacgcgctcgaagactattacaccaccgacgaacacagctccaacaactagacgaagtcctacgagatctaggcttcccaatcccaacaccgggagagttcctagacttaaacgaacaaaccgacccataccgcgtgtggcgagtccgagcacgactcgtggaagagaaactcccagaggaattacgcggaccagccataagcatggcagtgaggcacatcgcccgacaccgagggtggaggaacccgtatagtaaagtagaatccctactaagccccgccgaggaaagcccattcatgaaagcactccgcgaacgaatcctcgcaaccaccggcgaagtactagacgatggcataacgccgggccaagctatggcccaagtcgcactgacccataacatctcaatgcgcggaccagaaggcatactaggaaaactacaccaatccgataacgcaaacgaaatccggaaaatatgtgcccgccagggggtcagccccgacgtttgcaaacagctactccgggccgtattcaaagccgactcacctagaggcagcgccgtgagtagagtagcacccgatccccttcccggtcaggggagcttccgcagagccccaaaatgcgacccagagttccagcgcttccgaataatatccatagtggcaaacctgcgaatatctgaaacgaaaggcgaaaacagaccactaaccgccgacgaacgcagacacgtcgtcaccttcctaacggaagacagtcaagccgatcttacttgggtggacgtcgcagaaaaactcggagttcaccgccgggacttaaggggaacagccgtacacaccgacgacggagaaagaagtgccgcccggcccccaatcgacgcaacggatagaatcatgagacagaccaaaatcagttccctcaaaacgtggtgggaagaagccgacagcgaacagagaggcgcaatgatcaggtacctgtacgaagacccaaccgattctgaatgcgcagaaatcatagctgaactcccagaagaagatcaagccaaactagactccctacacttacccgcaggacgcgccgcatacagcagagagagtctaacagccttaagcgaccacatgctcgcgacaaccgacgacctccacgaggcacgaaaacgccttttcggcgttgacgacagctgggccccacccgccgaagcaatcaacgcccccgtcgggaacccctcggtggaccgcacattaaaaatagtagggcgatacctctcagcagtcgaatctatgtggggcacgccagaagtcattcacgtagagcacgtccgagacgggttcacgagcgagcgcatggccgacgaacgagacaaggcaaaccgacgaagatataacgacaaccaagaagcaatgaagaaaatccagagagactacggaaaagaaggctacatatccagaggggacatagtaaggctggacgccctcgaactccagggatgtgcctgtctctactgcgggacaacaattggataccacacgtgccaactagaccacatcgtaccccaggcaggaccaggaagcaacaaccgccgagggaacctagtcgctgtatgcgaaagatgcaaccgctcgaaatcaaacaccccctttgcagtttgggcccaaaaatgcggcatcccccacgtcggagtaaaggaagcgatcggcagagtcaggggctggagaaagcaaacaccaaacacatcaagcgaagatcttacaaggctaaagaaggaggtcatcgcacgactaagacgaacacaggaggacccagaaatcgacgaaaggtccatggagagcgtagcctggatggcaaacgaactccaccacagaatcgcggccgcatacccagagacaaccgttatggtctatagaggtagtatcacagcggctgcacggaaagccgccggaatagactcccgcatcaatcttataggagagaagggacgaaaagacagaatcgaccgccggcaccacgccgtggatgcctccgtcgtcgcgctaatggaggcaagcgtcgcaaaaacactagccgaacgcagcagcctgcgcggcgaacagcgcctaaccggaaaagaacagacctggaaacaatatacaggcagtaccgtaggagccagagaacacttcgaaatgtggagaggccacatgctccacctcacggaactgttcaatgaaagactagccgaagacaaagtttacgtaacacagaacatacgcctgcgactcagcgacggcaatgcacacaccgtcaaccccagcaaactcgtatcacaccgactcggcgacggactcacagtacaacaaatcgaccgcgcgtgcactccagccctgtggtgtgccctaacccgagaaaaagacttcgacgagaaaaacggcctaccggcacgagaagaccgggccatccgagtgcatgggcacgaaataaaatcgtcagactacatacaagtgttctccaaaagaaagaaaaccgactcagaccgagatgagacaccgttcggagcaatagcggtacgtggagggttcgtcgagatcggacccagcatccaccacgccagaatatacagagtagaaggaaagaaaccagtctacgcaatgctcagggtgttcacacatgacctcttaagccagcgacatggcgacctatttagcgcggtgataccaccacaaagtatcagcatgagatgcgcggaacccaaactccgcaaagcgataacaacgggaaacgccacatatctagggtgggtcgtagtgggcgacgagcttgaaataaacgtagacagtttcaccaaatacgctattggacgcttcctcgaagacttcccaaacacaacacgatggcgcatctgcggttacgatacaaactcaaaactcacgctgaagccaatcgtcctggccgccgaaggactcgaaaacccgtcctcagccgtcaacgagatcgttgaactgaagggatggagagtagcgatcaacgtcctcacaaaagtccacccaacagtagtccgacgcgacgcactaggacgaccgcgctatagttcgagatcaaacctaccaacaagctggacgatcgagaaacgcccagccgcaacaaagaaagccggacaagcgaagaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 8327 - RNA, 4493 nt, synthetic construct
  misc_feature 1..4493: note = Cas9 variant mRNA product
  source 1..4493: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtccctgccgcgaccaagccctacagcatcggcctggacatcgggaccaactccgtgggctgggccgtgacgaccgacaactacaaggttcccagcaagaagatgaaggtgctcgggaacactagcaagaagtacatcaagaagaacctattaggcgtgctcctgttcgacagcggcatcacggccgaggggcggcgcctgaagcggacggcccgcagacgctacacccggcgccggaatcgcatcctctatctgcaagagatcttctccaccgagatggccaccctagacgacgccttcttccaacggctagacgacagcttcctggtccccgacgacaagcgcgactccaaatacccgatcttcggcaacctggtggaggagaaggcctaccacgacgagttccccaccatctaccacctccggaagtacttggccgacagcaccaagaaggccgacctgcgcctcgtgtacctggcgctggcccacatgatcaagtaccgggggcactttctcatcgagggcgagttcaactccaagaacaacgacatccagaagaacttccaggacttccttgacacctacaacgccatcttcgaaagcgacctgtccttggagaatagcaagcagctggaggagatagtcaaggacaagatctccaagctggagaagaaggaccgcatcctcaagctgttccccggggagaagaacagcggcatcttctccgagttcctgaaactcatcgtgggcaaccaggccgacttccggaagtgcttcaacctggacgagaaggccagtctgcacttctccaaggagagctacgacgaggacctcgagaccctgctggggtacatcggcgacgactactccgacgtgttcctcaaggcgaagaagctgtacgacgccatcctgctcagtgggtttctgacggtcaccgacaacgagaccgaggcgcccctgagctccgccatgatcaagcgctacaacgagcacaaggaggacctcgcactgctgaaggagtacatccggaacatcagcctcaagacctacaacgaggtgttcaaggacgacacgaagaacggctacgccggctacatcgacggaaagaccaaccaggaggacttctacgtgtacctgaagaagctgctcgccgagttcgagggcgcagactacttccttgagaagatcgaccgcgaggacttcctgcggaagcagcgcaccttcgacaacggttccatcccgtaccaaatccacctccaggagatgcgcgccatcctggacaagcaggccaagttctaccccttcctggcgaagaacaaggaacggatcgaaaagatcctgaccttccgcatcccctactacgtcggccctctcgcccgggggaacagcgacttcgcctggtccatccgcaagagaaacgagaagatcacgccttggaacttcgaggacgtgatcgacaaggagagctccgccgaggccttcatcaatcgcatgaccagcttcgatctgtacctccccgaggagaaggttcttcccaagcactcgctgctgtacgagaccttcaacgtctacaacgagctcaccaaggtgcggttcatcgcggagagcatgcgcgactaccagttcctggactccaagcagaagaaggacatcgtgcggctgtacttcaaggacaagcgcaaggtcacggacaaggacattatcgagtacctccacgcaatctacggctacgacggcatcgagctgaaggggatcgagaagcagttcaacagctccctgagcacctaccacgacctcctgaacatcatcaacgacaaggagttcctggatgactccagcaacgaagccatcatcgaggagatcatccacaccctcaccatcttcgaggaccgggagatgatcaagcagcgcctgtcaaagttcgagaacatcttcgacaagagcgtgctgaagaagctctcccggcgccactacacgggctgggggaagctgagcgccaagctgatcaacggcatccgggacgagaagtccgggaacaccatcctcgattacctgatcgacgacggcatcagcaaccgcaacttcatgcagctgatccacgacgacgcgctcagcttcaagaagaagatccagaaagcacagatcatcggcgacgaggacaaggggaacatcaaggaggtggtcaagtccctgcccggcagcccggccatcaagaaagggatcctgcagtccatcaagatcgtggacgagctcgtcaaggtgatgggcgggcgaaagcccgagagcatcgtggtcgagatggcccgcgagaaccagtacaccaaccagggcaagtccaacagccagcagcggctgaagcgcctggagaagtccctcaaggagctgggcagcaagatactgaaggagaacatccccgccaagctctccaagatcgacaacaacgcgctgcagaacgaccgcctgtacttgtactacttgcagaacgggaaggacatgtacaccggcgacgacctggacatcgaccggctaagcaactacgacatcgaccacatcatcccccaggccttcctgaaggacaactccatcgacaacaaggtgctggtgagctccgcgagcaaccgcgggaagtccgacgacgtcccgagcctcgaggtggtgaagaaacggaagacgttctggtaccagctgctcaagagcaagctgatctcccagcgcaagtttgacaacctgaccaaagcagagcgtggcggcctgagccccgaggacaaggccgggttcatccaacgccagctcgtcgagacccggcagatcaccaagcacgtggcgcgcctgctggacgagaagttcaacaacaagaaggacgagaacaaccgggccgtgcgcacggtcaaaatcatcaccctcaagtccaccctggtgagccagttccgaaaggacttcgagctgtacaaggtgcgcgagatcaacgacttccaccacgcccacgacgcctacctcaacgccgtggtggcgtccgccctgctgaagaagtaccccaagctcgagcccgagttcgtgtacggcgactacccgaagtacaatagcttccgggaacgcaagtccgccaccgagaaggtctacttctacagcaatatcatgaacatattcaagaagtccatcagcctggccgacgggcgggtgatcgagcgccccctgatcgaggtgaacgaggagaccggcgaatccgtctggaacaaggagagcgacctcgcgacggtgcggcgcgtcctgtcctacccccaggtcaacgtggtgaagaaggtcgaggagcagaaccacgggctggaccgggggaagcccaagggcctcttcaacgccaacctgagctccaagccgaagcccaacagcaacgaaaacctggtgggggccaaggagtacctcgaccccaagaagtacggcgggtacgccggcatctccaacagcttcaccgtgctggtcaaggggaccatcgagaagggcgccaagaagaagatcaccaacgtgctggagttccagggcatctccatcctcgatcgcatcaactaccggaaggacaagctgaacttcctgctcgagaaggggtacaaggacatcgagctgatcatcgagctgccaaagtacagcctcttcgagctgagtgacggctcccgccgcatgctggcgagcatcctctccacgaacaacaagcgcggggagatccacaagggcaaccagatcttcctgagccagaagttcgtgaagctgctctaccacgccaagcggatctccaacaccataaacgagaaccaccggaaatacgttgagaaccacaagaaggagttcgaggagctgttctactacatcctggagttcaacgagaactacgtcggggccaagaagaacgggaagctcctgaacagcgcctttcagtcctggcagaaccacagcatcgacgagctgtgctctagcttcatcggccccacagggtccgagcgcaagggcctcttcgaactgaccagccgggggtccgccgcggacttcgagttcctgggcgtgaagatcccccgctaccgggactacacgcccagctccctcctcaaggacgctaccctgatccaccagagcgtcacggggctctacgagacccgcatcgacctggccaagttgggagagggcaagcggccggccgccacgaagaaggcgggtcaggccaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 8328 - RNA, 3575 nt, synthetic construct
  misc_feature 1..3575: note = Cas9 variant mRNA product
  source 1..3575: mol_type = other RNA
gggagagtcccgcagtcggcgtccagcggctctgcttgttcgtgtgtgtgtcgttgcaggccttattcaagcttaccatggcaccgaaaaagaaacgcaaagtgggcatccacggagtaccagccgctgccgccttcaaaccaaacagcataaattatatcctcggcctagatatcggtatcgcctccgtagggtgggccatggtcgagattgatgaagaagaaaacccaatcaggctcatagacctaggcgtacgagtcttcgaacgcgccgaagtcccaaaaacaggagattccctcgctatggcacgaagactagcaagaagcgtgagacgacttacccgccgacgcgcccaccgcctcctccgaactcgtcgcctcctaaagcgcgaaggagtcctccaagccgccaatttcgacgaaaacggtctaatcaaaagcctccccaacacgccatggcaactccgagcagcggccctagaccggaaactaacacccctagaatggtccgctgtcctactgcacctcatcaaacaccgcggatacctaagccagaggaaaaacgaaggagagaccgccgacaaagaactaggcgcgctactgaaaggtgtagcaggcaacgcacatgccctacagacgggtgactttcgaacaccggcagagctcgcacttaacaaattcgaaaaagaatctggacatatccgaaatcaaagatccgactacagccacacattcagccgaaaagatctacaagccgaactcatccttctattcgaaaaacaaaaagagttcggaaatccccacgtatcgggcggactgaaggaagggatcgaaaccctactcatgacacaacggcccgccctatcaggcgatgccgttcagaaaatgctaggccactgcacattcgaaccagccgaaccaaaggcggccaaaaacacctacacagcggaacgcttcatctggttaactaaactgaataacttacgcatactcgaacaaggctctgaacgacccctcacggatacagaacgcgcaaccctaatggacgagccctaccgcaaaagcaaactgacctatgcacaagcgagaaaactcctaggactcgaagacacagccttcttcaaaggtctcaggtacggaaaagataacgccgaggccagcacactcatggaaatgaaagcctaccatgccatcagccgagccctggaaaaagagggcctcaaagataagaaaagccctctcaaccttagccccgaacttcaagatgaaatcggaaccgcatttagcctcttcaaaacagacgaagacatcaccggacgactgaaagaccgcatccaaccagagatactcgaggcgctgctaaaacacatatccttcgacaaattcgtacaaatcagcttaaaggcactacgccggatagtacccctaatggaacaagggaaacgatacgacgaagcatgtgccgaaatatacggtgatcactacggaaagaaaaacactgaagaaaagatctacctcccaccaatacccgccgacgaaataaggaaccccgtagtactacgtgccctctcacaagcacgcaaagtcattaacggagtagtcagaagatatggcagccccgcgcggatccacatcgaaacagcccgcgaagtaggcaaatctttcaaagatcgcaaagaaatcgagaaaagacaagaagagaatagaaaagatcgagagaaagccgccgcaaaattccgagaatatttccccaacttcgtcggtgaaccaaaaagtaaagacatcctcaaactccgcctctatgagcaacagcacggaaaatgcctatacagcggaaaagaaatcaacctcggccggctaaacgagaagggatacgtagaaatagaccacgccctcccattctcgcgaacatgggacgactcttttaataacaaagtcttagtcctcggatcagagaaccaaaacaaaggaaatcaaacgccatacgagtacttcaacggcaaggacaacagcagagaatggcaagagttcaaagcacgagtggaaacctcccgattcccacgctccaagaaacaaagaatcctactccagaaattcgacgaagacgggttcaaagaacgcaacctgaacgatacacggtacgtcaaccgcttcttatgccaattcgtggcggaccgcatgcgcctcacgggaaaaggtaagaaacgggtattcgccagcaacggacagataacgaacctcctccggggattctggggcctccgaaaagtccgggcagaaaacgaccgacaccacgcgctagacgcggttgtcgttgcttgcagcaccgtcgccatgcagcagaaaataaccagatttgtcagatacaaagagatgaacgcctttgacggaaaaactatcgacaaagagacaggcgaagtactacaccaaaagacacacttcccgcaaccatgggagttcttcgcccaagaagtcatgataagggtattcgggaaaccagacggcaaaccagagttcgaagaagcagacaccctagaaaagctccgcaccctactggcagaaaagttgagcagccgccccgaagccgtacacgaatacgtaacaccactcttcgtctcccgagcacccaaccgaaaaatgagcggccaaggccacatggaaaccgtaaaatccgccaagcgcctggacgaaggcgtctccgtactaagagtacccctcacccaactcaagctaaaagacctggagaaaatggttaacagagaaagagaaccaaagctatatgaggccctcaaggcgcgcctcgaggcacacaaagacgacccagcaaaagcattcgctgaacccttctataaatacgataaagccgggaacagaacacaacaggtaaaggccgtccgggtagaacaggtacagaagaccggagtctgggtccgaaaccataatggcatcgcagacaacgcaacaatggtacgcgtcgatgtgttcgaaaaaggcgacaagtactacctagtacccatatacagctggcaggtcgcgaaaggcatcctaccggacagggccgtagtccagggcaaagatgaagaagactggcagctaatcgatgattccttcaactttaaattcagcctacacccaaatgacctcgtagaagtaatcaccaaaaaggcaagaatgttcggatacttcgccagctgccacagaggaaccggaaacatcaacattcggatacacgacctcgatcacaaaataggcaagaatggcatactcgagggcataggggtcaaaaccgcactatccttccagaagtaccaaatcgacgagcttggaaaagaaatccggccctgtcgactgaagaaaaggccaccagttcggaagagaccggccgccaccaaaaaggcaggtcaagccaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 8329 - RNA, 4331 nt, synthetic construct
  misc_feature 1..4331: note = Cas9 variant mRNA product
  source 1..4331: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgaagaagccatacaccatcggcctggacatcgggaccaacagcgtgggctgggccgtgctcaccgaccagtacgacctggtcaagcggaagatgaagatcgccggggactccgagaagaagcagatcaagaagaacttctggggcgtgcgcctgttcgacgagggccagaccgccgctgaccggcgcatggcgcggaccgcccgccggcgcattgagcggcgccggaaccgcatcagctacctccagggaatcttcgccgaggagatgtccaagaccgatgccaacttcttctgccggctgagcgactccttctacgttgacaacgagaagcgcaacagccggcaccccttcttcgcgacgatagaggaggaggtcgagtatcacaagaactaccccacaatctaccacctccgcgaggaactcgtgaactccagcgaaaaggccgacctgcgtctagtgtacctcgccctggcccacatcatcaagtaccgcggcaacttcctgatcgagggggccctcgacacccagaacacctccgtcgacggcatctacaagcagttcatccagacgtacaaccaggtgttcgcgtccgggatcgaggacggctcccttaagaagctggaggacaataaggacgtggccaagatcctcgtcgagaaggtgacccggaaggagaagctggagcgcatcttaaagctctacccgggcgagaagtccgccgggatgttcgcccagttcatcagcctaatcgtgggcagcaaggggaacttccagaagcccttcgacctgatcgagaagtccgacatcgagtgcgccaaggactcgtacgaggaggacctcgagtccctgctggcgctcatcggggacgagtacgccgagctgttcgtcgccgccaagaatgcctacagcgcggtggtgctgagtagcatcatcaccgtcgccgagaccgagacgaacgccaagctcagcgcctccatgatcgagcggttcgacacccacgaggaggacctgggcgagctgaaggcattcatcaagctccacctccccaagcactacgaggagatcttcagcaacaccgagaagcacgggtacgcgggctacatcgacgggaagaccaagcaggccgacttctacaagtacatgaagatgacgctggagaacatcgagggcgccgactacttcatcgccaagatcgagaaagagaacttcctgcgcaagcagcgcacattcgacaacggggcgattccccaccaactgcacctggaggagctcgaggccatcctgcaccagcaggccaagtactacccgttcctgaaggagaactacgacaagatcaagtccctcgtgaccttccggatcccctacttcgtgggccccctggccaacggccagagcgagttcgcctggctgacccgcaaggcggacggggagatccggccctggaacatcgaggagaaggtcgattttggcaagtccgccgtagacttcatcgagaagatgacgaacaaggacacctacctcccgaaggagaacgtgctgcccaagcacagcctgtgctaccagaagtacctcgtctacaacgagctgaccaaggtgcgctacatcaacgaccaggggaagacctcgtatttcagcggccaggagaaggagcagatcttcaacgacctgttcaagcagaagcggaaggtcaagaagaaggacctcgagctgttcctgcgtaacatgtcccacgtggagagccccacgatcgaggggctggaggactccttcaacagctcctacagcacctaccacgacctcctgaaggtgggcatcaagcaggagatcctggacaaccccgtcaacacagagatgctcgagaatatcgtgaagatcctgacagtgttcgaggacaagcggatgatcaaggagcagctgcagcagttctccgacgttctcgacggcgtggtgctgaagaagctggagcgccggcactacacggggtggggccgcctcagcgccaagctgctgatggggatccgggacaaacagtcccacctcaccatcctggactacctgatgaacgacgacggcctcaatcgcaacctgatgcagctgatcaacgacagcaacctttcattcaagagcatcatcgagaaggagcaggtcaccaccgccgacaaggatatccagagcatcgtggccgacctggcgggatccccggccatcaagaagggcatcctgcagagcctcaagatcgtggacgaactggtctccgtgatgggctacccgccccagacgatcgtggtcgagatggcccgggagaaccagactaccgggaagggcaagaataacagccgcccccggtacaagtccctggagaaggccatcaaggagttcgggagccagatccttaaggagcaccccaccgataatcaggagctgcgcaacaaccgactgtacctctactacctgcagaacggcaaggacatgtacacgggccaggaccttgacatccacaacctctccaactacgacatcgaccatatcgtgccccagagcttcatcaccgacaactccatcgacaacctggtgctgaccagctccgccgggaaccgcgaaaagggcgacgacgtcccgcccctcgagatcgtgcgcaagcgcaaggtgttctgggagaagctgtaccaggggaacctgatgagcaagcgcaagttcgactacctgaccaaggcggagcggggcgggctgaccgaagccgacaaggcccgcttcatccaccggcagctggtcgagacgcgccagatcaccaagaacgtggccaacatcctccaccagcggttcaactacgagaaggacgaccacggcaacaccatgaagcaggtccgcatcgtgaccctgaagtccgcgctggtgagccagttccggaagcagttccaactctacaaggtgcgcgacgtcaacgactaccaccacgcccacgacgcctacctgaacggcgttgtggcgaacactctgctcaaggtctacccccagctggagcccgagttcgtgtacggggactaccaccagttcgactggttcaaggccaacaaggcgaccgccaagaagcagttctacaccaacatcatgttgttcttcgcccagaaggaccggatcatcgacgaaaacggtgagatcctctgggataagaagtacctggacaccgtgaagaaggtcatgtcctaccgccagatgaacatcgtgaagaagacggagatccagaagggggagttctcgaaggccaccatcaagcccaagggcaactccagcaagttaatcccccggaagaccaactgggacccgatgaagtacgggggcctcgacagccccaacatggcctacgcggttgtcatcgaatacgccaagggcaagaacaagctggtgttcgagaagaagatcatccgcgtgaccatcatggagcggaaggccttcgagaaggacgagaaggccttcctggaggagcaggggtaccgccagccgaaggtcctcgccaagctgccgaagtacacgctgtacgagtgcgaggagggccggcgccggatgctcgcgtccgcaaacgaggcccagaaggggaaccagcaggtcctgcccaaccacctggtgaccctcctgcaccacgccgcgaactgcgaggtgagcgacggcaagtccctggactacatcgagagcaaccgcgagatgttcgcggaactcctggcccatgtgtccgagttcgccaagcggtacaccctggccgaggcgaacctcaacaagatcaaccagctgttcgagcagaacaaggagggggacatcaaggccatcgcccagagcttcgtggacctgatggccttcaacgccatgggcgcgcccgcctccttcaaattcttcgagaccacgatcgagcgcaagcggtacaacaacctcaaggagctgctgaacagcaccatcatctaccaatccatcaccggcctctacgagtctcgcaagcgcctcgacgacaagcggcccgccgccaccaagaaggcagggcaggcgaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 8330 - RNA, 4364 nt, synthetic construct
  misc_feature 1..4364: note = Cas9 variant mRNA product
  source 1..4364: mol_type = other RNA
gggagagtcccgcagtcggcgtccagcggctctgcttgttcgtgtgtgtgtcgttgcaggccttattcaagcttaccatggctcccaagaagaaacgcaaggtgggcatccacggggtcccggcagcgaagaagccctacagcatcggcctggacatcggcaccaattccgtgggttgggccgtggtaaccgacgactacaaggtgcccgccaagaagatgaaggtgctcgggaacacggacaagagccacatcgagaagaacctgctgggcgccctactgttcgactccggcaataccgccgaggatcggcgcctaaagcggaccgcgcgcagacgatacacccggcgccggaaccgcatcctctaccttcaggaaatcttctcagaggagatgggaaaggtcgacgactccttcttccaccggctggaggacagcttcctcgtgacggaagacaagcgaggcgagcggcaccccatcttcgggaacctggaggaggaagtgaagtaccatgagaacttcccgaccatctaccacctccgccagtacctggccgacaatcccgagaaggttgacctgcggctggtgtacctcgccctggcccacatcatcaagttccgcgggcacttcctgattgaggggaagttcgacacgcggaacaacgacgtgcaacgcctctttcaggagttcctggcggtctatgataacacgttcgagaactccagccttcaggagcagaacgtccaggtggaggagatcctcaccgacaagatctctaaaagcgccaagaaggaccgggtgctgaagctgttccccaacgaaaagtccaacggccgcttcgccgagttcctcaagctgatcgtgggcaaccaggccgacttcaagaagcatttcgagctggaggaaaaggccccgctacagttcagtaaggacacctacgaggaggagctggaggtgctgctcgcgcagataggtgataattacgccgagctgttcctgtccgccaaaaagctgtacgacagcatcctgctgtccggcattctaacagtcaccgacgtgggaacgaaggccccgcttagtgcttcaatgatccagcggtataacgaacaccagatggacctggcgcagctaaagcagttcataagacagaagctgagcgacaagtacaacgaagtgttctccgacgtcagcaaggacggctatgccggctacatcgacgggaagaccaaccaggaggccttctacaagtacctgaaggggctcctgaacaagatagaggggagcggctacttcctggacaagatagagcgcgaggacttcctacggaagcagcgtactttcgacaacgggtccataccccaccagatccacctccaggagatgcgggccatcatccgccgtcaggcagagttctaccccttcctcgcggacaaccaggaccgcatcgagaagctgctgaccttcagaatcccctactacgtggggccgctggcccgcggcaagagcgactttgcctggctgtcccgtaagagcgccgacaagataacgccctggaacttcgacgagatcgttgacaaggagagcagcgccgaggcgttcatcaacagaatgaccaactatgacctctacctccccaaccagaaggtcctgcccaagcactccctcctatacgagaagttcaccgtctacaatgagctgaccaaggtgaagtacaaaacggagcaagggaagaccgcgttcttcgacgctaacatgaagcaagagatcttcgacggcgttttcaaagtgtaccggaaggtcactaaagataagctcatggacttcctggagaaggagttcgacgagttccgcatcgtggacctgaccggtctggacaaggaaaacaaggtgtttaacgccagctacggcacgtaccacgacctgtgcaagatactcgataaggacttcttagataactccaagaacgagaagatcctggaggacatcgtcctgaccctcactctgttcgaggaccgggagatgatccgcaagcggctggagaactatagcgacctcctgacaaaggagcaggtcaagaagctggagcgccggcactacactgggtggggtcgcttgtccgcggagctaatccacggcatccggaacaaggagagcaggaagaccatcctagactacttaatcgacgacgggaactccaacaggaacttcatgcagctgatcaacgacgacgccttgtcttttaaggaggaaatcgccaaggcccaggtgatcggcgagaccgacaacctcaaccaagtggtgtccgacatcgccgggtctccggcgatcaagaagggcatcctgcagtccctgaaaatcgtggacgagctcgtcaagatcatgggccaccaacccgagaacatcgtggtggaaatggcccgtgaaaaccagttcaccaatcagggtcgccggaacagccagcagcgactgaagggcctgacggactccatcaaggagttcgggagccagatcctcaaagaacacccagtcgagaacagccaactgcagaatgaccgactgttcctctactacctgcaaaacgggcgcgacatgtacaccggggaggagctggacatcgactacctctcccagtacgatatcgaccacataatcccccaagccttcatcaaagacaacagcatcgataaccgggtgctgacctccagcaaagagaacaggggcaagtccgatgacgtacccagcaaggacgtcgtgcggaagatgaagtcctactggagcaagctgctctccgccaagctgatcacccagcgcaagttcgacaacttgacgaaggctgagcggggcgggctcaccgacgacgacaaggcgggcttcatcaagcgccagcttgtggagacccggcagatcaccaagcacgttgcccggatcctggacgagcggttcaacaccgagacggacgagaacaataagaaaatccgccaggtgaagatcgtgaccctcaagagcaacctggtctccaacttccggaaggagttcgaactgtacaaggtccgagagataaatgactaccaccacgcccacgacgcctacctcaacgccgtgatcgggaaggcgctgctgggcgtctacccccagctcgagcccgagttcgtttacggggactacccccacttccacggccacaaggagaacaaggccaccgccaagaagttcttctacagcaacatcatgaactttttcaagaaggacgatgtgcggactgacaagaacggcgagatcatctggaagaaagacgaacacataagtaacatcaagaaggtcctgagctacccccaggtgaacatcgttaaaaaggtcgaggagcagaccggaggcttctccaaagagtcgatcctccccaaggggaactccgacaaacttatcccccgcaagacgaagaagttctactgggacaccaagaagtacggcgggttcgacagccccatagtggcctacagcatcctggtgatcgcagacatcgagaagggcaagtccaagaaactgaagaccgtcaaggcactcgtgggcgtaacgataatggaaaagatgaccttcgagcgggacccggtcgccttcttggagcgcaaggggtatcgcaatgtgcaggaggagaacatcatcaagctgcccaagtatagcctcttcaagctcgagaacgggcggaagcgcctgctagcctccgccagggagctgcagaaggggaacgaaatcgtgctgcccaaccaccttggaaccctgttataccacgcgaagaacatccacaaggtcgatgagccgaagcatctcgactacgtggacaaacacaaggatgagtttaaggaactgctggacgtggtctcaaacttctccaagaagtacaccctcgccgagggtaatctagagaagatcaaggagctgtatgcccagaacaacggcgaggacctcaaggagctcgctagcagtttcatcaaccttctcactttcacggccatcggggcgcccgccaccttcaagttcttcgataagaacatcgaccgcaagcggtacaccagcacgaccgagatcctgaacgccacgcttatccaccagtccataaccggactctacgagacgcgcatcgacctgaacaagctgggcggggacaagcggcccgccgccaccaagaaggcgggccaagccaaaaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 8331 - RNA, 3497 nt, synthetic construct
  misc_feature 1..3497: note = Cas9 variant mRNA product
  source 1..3497: mol_type = other RNA
gggagagtcccgcagtcggcgtccagcggctctgcttgttcgtgtgtgtgtcgttgcaggccttattcaagcttaccatggcacctaaaaagaaacggaaagtgggcatacacggcgttccagccgcacaaacaaccaacctcagttacatactaggtctagacctcggtatcgcatcagtcggctgggccgtcgtcgaaatcaacgaaaacgaagaccccatcggactaatagacgtcggcgtaaggatattcgaacgcgccgaagtcccaaaaaccggagaaagcctagcactgtccaggagactcgcgcggagtacccgccgcctaatacgccgccgagcccaccgcctactcctcgcgaaacgcttcctcaagagagaaggcatactgagcaccatagacctcgagaaaggcctgccaaaccaggcctgggagctaagagtcgccggcctcgaaaggcgactatcggccatcgaatggggagccgttctcctgcacctaataaaacacagggggtacctatcgaaaagaaagaacgagagtcaaacgaacaacaaggagctgggcgccctgctaagcggagtggcgcaaaaccaccagctcctacaatccgacgactaccgaacacccgcagaattagccctcaagaaatttgcaaaagaagaggggcacataagaaaccaacgcggcgcttacacacacaccttcaatagattagacctcttagcagaactgaacctgctattcgcacaacagcatcaattcggaaacccacactgtaaagagcacatccagcaatacatgactgaactcctaatgtggcagaaacccgcactcagtggcgaggccatcctaaaaatgctcggaaaatgcacacacgagaaaaacgagttcaaagccgcgaaacatacctacagcgccgaacgttttgtttggctcaccaaactcaataaccttcgaatactcgaagacggggccgaacgggcactaaacgaagaagaaagacaactactaatcaaccacccgtacgaaaagagcaaactaacatacgcgcaggtacgaaaattactaggcctctccgaacaagctattttcaagcacctacgctacagtaaagaaaacgcagagtcagccaccttcatggagctcaaagcctggcacgccatacgaaaagcactcgaaaaccagggcctgaaggacacctggcaggacctcgccaagaaacccgatctcctcgacgaaatcggaaccgccttctcactctacaaaacagatgaagacatccaacaatacctaacgaacaaagtacccaacagcgtaataaacgcactactcgtatccctgaacttcgataagttcatcgaactcagcctgaaaagcctgagaaaaatacttcctctaatggaacaaggcaaacgctacgatcaggcctgccgcgagatctacggacatcactacggggaggccaaccaaaagacgtcacaactcctgcccgccattccagcccaagaaatacgcaaccccgtagtcctgcgaacgctgtcccaagcaagaaaagtaataaacgccatcatacgacaatacggctcccccgcccgagtccacatagaaacgggtcgagaactagggaaatccttcaaagaacgacgcgaaatccaaaaacagcaggaggataatcgaaccaaacgcgagtcagcggttcaaaagttcaaggaactcttctccgacttcagcagcgaaccaaaatctaaagacatactcaagttccgcctttacgagcaacaacacggtaaatgcctatactcgggcaaagaaatcaacatacacaggctgaacgaaaaaggatacgtcgagatcgaccacgcactacccttcagtcggacctgggacgactcattcaacaataaagtacttgtcctagcaagcgagaaccaaaacaaaggcaaccagacaccatacgagtggctacaagggaaaataaactccgaacgctggaaaaacttcgtcgcactggtactcggcagccagtgctcagccgcgaagaaacaacgcctcttgacccaggtcattgacgacaacaaatttatcgaccgcaaccttaacgacactcgatacatcgcacgcttcctatcaaactacatccaggaaaacctcctactcgtcggcaaaaacaaaaagaacgtattcacgccaaacggccaaatcacagccctgctccggtcgcgatggggactaatcaaagctcgagaaaacaacaaccgacaccatgccctagatgcgatcgtggtcgcttgcgcgaccccctcaatgcaacagaaaataacccgcttcatccgatttaaagaagtccacccctacaaaatagaaaaccgatacgaaatggtcgaccaagagagtggagaaattataagcccccacttccccgagccatgggcatacttcaggcaagaggtaaacatccgagtattcgacaaccaccccgacacggtgctaaaagagatgctcccggaccggccacaggcaaaccaccaattcgtacaacctctattcgtctcccgagcgcccaccagaaaaatgtccggccaaggccacatggaaaccatcaagtccgccaaacggctggcagaaggcatctccgtactccgaatacccctaactcaactcaaacccaatctcctggaaaacatggtaaataaggagcgcgaacccgccctgtacgcaggccttaaagcccgactcgccgagttcaaccaggaccccgcaaaagccttcgccacaccattctacaaacaaggcggccagcaggtaaaagcaatccgagtagagcaagtacaaaaatcaggagtcctagtacgcgaaaacaacggagtcgccgacaatgcctcaatcgtacgaaccgacgtattcatcaaaaacaacaaattctttctcgtccccatctacacgtggcaagtagcaaagggaatcctaccaaacaaggcaatcgtcgcacacaaaaatgaagacgaatgggaagaaatggacgaaggtgccaaattcaagttctctctcttccccaacgaccttgtcgaactaaaaaccaagaaagaatacttcttcggctactacatcggactggaccgggcaacagggaacataagcctaaaagagcacgacggcgaaatctccaaaggcaaagacggagtctacagggtaggcgtcaaacttgcactgagctttgaaaaataccaagtagatgagcttgggaaaaaccgacaaatctgccgaccccaacaaagacaacctgtcagaaagagaccagccgcaactaaaaaggcaggacaagccaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 8332 - RNA, 3575 nt, synthetic construct
  misc_feature 1..3575: note = Cas9 variant mRNA product
  source 1..3575: mol_type = other RNA
gggagagtcccgcagtcggcgtccagcggctctgcttgttcgtgtgtgtgtcgttgcaggccttattcaagcttaccatggcacccaaaaagaaacgcaaagtcggaatccacggagtaccagcagcagccgcctttaaaccaaacccaatcaactacatactcggattagacatagggatagcatcagtcggatgggccatggtcgagatcgacgaggacgaaaaccccatatgcctcatagacctgggggttagggttttcgagcgtgcagaggttccaaaaacaggcgacagcctagcaatggcacgtagactagcgcgctctgtccgcagactcacgagacgacgggcccacagactgctaagagcccgccgcctgctcaaaagagaaggagtcctacaagccgccgactttgacgaaaacggactcataaaaagcctccccaacacaccctggcaacttcgggcggccgccttagaccgaaaactcacacccctcgagtggtccgccgtgctactgcacctgatcaaacatcgaggatacctcagccaacgcaaaaacgagggagaaacggcagacaaagagctcggcgcactgcttaaaggcgtagcggacaacgcacacgcactacagacgggggacttccgcacgccagccgagctcgcactcaacaaattcgagaaagaaagcggtcacatccgaaaccagcgcggagactactcccacacattctcccgaaaagacctgcaagccgaactcatcctactattcgaaaaacagaaagagttcggcaacccacacgtatcaggcggtctaaaagaaggtatagaaacactcctcatgacccaaagaccggccctgtcaggagacgcagtccagaaaatgctcgggcattgcacattcgaaccagcagagcccaaggcagctaaaaacacatacaccgcagaacgattcatctggctgaccaagctcaacaacctcagaatattagaacaagggtctgaacgccccctgactgacacggaacgcgcaacactcatggacgaaccgtaccgcaaaagcaaactcacctacgcacaagcccgtaaactactgggcctcgaagacacagctttcttcaagggtctgcgatacggaaaagacaacgcagaagcatcaacattaatggaaatgaaggcttaccatgccatcagccgagccctagaaaaggaaggcctaaaagataagaaaagtcccctaaacctgtcgcccgagctacaagatgaaatcggcacagccttctcgctttttaaaaccgacgaggacatcacagggcgactcaaagaccgaatacaacccgagattctggaggcgctcctcaaacacatatcattcgacaaattcgtccaaatatccctcaaagcactacgcagaatcgttcctctcatggaacaaggcaaacgctacgatgaagcctgcgcagaaatatatggagaccattacgggaaaaagaacaccgaagagaaaatctatctgcccccgatcccagcggacgaaatacggaatcccgtcgttctgcgagcgctatcccaagcgagaaaagtaatcaacggggtcgtcagacgctacggcagtcccgcaagaatacacatagaaaccgcccgagaggtcggcaaatccttcaaagaccgcaaagagatcgaaaaacgccaagaagaaaatcgcaaggaccgagaaaaagcggcagcgaaattcagagaatacttcccaaacttcgtcggggaacccaaatccaaagatatcctaaaactccgcctatatgaacaacagcatggcaaatgcctctacagcggtaaggaaatcaacttaggaagactgaacgaaaaaggctacgtggaaatagaccacgcgctcccattcagccgcacttgggacgactcattcaacaacaaagtgctggtcctcggctcagagaaccagaataaagggaatcaaaccccctacgaatacttcaacggcaaagacaacagccgcgaatggcaagagttcaaggcacgagtggagacctcgcgcttccccagaagcaagaaacagcgaatactcctacagaaattcgacgaagatggcttcaaagaaaggaacctaaatgacacacgctacgtaaaccgctttctttgccaattcgtagcagaccggatgcggctcactggaaagggcaaaaagagagtcttcgcatccaacggacaaatcactaacctgctgaggggattctggggattacgcaaagtccgggcagagaacgaccgacaccatgcgctcgacgccgtagtcgtagcatgcagcaccgtagccatgcaacagaaaatcacgcgcttcgtgagatacaaggaaatgaacgcattcgacggaaagaccatcgacaaagagaccggagaagtcctacaccagaagacccatttcccccaaccctgggagttcttcgcccaggaagtcatgatacgcgtcttcggcaaacccgacggaaagccagagttcgaagaagcggacacgccagaaaaactaagaacgctgctcgccgagaaacttagctccagacctgaagcagtacatgaatatgtaaccccactcttcgtaagccgagccccgaaccgcaaaatgtccggccaggggcacatggaaacagtaaaatcagccaaacgcctagacgagggcgtgagcgtactaagggtaccgcttacacaactcaagctaaaagacctagagaaaatggtcaaccgcgagcgcgaaccaaagctctacgaggcccttaaggctcggctagaggcacacaaagacgacccagccaaagccttcgcggaaccgttttacaaatacgacaaggccggcaatcggactcaacaagtcaaagccgtaagagtagagcaggtccagaaaacaggcgtctgggtacgtaaccacaacggcatagcagacaacgccactatggtacgcgtcgacgtgttcgaaaaaggcgacaaatattatctagtgcccatatacagctggcaagtcgcaaaaggaatcctaccagaccgcgcggtggtccaaggaaaggacgaagaagactggcaactcatcgacgacagcttcaacttcaaattcagcctacaccccaacgacctagtcgaagtcatcacaaagaaggcccggatgttcgggtacttcgcctcctgccaccgcggcaccggtaacataaacataaggatccatgacctcgaccacaaaataggcaaaaacggaatattagaaggcatcggggtaaaaacagcccttagcttccaaaaataccaaatagacgagctaggaaaagaaataaggccctgccgactcaaaaagagaccaccagtgcgcaaaaggcccgcagcaacgaagaaagccggccaagccaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 8333 - RNA, 3581 nt, synthetic construct
  misc_feature 1..3581: note = Cas9 variant mRNA product
  source 1..3581: mol_type = other RNA
gggagagtcccgcagtcggcgtccagcggctctgcttgttcgtgtgtgtgtcgttgcaggccttattcaagcttaccatggcaccgaagaagaaaaggaaagtcggcattcacggagtcccagccgcaaaataccatgtaggcatagacgtaggaacattcagcgtagggctcgcggcaatagaggtagacgacgcaggtatgcccatcaaaaccctaagccttgtgtcacacatccacgacagcggcctcgatccagatgaaatcaaatcggcggtcacgcgactagcaagcagcggtatcgccagacgaacgcgcagactgtaccgaaggaaaaggagaagactccagcaactggacaaattcatacaacggcaaggatggccagtgatagaattagaggactacagcgacccactatacccctggaaagtaagagccgagctcgcagcaagttacattgcggatgagaaagaacgaggcgagaaattgagcgtggcactgagacatatcgccagacacagaggatggcgcaacccatacgcaaaagtaagcagcctatacctcccagacgggccgtccgacgcattcaaagcgatcagagaagagataaagagggcgagtgggcaaccagtgccagaaacagccacggtgggacaaatggtgaccctatgcgaactaggcacgctgaagctaagaggagaaggcggagtcctgagtgcacggttgcagcaaagcgactacgcccgcgaaatacaagaaatatgccgcatgcaagaaatagggcaagaactctacagaaaaataatcgacgtagtattcgcagctgaaagcccaaaggggagcgccagcagccgagtaggaaaagaccccttacaacccgggaaaaaccgcgcgctaaaggccagcgacgcattccaacgatacaggatagcagccttaataggaaacctaagagtccgagtagatggagagaaacgcatcctcagcgtagaggagaagaacctcgtgttcgaccatctggtcaatctaaccccaaagaaagaaccagaatgggtaacgatcgcagaaatactgggcatagacagagggcagctaataggaaccgccacgatgacggacgacggagaacgcgcgggagcccgaccacctacgcacgacacgaacagatccatcgtgaacagccgaatagccccgctagtcgactggtggaaaacagcgagcgccctcgaacaacatgcaatggtcaaggctctaagcaacgcggaagtagacgacttcgactcaccagagggagcaaaagtccaagcattcttcgccgacctagacgacgacgtccacgcaaaactcgactcccttcatctgccagtcggacgagcggcgtacagcgaagacaccctagtacgattaacacgacgcatgctaagcgacggagtagatctgtacaccgcaagactacaggagttcggcattgaaccaagctggacgccaccaacccccaggatcggagaaccagttggtaacccagctgtagaccgagtactaaaaacagtcagtcgatggcttgaaagtgcgaccaagacttggggagcaccagaacgggtcataatagaacacgtaagggagggatttgtaacagaaaaacgggcgcgagaaatggacggggacatgcgtagacgagcagcaaggaacgcaaaactgttccaggaaatgcaggagaaactaaacgtacaaggaaaaccctctagagcagatctctggcggtaccagagcgtccaaagacaaaactgccaatgcgcatactgcggcagcccaatcacgttcagcaactcagaaatggaccacatcgtgccaagggctgggcagggatccaccaacacgcgcgagaacctagtggcggtgtgccacaggtgtaaccaaagcaaaggaaacaccccgttcgcgatatgggcgaaaaacacctccatagagggcgtaagcgtaaaggaagctgtggaaagaacacgacactgggtcacggacacaggaatgcgctcaaccgactttaagaaatttacaaaggctgtcgtcgagaggttccaaagagcaacgatggacgaagagatagacgcaaggagcatggaatcggtcgcatggatggcaaacgaattgcgcagtcgggtagcacagcacttcgctagccacggaacaacggtacgagtctaccgcggaagcctcacagcggaagcacggagggccagcggcataagcggcaaactaaagttcttcgacggagtcgggaaatctcgcctagaccgcagacaccatgccatagacgcggccgtgatcgcattcacaagtgactacgtggccgagaccctagcagtacgaagcaatttgaagcaaagccaagcgcacagacaggaagccccgcaatggcgagagttcacaggaaaagacgcagaacacagagcggcatggagggtatggtgccagaaaatggaaaaactaagcgcattgctcaccgaagacctcagggacgacagagtcgtcgttatgagcaacgtgcggctacgcctcggcaacggctcggcccacaaagaaacaataggaaaactcagcaaggtcaaactaagctcacaactgtccgtatccgacatagacaaagcgtcgagcgaagcactctggtgcgcgctaacgcgagaacccggatttgaccccaaggaaggcctccctgcaaacccagaacggcacatacgagtaaacggtacacacgtgtatgctggtgacaacatcggattattcccagtctcagcaggaagtattgcgctgcggggaggatacgcagaactcggctcaagttttcaccacgcaagggtatataaaataacaagcgggaagaaaccagcattcgctatgttgagagtatacacgatagacctgctcccctaccgcaaccaagacctattcagcgttgaactaaaaccacaaacaatgtcaatgaggcaagccgaaaagaaactgcgagacgccctcgccaccgggaacgccgaatacctcggctggttagtcgtcgacgacgagctcgtagtagacaccagcaaaatagcaacggaccaagtaaaagcagtcgaagcggagctaggaacgataagacgatggagggtagatggatttttcagcccaagcaaactacgcctaagaccgcttcaaatgtcaaaagaaggcatcaaaaaggaaagcgcaccagagctgagcaagataatcgacagacccggctggctaccagcagttaataaactcttcagcgacggcaacgtcacagtcgtgcgaagggactcgttggggcgggtacggctagaaagcacagcgcacctacccgtcacatggaaggtacaaaagagaccagccgcgacgaagaaggcaggccaggcgaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 8334 - RNA, 3281 nt, synthetic construct
  misc_feature 1..3281: note = Cas9 variant mRNA product
  source 1..3281: mol_type = other RNA
gggagagtcccgcagtcggcgtccagcggctctgcttgttcgtgtgtgtgtcgttgcaggccttattcaagcttaccatggcccccaagaagaaacgcaaggtgggcatccacggggtcccggccgcggcccggatactggccttcgacatcggcatcagctccatagggtgggccttcagcgagaacgacgagctcaaggactgcggcgtgcgcatcttcactaaggtggagaaccccaagacaggagagtccctggccctgccccggcgcctcgcgcggagcgcccgcaagcggctggcccgccggaaggcccgcctgaaccacctcaagcacctgatcgcgaacgagttcaagctgaactacgaggactaccagtccttcgatgagagcctcgccaaggcctacaaaggctccctgatcagcccctacgagctgcggttccgcgcactcaacgagctgctgtccaagcaggacttcgcccgggtcatcctccacatcgcgaagcgccggggctacgacgacatcaagaacagcgacgacaaggagaagggggccatcctgaaggccatcaagcagaacgaggagaagctggccaactaccagtccgtgggcgagtacttgtacaaggagtacttccagaaattcaaggagaacagcaaggagttcacgaacgtgcgcaacaagaaggagtcctacgagcggtgcatcgcccagagcttcctgaaggacgagctgaagctcatctttaaaaagcagcgcgagttcgggttctccttcagcaagaagttcgaagaggaggtcctttccgtggcgttctacaagcgggctctgaaggacttcagccacctcgtgggcaactgctccttcttcaccgacgagaagcgcgccccgaagaacagccccctggccttcatgtttgtcgccctgacccggatcatcaatctcctgaacaacctgaagaacaccgagggcatcctctacacgaaggacgacctgaacgcgctgcttaacgaggtgctgaagaacggcaccctgacctacaagcagaccaagaagctcctggggctgagcgacgactacgagttcaaaggggaaaagggcacgtacttcatcgagttcaagaagtacaaggagttcattaaggccctcggggagcacaacctgtcccaggacgacctgaacgagatcgccaaagacatcaccctcatcaaggacgagatcaagctgaagaaggccctggccaagtacgacctcaaccagaaccagatcgacagcttatccaaacttgagttcaaggaccacctcaacatcagcttcaaggcgctaaagctggtgacgcccctgatgctcgagggcaagaagtacgacgaggcctgcaacgagctgaacctgaaggtcgccatcaacgaggacaagaaggacttcctccccgccttcaacgagacctactacaaggacgaggtgaccaacccggtggtcctgcgtgcgatcaaggagtaccgcaaggtgctgaacgccctcctgaagaagtacggcaaggtgcacaaaatcaacatcgagctggcgcgggaggtcgggaagaaccactcccagcgcgccaagatcgagaaggagcagaacgagaactacaaggccaagaaagacgcggagctcgagtgtgagaagctgggcctgaagatcaacagcaagaacatcctcaagctgcggctgttcaaggagcagaaggagttctgtgcctactccggggagaaaatcaagatcagcgacctccaggacgagaagatgttagagatcgaccacatctacccatactcccgcagcttcgacgactcctacatgaacaaggtgctggtgttcaccaagcagaaccaggagaagctcaaccagacccccttcgaggccttcggcaacgacagcgcgaagtggcagaagatcgaggtcctggcaaagaacctacccaccaagaagcagaagcggatcctcgacaagaactacaaggacaaggagcagaagaacttcaaggaccgcaacctgaacgacacacggtacatagctcgcctggtgctcaactacaccaaggactacctggacttcctgccgctctccgacgacgagaacaccaagctgaacgacacccagaaggggagcaaggtgcacgtcgaggccaagtccggcatgctgacgagcgctctccggcacacctggggcttctccgccaaggaccgcaacaaccacctccaccacgccatcgatgcggtgataatcgcctacgccaacaacagcatcgtcaaggccttctccgacttcaaaaaggagcaggagagcaacagcgcggagctgtacgccaagaagatctccgagctggactacaagaacaagcggaagttcttcgagcccttcagcggtttccgccagaaggtgctggacaagatcgacgagatcttcgtgtccaaacccgagcggaagaagcccagcggtgccctgcacgaggagaccttccgtaaagaggaggagttctaccagtcctacgggggcaaggagggggtcctcaaggcgctggagctgggcaagatccggaaggtgaacgggaagatcgtgaagaacggggacatgttccgcgtcgacatcttcaagcacaagaagaccaacaagttctacgccgtgccgatctacacgatggacttcgcgctcaaggtgctgcccaacaaggccgtcgcccggagcaagaagggcgagatcaaggactggatcctgatggacgagaactacgagttttgcttctccctctacaaggacagcctgatcctgatccagaccaaggacatgcaagagcccgagttcgtgtactacaacgccttcacctcctcaaccgtgtccctcatagttagcaagcacgacaacaagttcgagacgctgtccaagaaccagaagatcctgttcaaaaacgcaaacgagaaggaggtgatcgccaagagcatcgggatccagaacctcaaggtgttcgagaagtacatcgtctccgcgctgggcgaggtgaccaaggccgagttccgccagcgggaggacttcaagaagaagcgccccgccgccaccaagaaggcggggcaggccaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 8335 - RNA, 3692 nt, synthetic construct
  misc_feature 1..3692: note = Cas9 variant mRNA product
  source 1..3692: mol_type = other RNA
gggagagtcccgcagtcggcgtccagcggctctgcttgttcgtgtgtgtgtcgttgcaggccttattcaagcttaccatggcccccaagaagaagcgcaaggtgggcatccacggggtcccggccgcgtcggacctagttctcggcctggacatcgggattggctccgtgggggtcgggatcctgaacaaggtgaccggcgagatcatccacaagaacagccggatcttccccgccgcccaggccgagaacaacctagtgcgccggacgaaccgccagggccggcgcctggcccggcgcaagaagcaccggcgcgtccggctgaaccgcctcttcgaggagtccggcctgatcacggacttcaccaagatcagcataaacctgaacccctaccagttacgggtgaaggggctgaccgacgaactgtccaacgaggagctgttcatcgcgctgaagaatatggtgaagcaccgcggcatcagctacctggatgacgcctccgacgacgggaacagctccgtcggcgattacgcccagatcgtgaaggagaatagcaagcagctcgagaccaagacgcccggacagatccagctggagcggtaccagacctacgggcagctgcgcggcgatttcaccgtggagaaagacgggaagaagcaccgactcatcaacgtcttcccgacctccgcctaccgaagcgaggcgctgcggatcctgcaaactcagcaggagttcaacccccagatcaccgatgagttcatcaaccgctacctcgagatcctgaccggcaagcggaagtactaccacggccccgggaacgagaagtcccgcaccgactacggccgctatcggacgagcggggagaccctggacaacatcttcggcatcctcatcgggaagtgcaccttctaccccgacgagttccgcgccgccaaggcctcctacaccgcccaggagttcaaccttttaaatgacctcaacaacctgacggtgccgaccgaaaccaagaagctcagcaaggagcagaagaaccagatcatcaactacgtgaagaacgagaaggctatgggccccgccaagctgttcaagtacatcgccaagctcctgtcctgcgacgtcgccgacatcaagggctaccggatcgacaagagcgggaaggccgagatccataccttcgaggcgtaccgcaagatgaagacgctcgagaccctggacatcgagcagatggacagagagaccctggacaagctcgcctacgtactgaccctgaacacggagcgcgagggcatccaggaggccctcgagcacgagttcgccgacgggtccttcagccagaagcaggtcgacgagctggtgcagttccggaaggccaacagctccatcttcggcaaagggtggcacaactttagcgtgaagctgatgatggagctcatccccgagctgtacgagaccagcgaggagcagatgaccatcctgacccgcctcggcaagcagaagacaaccagctccagcaacaagactaagtacattgacgagaagctgctgaccgaggaaatctacaaccccgtggtcgcgaagtccgtgcggcaggccatcaagatcgtgaacgccgccatcaaggagtacggcgacttcgacaacatcgtcatcgagatggcccgcgagacgaacgaggacgacgagaagaaggcgatccagaagatccagaaggccaacaaggacgagaaggacgccgccatgctcaaggcggccaaccagtacaacgggaaggccgagctgcctcacagcgtgttccacggccacaagcagctggccaccaagatccggctgtggcaccagcagggcgagcgctgcctctataccggcaagaccatctccatccacgacctgatcaacaacagcaaccagttcgaggtcgaccacatcctgcccctctccatcacgttcgacgacagcctggccaacaaagtgctggtgtacgcgaccgccaaccaggagaaggggcagcggacgccctaccaggccctggactccatggacgacgcctggtcgttccgcgagctgaaggccttcgtccgggagtccaagaccctgagcaacaagaagaaggagtacctcttgaccgaggaggacatctccaagttcgacgtgcgcaagaagttcatcgagcggaacctcgtggacacgcgctacgcgagccgggtcgtgctcaacgccctgcaggagcacttccgcgcccataaaatcgacaccaaggtgtccgtggtgcgcggccagttcaccagccagttaagacgccactggggcatcgagaagacccgggacacgtaccaccaccatgcagtggacgccctcatcatcgcggcctcctcccagctgaacctgtggaagaagcagaagaacaccctcgtcagctactccgaggaccagctgctggacatcgagaccggggagctcatcagcgacgacgagtacaaggagtccgtgttcaaggccccctaccaacatttcgtggacaccttaaagagcaaggagttcgaggattccatcctgttcagctaccaggtcgactccaagttcaaccgcaagatcagcgacgccacgatctacgcgacccggcaggccaaggtgggcaaggacaaggccgacgagacctacgtgctcgggaagatcaaggacatctacacccaggacggctacgacgccttcatgaagatctacaagaaggacaagtccaagttcctgatgtaccgccacgacccgcagacgttcgagaaggtcatcgagcccatcctcgagaactaccccaacaagcagatcaacgagaagggcaaggaggttccctgcaacccgttcctcaagtacaaggaggagcacgggtacatccggaaatacagcaagaagggcaacgggcccgagatcaagtccctgaagtactacgacagcaagctgggcaaccacatcgacattacccccaaagactccaacaacaaggtggtcctccagagtgtgtccccctggcgcgccgacgtgtacttcaacaagaccaccgggaagtacgagatcttgggcctgaaatacgcggacctccagttcgagaagggcacggggacctacaagatcagccaggagaagtacaacgacatcaagaagaaagagggcgtcgacagcgactccgagttcaagttcaccctgtacaagaacgacctgctcctggtgaaggacaccgagacgaaggagcagcagctgttccggttcctcagccgcaccatgccaaagcagaagcactacgtggagctaaagccctacgacaagcagaagttcgagggcggagaggccctgatcaaggtcctcgggaacgtggccaactccggccagtgcaagaagggactgggcaagagcaacatctccatctacaaggtgcggaccgacgtcctggggaaccaacacatcattaagaacgagggggacaaacccaagctcgacttcaagcgccccgccgccaccaagaaggcgggccaggccaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 8336 - RNA, 4250 nt, synthetic construct
  misc_feature 1..4250: note = Cpf1 variant mRNA product
  source 1..4250: mol_type = other RNA
gggagagtcccgcagtcggcgtccagcggctctgcttgttcgtgtgtgtgtcgttgcaggccttattcaagcttaccatggcccccaagaagaagcgcaaggtgggaatccacggcgtcccggccgcgacccagttcgagggcttcaccaacctgtaccaggtgagcaagacgctccggttcgagctgatcccccaggggaagaccctgaaacacatccaggagcagggcttcatcgaggaggacaaggcccgcaacgaccactacaaggaactcaaacccatcatcgaccggatctataagacctacgccgaccagtgcttgcagctggtgcagctcgactgggagaatctgtccgccgccatcgacagctaccgcaaggagaagaccgaggagacccgtaacgcgcttatcgaggagcaggccacctaccgcaacgctattcatgactacttcatcgggcggaccgataacctcaccgacgccataaacaagcgccacgctgaaatctacaagggcctcttcaaggccgagctattcaacggcaaggtactaaagcagttagggacggtgaccaccaccgagcacgagaatgccctactccggtccttcgacaaattcacgacctacttctcaggcttctacgaaaaccgcaagaacgtgttcagcgcagaggacatcagcaccgcaatcccccaccggatcgtccaggacaatttcccgaagtttaaggagaactgccatatcttcacccgtctgatcacggcggtgccgtccctgcgggaacacttcgaaaacgtgaagaaggccatcggaatttttgtcagcacctccatcgaggaggtgttcagtttccccttctacaaccagttgctgacccagacccagatcgacctgtacaaccagctcttgggcgggatctctcgcgaggccggcacggagaagataaagggcttaaatgaggtgctcaacctggccatacagaagaacgacgagacagcccacatcatagcgagcctgccccaccggttcatcccgttattcaaacagatcctgtctgaccgtaacacccttagcttcatcctcgaggagttcaagagtgacgaagaggtcatccagtcgttctgcaaatacaagacccttctgcggaacgagaatgtgctcgagacggccgaggcccttttcaacgaactgaactccatcgacctcacccacatcttcatcagccacaagaaactcgagaccatcagcagcgccctgtgcgaccactgggacaccctccgcaacgccctgtacgagcggcgcatcagtgagctgacgggcaagatcaccaagtccgcgaaggagaaggtgcagcggagcctcaagcatgaagacatcaacctgcaggagatcatctccgccgccggcaaggagctgagtgaggccttcaagcaaaagacctcagaaatcctatcccacgctcatgcggccctggaccagccgttgcccaccacgctcaagaagcaagaagagaaggagatcctgaaatcccagttagacagcctgctcgggctgtaccacctcctcgactggttcgcagtcgacgaatccaacgaggtggaccccgagtttagcgcccgcctgaccggcattaaactggagatggagccgtccctcagcttctacaacaaggcgcgcaactacgccaccaagaagccctactccgtggagaagttcaagctgaacttccagatgcccacgctggccagcggctgggatgtaaacaaggagaagaacaatggggccatactcttcgtgaagaacggcctgtactacctggggatcatgcctaagcaaaagggccggtacaaggccttatccttcgagcccacggagaagaccagcgaagggttcgacaagatgtactacgactacttccccgacgcggccaaaatgatccccaagtgctccacacagctgaaagcagtgaccgcccacttccagacccacacgaccccgattctgttgagtaacaacttcatcgagccgctggagatcaccaaagagatctacgatctgaacaaccccgagaaggagcccaaaaagttccagaccgcctatgcgaaaaagacgggagaccagaaaggctaccgcgaggccctgtgcaagtggatcgacttcacccgggatttcctatccaagtacaccaagaccacgagcatcgacctgagttcactccggccaagctcccagtacaaagatctgggggagtactacgccgagctgaatccgctcctgtatcacatctcattccaacggatcgccgagaaagagatcatggacgccgtagagacgggcaagctctacctcttccagatctacaacaaggacttcgcgaagggacaccacggcaagcctaacctgcacacattgtactggaccggcctcttctcccccgagaacctcgccaagacgagcatcaagctgaacgggcaggccgagctgttctacaggcccaagagccggatgaagcgcatggcccacaggctgggtgagaagatgctgaacaagaagctaaaggaccagaagaccccgatccccgacaccctgtaccaagagctgtatgactacgtgaaccatcgcttaagccacgacctctccgacgaggcgcgtgccttactccccaacgtgatcaccaaggaggtcagccatgagatcatcaaggaccgcagattcacgtccgacaagttcttcttccacgtgccgatcacactgaactaccaggccgctaacagcccctccaagttcaaccagcgcgtcaacgcctacctaaaggagcaccccgagacgcccatcattgggatagaccggggcgagcgcaacctgatctatatcaccgtgatcgacagcacggggaagatcctggagcaacgatccctgaacaccatccagcagttcgactaccagaagaaactcgacaaccgcgaaaaagagcgggtggcggcacgccaggcctggagcgtcgtgggcaccatcaaggacctgaagcaggggtacctgagccaggtgatccacgagatcgtcgacctcatgattcactaccaggccgtcgtggtcctggagaacttaaacttcggcttcaaatcgaaacgcaccggcatcgccgagaaagcggtgtaccagcagttcgagaagatgctcattgacaagttaaactgcctggtgctaaaagattacccggccgagaaggtcggaggcgtgctgaacccctaccagttgacggaccagttcaccagcttcgccaagatgggcacccagtctggcttcctcttctacgtgcccgccccctacaccagcaagatcgacccgctgacggggttcgtagaccccttcgtttggaagaccatcaagaaccatgagagtcggaagcacttccttgaggggtttgacttcctccactatgatgtgaagactggcgatttcatcctgcacttcaagatgaaccgcaacctgagcttccagcgggggctccccggtttcatgcccgcctgggacatcgtcttcgagaagaatgagacccagttcgacgcgaaggggacgcccttcatcgccggcaagcgcatagtccctgtgatcgagaaccaccggttcaccggccgctaccgggatctgtaccccgcaaacgagctgatcgccctcctggaggagaaggggatcgtctttcgagacggctccaacatcctgcccaagttgttagagaatgacgacagccacgcaatcgacaccatggtggccctgattcggtccgtgctccagatgcgcaacagcaacgcggccaccggggaggactacatcaactccccggtccgggacctgaacggcgtgtgctttgatagccgcttccagaaccccgagtggcccatggacgccgacgcgaacggggcctaccatatcgccctgaagggacaactcttgctgaaccacctcaaggagtctaaggacctcaagctgcaaaacggtatcagcaaccaggactggctcgcctatatacaagagctgcggaacaagcgccccgccgcgactaaaaaggctgggcaggccaagaagaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 8337 - RNA, 4229 nt, synthetic construct; identical to SEQ ID NO: 2537
  misc_feature 1..4229: note = Cpf1 variant mRNA product
  source 1..4229: mol_type = other RNA

SEQ ID NO: 8338 - RNA, 51 nt, synthetic construct; identical to SEQ ID NO: 4858
  misc_feature 1..51: note = NLS2 variant
  source 1..51: mol_type = other RNA

SEQ ID NO: 8339 - RNA, 48 nt, synthetic construct; identical to SEQ ID NO: 4859
  misc_feature 1..48: note = NLS4 variant
  source 1..48: mol_type = other RNA

SEQ ID NO: 8340 - RNA, 4107 nt, synthetic construct
  misc_feature 1..4107: note = Cas9 variant
  source 1..4107: mol_type = other RNA
atggataagaaatactcaataggcctagatataggaacaaattcagtaggatgggcagttataacagatgaatacaaagtaccgagtaagaaattcaaagtactaggaaatacagaccgacatagcatcaagaaaaacctgataggcgccttacttttcgacagcggtgaaacagcagaagcaacaagactaaaaaggacagcaagacgtagatacacaagacgtaaaaatcgaatttgctacttacaagaaatattttcaaacgaaatggcaaaagtagatgatagcttctttcatagattagaagaatcatttctcgtagaagaagataagaaacacgaaagacatccaatatttggtaacatcgtcgatgaggtagcctatcacgaaaaatacccaactatttatcatctacgaaagaaattagttgacagtacagacaaagctgatcttcgactaatatatttggccctcgcacacatgattaaatttagagggcactttttaatagaaggtgatttaaatccagataactcggacgttgataaattgttcatacaacttgtacaaacgtacaaccaactcttcgaagaaaacccaataaatgccagtggtgttgacgccaaagcaatattatcagcaagactatcgaaatcacggcgtttagaaaatctgatagcccagctacccggagagaagaaaaacggactttttggaaatctaatagcactatcactcggtttgacaccaaacttcaaaagtaacttcgacttagcagaagacgcaaaattacaactgtctaaagatacatatgacgatgacctcgataatctattagctcagataggagaccaatacgcagacctattcctcgcagctaaaaacctatctgatgcaatattattatcagacatacttcgagttaacactgaaataacaaaagctcccctctccgcatctatgataaaaagatacgacgaacaccaccaagatctgactttacttaaagctctagttcggcagcaactaccagaaaaatacaaagaaatattctttgaccaaagcaaaaacggatatgcaggttatatagacggcggcgcgagtcaagaagaattttataaattcatcaaacctatacttgagaaaatggacggcactgaagaactattagtgaaactaaatagagaagatctactaagaaaacaacgaaccttcgacaatggaagcataccacaccagatacacctaggagaactacacgcgatacttcgccgtcaagaagacttctatccattcttaaaagataacagagagaaaattgagaaaattttaacattccgaataccatactatgtaggaccgttggctagaggtaattcgagatttgcatggatgacaagaaaatcagaagaaacaataactccctggaactttgaagaagtcgtagacaaaggagcaagtgcccaatcctttatagaaagaatgaccaattttgacaaaaatttgccaaacgaaaaagttctccccaaacattcacttctatacgaatactttactgtatacaatgaactaacaaaagtaaaatacgtaactgaaggaatgagaaaacctgccttcctatcaggggaacagaagaaagcaatagttgacctactatttaaaacaaacagaaaagttacagttaaacaactaaaagaagattactttaagaaaatagaatgtttcgactctgtcgaaatatcaggagttgaagatcgattcaacgcaagtttgggaacataccatgatttattaaaaataataaaagataaagatttcttagataatgaagaaaacgaagatatacttgaagacatagtactaacacttacactattcgaagacagagaaatgattgaagaacggctaaaaacctacgctcacttatttgatgataaagtgatgaaacaattgaaacgaagaagatacacaggatggggacgactatcaagaaaactaattaacggtataagggacaaacaatcgggtaaaaccatcctagactttcttaaaagtgatggattcgcaaacagaaacttcatgcagctaattcatgatgacagtttaacattcaaagaagacattcaaaaagcacaagtctccggacaaggagacagcttgcatgagcatatagcaaatcttgcagggagtccagcaatcaagaaaggaattttacaaactgtaaaagtagtagacgagctagtgaaagtcatgggtcgccacaaacccgaaaatatagtaatagaaatggcgcgagaaaatcaaacaacacaaaaaggtcagaaaaatagcagagaaagaatgaaaaggatcgaggaaggtataaaagaattgggctcgcaaatattaaaagaacatccagtagaaaatactcaacttcaaaacgagaaactttacttatattacctacaaaacggaagagatatgtatgtggaccaagaactcgatataaatcgtctttcagattatgatgtcgatcacatagtgccgcaatctttcctaaaagacgattcaatcgataacaaagttttaacaaggagtgacaaaaataggggaaaatcggataacgtaccatctgaagaagtagtcaagaaaatgaaaaactattggagacaactacttaacgcgaaactaataacgcagagaaaatttgataatttgaccaaagctgaaagaggaggattaagtgaactagataaagcaggatttattaaacgccaattagtagaaacaagacaaatcactaaacacgtagcacaaattctcgactcaagaatgaacacgaaatacgatgaaaacgataaactaattcgagaagtaaaggtaatcacactaaaatcaaaattagtatccgactttagaaaagattttcaattttataaagtacgagagataaacaactatcaccatgcccatgacgcctatctgaacgctgtggtaggcacagcactgatcaagaaatacccaaaattggaaagtgagttcgtatacggagattacaaggtttatgatgttaggaagatgatcgctaaaagcgaacaagaaatcgggaaggccacagcaaaatatttcttttatagtaacattatgaacttctttaaaaccgagataactcttgcaaatggagaaatcaggaagagacctctaattgaaacgaacggagaaaccggagaaatagtatgggataaagggcgtgatttcgcgacagtacgcaaagtattatccatgccacaagtaaacatagtcaagaaaaccgaagtacaaactggaggattcagcaaagaatctattttaccaaaaagaaatagtgataaattaatcgcaagaaagaaagattgggacccgaagaaatatggaggatttgatagtccaacagtagcatatagtgtgcttgtggtcgcaaaagttgaaaagggaaagtctaagaaattaaaatcagttaaagaactacttggaatcacgatcatggaacgcagttcatttgagaaaaaccccattgactttctcgaagcaaaagggtataaagaagtcaagaaagacctaattatcaaattaccaaaatactctctcttcgaactagagaacggtagaaaacggatgctagcttcagcaggagaactacaaaaaggcaacgaactcgcattaccatccaaatacgtaaactttctatatttagcgtcacattacgaaaaattaaaaggaagtcccgaagataacgaacaaaagcaactattcgtcgagcagcacaaacattacttagacgagatcatcgaacaaattagcgagttctcaaagagagtaatactagcagacgcaaacctggacaaagtattgagcgcttataataaacatagggataaaccaatcagagaacaagccgagaatataatccatttattcacactaacaaatctaggcgccccggctgcatttaaatactttgatacaacaatagatagaaaacgctacacctcaacgaaagaggtccttgacgccacattaatacaccaatctataactggattgtatgagacaagaatagatctatcccagctgggaggcgactga

SEQ ID NO: 8341 - RNA, 4890 nt, synthetic construct
  misc_feature 1..4890: note = Cas9 variant
  source 1..4890: mol_type = other RNA
atgaatttcaaaattctgcctatcgctatagacttgggagtgaaaaatactggcgtattctctgcattctaccaaaagggaacctcgcttgaaaggttagacaacaaaaatggcaaggtatatgaattatcaaaagacagctacacattattaatgaacaaccgtacagccagacgccaccaaagacgaggcattgatagaaaacagctagtaaaaaggttgtttaaactaatatggaccgaacaactaaatttagaatgggataaagatacccaacaagccattagctttcttttcaacagaagaggattctcattcataaccgatggatattcacccgaatacctaaatatagtacccgaacaagttaaagccatattaatggacatatttgacgactacaacggcgaagatgacttagattcctatctgaaactagcgacagaacaagaaagcaagatttcagaaatatacaacaagctgatgcagaaaatactagagttcaaactcatgaaactctgcacagatataaaggacgataaagtttcaacgaaaacactgaaggaaatcacgtcttacgaatttgaattattagcggactatctcgctaactattcagaatccctaaaaacgcaaaaattttcttacacagacaagcaaggcaatttaaaggaattgtcgtattatcatcatgacaagtacaacatacaagaatttttgaagaggcacgccacaattaacgacagaatcttagatactcttctcactgacgatcttgacatatggaatttcaatttcgaaaagtttgactttgataaaaacgaagaaaaactgcaaaaccaagaagataaagaccacatacaagcccaccttcaccacttcgtattcgcagtcaacaaaataaaatcagaaatggcaagtggcggacgacacagatctcaatatttccaagagataaccaacgtacttgatgaaaacaatcaccaagaaggttatcttaaaaacttctgcgaaaaccttcataataagaaatactcaaacctctcagtgaaaaacctagtcaatctcataggcaacttatcaaatctagaactaaaaccgttgaggaaatactttaatgacaaaatacacgccaaagcagaccattgggatgaacaaaaattcactgaaacatactgtcactggatattaggtgaatggcgagttggagtaaaagaccaagataaaaaggatggagcaaaatattcgtataaagatttatgcaatgaattaaagcaaaaagtgacaaaagccggactcgttgatttcctcctagagttagacccttgtagaacaatacccccatatttagataacaacaacagaaagccaccaaaatgccaaagcctaatattaaacccaaaatttttagacaatcaatatccaaactggcaacaatacttgcaagaattaaagaaattacaatctatccaaaattacttagactccttcgaaacagatctaaaagtcctaaagagttccaaagaccaaccttatttcgtagaatataaaagctcaaaccaacaaatcgcgtcaggtcaacgggattataaagacttagatgcacgcatactacaattcatatttgacagggtgaaagcatctgacgaactattactaaacgagatatacttccaagctaagaaattaaaacaaaaagcatcatcggaactcgagaaattagagtcctcaaagaaattagatgaagtaatcgcaaattcacaactaagtcaaatattaaaatcacaacatactaacggaatttttgaacagggaacgtttcttcacctagtttgcaaatattacaaacaacgtcaacgggctagagacagtcgattatacattatgccagagtacagatacgacaagaaacttcataaatacaacaacacaggaagatttgatgacgacaatcaactactaacttactgtaatcacaaacctaggcaaaaacgataccaactgttaaacgacctagcaggcgtccttcaagtatcaccaaattttctaaaagacaagattggctcagacgatgatctattcataagcaaatggcttgttgaacatataagaggttttaaaaaggcgtgcgaagatagcctcaaaattcagaaagataatcgcgggttacttaatcacaagataaacattgcgagaaacacaaagggcaaatgcgaaaaagaaattttcaatctaatatgcaaaattgaaggatcagaggacaagaaagggaattataaacacggactcgcatacgaactcggagtactactttttggggaaccaaatgaggcttccaaacctgaatttgacaggaaaataaagaaatttaacagcatatactctttcgcacaaatacaacagatcgcctttgcagaaagaaaaggtaatgcaaacacatgcgcagtgtgctccgcagataacgcacaccgcatgcaacaaattaaaataacagaaccagtagaagacaataaagacaaaataatactgagtgccaaagcacaaagactcccagccataccaacaagaatagtagacggagcagtcaaaaagatggcaactattttagccaaaaatatagtagatgacaattggcaaaacataaaacaggtacttagcgcaaagcatcaactacacatacccataatcacagaaagtaatgcattcgaatttgaaccagccctcgcggacgtcaaaggaaaaagcctaaaagacagacgaaagaaagcactagaaagaatttcaccagagaatatcttcaaagacaaaaataacagaataaaagagttcgcaaaaggaatatcagcatactctggagcgaatttgactgatggagattttgacggggcaaaagaagaactagatcatataatccctcgaagccacaagaaatatggaacactaaatgatgaagccaacctaatttgtgtaacccgcggtgacaacaaaaataaaggaaacagaatcttctgcttaagagatttagcagataattataaattaaaacaattcgaaacaacagatgacttagaaattgaaaagaaaatcgccgacacaatttgggatgctaataagaaagattttaaattcggtaactatcgaagttttattaacctcacgccacaagaacaaaaagcattcaggcatgctctattcttagctgacgaaaaccccataaaacaggcggtaattcgagcaataaacaaccgaaaccgcacatttgtaaacggaactcaaagatactttgcagaggtactcgccaacaatatatatttaagagccaagaaagaaaaccttaacacagacaaaatttccttcgactacttcggaataccgacaatcggaaacggaagaggcatagcagaaataagacaattatacgaaaaagttgactcagacatacaagcgtatgcaaaaggagataaaccacaagcctcatacagccacctaatagacgcaatgttagcgttctgtatagcggcagacgaacacaggaacgacggatcaatcggactagaaatagataaaaactactcgctatacccactagataaaaataccggggaagttttcaccaaagacatattttctcaaattaaaataaccgacaacgagttctcagataagaaattagtacgaaagaaagcaatagaaggtttcaatacccatagacaaatgacgagagacggaatttatgcagaaaattacttaccaatcctcatacacaaagaattaaacgaagtgagaaaaggctatacctggaaaaatagcgaagaaattaaaattttcaaaggaaagaaatacgacatccaacaacttaacaatttggtttactgcctgaaatttgtagataaacccatttccatagatatacagatatccacattggaagaacttagaaacatcctaactacaaataacatagcagcaacggcagaatattattatataaatttaaaaacccaaaagctacacgaatattacatagaaaattataatacagccttaggctataagaaatattcaaaagaaatggagttcttaagatcattagcctacagatccgaacgtgtgaaaataaaatcaatagacgatgtaaaacaagttctggacaaagactcaaatttcataatcggtaaaataacattgccattcaagaaagaatggcaacgtctataccgtgaatggcaaaatacaacaattaaagacgattacgaatttctcaaatcgttcttcaatgtaaaatctatcactaaactacataagaaagtacgaaaagattttagcttaccgatatccacaaacgaaggaaaatttcttgttaaaaggaaaacttgggacaacaattttatttaccaaattttaaacgattcagacagccgagcggacggcactaaaccattcatcccggcattcgatatcagcaaaaatgaaatagttgaagccataatagattcgttcacaagcaaaaacatattttggctaccgaaaaatatagaattgcaaaaagttgacaacaaaaatatcttcgctatagacacgagcaaatggtttgaagtcgaaacaccaagtgacctaagagatataggaatagcaacaattcaatacaaaattgacaacaattcaagacccaaagtacgagttaaattagattacgtaatagacgatgattcaaaaatcaattatttcatgaatcactcgctcttaaaatctcgttaccctgacaaagtattagaaatactaaaacaatccaccataatcgagttcgaatcatctggatttaacaaaaccatcaaagaaatgttaggaatgaagttagctgggatatacaatgaaacaagtaataactga

SEQ ID NO: 8342 - RNA, 3162 nt, synthetic construct
  misc_feature 1..3162: note = Cas9 variant
  source 1..3162: mol_type = other RNA
atgaaacgaaattatatccttggactagacatcggaataacatcggttgggtatgggataatcgactacgaaacaagagacgtaatagacgcaggagtacggttattcaaagaagctaatgtggaaaacaacgaaggaagacgctcaaaaaggggagcacgcagactaaaacgaagacgacgacaccgaatacaaagagtgaaaaaactattattcgactataatctcctaacagaccactcagaattatcaggaataaatccatacgaagcaagagtaaaaggattatcacaaaaacttagcgaagaagaattctctgcagcccttctgcacctagccaagcgcagaggagtccacaacgtcaacgaagtggaagaagacacgggtaacgaactaagcacaaaagaacagatcagtagaaacagcaaagcactagaagaaaaatacgtagcggaactccaactggaacgcctaaaaaaagacggagaagtacgcggatcaataaatagattcaaaacatcggattacgtaaaagaagccaaacaactgctaaaagtacaaaaagcctaccaccagctggatcaaagctttatagatacatacatagaccttttagaaacacgacgaacatactacgaaggaccaggcgagggatccccgttcggctggaaagatataaaagaatggtacgaaatgttaatgggacattgcacatatttcccagaagaacttcgctcagtgaagtacgcttacaacgctgatctgtacaatgcacttaacgatttgaataatctagtcatcacaagagacgaaaatgaaaaattagaatattatgaaaaattccaaatcatagaaaatgtatttaaacaaaaaaaaaaaccaacactaaaacaaatagccaaagaaatactagttaacgaagaagatataaaaggttacagagttacatccacgggaaaaccagaattcactaacctcaaagtctaccacgacatcaaggacatcacagccagaaaagaaataattgagaacgcagaacttttagatcagattgcaaaaatcctaaccatataccaatcatcagaagacattcaagaagaactcactaatctcaactcagaactgacccaagaagaaatagaacaaatatcaaatctcaaaggttacactggcacacacaacctatcccttaaagcaataaatctaatcttagatgagttatggcataccaacgacaatcaaatagctatctttaatcgactcaagttagtcccaaaaaaagtagacctaagccaacaaaaagaaatacccacaactctcgttgacgactttatactatcacccgtagtgaaaagatcttttatacaatctataaaagtaataaatgccattataaaaaaatacggactaccaaacgacataataatagaactagcaagagagaaaaacagtaaagacgcacaaaaaatgataaatgagatgcaaaaaagaaatagacaaacaaacgaaagaatagaagaaataattagaaccacaggaaaagaaaatgcgaaatatttaatagaaaaaatcaaactgcacgacatgcaagaaggaaaatgcctatatagtcttgaagcaatacccctagaagatttattaaataaccccttcaactacgaagtagaccatatcatacctaggtctgtcagttttgacaactcatttaacaacaaggtacttgtaaaacaagaagagaacagtaaaaaaggtaacagaacaccattccaatatctttcctcctccgactccaaaataagttacgagacattcaaaaaacatatattaaacctggcaaaaggaaaaggaagaataagtaaaacaaagaaagaatatttacttgaagaaagagatataaatcgcttcagcgttcaaaaagacttcattaacagaaacctagtagacaccagatatgcaaccagaggtctcatgaacctattaagaagctattttagagtaaataatcttgacgtgaaagtaaaaagtataaatggaggttttactagtttcctacgaagaaaatggaagttcaaaaaagaacgaaataaaggatataaacatcacgccgaagatgctctaataatcgcaaacgcagacttcatattcaaagaatggaaaaagctcgataaagcaaagaaagtaatggagaatcaaatgtttgaagaaaaacaagcagaaagtatgcctgaaatcgaaacagaacaagaatacaaagaaatatttataacaccccaccaaatcaaacacataaaagacttcaaagactataaatatagccacagagtagataaaaaaccaaatcgggaattgattaacgacacactctacagcacacgaaaagatgacaaaggaaatactctaatagtaaacaacttaaacggcttatatgataaagataacgacaaattaaaaaaactgataaacaaatccccagaaaaactactaatgtaccatcacgacccacaaacctatcaaaaactaaaacttatcatggaacaatatggagatgaaaaaaacccattatacaaatactacgaagagaccggcaactacctaacaaaatactctaaaaaagacaatggacccgttataaaaaaaatcaaatattatggaaataaactaaatgcacatttggacataacagacgactacccaaactcacgcaacaaagtagttaaactctcactaaaaccatatcgattcgatgtatacctcgacaacggagtatataaattcgtcacggtcaaaaacctagatgtcatcaaaaaagaaaactactacgaagtaaactcaaaatgctacgaagaagcaaaaaaacttaaaaaaatatctaatcaagccgaattcatagcaagcttctataataatgacctaataaaaatcaacggagaactataccgcgtaataggtgttaacaacgaccttctaaatcggatagaggtaaacatgatcgatattacatacagagaatacttagaaaacatgaatgacaaaagacctcccaggataattaaaacgattgcctctaaaacccagtccataaaaaaatattcaacagatatccttggaaatctatatgaagtaaaatcaaaaaaacaccctcaaataataaaaaaaggatga

SEQ ID NO: 8343 - RNA, 4230 nt, synthetic construct
  misc_feature 1..4230: note = Cas9 variant
  source 1..4230: mol_type = other RNA
atgttatttaataaatgcataatcatttctattaacctagatttctccaataaagaaaaatgtatgacaaaaccctactcaataggtttggatataggaacaaattcagtagggtgggcagtaatcacagataactataaagtgccatcaaagaaaatgaaagtattaggaaacacatccaagaaatacattaagaaaaatttattaggagtgcttctgtttgactcaggaataaccgcggaaggacgcagactaaaaagaacagcacgacggcgctacacaagacgaagaaaccgaatactatacctacaagaaatcttctctaccgaaatggcaactctagacgatgcattctttcaaagattagacgactcatttctcgttccagatgacaaaagagactcaaaatacccaatctttggtaacttagtagaagaaaaagtataccatgacgagttcccaactatataccaccttagaaaatatctagccgactccactaagaaagcagacttacgcctagtctatctagcattagctcacatgatcaaataccgaggacactttctaatagaaggggagttcaatagcaaaaataacgacatccagaaaaattttcaagactttttagacacatataacgctatctttgaatcagacttatcactagaaaactctaaacaacttgaagaaatagttaaagacaaaataagcaaactagagaagaaagatcgaatactcaaattatttcccggagagaaaaattctggaatatttagcgagttcctaaaacttattgtaggaaatcaagcagattttcgtaaatgtttcaaccttgacgaaaaggcttcacttcactttagcaaagaaagctacgacgaagatttagaaacactacttggatacataggagacgactattccgacgtttttctaaaagccaagaaactgtatgatgcgatccttctatcaggatttcttacggtaaccgataacgaaactgaagcgccgttaagttcagccatgattaaaagatataatgaacacaaagaagacctggccctactaaaagaatatataagaaacatatccctaaaaacatacaacgaagtatttaaagacgatacgaaaaacggctacgcaggatatatagatggaaaaacaaaccaagaagacttttatgtatacctcaaaaacttactcgccgagttcgaaggcgcagattactttctcgagaaaatcgaccgagaagattttctacggaaacagcgaacattcgacaacggaagcataccttatcaaatacacctacaagaaatgagagctatattggacaaacaagccaaattctatccattcctagcgaagaacaaagaacgaatcgagaaaattttaaccttcagaataccatactatgtaggtcccttagcaagaggaaatagtgatttcgcatggagcatacggaaaagaaacgagaaaatcacaccatggaactttgaagatgtaatagataaagaatcatcagctgaagcattcatcaatagaatgacatcatttgacctataccttcctgaagaaaaagtcctaccaaaacatagcttactttacgaaacattcaacgtctacaacgaactaacaaaagttaggtttatagcagaatctatgcgggactatcagttcctagacagcaaacagaagaaagacatagttagactctactttaaagacaaaagaaaagtcaccgacaaagacatcattgaatacttacatgctatctatggatatgacggaatagaattaaaaggaatagaaaaacaattcaattcaagcctctcaacataccacgacctactgaacatcataaacgacaaagagttcctagatgatagttcaaatgaagcaatcatagaagaaataattcacacgttaacaatattcgaagacagagaaatgataaaacaaagactatctaaattcgaaaatatattcgacaaatccgtactgaagaaactatctagaagacattacacaggatggggtaaattatcagcaaaattaatcaacggaatacgtgatgaaaaatctggtaacacgattctcgactacttaatagacgatggtatatcaaatcgtaatttcatgcagctaatacacgacgatgcgctcagctttaaaaagaaaatacaaaaagcacaaataattggtgatgaagacaaaggaaacattaaagaagtagtaaaatcattacccgggtctcctgctatcaagaaaggaatactccaatcaataaaaatcgtagacgaacttgtaaaagtcatgggcggtagaaaacccgaaagtattgtggtcgaaatggcacgagaaaatcagtatacgaaccaaggaaaatcgaactcacaacaaagactaaaacgcctagagaaaagccttaaagaattaggttcaaaaatacttaaagaaaatataccagcaaaattaagtaaaatagataacaacgcactacaaaatgatagactatacttatactatttacaaaacggaaaagacatgtatacaggagacgatctagatatagaccgtttaagcaactacgatatagatcatatcataccacaagcattcctaaaagacaactcaattgacaataaagtcctggtatcttcggcgtcaaatagaggaaaaagcgacgactttccatccttggaagtggttaagaaacgaaaaactttctggtatcaattgctaaaatctaaattaatatcgcaaagaaaattcgataacctaactaaagccgaacggggtgggctattaccagaggataaagccggatttattcagcgacagctagtcgaaactagacaaataactaaacatgtagcacgactactagacgaaaaattcaacaacaagaaagatgaaaataatagagccgtaagaacagtaaaaatcatcactttaaaatcaaccctagtgtcacaattcagaaaagacttcgaactttataaagtacgagaaatcaatgatttccaccatgcacacgacgcctacttaaatgctgttatcgcatcagcactactaaagaaatacccgaaactcgaaccagagttcgtttatggtgactatccgaaatacaacagtttcagagaacgaaaatcagcaacagaaaaagtttatttttatagtaacattatgaacatattcaagaaatccatatcactggcagatggccgagttatagaacgaccactcatcgaagtcaatgaagaaactggagagtcagtttggaataaagaatcagacttagcaacagtacgtagagtactctcatacccccaagtaaacgtcgtcaagaaagttgaagaacaaaatcacggattagacagaggaaaacccaaagggctatttaacgcaaacctatcctctaaacccaaaccaaacagcaacgaaaatctagtaggtgctaaagaatatctagacccaaagaaatacggcggctacgcaggaattagtaattcctttgcggttctagtaaaaggaactatagagaaaggcgctaagaagaaaattactaatgtacttgaatttcaaggcatctcaatactagacagaatcaattatcgaaaagataaactgaacttcctcttagagaaaggttataaagacatagaattaatcatcgaactaccaaaatattccttattcgaactaagtgatggaagcagacgaatgctagcaagcatcttatcgacaaataacaaaagaggagaaattcataaagggaaccaaatcttcctatcgcaaaaattcgtaaaactcctatatcatgcaaaacgaatatcaaatacgataaacgagaatcacagaaagtacgtggagaaccataagaaagagtttgaggaattgttctactacatcctagaatttaacgaaaattatgttggtgccaagaaaaacggaaaactattaaattcagcattccaatcttggcaaaaccacagtatagatgaactatgcagttcatttataggtccaacgggatcagaacgcaaaggactttttgaactaacaagcagaggctccgcagctgatttcgaatttttaggtgtaaaaataccacgttatagggactatacacccagctcccttttaaaagacgcaacgttgatccaccaatcagtaactggattatatgagacacgaatagatttggcaaaactaggagaaggatga

SEQ ID NO: 8344 - RNA, 3306 nt, synthetic construct
  misc_feature 1..3306: note = Cas9 variant
  source 1..3306: mol_type = other RNA
atgtggtatgcaagtcttatgagcgcgcaccaccttagggttgggatagatgttggaacacattcagtaggtctagcaacgttaagagtagacgaccatggaacaccaatagaactattaagtgcattaagtcacatacatgattcaggcgtaggaaaagaaggaaagaaagatcacgatacgaggaagaaattaagtggaatagcaaggcgagccagaagattactacaccaccgaagaacacagctacaacaattagacgaagttctaagagatctaggcttccccattccaactccaggcgaatttttagatttaaacgaacaaacagacccataccgagtatggcgagttcgtgctagattagtagaagaaaaactaccagaagaactgcgagggcctgccatatcgatggcagttcggcatattgcgagacatagaggatggagaaatccgtatagtaaagtagaaagccttctaagtcctgctgaagaatcaccattcatgaaagccttgagagaacgaatattagcaactacaggagaagtgctagatgatggaataacaccggggcaagcaatggcacaagttgctttaactcataacattagtatgagaggaccagaaggaatcttgggaaaattacaccaatcagataatgcaaacgaaatacgtaaaatatgtgcaaggcagggagtaagtccggatgtatgcaaacaattacttcgcgctgtgtttaaagcagacagtccgagaggaagcgcggtttcacgagtagctcctgatccactaccaggacaaggaagttttagacgagcgccaaaatgcgatcccgagttccaaagatttagaattataagtattgttgcgaatctaaggatcagtgaaacaaaaggagaaaatagaccattaacagcagatgagagacggcacgtagtgactttcttaacggaagattctcaagccgatctaacatgggtagatgtcgctgaaaaattaggagtacatagaagagatctacgtggaacagcagttcataccgacgatggagaaagatctgctgcaagaccaccgattgatgcaaccgacagaataatgagacaaacaaaaataagttccttaaaaacatggtgggaagaagctgattcagaacaaagaggtgcaatgatcaggtatctttatgaagatccgactgacagcgagtgtgcggaaataatagctgagcttccagaagaagatcaagcaaaattagatagcttacatttgccagctggtagggcagcgtactctcgagaaagtttaacagcgctgtcagatcatatgttagcgacaacagatgatttgcatgaagcaaggaaaaggttgttcggcgtagatgattcgtgggcacctcctgctgaagcaataaatgcaccagtaggaaatccatcagttgatagaactctaaaaattgttggaagatatctaagcgcagttgaaagtatgtgggggacaccagaagtaatacacgtagagcatgtgagagatgggtttacaagtgaaaggatggctgacgaacgagacaaagcaaataggcggagatacaatgacaaccaggaagcaatgaagaaaatacaacgtgattacggaaaagaaggatatatttctcgaggagatatagtcagactcgacgctttagagctgcaaggatgcgcttgcctctattgtggaactacaatagggtaccatacatgtcaattagatcacatagtacctcaagcaggacccggaagcaataatagaaggggtaatttagtagctgtttgcgaaagatgtaacagaagcaaaagcaatactccattcgcggtatgggcgcaaaaatgcggcattccacatgtaggggtgaaagaagcaatcggacgagtgcgtggttggagaaaacaaactccaaacacatcctctgaagatttaacaaggctaaagaaagaagtaatcgctcgattaagaagaacacaggaagatccagaaatagacgagagatcaatggaatcagttgcgtggatggctaacgaattacatcaccgaatagcagcggcatatcccgaaacaacagttatggtatacagaggaagtataactgctgccgctagaaaagcagcaggtatcgattcaagaattaatttaataggagaaaaaggcagaaaagacagaatagatcgaagacatcatgcagtagatgcatcagtagtagccttaatggaggctagtgtcgcaaaaactttagctgaacgtagtagcctaagaggagaacaacgtctaacaggaaaggaacaaacatggaaacaatatacaggtagcactgtaggggcacgtgaacactttgagatgtggcgagggcacatgctacatctaaccgaattgttcaacgaaagattagcagaggataaagtgtacgtaacacaaaatataagattaagactttcggacggaaacgcccatacagtaaatccatccaaattggtgagccacaggctaggagatgggttaacagtgcaacaaatagatcgagcttgtactccagcactttggtgtgcattaacaagagaaaaagattttgacgagaaaaacggattgccagcccgagaagatagagcaattagagtccatggacatgaaataaaatcttcagattatatacaagttttcagcaaaagaaagaaaacggattccgatagggatgaaacaccattcggcgccattgcggttagaggaggttttgtggaaattggaccatcaatacatcacgctcgcatttatagagtagaagggaagaaaccagtatatgctatgttaagggtcttcacacacgatctattaagtcaacgacatggcgatttgttttccgcagtaattcccccgcaaagcatatcaatgagatgtgcagaacccaaattaagaaaagcaataacaacagggaatgcaacatatttagggtgggtcgtagtaggagacgaattagaaattaacgtagactcattcacaaaatatgctataggacggttcctagaagactttcctaatacgacaagatggagaatctgtggatatgatacaaacagcaaattgacactaaaacctatagtattagcagcagaaggtttagaaaatccaagcagtgcagttaatgaaatcgtcgaattaaaaggctggcgcgtagcaattaatgtacttaccaaagtacacccgacagtagtaagaagagatgctctaggtagaccaagatactcatcaagatcaaacctaccgacttcatggaccatcgaatga

SEQ ID NO: 8345 - RNA, 4167 nt, synthetic construct
  misc_feature 1..4167: note = Cas9 variant
  source 1..4167: mol_type = other RNA
atgacaaaaccatacagcatagggttagatattggaaccaactcagtaggttgggcagttaccactgacaactacaaagtaccatcgaagaaaatgaaagtacttggtaacacatcgaagaaatatataaagaaaaatttactaggtgtactactcttcgattccggtataacggctgaaggcagaaggctaaaaagaacagcccgtagaagatacacacgcagaagaaatagaatcctatatttacaagaaatcttttcaacagaaatggcaactttagatgatgccttcttccaacgattagacgactcattcttagtaccagacgataaaagagatagtaaatatccaattttcggaaacttagtagaagaaaaagcatatcatgatgaatttcccacaatctatcacctaagaaaatatctggccgatagcacaaagaaagcagacctacggctagtatatttggccctcgcacatatgattaaatacagaggacatttcctcatagaaggagagttcaactccaaaaataacgatatccagaaaaacttccaagactttctcgatacatataatgccatatttgaaagcgatttaagtctagaaaactcgaaacaattagaagaaattgtaaaagataaaatatcaaaactcgaaaagaaggatagaatactcaaactatttcccggagagaaaaacagtggtatattctctgaatttttaaaactaattgttggaaaccaagcagattttcgaaaatgctttaatcttgatgaaaaagcctcactacatttttcaaaagaatcatatgacgaagacctggaaacattactaggctatataggggatgactactcagatgttttcctgaaagctaagaaactctacgatgcaattctattatcaggtttcctcacagtgactgacaatgaaacagaagcacccctctcctccgcgatgataaaaagatacaatgaacacaaggaagatttggcactattaaaagagtatatccgaaatatatctttaaaaacatataatgaagtatttaaggatgatactaagaatggatatgcaggatatatagacgggaaaacaaaccaagaagatttttatgtatacctgaagaaactactagccgagttcgaaggagctgattactttttagagaaaatagatagagaagatttcttaaggaaacaaagaacttttgacaacggatcaataccctatcaaatacatctgcaagaaatgagggctatcctagacaaacaagccaaattttatcccttcttagctaaaaacaaagaaagaattgaaaagatactaacgttcagaataccctactacgtcgggccgcttgcacgaggtaattccgattttgcatggagtattcgaaaacggaatgagaaaattaccccatggaacttcgaagacgtaattgataaagaatcatccgccgaagcattcataaacagaatgacaagttttgatttgtatctaccagaagaaaaagtccttccgaaacacagtttattatacgaaacatttaatgtatataacgaactaacaaaagtcagattcatagcagaaagtatgagagattaccaattcttagacagtaagcaaaagaaagacatagtacgcctctatttcaaagacaaacgcaaagtcacagacaaagacataatagaatacctacacgccatatatggctatgatggaatagaactcaaaggtatagaaaaacaattcaactcatcattatcgacgtaccatgatttacttaacattatcaatgataaagaatttttagatgattcttcaaatgaggcaattatcgaggaaattatacacacgctcacaatctttgaagacagagaaatgataaaacaacgactatccaaatttgaaaatatatttgataaatcagtcctaaagaaactatcaagacgacattacacagggtggggaaaactcagtgcaaaattaataaacggaataagagatgagaaatcaggaaatacaatattagactatttaattgacgacggcatatcaaatagaaatttcatgcaacttatccatgacgatgccttgtcattcaaaaagaaaattcaaaaagctcaaattataggagatgaagataaaggtaacattaaagaagttgtaaaatccctgccaggaagtcctgcaataaagaaaggaatactacaatcaataaaaatagtagacgaattagttaaagtcatgggcggaagaaaaccggaatcaatagtcgtagaaatggccagagaaaaccaatatacaaatcaaggtaaatcaaatagtcagcagagattaaaaagattagaaaaatcattaaaagaattaggatcaaaaattctcaaagaaaacattccagcaaaactatccaaaatcgataataacgcactacaaaacgaccggctttacttatattatcttcaaaatggaaaagacatgtacacgggtgacgacttggatatagataggctttccaattacgatatagatcatataataccacaagcctttttgaaagacaatagcatagacaataaagtcctagtatcaagtgcatcaaatcggggaaaatcagatgacgtccccagtctagaagttgttaaaaagcgaaagacattctggtatcaactgttaaagtccaaactgattagtcaacgaaaattcgacaacctcacgaaagcggaaagaggaggactatcaccagaagacaaggctggcttcatccaaagacagttagtagaaaccagacaaataacaaaacacgtcgccagactgttagacgaaaaattcaacaacaagaaagacgaaaacaatcgagcagtaagaaccgtaaaaataataaccttaaaatcaacactcgtttcccaattccgaaaagatttcgaactatataaagtacgagaaattaatgactttcatcatgctcacgatgcttatctgaacgccgtcgtagcaagcgcattacttaagaaataccctaaactagaaccagaatttgtatacggcgattacccaaaatacaattccttccgagaacgcaaatcagcaaccgaaaaagtatacttttattccaacatcatgaacatatttaagaaatccatatctctagccgacggacgagttattgaacgaccgctaatagaagttaatgaagaaacaggagaaagtgtgtggaataaagagtctgacttagcgaccgtaagaagggtcctaagttatccacaagtaaatgtagtaaagaaagtagaagaacaaaaccatggactagaccgcggaaaacccaaaggactatttaatgcaaacctgagtagcaaaccaaaaccaaactcaaacgaaaacctcgttggcgcaaaagaatacctagatcccaagaaatacggcggctacgctggtatatccaatagctttacagtcctagtaaaaggtacaatagagaaaggagccaaaaagaaaataacaaacgtattagagttccaaggaatatctatactagaccgaatcaactacagaaaagataaactcaatttcttactggaaaaagggtataaagacatcgaattaatcattgaactgcctaaatacagcctttttgaactctcggacggctcaagacgtatgttagcaagcatactgtccacgaacaataaacgtggggaaatacacaaaggaaaccaaatatttctttcacaaaaattcgtaaaattactataccacgcaaaaagaataagcaatacaataaatgaaaaccatagaaaatacgtagaaaatcataagaaagaatttgaagaactcttttactacattttggagttcaacgaaaactatgttggagcaaagaaaaacggcaaacttctaaactctgcatttcaaagctggcagaatcacagtatagacgaactatgttcaagtttcatagggccaactgggagcgaaagaaaaggactatttgaacttacatcaagaggatccgcagcggatttcgaatttttaggtgtaaaaataccacgttatagagactacacaccatcaagtttgctgaaagatgctacattaatacaccaaagtgtcactggattatatgaaactagaatcgatttagccaaactaggagaaggctga

SEQ ID NO: 8346 - RNA, 3249 nt, synthetic construct
  misc_feature 1..3249: note = Cas9 variant
  source 1..3249: mol_type = other RNA
atggcagcattcaaaccgaatagcataaattacattttaggattagatattggaattgcctcagtaggatgggcgatggttgaaatagatgaagaagaaaatcctattagattgatagaccttggagtgcgagtattcgaacgagcagaggtacctaaaacgggggatagtttagcaatggcacgacggttagcaaggtctgtaagaagactaacaagaaggagagcacatagactactaagaacgagacgactactcaaaagagaaggagtattacaagctgcaaacttcgatgaaaacggcctcataaagagcttaccaaatactccgtggcaactgagagcagccgccttagaccgaaaactgacacctcttgaatggtcagctgtactattacacctaataaaacacagaggttatttaagtcaacgaaagaatgaaggagaaacagcagataaagaactaggagcgttactaaaaggcgtggcgggaaatgcccacgctctgcaaactggcgatttcagaacaccggcagagcttgcattaaataaatttgaaaaagaatcaggtcatataagaaaccaaagaagtgattactcacatacgttttcacgaaaagatctacaagcggaactaatattattattcgaaaaacagaaagaatttggcaatccccatgtatcaggcggattaaaagaaggaatagaaacattactaatgacacagagaccagcactgtcaggtgacgcagttcagaaaatgttgggtcactgcactttcgaaccagcagaaccaaaagctgccaaaaatacatacacagcagaacgctttatttggctaacaaaacttaataatttacgtatactcgaacaaggatcagagagaccactaactgatacagaacgggcgactctaatggatgaaccatacagaaaaagcaaactgacatacgcgcaagcaagaaaattacttggtttagaagacaccgcatttttcaagggactaagatatggaaaagataatgcagaagcgtcaaccctaatggaaatgaaggcataccatgcaatttcaagagcacttgaaaaagaaggacttaaagacaaaaagtcacccctaaatcttagcccagaacttcaagacgaaatcgggacagcatttagtttgtttaaaacagacgaagatataactggaagattaaaagatagaatacaaccagaaatattggaagcactactcaaacatatctctttcgataaatttgtacaaatcagtctaaaagcattaagacgtatagtgccattaatggaacaaggaaagcgatacgacgaggcctgtgcagagatatatggagatcactatggcaagaaaaataccgaagagaaaatatatcttcccccaatcccagcagatgaaatacgcaatccagtagttttaagagctctttcacaagcaaggaaagtaattaatggagttgttagacgatacggatcaccagctagaatccatatagaaactgcaagagaagtaggcaaatcatttaaagataggaaagaaatcgagaaaagacaagaagaaaaccgaaaagatagggaaaaagcagcagcaaaatttagagaatactttcctaattttgtaggagaaccaaaatcaaaagatatactaaaactccgtctatacgaacaacaacatggaaaatgcttatatagtggaaaagaaataaatttaggtcgactaaatgagaaagggtacgtggaaatagatcatgctttacccttctcaagaacctgggacgatagctttaataataaagtactggtacttggatcggaaaatcaaaataaaggtaaccaaaccccgtatgaatactttaatggcaaagataatagtagagaatggcaagagttcaaagcacgagtagaaacatccagattcccaagatcaaagaaacaaagaatattactacagaaattcgacgaagacggatttaaagaaagaaatttaaacgatactagatatgtaaacaggtttttatgtcaatttgtggcagaccgaatgagactaacaggaaaaggaaagaaaagagtcttcgcaagtaatggtcaaatcaccaatttattgagaggattttggggccttagaaaagttagagcagaaaatgatagacatcatgcgttagacgcagtggttgtggcttgcagcactgttgcaatgcagcagaaaataaccagatttgtacgatataaagaaatgaatgcattcgatggcaaaacaatagacaaagaaacaggtgaagttttacatcagaaaacacattttccccaaccctgggagttctttgcacaagaagttatgataagagtattcggaaaacctgacgggaaaccagagttcgaagaagccgatacattagaaaaactgagaactctcctagcggaaaaacttagctcaagaccagaagcagtacacgaatatgttacgccgttattcgtctcaagagctccaaatcgcaaaatgtcaggacaaggacacatggaaaccgtaaaaagcgcaaaaagactagacgaaggcgtaagcgtactgagagtaccattaacacaattaaaattaaaagatctcgagaaaatggtcaacagagaaagagaacccaaattgtatgaagcactaaaagcacgactagaagcgcataaagatgacccagcaaaagcatttgcggaacccttttacaaatatgataaagcaggtaatcgaacacaacaagtaaaagcagtacgagtagaacaagtgcagaaaacaggagtttgggtacgaaatcacaatggcattgctgacaatgcaacaatggtacgcgtagacgtattcgaaaaaggagataaatactacctagtccctatttacagttggcaggttgcaaaaggaatcttaccagatagggctgtagtacaaggaaaagacgaagaagactggcagctaattgatgattcttttaattttaaatttagccttcacccaaacgacctagttgaagtaataaccaagaaagcaagaatgtttggatattttgcgagctgtcaccgtggtaccggaaatattaatataagaatacatgatttagaccacaaaataggtaaaaatggaatcctagaaggaataggggtaaaaacggcattatcttttcaaaaatatcaaatagatgaactaggaaaagaaatacgaccctgtagattaaagaaacgccctcctgtaagatga

SEQ ID NO: 8347 - RNA, 4005 nt, synthetic construct
  misc_feature 1..4005: note = Cas9 variant
  source 1..4005: mol_type = other RNA
atgaagaaaccctacacaatcggcctggacatcggaactaacagcgtaggatgggcagtattaactgatcaatacgacctggtcaagaggaaaatgaaaatagcaggagactcagaaaagaaacaaataaagaaaaatttttggggagtcagactattcgatgaaggtcagacagcggcagaccgcagaatggcaagaacagccagaagaagaatagagagaagaagaaatagaataagctatttacaaggaattttcgcagaagaaatgtctaaaacagatgcaaatttcttttgcagactaagcgattcattttatgtagataacgagaaaagaaactcacgacatccattctttgctactatagaagaagaagtagaataccacaaaaactatccaacaatatatcatttacgtgaggagctagtgaacagcagcgaaaaagctgatttaagactcgtatacttagcattagcgcatattattaagtacagaggaaattttctaattgaaggagcacttgatacacaaaacacatctgtagatggcatctataaacaatttatacaaacatacaaccaagtgttcgcatcggggatcgaagacggcagcctaaagaaacttgaagacaacaaagacgtagcaaaaatcctagtagaaaaagtgacgcgaaaagaaaaactagaaagaatactcaagctatatccaggagaaaaatcagcggggatgttcgctcaattcatatcactaattgtaggaagtaaaggaaattttcaaaaaccattcgatttaatcgaaaaatcagatatagaatgcgcaaaagacagctatgaagaagacctcgaatcattacttgccctgatcggagacgaatatgcagaactattcgtagctgccaaaaatgcatactcagccgtagtactatcttcaataataaccgtcgccgagaccgaaacaaacgcaaaactatcagcatctatgatagagagatttgacacccatgaggaagatcttggcgaattaaaggcttttataaaattacatctcccaaaacattacgaagaaatattttctaacacggaaaaacatggctatgcaggatacatagacggaaaaactaaacaagcagacttttacaagtatatgaaaatgacattagaaaacatagaaggagcggattactttatagctaaaatcgagaaggaaaactttctcagaaaacaacgaacattcgataatggcgccattccacaccagctgcacttagaagaattagaagcgatactgcaccagcaagcaaaatactacccattcttaaaggaaaattatgataaaataaagtcgttagtaactttccgaataccatacttcgtcgggccactagcaaacggacaatccgaatttgcatggctaacaagaaaagcggatggagaaattagaccatggaatatagaagaaaaagtagattttggtaaatctgccgtagattttattgaaaagatgacgaataaagatacctacctacctaaagaaaatgtattacctaaacatagtttgtgttatcaaaaatatttagtatacaacgaattaactaaagtaaggtatatcaatgatcaaggtaaaacctcatatttctcaggacaagaaaaagaacaaattttcaatgatctatttaaacaaaaacgcaaggtcaaaaagaaagacctagaattattcttacgaaatatgtcgcacgttgaatctccaaccatagagggactagaagacagttttaattctagttatagcacttaccatgaccttctaaaagtaggaataaaacaggaaatactagacaatccagtgaatacagaaatgctagagaatatagtgaaaatattaactgtttttgaagataaacgaatgataaaagaacaactacaacaattctccgatgtactagacggagttgtattaaagaaacttgaacgtcgacactatacgggatggggaagactctcagcaaaactgctgatggggataagagataaacaatcccacttgactatcctggattatttaatgaacgacgatggcctaaacagaaatctaatgcagctgataaacgattcgaatctatcttttaaaagcataatagaaaaagaacaagtaacaacagcagacaaagacatacaaagtatagtcgcagacttagcaggttcgccagcaatcaagaaaggaatactacaaagtcttaaaatagtagacgagctagtatccgtgatgggctacccaccgcagacgatcgtagtagaaatggctcgagaaaaccaaactactggtaaaggtaaaaacaacagcagaccaaggtacaaatcattagaaaaagctataaaagagttcggatcccaaatactaaaagaacatcctacggacaaccaagaactaagaaataataggctctatttatactaccttcagaacggaaaggacatgtacacaggccaagacttagatatacacaatctgtcaaattacgacatagaccacatcgttccacaatcttttataacagacaattcaatagataacctagtactcacaagctcagccgggaacagagagaaaggcgacgacgtaccaccgctagaaatagtcagaaagagaaaagtgttctgggaaaaactatatcaaggaaatcttatgagcaagagaaaattcgactacttaacaaaagcagaaagaggtggcctgaccgaagccgacaaagcccgttttatacataggcagctagtagaaactagacaaataactaaaaatgtagcaaacatactgcaccaaagattcaattacgaaaaagacgaccacggtaatacaatgaaacaagtacgcatcgtgaccttaaaatcagcattggtatcacaatttcgaaaacaattccaattgtataaggttcgggatgtaaacgactatcatcacgcacacgacgcatatctgaacggcgtcgtggccaatactctattaaaggtttacccacaattagaacctgagtttgtgtatggagactatcatcaatttgactggtttaaagcaaataaagcaaccgctaagaaacaattctacacaaacataatgctattctttgcacaaaaagaccggataatagatgaaaatggtgaaatactatgggataagaaatacctggatacagtaaagaaagttatgtcgtacagacaaatgaacatcgtaaagaaaacagaaatccaaaaaggcgagttctccaaagctactataaaaccaaaaggaaactctagcaaactaatccccagaaaaacaaactgggatccaatgaaatatggaggcctagacagtccaaatatggcatacgctgtagttatagaatacgccaaagggaaaaataaattagtatttgaaaagaaaataataagggtaacaataatggaaagaaaagcgttcgaaaaagatgaaaaagcctttttagaagaacaaggatatagacagccaaaagttctagcaaaacttcctaaatatacattatacgaatgcgaagaaggaagaagaagaatgttagcaagtgcaaatgaagcacaaaaaggcaaccaacaagttttaccaaatcatttggtcacattactacaccacgctgccaattgcgaggtgagtgacggcaaatctttggactatatagaaagcaatcgcgagatgtttgcggagttactcgcacacgtaagtgaatttgcaaaacgatatacgcttgcagaagcaaacctaaacaaaattaatcaattattcgaacaaaacaaagaaggcgacataaaagcaatagcgcaatcatttgtagacttaatggctttcaacgctatgggggctccagccagttttaaattctttgaaaccactatagagagaaaaaggtataataacttaaaagaattactaaattctacaataatttaccaaagtatcaccggattatacgaaagtagaaaaagattggatgattga

SEQ ID NO: 8348 - RNA, 4038 nt, synthetic construct
  misc_feature 1..4038: note = Cas9 variant
  source 1..4038: mol_type = other RNA
atgaagaaaccatatagtattggattagatataggaacaaacagcgtaggatgggcagtcgtcacagacgattataaagtacccgcaaagaaaatgaaagttctaggaaacaccgacaaatctcacatcgaaaagaacctactaggagcgttactattcgattcaggtaacacagcagaagatcgaagactaaaaagaaccgcacgacgtcggtacacaagacgcagaaaccgaattttatatctgcaagaaatcttttcagaagaaatgggtaaagtcgacgatagcttcttccatcgcttagaagatagtttcctagttacagaagacaaaagaggagaaagacatccaatattcggcaacctcgaagaagaagtgaaatatcacgaaaattttccaacaatttatcatctccgccaatacctagccgacaatcccgaaaaagtagacttaagattagtatacctagccctcgcccacataataaaatttagaggacacttcctcatagaaggtaaatttgacactagaaataacgacgtccaaagactgtttcaagaatttctagcagtttacgataacacatttgaaaacagttcactacaagaacaaaatgttcaagtagaagaaatacttaccgataagatctcaaaaagcgcaaagaaagatagagtactcaaactctttccaaatgagaaaagcaacggaagattcgcagagttcctaaaactaatagtaggaaaccaagcggacttcaagaaacacttcgaactagaagaaaaagctcccctgcaatttagtaaagatacatatgaagaagaattggaagtactactggcacaaataggtgacaattatgcggaactcttcctatctgctaaaaagctatatgattccatactcttatccggaatactcacagtcacagacgtcggtacaaaagcaccgttatcagcgtctatgatacaaagatacaacgaacaccagatggatctggcgcaattaaaacaatttatccgacaaaagctaagcgacaaatacaatgaagtcttcagtgatgtatcgaaagacggatatgcaggatacatcgatggtaaaactaaccaagaagcattctacaagtacctaaaaggcttattaaacaaaattgaaggtagtggatattttctagataagatcgaacgagaagactttttaagaaaacaacgtacattcgataatggcagtattccgcatcaaatacaccttcaagaaatgagagccattataaggaggcaagcagaattttacccgtttttagcagataatcaagacagaatagagaaactactaacattccgaataccatactacgttggacccttagcacgaggaaaatctgattttgcttggctaagcagaaaaagtgctgacaaaataacgccatggaattttgatgaaatagtagacaaggaatcctcggccgaggcattcattaatcggatgacaaattacgatttgtatttgccaaaccaaaaggtattgcctaagcattctctactatatgaaaaattcacagtatacaacgaactaactaaagttaaatacaaaacagagcaaggtaaaaccgcattctttgacgcaaacatgaaacaggaaatattcgacggagtatttaaagtatacagaaaagtcacaaaagacaagctaatggacttcttagaaaaggaatttgatgagttccgaatagtcgaccttacaggcctggataaagaaaacaaagtatttaacgcaagttacggaacgtatcatgatttatgtaaaatacttgacaaagacttccttgacaattcgaaaaacgagaaaattttagaagatatagttctaacattaacattatttgaagaccgcgaaatgatacgtaaaagattagaaaactacagcgacttacttactaaagaacaagtcaaaaagctggaaagacgacactacaccggttggggaagactcagtgcagaactaatacacgggataaggaacaaagaatccagaaaaacaatcttggactacctaattgatgatgggaatagcaaccgcaactttatgcaactgataaatgacgacgcattatcatttaaagaagaaatcgcaaaagcccaggtaataggcgaaaccgataacctaaatcaagtagttagtgacatcgctggatcccccgcaataaagaaaggtattctacaatctcttaaaatcgtagacgaattagtaaaaataatgggacatcaaccagaaaatatagtcgtagaaatggccagggaaaaccaattcacaaatcagggacggcgaaacagccaacaacgactaaaaggactaaccgactcaatcaaagagttcggttcacaaatacttaaagaacaccccgtagaaaattctcaacttcaaaatgaccggctgttcctatattatctacaaaacggcagagacatgtatacgggagaagaactcgatatagactacttgagccagtacgacatcgaccatattatacctcaagccttcataaaagataattcaatagataatagagtattaacctcttcaaaagaaaatagaggcaaaagtgatgatgtaccaagtaaagacgtggtacggaaaatgaaaagttattggagtaaacttttatcagctaaattaataacacaaagaaaatttgataatttgacaaaagccgaaagaggtggactaacagatgatgataaagccggattcatcaaaagacaacttgtagaaacccgacaaataacgaaacatgtggcaagaatactagacgaacgatttaatacagaaacagatgaaaacaataagaaaattcgacaagttaaaattgtaacattgaaaagcaatctagttagtaattttcgaaaagaatttgaattatacaaagtacgcgaaataaatgattatcatcacgctcatgatgcataccttaatgcagtcataggaaaagcgctacttggagtatacccccagctcgaaccggaatttgtctatggagactacccacacttccatggacataaagaaaacaaggcaacagcaaagaaattcttttatagtaatataatgaatttctttaaaaaggatgacgtaagaacagacaaaaatggcgaaataatatggaagaaagacgaacacattagtaacataaagaaagtattaagttacccacaagtcaacatagtaaagaaagttgaagaacaaacagggggattttcaaaagaaagtatattaccaaaaggcaacagcgataaactaataccaagaaaaaccaagaaattttattgggacacaaagaaatatggaggttttgattcacccatagttgcatatagcatattagtaatcgcagacattgaaaaaggaaaatcaaagaaactcaaaacggtgaaagcgttagtcggcgttaccataatggagaaaatgacatttgaaagagatccagtagcattccttgaaagaaaaggctaccggaacgttcaagaagaaaacataataaaattacccaaatacagcctattcaaattagaaaacggcaggaaaagactacttgcaagcgccagggaactgcaaaaaggcaatgaaatagtactacctaaccacttaggaaccttattataccatgccaaaaatatccacaaagttgacgaaccaaaacatctagactatgttgacaaacataaagatgaatttaaagaattattagatgttgtatcaaacttttcaaagaaatatacattagcagaaggaaatttggagaaaataaaagaattatacgcacaaaataacggcgaagacttaaaagaactagcaagctcatttataaatttgttgacctttacagcaataggagcgcctgcaaccttcaaattctttgacaaaaacattgatcgtaaaagatacacaagtacaaccgaaatactcaacgctacactaatacaccaaagtatcacaggactatacgagacaagaattgacttaaataaactaggtggagactga

SEQ ID NO: 8349 - RNA, 3171 nt, synthetic construct
  misc_feature 1..3171: note = Cas9 variant
  source 1..3171: mol_type = other RNA
atgcaaacaactaatttaagctacattcttggattagatctaggaatcgcatcagtaggctgggcagtagttgaaattaatgaaaacgaagatccaataggtctaatagatgtaggagttagaatatttgaaagagctgaagttcccaaaacaggagaatcactagcgttatcgcgaaggcttgctagaagtacaaggagactaatcagacgacgcgcacatagactcttacttgctaaacgctttctaaaaagagaaggaatactatccacaatcgatcttgaaaaaggcctaccaaatcaggcatgggagttaagagtagctggtttagaacgaagactaagtgcgatagaatggggagcagtactactacatctcataaaacatagaggatatttatcaaaaaggaaaaatgagtcacaaactaataacaaagaacttggagcattactaagcggggtagcacaaaaccaccaacttcttcaaagtgatgactacagaacaccagcggaacttgcactaaagaaatttgcaaaagaagaaggacacatccggaaccaaagaggcgcatacacacatacattcaatcgactagatctactagcagaattaaatttactttttgctcaacaacatcaatttggtaacccacactgtaaagaacatatacaacaatacatgacggagctacttatgtggcaaaaaccagcattatccggtgaggcaatattaaaaatgctaggcaaatgcactcatgagaaaaatgagttcaaagcagctaaacatacttacagcgctgaacgatttgtttggctgacaaaattaaacaatttaagaatactagaagatggagcagaacgagctctaaacgaagaggaacgacaactattaataaaccatccatatgaaaaatcaaaattaacctatgcacaagtaagaaaattactaggattaagcgaacaggcaatctttaaacacttaagatactctaaagaaaatgcagaatcggctacattcatggaattaaaagcctggcatgcaatacgcaaggcattagaaaaccaaggactaaaggacacttggcaagacttagcaaagaaaccagacctactagacgaaataggcacagccttctccctgtacaaaacagatgaggatatacaacagtatctaacaaataaagtcccaaattcagttataaacgctttattagtgagtttaaacttcgataaatttattgaactaagcctcaaaagtctaagaaaaattctccctctaatggaacaaggaaagaggtacgatcaagcatgcagagaaatatacggacatcattacggagaggcaaatcagaaaacctctcaactactcccagctattcctgctcaggaaattcgaaatcctgtagtcttaagaacattatcacaagcaagaaaagtcattaatgctataatacgccagtacggcagccccgcacgtgtacacatcgagacgggaagagaacttggaaaatcattcaaagaaagaagagaaattcaaaaacaacaagaagataaccgaactaagagggaatcagccgtgcaaaaattcaaggaactatttagcgatttttccagtgaaccaaaatcaaaagacatcttgaaattccgattatacgagcaacaacacggtaaatgtctatattcagggaaagaaataaacatacatagactaaatgaaaaagggtacgtcgaaatagatcatgccctacctttctcaaggacctgggacgatagctttaacaataaagtcctagtcttagcttctgaaaaccaaaataaaggaaaccaaaccccttatgaatggctacaaggcaagataaattcagaaaggtggaaaaacttcgtagccttagtattaggatcacaatgttcagcagctaagaaacaaagactattaacacaggtaatcgatgacaataaattcatagacaggaacctaaatgatactagatacatcgccagatttttatctaattacattcaagaaaacctactattagtcggcaaaaacaagaaaaacgtatttacaccgaacgggcagatcacagccttacttagatcaagatggggactcatcaaagccagagaaaacaataaccgccaccacgccttagacgctattgttgtcgcttgcgcaacacccagcatgcagcagaaaataacaagattcatcagatttaaagaagttcatccatataaaatagaaaacagatatgaaatggtggatcaagaatcaggagaaataatatctccacatttcccagaaccatgggcctacttcagacaagaagtaaatataagagtattcgataaccatccagacaccgtactaaaagaaatgttaccagaccgccctcaagccaatcaccaattcgtacaacctttatttgtttcacgagcaccaactcgtaaaatgtcaggacagggacacatggaaaccattaaaagcgcaaaaagattggcagagggaattagtgtactaagaatacccctaacacaattaaaaccaaatctactagaaaacatggtaaacaaagaaagagaacctgcattatacgcaggtctcaaagcacgtctggcagagttcaatcaagatccagcaaaagcctttgctacacctttttataaacaaggaggacaacaggtaaaagcaataagagttgaacaagtccaaaaatccggggtactcgtaagagaaaacaacggtgttgcagataacgcctctatagttcgaactgatgtattcatcaaaaacaacaaattctttttagttcctatatatacatggcaagtagcaaaaggtatactacctaacaaagcaatagtagcacacaaaaacgaagacgaatgggaagaaatggatgaaggagcgaaatttaaattttccttatttcccaatgatcttgtagaactaaagactaagaaagaatacttctttggatactatataggactagatagagctacgggaaatatatcactaaaagaacacgacggcgaaataagtaaaggaaaagatggagtctatcgagtaggcgttaaattagccttatcatttgaaaaatatcaagttgacgaattaggaaagaatagacaaatatgtagaccacaacaacggcaaccagtgcgatga

SEQ ID NO: 8350 - RNA, 3249 nt, synthetic construct
  misc_feature 1..3249: note = Cas9 variant
  source 1..3249: mol_type = other RNA
atggccgcattcaaaccaaatccaataaattacatattaggtttagatataggtatcgctagtgtaggatgggcaatggtagaaatagacgaagatgaaaatcctatatgtttaatcgacctaggtgtaagagtattcgaacgtgctgaagttccaaaaacaggtgatagtttagcaatggcacgcagattagcaagaagcgtaaggcgattaactagaaggagagcccacagattattaagagcaagaagactattaaaaagagaaggagtactacaagcagcggattttgacgaaaatggactgataaaatcactacctaatacaccatggcaactaagagctgcagcactggatagaaaactaacccccttggaatggtcagcagtattacttcatctcataaaacaccgaggatatctaagtcaaaggaaaaatgaaggagaaactgctgataaagaattaggagcactgctaaaaggagtcgcagataatgcacacgcattacaaactggagatttcagaacaccagcggaactagctctcaacaaattcgaaaaggaatcaggacacatacgaaatcaaagaggagactatagccacacgtttagtcggaaagacctacaagcagaactgattctactctttgaaaaacaaaaggaatttggtaatccacacgtttcaggcggactaaaagaaggaatagaaacattactaatgacacaaaggcctgcgttatccggtgacgcagtacaaaagatgctcgggcattgcacgtttgaaccggcagaaccaaaagcagctaaaaacacatatacagcagaacgtttcatatggctgaccaaactaaataatcttagaatattagaacaaggatcagaaaggccattaacagacactgaacgagcaactctaatggatgaaccataccggaagagtaaattgacatacgcacaagcaagaaaactactaggtttagaagacacagcatttttcaaaggactaaggtatggaaaggacaacgccgaggcttcaactctaatggaaatgaaagcataccatgcgataagcagagcattagaaaaagaaggcttgaaagataagaaaagtccactaaatttaagtccggaattacaagatgaaattggaacggcctttagcttattcaaaactgatgaagacattacaggaaggctaaaagacagaatacagccagaaatattagaggcactgttaaaacacataagttttgacaaattcgtacagatatccctgaaagcacttagacgaattgtacctttaatggaacaaggtaaaagatacgatgaagcatgtgcagaaatatatggtgaccactacggaaagaaaaatacagaagagaaaatatatttgcctccaattccagcagacgaaataaggaatccggtcgtattaagagcactaagtcaagcacgtaaagtaattaatggagtagtacgtcgatacggatcaccagcacgaatacacattgaaacagctagagaagttggcaagagctttaaagatcgcaaagaaatagagaaaagacaagaagaaaacaggaaagatcgggaaaaagcggcggcgaaatttagagaatattttcctaatttcgtcggggaacctaaatcaaaagatatactcaaactaagattatatgaacaacagcacggaaaatgtctctacagtggaaaagaaataaatcttgggcgactaaatgaaaaaggatatgtggaaatagatcatgcattacctttttcgaggacctgggatgatagtttcaacaacaaagttttagtacttggtagtgaaaatcaaaataaaggtaaccaaacaccatacgaatattttaacggcaaagacaactcacgtgaatggcaagagttcaaagcacgagtggaaacatccagatttccaagaagcaagaaacaaagaatacttttacagaaattcgacgaagatgggttcaaagaaagaaacttaaatgacacaaggtacgttaatagattcctttgtcaatttgtcgccgatagaatgagactgaccggtaaaggaaagaaaagggtattcgcttctaatggacaaattacaaatctactgaggggattttggggattacgtaaagtcagggctgaaaatgatcgacaccatgcactagatgcagtagtcgtagcatgcagtactgttgctatgcaacagaaaattacaagattcgtaagatacaaagaaatgaatgcctttgatggaaaaactattgacaaagaaacaggcgaagtattacaccagaaaacacattttccacaaccatgggagttcttcgcgcaagaagtaatgatcagagtttttggaaaacctgacggcaagcctgaatttgaagaagcagatactccagaaaaactacgaacactactagcagaaaaattaagttcacgacctgaagcagttcacgaatatgtaacaccattatttgtatcccgagctccgaatagaaaaatgtcaggacaaggtcacatggaaactgtaaaatcagcgaaacgattagatgaaggagtaagtgtacttagagttccgttaacccaattaaaactcaaagatttagagaaaatggtcaatagagaaagagaacccaaactatacgaggctttaaaagcacggctagaagctcacaaagatgacccagcaaaagcattcgcagaaccattctacaagtatgacaaagccggaaatcggacgcaacaagtaaaagcagtaagagttgaacaagtacagaaaacaggcgtctgggtaagaaatcataacgggatagctgataatgcgaccatggtgagggtggatgtgtttgaaaaaggagataagtattatctggtacctatatattcttggcaagtagcaaaaggtatactaccagatagagcagtagtccaagggaaagacgaagaagattggcaactcatagatgacagtttcaattttaagttttcattgcatcctaatgacttagtggaagttataaccaagaaagctaggatgttcggatactttgcatcctgccacaggggcacggggaatataaacataagaatccatgatctagatcataaaataggcaaaaatggaatattagaaggaataggagtcaaaacagcacttagtttccaaaaatatcaaatagacgaattaggaaaagaaatacgaccttgtcgacttaagaaaaggcctcctgtgagatga

SEQ ID NO: 8351 - RNA, 3255 nt, synthetic construct
  misc_feature 1..3255: note = Cas9 variant
  source 1..3255: mol_type = other RNA
atgaaatatcacgtaggaatagatgttgggacattcagtgtaggactcgcggctatcgaagtggatgatgcgggcatgccaatcaaaactttatcattagtcagtcatattcatgatagtgggctggaccccgatgagatcaaatcggcagttaccagactagcgagctctggcatagcaagaagaactagaagactgtatagaagaaaaagaaggagactgcaacaactagacaaatttatacaaagacaaggttggccagtaattgaattagaggactatagtgatcctctatatccatggaaagttagagcagaactagctgcttcatatatagcagatgaaaaggaacgaggagaaaaactcagcgtagccctaagacacattgccagacataggggatggagaaatccatacgctaaggtatcatcgttatatttaccagatggaccatcagacgcatttaaagcaataagggaagaaataaaacgtgcaagtggacaacctgttccggagactgcaacagtagggcaaatggtaacgctatgtgaattaggaacactaaaactaagaggtgaaggaggagttttatctgcaagattacaacaaagtgactatgcacgagaaattcaagaaatatgtaggatgcaagagattggacaagaactatatagaaaaataatagatgtagtattcgcggctgaatcgccaaaaggatcagcatcgagtcgagttgggaaagacccgttacaaccaggtaaaaacagggctctaaaagcaagtgacgcatttcaacggtacaggattgcggctttaataggaaatctaagggttagagtagacggagagaaaaggatcctaagtgtcgaagagaaaaatttggtattcgatcatctggtaaatctcacaccaaagaaagaacccgaatgggtaaccatagcagaaatcttaggaatagacagaggacagctaataggtacagctacaatgacggatgacggtgagcgcgcaggcgcacgtccacccacccatgacacaaatagatcaattgtaaatagtaggatagccccacttgtagactggtggaaaactgcctcggctctagaacaacacgcaatggtaaaagcactttcgaacgcagaagtagatgattttgactcacccgaaggtgcgaaagtgcaagcattcttcgctgaccttgatgatgatgtacatgcgaaacttgatagcttacaccttccagttggcagagctgcttattctgaagataccctagtgagattaacacgtagaatgttatcagatggagtagatctatacacagcgagactacaagaatttggaatcgaaccaagttggacacctccaacaccaagaattggagaacctgttggaaatccagccgttgatagagttttaaaaacggtaagtcgatggttagaaagcgctacaaaaacatggggagccccagaaagggtgattattgaacacgttagagaaggtttcgttacagaaaaacgagcaagagaaatggatggagacatgagaagacgagccgcacgcaacgcaaaattatttcaagaaatgcaagagaaattaaacgtgcaagggaaaccaagcagagcagacttatggagatatcaatcggtgcaaagacaaaattgtcaatgcgcatactgcggtagccccataacattctccaattctgaaatggatcatatagttccaagagcaggacaaggtagcacaaatacacgcgagaatctagtagcagtatgtcacagatgcaaccaaagtaaaggaaatacaccatttgcaatatgggcgaaaaacacatcaatagaaggagttagcgtgaaagaagcagttgaaagaacaagacactgggttacagatacaggcatgagatccacagatttcaagaaattcacaaaggcagtagtagaaagatttcaacgagcaacaatggacgaagaaatcgatgcacggagcatggagtctgtagcatggatggcaaatgaattaagatcgagagttgcacaacactttgcatcacatggtacaaccgtaagagtttaccgagggtctttaacagcagaagcacgtagggcatcaggaatatccggcaaactaaaattctttgatggagtcggaaaaagcaggttggaccgaagacatcatgcaattgatgctgcagtaatagcttttaccagtgattatgtagctgaaacattagctgtaagaagtaatctaaaacaaagtcaagctcaccgacaagaagccccacaatggagagaatttacaggaaaagatgcagagcacagggccgcttggagagtatggtgccagaaaatggaaaagctaagtgcattactgacagaggatttaagagacgatagagtagtcgtgatgtccaatgttcgcttaagactaggcaacggatcagcacataaagaaactataggtaaattaagcaaagtaaagttaagtagccaattaagcgtgagtgatatagataaagcatcttcggaagcgttatggtgtgctttaaccagagaaccaggatttgatcctaaagaaggactaccagcaaatcccgagagacatatacgagtaaatggaacacacgtttatgcgggtgataatataggattattccctgtatccgccgggtccatagcattacgaggtggttatgcagaacttggatcgagcttccatcatgcgagagtatataaaattacatccggtaaaaagccagcgtttgcgatgttgagggtatacacaatcgatcttttaccatatcggaaccaagatctattctcagtagaactaaaaccacaaactatgagcatgagacaagcagaaaagaaacttagggatgcactagcaactggaaacgcagaatatttaggctggcttgtggtcgatgatgaacttgtagtggataccagtaaaatagctacagatcaagttaaagcggtagaagcagagcttggaacaatacgaaggtggcgagttgatggattctttagtcctagtaaactaaggttaagacccttgcaaatgagcaaggaagggataaagaaagaatcagcaccagaactgagtaaaattatcgacagacctggatggttaccagctgttaataaattgtttagtgacgggaacgtaactgtagtcagaagggattcactaggccgtgttagattagagagcacagcacacctaccagtaacctggaaagtacaatga

SEQ ID NO: 8352 - RNA, 2955 nt, synthetic construct
  misc_feature 1..2955: note = Cas9 variant
  source 1..2955: mol_type = other RNA
atggcaagaatcttagcattcgatataggaatctcatccatcggatgggcattttcggaaaatgacgaactaaaagattgcggggtacgcatattcaccaaagtagaaaacccaaaaactggcgaatcgttagcactcccgcgcagactagcacgatctgcacgcaaacgactagcaagaagaaaggcacgcctaaaccacctcaaacatttaatagcaaatgaattcaaattgaactatgaagattatcaatcattcgacgaaagcttagcaaaggcctacaaaggctcattaatatcgccgtatgaactcagatttagagcattaaacgaactattatcaaaacaagacttcgcaagagtaatcttacatatagccaaaagaagaggctacgatgatatcaagaactcagatgataaagagaaaggagcaattctcaaggccatcaaacaaaacgaagaaaagctagcaaactatcaatcagtaggcgaatacctgtacaaagaatacttccaaaaatttaaagaaaattccaaagagttcacaaatgtaagaaacaagaaagagagctacgaaagatgtatagctcaaagtttcctgaaagacgaattaaaattaatattcaaaaaacaaagggagttcggatttagtttctctaaaaaattcgaagaagaagtcctatcagtagccttctacaaaagagcattaaaagactttagccatctcgtaggaaattgcagcttttttacggatgaaaaacgagcacccaaaaactcacctcttgctttcatgtttgtagcactaaccagaataataaacttactaaataacctaaaaaacaccgaaggaatattatataccaaagacgacttaaacgcactcctaaatgaagtactaaaaaatggaacgttaacttataagcaaaccaaaaaattacttggattatcagatgactacgaattcaaaggagaaaaaggaacgtatttcatcgaattcaaaaaatataaagaatttattaaagcgcttggcgaacataacttaagccaagatgaccttaacgaaatagcaaaagacataacgttaattaaggatgaaataaaactaaaaaaagcattagccaaatacgatttaaatcaaaaccaaatagattctctcagcaagctggaatttaaagatcatttaaacatcagcttcaaagctttaaaactcgtaacgccattaatgctagaaggcaaaaaatacgatgaagcatgcaacgaacttaacttaaaagtagccataaatgaagacaaaaaagactttttacctgcctttaacgaaacatattataaagacgaagtcacgaatcccgttgtattacgagccatcaaagaatatcgtaaagtacttaatgcattattaaaaaaatacggaaaagtccataaaataaatatagaactagctcgggaagtaggaaaaaatcattcccaaagagctaaaatagaaaaagaacaaaatgaaaattacaaagccaaaaaagacgcagaactagaatgtgaaaaactaggattaaagattaacagcaagaacattctcaaactccgcttatttaaagaacaaaaagaattttgcgcatattcaggtgaaaaaataaaaatatccgacttacaagatgaaaaaatgctcgaaatagatcacatctatccatactcaagaagctttgacgattcgtacatgaacaaagtattagtattcacaaaacaaaatcaagaaaaattaaaccaaacaccctttgaagcgtttggaaacgacagtgcaaaatggcaaaaaatagaagtcctagctaaaaatctaccgacaaaaaagcaaaaaagaattctagataaaaactacaaagacaaagaacaaaaaaattttaaggatagaaaccttaacgacacaagatatatagcccgactagtacttaattataccaaagattacctagacttcttgccactcagcgatgacgaaaacacaaaactaaacgacacacaaaagggatcaaaagtccacgtagaagcaaaatcgggcatgctaacatcagctttgagacacacatggggattctctgccaaagacagaaacaaccacctacaccatgcaatagatgcagtcataatagcatatgcaaacaactctatcgtaaaagcattcagtgattttaaaaaagaacaagaatccaactccgctgagttgtatgcaaaaaaaatctccgaattagactacaaaaacaaacgaaaattctttgaaccattctcaggcttcagacaaaaggttttagataagatcgacgaaatctttgtatcaaaaccagaaagaaaaaaaccatcaggagcactacatgaagaaacatttcgaaaagaagaagaattctaccaatcgtacggcggaaaagaaggagtactaaaagccttagagctgggaaaaataagaaaagttaatggaaaaattgtcaaaaacggcgacatgtttcgagtagacatcttcaaacacaaaaaaaccaataaattctacgccgttccaatctatacgatggactttgctctaaaagttcttcctaacaaagccgttgcaagatcaaaaaaaggcgagataaaagattggattctaatggatgaaaactacgaattctgtttctcactatacaaagatagcctcatattaattcaaacaaaagatatgcaagaaccagaatttgtgtactacaatgcattcacatcatcaacagtatcactaatcgtaagtaaacatgacaacaaattcgagacactaagtaaaaatcaaaaaatccttttcaaaaatgcaaacgaaaaagaagtaatagcaaaaagcataggcatacaaaatctaaaagtattcgaaaaatatatcgtatccgctttgggagaagttaccaaagccgaattccgtcaaagagaagacttcaaaaaatga

SEQ ID NO: 8353 - RNA, 3366 nt, synthetic construct
  misc_feature 1..3366: note = Cas9 variant
  source 1..3366: mol_type = other RNA
atgtcagatttagtattaggtctagatataggcataggaagcgtcggagtaggaatactaaacaaagtcactggagaaataatacataaaaattcaagaatatttcccgcagcacaagctgaaaacaacctcgttagaagaacaaatagacaaggccgaagactcgccagacgaaagaaacatagaagggttagacttaatagactattcgaggaatcaggtctaataacagattttactaaaatcagtataaacctaaacccatatcaattaagagtaaaaggactaaccgatgaactaagcaatgaagaactattcatagcacttaaaaatatggtaaaacataggggaatctcatatctagatgatgcaagcgatgacggcaactcatccgtaggagactacgcacaaattgtaaaagaaaacagtaaacaattagagacaaaaacgcccgggcaaatacaattagaacgataccaaacttacggacaattaagaggtgacttcactgtagagaaagatggaaagaaacatagattaataaacgtatttccaacctctgcgtatcgaagtgaagcactaagaatactgcaaacgcaacaagagttcaaccctcagataacagatgaatttataaaccgatatctagaaatacttacgggaaaacgaaaatactaccatggacccggaaacgaaaaatctagaacagactatggaaggtacagaacatcaggagaaacgctcgataacatcttcggaatacttattgggaaatgcacattctacccagacgaatttagagcagcaaaagctagttacactgcacaagaatttaaccttttaaatgatctgaataatctaacagtgccaacagaaactaagaaactgagcaaagaacagaaaaaccaaataataaattacgtcaaaaacgaaaaagctatgggaccagctaaattatttaaatacatagcaaaattactaagttgcgacgtagccgacataaaaggttatagaatcgacaaaagcggaaaagcagaaatacacacatttgaagcatatagaaaaatgaaaacactggaaaccctggacattgaacaaatggatagggaaaccttagacaaattagcgtatgttctgacactgaataccgagcgagaaggtatacaagaagctctagaacacgagtttgctgatggatcctttagccaaaaacaagtagacgagctagtacaattcagaaaagcaaattcatcaatctttggcaaaggatggcataacttctcggtaaaactcatgatggaactcatcccagaattatatgaaaccagtgaagaacaaatgaccatcctaacaagactaggtaaacagaaaaccaccagctcatcaaacaaaacaaaatacatagacgaaaaactactaactgaagaaatatataatccagtagtagcaaaaagcgtcaggcaagcaataaaaatcgtaaatgcagctataaaggaatatggcgacttcgataacattgtcatagaaatggcgcgagaaactaacgaagacgacgagaaaaaggcaatacagaaaattcaaaaggcaaataaagatgaaaaggatgcagcaatgctaaaagcagcaaaccaatataacggcaaagcagaacttcctcattccgtctttcacggccacaaacaactagccacaaaaataagactatggcatcaacaaggagagcgatgtctttacaccggaaaaactatctcaatacacgatcttataaacaatagcaaccaatttgaggttgaccatattttaccactttccataactttcgatgactcactagctaacaaagttctagtatatgcaaccgcaaaccaagaaaaagggcaacgaacaccataccaagcgttagacagcatggatgacgcgtggagtttcagggaactgaaagcattcgttagggagagtaagacattatcaaataaaaagaaagaatatttattaaccgaagaagatatatcaaaatttgatgtgagaaagaaattcatagaaaggaatctagtagatactaggtatgcaagtcgagtagtcttaaacgcattacaagaacactttcgtgcccataaaattgatacaaaagtctccgtagttcgcggacaattcacatcacaactgcgaagacactggggcatcgagaaaacacgagatacttaccaccatcatgcagtcgatgcacttataatcgcagcaagttcacaacttaatctctggaagaaacagaaaaatacattagtctcatactcagaagatcaactcttggatatcgaaactggagaattaatatcagatgatgaatacaaagaaagcgtgttcaaagccccataccaacactttgtagatacattaaaatcaaaagaatttgaagactcgatcttattttcttatcaagttgattcaaaatttaaccgcaaaatatcagacgctacaatttacgcaacccgacaagcgaaagtagggaaagacaaagcagatgaaacatatgtactcggaaaaataaaagacatatacactcaagatggatacgacgcatttatgaaaatatataagaaagacaaaagtaaattcctaatgtacagacatgacccccaaacatttgaaaaagtaatagaacccatacttgaaaattacccaaacaaacaaataaatgaaaaaggaaaagaagtaccttgcaatccattcctcaaatataaagaagaacatggatatatcagaaaatattcaaagaaaggaaatggacccgaaataaaatcactaaaatactatgactcaaaattgggaaaccatatagatataacacctaaagacagtaataacaaagttgtattacagagtgtatcaccttggagggccgatgtatacttcaacaaaacaaccggaaaatacgaaatactcggactaaaatacgccgatcttcaattcgaaaaaggtactggcacatacaaaataagccaagaaaaatataatgatataaagaagaaagaaggagttgattcagactcagaatttaaattcaccttatataaaaacgatctactcttagtaaaagacacagaaacaaaagaacagcaacttttcagatttctatcaagaaccatgccaaaacaaaaacattacgttgaactaaaaccctatgataaacaaaaattcgaaggaggcgaagcactaattaaagtactaggcaacgtggcaaactcaggccaatgcaagaaagggctaggaaaatcaaacatatcaatatataaagttcgaacagacgtcctcggcaaccaacacataattaaaaacgaaggggacaaaccaaaactagacttttga

SEQ ID NO: 8354 - RNA, 2556 nt, synthetic construct
  misc_feature 1..2556: note = Cas9 variant
  source 1..2556: mol_type = other RNA
atgacaaacggaaaaatattaggattagacattggcgttgcatcagtaggagtaggaataatagaagctaaaacaggaaaagtaattcacgcaaactcacgtctgttctcagcggcgaacgcagaaaacaacgctgaaagaaggggattcaggggggctcgaagattaacaagaagaaaaaaacaccgagtaaaaagggtaagagatttattcgaaaaatacgacatattaacagacttcagaaacctaaaccttaatccatacgagctaagagtaaaaggacttactgaacaactaacaaatgaagaattattcgcagcgctcagaacaatagccaaaagaagaggaatatcatacctcgacgacgcagaagacgactccaccggctcatcagattatgcaaaatcgatcgatgaaaacagaagactattaaagtcaatgacacctggtcaaatacaactagaaagattagaaaaatatggacaactcagaggaaactttactgtatatgacgaaaacggagaagcacataggctaatcaatgtattttccacatccgactacaaaaatgaagccagaaaaatactagaaacacaaagcaactacaacaaacaaataacagacgaatttatagaagactacatagaaatactaactcaaaagcgaaaatactaccatggtccgggtaacgaaaaatctagaacagattacggaagattcagaacggatggtacaacactcgaaaacatatttggtattctaataggaaaatgcagtttctacccggaagaatatagagcaagcaaagcatcatatactgcccaagaattcaacttcctaaacgatttaaacaacctaaaagtgccaaccgaaactggcaaattatcaaccgaacaaaaagaatacctagtaaatttcgctaaaaactcgaaaaccttaggtgcgtccaaattactaaaagaaatagccaaattagtcgacggggacgtaaaagatatcagtggatacagagaggactcaaaaggaaaaccggacttacacacattcgaaccatacagaaaattaaaatttaacttaacgacagtcgacatagacaacttaagcagagacatattagacaaactagctgatattctaacactaaacacagaaagagaaggaatagaagacgccataaaccaaaacctcccggaacaatttacaaaagaacaaatctctgaaatagtccaaatacgaaaaagccaaagctcagcatttaataaaggatggcactcgttcagcgccaaactaatgaacgaactgatacccgaattatatgccacatcagaagaacaaatgaccattttaaccagacttgaaaaatttaaagcaacaaaaaaaagtagtaaaaacactaaaacaatagacgaaaaggaaataactgacgaaatatacaatccagttgtagcaaaaagcgtaaggcaaacaataaaaattataaatgcagcagttaaaaaatatggagattttgacaaaatagtcatagaaatgcctagggacaaaaacgcagacgacgaaaaaaaattcattgataaaaaaaacaaagaaaataaaaaagaaaaagacgactccctaaagagagcagcctatctctataatggaacagacaaattaccagatgacgtattccatggaaacaaacaactagcaacaaaaataagactatggtaccaacaaggagaacgatgtttatactcaggaaaaccaattttaatacaagacttagttcataacagcaacaacttcgaaatagaccacatattacccctaagcctatcattcgatgattcactagcaaataaagtactagtttatgcatgggcaaatcaagaaaaagaacaaaaaactccataccaagtaatcgatagcatggatgcagcatggtctttcagagaaatgaaagactatgtactcaaacaaaagggcataggaaaaaaaaaacgtgaatatcttctaaccacggagaatatcgacaagatagaagtaaaaaaaaaatttatagaacgcaatctagtagatacgagatacgcatcacgagtggtattaaactcactacagacagcccttaaagaattagggaaagatacaaaagtctcagtagtcagaggacaattcacatcacaactaaggagaaaatggaaaatagataaaagtagagaaacctaccatcatcacgcagtagacgcattaattatagcggctagtagccaattaaaattatggcaaaaacatgaaaacctaatgtttgaaaattatggggaaaatcaagttgttaacaaagagacaggggaaatcttatcaatctccgatgacgaatataaggaatcagtttttcaaccaccatatcaaggatttgttaatacaatctcatctaaagcatttgaagacgaaatactgttctcataccaagtagactcaaaattcaatcgaaaagtaagcgatgctacaatatacagtacgcgtaaagcaaaactagggaaagataaaaaggaagaaacctacgtcctaggaaaatga

SEQ ID NO: 8355 - RNA, 2598 nt, synthetic construct
  misc_feature 1..2598: note = Cas9 variant
  source 1..2598: mol_type = other RNA
atgagacataaaatcggattggacataggaatcacatccgtaggatgggccgttataaacttagacatacccaggatagaagatttaggtgtcagaatattcgatagagccgaaaatccacaaactggagagtcattagcattaccacgaagacttgctagaagtgcccgtagaaggctacgaagaaggaaacaccgcttagaaagaataagaagactactaatcagagaaggaatactaactaaagaagaactggacaaattattcgaggaaaaacacgaaatcgatgtctggcaattaagagtagaagcactagatagaaaactaaacaatgatgaacttgcaagggtattactccacctagcaaagcgaagaggtttcaaatctaatcgaaaatcagaaagaaacaataaagaaaactccacaatgttaaagcacatagaagagaatcgagctttactgagcggctatagaacagtagcagaaatgatagtaaaagaccccaaatttgcctttcataaacgaaataaaggagaaaattacacgaacactatagcaagagatgacctagaaagagaaatcaaattaatatttactaaacaacgagaatacggaaatatagtctgcacagaaacgttcgaaaacgaatacattatgatatgggctagccaaagaccattcgcatccaaaaacgacattgagaaaaaagtaggattttgcacatttgaaccaaaagaaaaaagagcaccaaaagccacatacacattccaatcctttgttgcatgggaacatatcaataaattacgcttagtctacccaactggaacaagaggtttgaccgacgaagaaagaagactattatataaacaagcatttcacaaaaataagataacataccatgatatacgaactctattacatttaccagacgacacctacttcaaaggtatcgtatacgacagaggtgccccactaaaacaatcagaaacaattagatttcttgaacttgacgcataccatcagatacgaaaagctgtagacaaagtctatggcaaagggaaatcctcatcatttttaccgatagatttcgatacttttggatatgcgttgaccttgtttaaagacgacgccgacataaggtcatacttacgtaacgaatacgaacaaaatggtaaaagaatgcccaacctagccaacaaagtctatgacaatgaaccaattgaagagttattaaatttatcattcactaaatttggccacttatcactaaaagcacttagaaatatcctcccatacatggaacaaggggaagtatactcagtagcatgtgaaagagcaggctacacatttacaggtcctaaaaaaaaacaaaaaacactacttctaccaaatatacctcccatagcaaatccagtagtaatgagagcactcacacaagcacgaaaagtagtaaacgcaatcataaaaaaatacggatcccccgtctcaatacatattgaattagcaagagatttatcacaaacctttgacgagagaagaaaaacaaaaagagaacaagatgaaaataggaaaaaaaacgaaactgccatacgacaattaatggaatacggattaacaataaatcccaccggacatgacatagtcaaattcaaactatggtctgaacaaaatggacgatgcgcctactcattacaaccaatcgaaatcgaaaggctgcttgagcccggttacgtagaagttgatcatgtaataccatattccaggagcctcgacgactcgtatacaaataaagttttagttttaactaaagaaaacagagaaaaaggtaacagaataccagcagaatatctaggagtcggaacagaacgatggcaacaattcaaaacatttgtactaactaataaacaattcagcaaaaaaaaacgtgatagactactacgacttcactatgacgaaaacgaagaagctgaatggaagaacagaaacttaaatgacacccgctacatttcccgattcttcgcgaacttcatacgagaacatctaaaattcgctgaaagcgacgacaaacaaaaagtgtacacagtaaacggaagagtcaccgcacacttaagatcacgatgggacttcaacaaaaaccgagaagaaagtgatctacatcatgcagttgatgcagcaattgttgcatgtacgtcaccaagcgatatagcacgagtcacagccttctaccagcgtcgagaacaatgcaaagaaagtgcaaaaaaagcagaaccacactttccacaaccttggcctcattttgcagatgaattaagagcgcgtttatcaaaaaatccaaaagaaagtataaaagctttaaatctaggtaactacgacgatcaaaagttagaatcactacagccagtattcgtatcacgtatgccaaaaagaagcgtcacgggagcagcacatcaagaaacattaagaaggtacataggcatagacgaaagatcaggaaaaatacaaacagtagtaaaaacaaaattatcagaaataaaactagacgaaactggtcacttcccaatgtatggaaaagaatcagatccacctgcatcagcctga

SEQ ID NO: 8356 - RNA, 2886 nt, synthetic construct
  misc_feature 1..2886: note = Cas9 variant
  source 1..2886: mol_type = other RNA
atggcaagaatcttagctttcgacataggaatatcttctataggatgggcattcagcgaaaatgacgaactaaaagattgtggtgtaagaatattcactaaagcagaaaacccaaaaaccggcgaatccttagcactcccacgaagactcgccagatcagctcgtaaaagactagcaagaagaaaagcaagactaaaccacctaaaacatctgatagcaaacgagttcaaactaaattatgaagattatcaaagctttgacgaatcactagcaaaagcctataaaggaagtctaatatcaccatacgagctgcgcttcagagcgctaaatgaactcttaagtaaacaagactttgcccgcgtcatcctacatatagctaaaagacgtggatatgacgatataaaaaacaacggagatgaagaaaaaggcaaaatactaaaagctataaaacagaacgaagaaaaactagttaattaccagagcgtaggagaatatctctataaagaatattttcaaaaattcaaagaaaattccaaagaattcataaacgtaagaaacaaaaaagaaagctatgaacgatgcataacacaatcatttctaaaatacgagttaaaactaatattccaaaaacaaagagaattcggattttcattttccaaaaaattcgaagaagaggtattaagcgtagcattctataaacgagcacttaaggacttttctcacctcgtcggaaactgctcctttttttccgacgaaaaacgcgcgcccaaaaactctcccctagcctttatgtttgtagcactgacacgtatcataaacctcttaaacaatctcaaaaataccgaaggaatactctacacaaaagacgacttaaacgctttattaaatgaggtactaaaaaatggaacccttacatataaacaaacaaaaaaactattaggattatcagatgattacgaattcaaaggagaaaagggcacttacttcatagaatttaaaaaatataaagaattcataaaagcactaggcgaacacaatctaagtcaagacgatttaaacgaaatagcaaaagacattactctaataaaagacgaaataaagcttaaaaaagcgctcgcaaaatacgacctgaaccaaaatcagatagatagtttatccaaactagaatttaaagatcatttaaacataggcttcaaagcgctaaaactaatcacgcctctaatgctagaaggaaaaaaatacgacgaagcatgcaacgaactcaacctaaaagtagcaataaacgaggacaagaaagacttccttccagcatttaacgaaacatattataaagacgaagtaactaacccagttgtattaagggcaataaaagaatacagaaaagtactaaatgcgttacttaaaaaatacggcaaagtacataagatcaacatagaactagcaagagaagtggggaaaaatcacagtcaacgagcaaaaatagaaaaagaacaaaatgaaaattataaagcaaaaaaagatgcagaactcgaatgcgaaaaactgggcctaaagatcaattcaaaaaatatcctaaaattaagattattcaaagaacaaaaagaattttgcgcatatagtggagaaaaaatcaagctatccgatctgcaagacgaaaaaatgttagaaattgaccatatatacccttattctaggtccttcgacgactcgtatatgaacaaagtactagtatttacaaaacagaatcaagaaaaattaaataaaacaccattcgaagcatttggtaacgacaacgtcaaatggcaaaaaatagaagtcctagcaaagaacttaccagaaaaaaaacaaaaacgaatactagataaaaactataaagacaaagaacaaaaagattttaaagatagaaacttaaacgacacaagatatattgccagactagttctaaattacacaaaagactacctcgactttcttccactatcagacgatgaaaacactaaactaaaaggttcaaaagtacacgtagaggctaaaagcggaatgctaacatcagccctcagacacacctggggattcagtacaaaagatcgaaacaaccaccttcaccatgcaatagacgcagctataatagcatacgcaaataattccatagtaaaagatttctcagacttcaaaaaagaacaggaaagcaacagcgcagaattgtacgcaaaaaaaatctcagaactagactacaaaaataaaagaaagttctttgaaccattcagtggatttcgccaaaaagtactagataaaatagatgaaatcttcgtgagtaaaccagaacgaaaaaaaccaagtggggccttacacgaggaaaccttcagaaaagaagaagaattctatcaatcgtacggcggaaaagaaggagtcctaaaagcacttgaacttggaaaaatcagaaaagtcaacggaaaaatcgtaaaaaacggagatatgtttagagtagatatattcaaacataaaaaaacaaacaaattctacgccgtaccaatttacacaatggactttgcgctcaaagtcttacccaacaaagcagtcgctagatctaaaaaaggagaaataaaagactggatacttatggatgaaaactacgaattttgcttctcattatataaagactccctaatactaatacagacaaaagatatgcaagaacccgaacttgtatattttaacgcgttcacgtcgtcaaccgtaagtctaattgtatcaaaacatgacaacaaatttgagacactaagcaaaaatttaaaagttttcgaaaaatacattgtatcagctctaggagaagtcaccaaagcagaattcagacaaagagaagacttcaaaaacgaactcagatga

SEQ ID NO: 8357 - RNA, 2955 nt, synthetic construct
  misc_feature 1..2955: note = Cas9 variant
  source 1..2955: mol_type = other RNA
atggcgaaaatactagccttcgatatcggaatcagcagcataggatgggctttcagcgagaacgatgaattaaaggattgcggtgtacgaatatttacaaaggcagaaaacccaaagacaggagaatcactcgcattaccacgaagaatcgcaagaagcgccagaaaaagactagcccgaagaaaagctagattgaatcacttaaaacatctcattgcgaatgaattcaaactaaactacgaagactaccaatcatttgacgaaatacttgcaaaagcatataaaggaagcttaatttctccatacgaactacgtttccgagcactaaacgaactcctaagcaaacaagacttcgccagagtcatcctacacatagcaaaaagacgtggatacgatgacatcaaaaacaacggagacgaagaaaaaggtaagatactaaaagccatcaaacaaaacgaagaaaaattagccaattaccaatccgtaggtgaatacctatacaaagaatacttccaaaaatttaaagaaaacagcaaagaattcataaacgttagaaacaaaaaagaaagttacgaaagatgcattgcacaatccttcttgaaagatgaactcaaacttatatttaagaaacaaagagaatttggcttctcattttcaaaaaaatttgaagaagaggtcctctctgtcgcgttctataaaagagcgcttaaggatttttcacatcttgtaggaaattgctctttcttcactgatgaaaagcgagccccaaaaaactcaccactcgcattcatgtttgttgcactcacaagaataataaacctactaaataaccttaaaaacaccttatacacaaaggatgatctaaatgcacttctaaacgaagttttaaagaatggcaccttaacatataaacaaacaaaaaaattattgggtctcagcgatgattatgaattcaaaggtgaaaagggaaactactttattgaattcaaaaaatataaagaattcataaaagcactaggagaacacagtctcagccaagacgatctaaatgaaatagcaaaagacattactctcatcaaagatgagataaaactaaaaaaggcactagccaagtacgatttaaatgaaaatcaaatagacaacctaagcaaactagaatttaaagaccatctaaacataagttttaaagctctaaaactaatcaccccactaatgctagaaggcaaaaaatatgacgaagcatgtaacgaacttacactcaaggtagcaattaacgaagataaaaaagacttcttaccagctttcaatgaaacttactacaaagatgaagtaacaaatccagtagtattgagagccataaaagaataccgaaaagtcctaaacgcattactcaaaaaatacggaaaagtacacaaaataaacatagaactggcaagagaagtaggcaaaaatcactcccaaagagcaaaaatagaaaaagaacaaaacgaaaattacaaagccaaaaaagatgcagagctcgaatgcgaaaaactaggtctcaaaatcaactcaaaaaatatattaaaacttagattatttaaagaacaaaaagaattctgcgtctacagcggagaaaaaataaaactatcagacctacaggatgaaaaaatgctcgaaatagatcacatatatccatactcccgaagctttgacgactcctacatgaacaaagtgcttgtttttacaaaacaaaatcaagagaaattaaaccaaaccccattcgaagctttcggaaacgatagcgctaaatggcaaaaaatagaagtgttagcaaagaatttaccaacaaaaaagcaaaagagaattctcgacaaaaattacaaagacaaagaacagaaagactttaaagacagaaatttaaatgatacacgatacatagccagattagtactaaactatacaaaggactacttagattttctcccactaagtgacgacgaaaacacaaaattaaacgatacccagaaaggatcaaaagtgcatgtagaagccaaatcaggaatgctaacctcagcattacgacacacatggggcttctcaactaaagaccgaaacaaccatttacatcatgctatagacgcagtaataatagcatatgccaataacagcatagtaaaagcattttcagattttaaaaaagaacaggaatccaacacagcagaattatatgccaaaaaaatctcagaactcgactataaaaacaaaagaaaattctttgaaccattcagcggttttagacaaaaagtcttagataaaatagatgaaatattcgtctctaagccagaaagaaaaaaaccatctggagccctccacgaagaaacattccgaaaagaagaagaattctatcagagctacggtggcaaagaaggcgttttgaaagcactcgaattaggaaaaatccgaaaagtaaacgggaaaatagtaaaaaatggagacatgtttagagtcgacatttttaaacacaaaaaaacaaacaaattctacgcagtcccgatatacactatggacttcgcattaaaagtactccccaataaagcagtagcgagatctaagaaaggagaaataaaagactggatactcatggatgaaaattatgaattttgcttctcattatacaaagattcacttatactaatacaaacaaaggacatgcaagaacctgaatttgtatattacaatgccttcacatcaagcacagtatctctaatcgtctccaaacacgataacaaattcgaaacactatccaaaaaccagaaaatactattcaaaaatgccaacgaaaaggaagtcatagctaaaagcatcggcatacaaaacttaaaagtcttcgaaaaatatatagtatcagcactaggggaagtaacgaaagcagaattccgtcaaagagaagaattcaagaacgaactacgctga

SEQ ID NO: 8358 - RNA, 2955 nt, synthetic construct
  misc_feature 1..2955: note = Cas9 variant
  source 1..2955: mol_type = other RNA
atggccagaatactagcattcgacataggcatcagttcaattggatgggcgtttagcgaaaacgatgaactaaaagattgcggtgtcagaatcttcacaaaagcggaaaacccaaaaacaggagagtcactggcactaccacgcagattagccagaagtgcccgtaaaaggctagcaagacgaaaagcgagactaaacagattaaaacacctcatagcaaacgaattcaaactgaattacgaagactaccaaagttttgacgaaagccttgcaaaagcctataaggggtcactcataagcccatacgaattacgattccgcgcattaaacgagttattgtcaaagcaagatttcgcaagggttatattacatatagcgaaacgccgaggatatgacgacatcaaaaactctgacgataaagaaaaaggagctatactaaaagctatcaaacaaaacgaagaaaaacttgctaactaccaatcagtaggcgaatacctatacaaagaatacttccaaaaatttaaggaaaactctaaagaattcacaaacgtgcgcaataagaaagaatcttatgaacgatgcatagcacaaagctttttgaaagatgaacttaaactcattttcaaaaaacagagagaattcggattctcattctcgaaaaaattcgaagaagaagtcctatcagtagcattttataaaagagcactaaaggacttctcccacctagtcggaaactgctcattctttacagacgaaaaaagagcgcctaaaaactcaccactagcatttatgttcgtcgccctcacaaggataataaacttactaaataacttgaaaaacacagaaggtatactatacacgaaagatgatctaaatgcacttttaaatgaatttttaaaaaacggcacactaacatacaaacaaacgaaaaaattgttaggactaagcgacgattatgaattcaaaggagaaaaaggaacctattttatagaatttaaaaaatataaagaatttataaaagcattaggagaacataacttaagccaagacgatctaaacgaaatagcgaaagacataacactaatcaaagacgaaataaaattaaaaaaagcccttgcaaaatatgacctcaatcaaaaccaaatcgacagcctgagcaagttagaattcaaagatcatttaaacatatctttcaaagcactaaagctaataacacccctcatgttagaaggcaaaaaatacgatgaagcatgtaatgaactcaatctaaaagtcgcaataaacgaagacaaaaaagattttcttcctgcatttaacgaaacatactataaggacgaagtaacaaatcccgtagtattaagagcaataaaagagtaccggaaagtactcaacgcactcttaaaaaaatacggcaaagttcacaaaataaacatcgaactagcacgagaagtcggcaaaaactactcccaacgagcaaaaatcgaaaaagaacaaaatgaaaattataaggcaaaaaaagacgccgaattagaatgcgaaaaactcggactaaaaatcaactcaaaaaatatattaaaattacgattattcaaggaacagaaagaattttgtgcctactcaggagaaaaaataaaaatatcagacctccaagacgaaaaaatgcttgaaatagaccacatatacccatacagccgatcattcgatgacagctatatgaataaggtactcgtatttacaaaacaaaaccaagaaaaattaaaccaaaccccatttgaggcatttggtaatgattctgctaaatggcaaaaaatagaggtactggcaaaaaacttaccaacaaaaaaacaaaaaagaatactagacaaaaactataaagataaagaacaaaaagactttaaagacagaaatttaaatgacacaagatatatagcacgattagtgttaaactatacaaaagattacctagacttcctaccactaagcgatgacgaaaatacaaaactaaacgacacacataaaggcagcaaagtacacgtcgaagcaaaaagcggcatgttaacatcagcattacgacatacatggggtttttcaacaaaagacagaaacaaccacttacggcacgctatagacgcagtaatcatcgcatacgcaaataatagtatcgtaaaagctttcagtgactttaagaaagaacaagaaagcaactcagcagaactatatgcaaaaaaaataagcgaacttgactacaaaaataaacgaaaattcttcgaaccattcagtggtttcagacagaaagtcctggacaagattgatgaaatatttgtctcaaaaccagaaagaaaaaaaccaagtggcgcactacatgaagagacattcagaaaagaagaagaattctatcaaagttatggcggaaaagaaggagtactaaaagcattggaattaggtaaaatcaggaaagtgaacggaaaaattgtaaaaaatggagatatgttccgtgttgacatatttaaacacaagaaaactaacaaattttacgcagtaccgatatatacgatggacttcgcactcaaagtattacctaataaagctgtagcaagatcgaaaaaaggagaaatcaaagactggatacttatggacgagaattacgaattttgtttttcattatataaggatagtttaattctaatccaaactaaagacatgcaggagccagaattcgtatactataacgcttttacatcttctactgtttcactaatcgtaagtaaacatgataacaaattcgaaacactgagcaaaaatcagaaaatactcttcaaaaatgctaatgaaaaggaagttattgcaaaaagtataggcatccaaaacctaaaagtctttgaaaaatatatagtcagtgcactaggtgaagttacaaaagcagagtttcgacaaagagaagatttcaaaaaatga

SEQ ID NO: 8359 - RNA, 2955 nt, synthetic construct
  misc_feature 1..2955: note = Cas9 variant
  source 1..2955: mol_type = other RNA
atggctagaatcctggctttcgacattggcatatccagtataggatgggcgttctcagagaatgacgaattaaaagactgtggcgtaagaatattcacaaaggtagaaaatccaaaaacaggagaaagccttgctctcccccgtcgactagcaagatctgctcgaaaaagattagcacgacgaaaagcaagactaaaccacctaaaacacctgatagcaaatgaatttaaactaaattatgaagactaccaatcgtttgacgaatcactagccaaggcatacaagggatccctcatatcaccatacgaactaagattccgcgctttaaatgaactgctatcaaaacaagatttcgcacgggtcattctccatatagcaaaacgaagaggttatgacgatatcaaaaattctgatgataaagaaaaaggagcaatactaaaagcaataaaacaaaatgaagaaaaactagcaaactatcaatctgttggtgaatatttatacaaagaatactttcaaaaattcaaagaaaacagcaaagaatttacaaatgtcaggaataagaaagaatcatacgaaagatgcattgcccaatcatttttaaaagacgaattaaaactaatatttaaaaaacaaagagaatttggattcagcttctcaaaaaaattcgaggaggaagtcttaagcgttgccttttacaaaagagctctcaaagacttttcacatttagtagggaactgctcctttttcactgacgagaaaagagccccaaaaaactcaccactagcatttatgttcgtcaccctaacaagaataataaaccttctcaacaatctaaaaaatacagaaggcatcctatacacaaaagacgacttgaatgctcttctaaatgaggtattaaaaaatggtactttaacttacaaacaaaccaaaaaattattaggactcagtgacgactatgaatttaaaggagaaaagggaacctacttcatcgaatttaaaaaatataaagaattcataaaagcgctgggagaacacaatctatcccaggatgacttaaacgaaatagcaaaagacattacactcataaaagacgaaataaaactaaaaaaagcactagccaaatacgacctaaaccaaaatcagatagactccctctcaaaattagaatttaaagatcacttaaacataagctttaaggcactcaaactaataacaccactaatgttagaaggaaaaaaatatgacgaagcatgcaacgaacttaacctcaaagtcgcaattaacgaagataagaaggatttccttccagccttcaacgaaacatactacaaagatgaagtgactaacccagtggttctcagagccattaaagaatacagaaaagtcttaaatgcattattaaaaaaatacggaaaagtccacaaaatcaatatcgaactagctagagaagtaggcaaaaatcattcacagcgagccaaaatagaaaaagaacaaaacgaaaactataaagcaaaaaaagacgcagagctcgagtgtgaaaaactcggattaaaaataaacagtaaaaatatactaaagctcagactattcaaagaacaaaaagaattctgtgcttactctggagaaaaaataaaaatatcagacctccaagacgaaaaaatgttagaaatcgatcacatctatccatattcaagatcttttgatgattcttacatgaacaaagttctcgtatttacaaaacaaaaccaagaaaaattaaacaaaaccccgttcgaagcattcggaaatgactcagccaaatggcaaaagatagaagtactagccaaaaatctacccacaaaaaaacaaaaaagaatactcgacaaaaattacaaagacaaagaacaaaaagatttcaaagacagaaacttaaatgacacaagatatatagctaggctagtcctaaactatacaaaagattacctcgactttctacccctatcagatgacgaaaacactaaactaaatgacacacaaaaaggatctaaagtccacgtggaagccaaatcaggaatgctaacaagtgcattaagacacacgtggggtttctcaaccaaagaccgaaataatcatttacatcacgcaatcgacgcagtaataatagcatacgcaaacaactcaatagtaaaagctttcagcgacttcaagaaggaacaagaaagcaatagtgcagaactgtatgctaaaaaaatatctgaactagactacaaaaacaaaagaaaattctttgaaccattcagtggatttagacagaaagtgctcgacaaaatagacgaaatattcgtttccaagcccgaacgaaagaaacccagcggggccttacacgaagaaacgttccgaaaagaagaagagttttatcaatcatatgggggcaaagaaggagtattaaaagccctagaactaggcaagattcgtaaagtaaatgggaaaatagtaaaaaatggagatatgtttcgtgtagacatctttaaacataaaaaaacaaacaaattttatgccgtccctatctacacaatggacttcgcacttaaagtcttacccaacaaagccgtagctcgatcaaaaaaaggcgaaatcaaagattggattctaatggacgagaactacgaattttgtttcagtctatacaaagacagcttaatactaatccaaacaaaagatatgcaagaaccagaattcgtatattacaatgctttcacatcatccacagtaagcttaatcgtctccaaacacgacaataaatttgaaacattatctaaaaatcaaaaaatactctttaaaaatgcaaacgaaaaagaagtaatagccaaatcaataggaatccagaatctaaaagtattcgaaaaatacatagtttccgcactaggagaggtcacaaaagcagaattcaggcaaagagaagacttcaaaaaatga

SEQ ID NO: 8360 - RNA, 2955 nt, synthetic construct
  misc_feature 1..2955: note = Cas9 variant
  source 1..2955: mol_type = other RNA
atggctcgcatactcgcctttgatataggaatctcgtcaataggctgggcattttccgaaaacgacgagctaaaagattgcggagtacgaatattcacaaaagcagaaaatccaaaaaccggagaatcactagcactaccaaggcgactcgcaagatcagcacgaaaaaggctagccagacgaaaggcaagactaaaccacttaaaacacctaattgccaatgaattcaaactaaactacgaagattatcaatcatttgacgaaagcctcgcaaaagcttacaagggaagcctaatatcaccttacgaactacgtttcagagcactaaacgaactactaagtaaacaagatttcgcacgagtaatattacacatagctaaacgaagaggctatgatgatattaaaaattcagacgacaaagaaaaaggagccatattaaaagcaataaagcaaaacgaagaaaaactagcaaactaccaaagtgttggtgagtacttatacaaagaatacttccaaaaatttaaagaaaatagcaaagaatttactaacgtccgaaataaaaaagagtcatacgaaagatgtatagcacaatcattcttaaaagatgagctaaaactaatatttaaaaaacagcgcgaattcggattctctttttctaaaaaattcgaagaagaggtcctaagcgtagcattttacaaacgagcactaaaagacttcagtcacttagttgggaactgttcctttttcaccgatgaaaaacgagccccaaaaaattcaccattagcatttatgtttgttgcactaacaagaatcatcaacctactaaataaccttaagaatacagaagggatcctatataccaaagacgacttaaatgctctactaaacgaagtgttaaaaaacggaacactaacatataaacaaaccaaaaaactactcggactgtcagacgactatgaattcaagggagaaaaaggaacatattttatcgagtttaaaaaatacaaagaattcataaaggctctaggagatcatagcttaagtcaagatgatctcaacgaaatagctaaagatattacactaatcaaagacgagatcaaactaaaaaaagctctcgcaaaatatgacctcaatcaaaaccaaatagactcattatcaaaattagaatttaaagaccacttaaatatatcatttaaagctttaaaattaataactcccctaatgttggaaggtaaaaaatacgacgaagcatgtaacgaattaaatctcaaagtcgcaattaatgaagataaaaaagacttcctaccagcatttaatgaaacgtattataaagatgaagtaacaaacccagtagtattaagagctataaaagaataccgcaaaattctaaacgcattacttaaaaaatacggaaaagtacacaaaatcaacatagaattagctagagaagtgggaaaaaatcactcccaaagagcaaagatagaaaaagagcaaaacgaaaactacaaagcaaaaaaagatgccgaaattgaatgcgaaaaattaggactaaaaataaactcaaagaacatattaaaacttagactattcaaagagcaaaaagaattttgcgcatattcaggagaaaaaataaaattatccgacctacaggatgaaaaaatgctggaaattgaccatatatatccgtactcaagaagctttgacgatagctatatgaacaaagtactagtatttactaagcaaaaccaagagaaactcaataaaacaccatttgaagcattcggtaacgattctactaaatggcaaaaaatagaagttttggcaaaaaacttacctgaaaaaaaacaaaaacgcatactagataaaaactacaaagacaaagaacaaaaagacttcaaagatagaaacctgaatgatacacgatacatagcacgactagtactaaactatactaaagattatttagattttttacccctaagcgatgatgaaaatacaaaactaaatgacacacaaaaaggcagtaaagttcatgtggaagcgaaatccggtatgctcacgagtgccctccgccatacatggggattttcagcaaaggacagaaacaaccacctacaccacgcaatagacgcagcaattattgcatacgcaaacaactccattgtaaaagcattcagtgacttcaaaaaagaacaagaatccaatagtgtggaattatacgcaaaaaaaataagcgaactcgattataaaaataaaagaaaattctttgaaccatttagcggatttagacagaaggtcctagacaaaattgacgaaatcttcgtatcaaaacccgaacgcaaaaaacctagtggggcacttcacgaagaaacattcagaaaagaggaagaattctatcaatcctacggtggcaaagaaggagtattgaaagcgttagaactcggcaaaataagaaaagtaaacggaaaaatagtaaaaaatggcgacatgtttcgcgtagatatctttaaacacaaaaaaacaaacaaattttacgcagtgccaatctacacgatggacttcgccttgaaagtcttacctaacaaagcagtagcaaggtcaaaaaaaggtgaaatcaaagactggattctaatggacgaaaattacgaattttgcttcagcctctacaaagatagcttaattcttattcaaactaaagacatgcaggagcctgaactcgtatactttaatgcattcacatcatcaaccgtatcattaatagtttcaaaacacgacaataaattcgaaacactttcaaaaaaccaaaaaatcctattcaagaatgctaacgaaaaagaagttatagcaaaaagcataggaatacaaaatctaaaagtatttgaaaaatatatagtatcagcacttggcgaagtcactaaagcagaattcagacaaagagaagattttaaaaaatga

SEQ ID NO: 8361 - RNA, 2955 nt, synthetic construct
  misc_feature 1..2955: note = Cas9 variant
  source 1..2955: mol_type = other RNA
atggcaaggattttagcattcgatataggcatctcaagcataggatgggcattctccgaaaatgacgaacttaaagattgcggcgtacgaatatttacaaaagtggaaaacccaaaaaccggagaatcactcgcactaccccgacgattagcacgatccgcaagaaaacgcctagcaagacgaaaagccagactgaaccatttaaaacatctaattgcaaacgaattcaaattaaattacgaggattatcaatccttcgacgaatccttagccaaagcttacaaaggctcactaatttcaccgtacgaactccgattcagggccttgaacgaactattgagtaaacaagacttcgcaagagtaatattgcacatagccaaacgacgaggttacgacgacataaaaaattcagacgataaagagaaaggcgcaatattaaaagcaataaagcagaacgaagaaaaactggctaactatcaatcagtcggagaatacctatacaaagagtactttcaaaaatttaaagaaaattcaaaagaattcacaaacgtaagaaataagaaagaaagctacgaacgctgcatagcccaatcatttttaaaagatgaattaaaactcatattcaaaaaacaaagagaattcggcttttctttcagcaagaaatttgaagaagaagtcctatcagtcgccttttataaacgagcactaaaagattttagccatctagtgggcaactgctcgtttttcacagacgagaaacgagcgccaaaaaactcacccttagcatttatgttcgtagcattaacaagaataataaatctactaaataatctaaaaaacacagaaggaatcttatacacaaaagatgacctgaacgcccttttaaacgaagttttgaaaaacgggactttaacatacaagcaaacaaaaaaactactaggcctgtcagatgattacgaatttaaaggcgaaaaaggaacatacttcatcgaattcaaaaaatacaaagagtttataaaagccctaggggaacacaacctatctcaagatgacctgaacgaaatcgcaaaagacataacattaatcaaagatgagataaaattaaaaaaggctcttgccaagtacgacttaaatcaaaatcaaatcgattctttaagcaaactagaattcaaagaccatctaaacatatctttcaaagccctaaaacttattacaccactaatgctcgaaggcaaaaaatacgacgaggcatgcaatgaactcaacttaaaagttgccataaatgaagacaagaaagattttctgcccgcgttcaatgaaacatactataaagatgaagtcacaaacccagtagtactacgtgcaataaaggaataccgcaaagtcctaaacgcactcctcaaaaaatacggaaaagtacataaaataaatatagaacttgcgagagaagtagggaaaaatcattcacaaagggcaaaaatagaaaaagaacaaaatgaaaactacaaggcaaaaaaagatgcagaactggaatgcgagaaattaggattaaaaatcaattcaaaaaatattctaaaattacgcctatttaaagaacaaaaggaattttgcgcctatagcggggaaaaaataaaaatatcggatctacaagacgaaaaaatgctagagattgatcatatatacccatattcacgaagttttgacgattcatacatgaacaaagtactcgtatttaccaaacaaaaccaagaaaaattaaacaaaactcctttcgaagcattcgggaacgacagcgctaaatggcaaaaaatagaagtactagcaaaaaatctacctacaaaaaaacaaaaacgaatactagacaagaactacaaagataaagagcaaaaggatttcaaagacagaaatctaaacgacacccgatatatagcacgcctagtgttaaactacacaaaggactacctagactttctaccactatcagacgacgaaaatacaaaattaaatgatacacaaaaaggctcaaaagtacacgtggaagcaaaatcgggaatgctaacaagcgcattaagacatacttggggattctcaacaaaagatcgaaacaaccatctccaccacgctatagacgcagtaatcatagcatacgcaaataattccattgtaaaagccttctccgattttaaaaaagaacaagaaagtaattcagccgaactgtatgcaaaaaaaatatcagaactagactacaaaaacaaaagaaaattctttgaaccattcagtggtttcagacaaaaagtcctagacaaaatagacgaaatattcgtcagtaagccagaaagaaaaaaacccagcggcgctttacatgaagaaacattcagaaaagaagaagaattttatcaatcgtacggaggcaaagaaggagtcctgaaagcacttgaactgggaaaaataagaaaagtcaatggtaaaatagtaaaaaatggagatatgttcagagtagatatattcaaacacaagaaaactaacaaattttacgccgtgcccatatacacaatggatttcgcacttaaagtacttccaaataaagcagttgcaagatcaaaaaaaggcgaaataaaagactggatactaatggacgaaaactatgagttttgtttttcattatataaagactcattaatactaatccaaacaaaagacatgcaagaacccgaatttgtctactacaatgcattcacatcaagcacagtcagtttaatagtaagtaaacacgacaataagtttgaaactctaagcaaaaatcaaaaaatactgttcaaaaacgcaaatgaaaaagaagttatagccaaatcaataggaatacaaaatttaaaagtattcgaaaagtacatcgttagcgcactaggagaggtaacaaaagccgaattcagacaaagagaagattttaaaaaatga

SEQ ID NO: 8362 - RNA, 2955 nt, synthetic construct
  misc_feature 1..2955: note = Cas9 variant
  source 1..2955: mol_type = other RNA
atggcaagaatacttgcatttgatataggtatatcaagcatcgggtgggcatttagtgaaaatgatgaactaaaggactgcggagtacggatatttacaaaagcagagaaccctaaaacaggagaatcattagcattaccacgcagattagcaagatctgcaagaaaaagactagcgcgtcgaaaagcaagactgaaccaccttaaacatttaatcgccaacgaatttaaactaaattacgaagactatcaatcctttgatgaaagtctagcaaaagcctacaaaggatccctaatttcaccatatgaattaagattcagagcattgaacgaacttctttcgaaacaagattttgcacgagttatattacatatagccaaaagacgaggatatgatgatataaaaaactcggacgacaaggaaaaaggagccatcctcaaagcaataaaacaaaacgaagaaaaactagccaactaccaaagcgtcggagaatatctttacaaagaatattttcaaaaatttaaagaaaattcaaaagagtttacaaacgtcagaaacaaaaaagaatcttatgaaagatgcatagcacaatcttttctaaaagacgaactcaaacttatcttcaaaaaacaacgagagtttggattctcgttctcaaaaaaattcgaagaagaagttttatcagtcgcgttctataaacgcgcattaaaagatttttcacatttggtaggcaactgcagcttcttcaccgacgaaaaacgcgccccaaagaatagccctctagccttcatgttcgtagcacttacaagaataataaatcttcttaacaatcttaaaaacacagaaggaattttatatacaaaagatgacctaaatgcgctacttaacgaagtacttaaaaacggtacattaacatacaaacaaactaaaaaacttctaggtctatcagatgattacgaatttaaaggagaaaaagggacgtactttatagaattcaaaaaatataaagaattcattaaagccttaggagatcattccctctcacaagacgatttaaacgagatagcaaaagacatcacactaataaaagacgaaataaaattgaaaaaagcgctcgcaaaatacgatctaaaccaaaatcaaatcgacagtctaagtaaactagaattcaaagatcaccttaacatatcctttaaagccttaaaactaatcactcctctaatgcttgagggaaaaaagtacgatgaagcttgcaacgaattgaatttaaaagtcgccattaacgaagacaaaaaagatttcctaccagccttcaatgaaacatattacaaagatgaagtaacaaaccccgtggtcttacgagcaataaaagaatacagaaaagtactaaacgcactattaaaaaaatatggaaaagtccataaaataaacatagaactggccagagaggtaggaaaaaattattcacaaagagcaaaaatcgaaaaggagcaaaatgaaaattataaagcaaaaaaggatgccgaattagaatgtgaaaaattaggcctcaaaataaattctaaaaacatccttaaattaagactatttaaagaacaaaaagagttctgtgcatacagtggagaaaaaatcaaaatatcagacctgcaagatgaaaagatgttagaaatcgaccacatatatccttactcaagatcattcgatgacttttatatgaataaagtactggtttttacaaaacaaaatcaagaaaaattaaatcaaacccctttcgaagctttcggaaacgacagcgctaaatggcaaaaaatcgaagtattagcaaaaaacttgccaacaaaaaaacaaaaaagaatactagacaaaaattacaaagataaagaacaaaaagactttaaagatagaaacctaaacgacacaagatatatcgcaagattagtactaaattacacaaaagattacctagatttcttacctttatcagatgatgaaaacacaaagttaaacgacacgcaaaaaggcagcaaagtacatgtagaagccaaaagcggaatgttaacttcagccctccgacacacctggggattttccgcaaaagaccgaaacaatcacctacatcatgctatagacgcagtaataattgcatatgcaaacaattcaattgtaaaagccttctcagacttcaaaaaagaacaagaaagtaactcagctgaactatatgcaaaaaaaatatcagaactcgactataaaaacaagcgcaaatttttcgaaccattttcaggatttcggcaaaaagtactggataaaattgatgaaatatttgtatcgaaaccagaacgcaaaaagccatcaggagcactccacgaagaaacatttcgaaaggaagaagagttttatcaaagctacggcggcaaagaaggagttttaaaagctctagaactaggcaaaatacgaaaagtcaatggaaaaatcgtaaaaaatggagatatgtttagggtagatatcttcaaacacaaaaaaacaaacaaattctatgctgtcccaatttacaccatggactttgctctcaaagtactaccgaataaagcagtcgcgagatccaaaaaaggagaaatcaaagattggatactaatggacgaaaactacgaattctgtttttcattatataaagattcacttatactaatacaaaccaaagacatgcaagaacccgagtttgtatattacaacgctttcacatcatcaacggtatcactaatagtatctaaacacgataacaaattcgaaacactatctaaaaaccaaaaaatactattcaaaaacgccaacgagaaagaagttatcgcgaaaagtatcggaatacaaaatttaaaagtatttgaaaaatatattgtgagtgcattaggcgaagtaacaaaagcagaattcagacaacgcgaagacttcaaaaagtga

SEQ ID NO: 8363 - RNA, 2955 nt, synthetic construct
  misc_feature 1..2955: note = Cas9 variant
  source 1..2955: mol_type = other RNA
atggctaggattctagcatttgacataggaatatcctcaattggatgggcgttttctgaaaatgacgaattaaaggactgtggcgttcgaatattcaccaaagcggaaaatccaaaaacgggagaaagtcttgctctaccccgaaggctagccagatcagcacgcaaaagactagcccgaagaaaagctagattgaatcatctaaaacatctaatagcaaatgaattcaaactaaactatgaagattaccaatcatttgatgaatcactagcaaaagcctataaaggatccctcatatcaccttacgaactaagattcagagctttaaatgaattactaagcaaacaagatttcgctagagtaattctacacattgcaaaacggagaggttacgacgatatcaaaaactcagacgataaagaaaaaggcgcaatcttgaaagctataaaacaaaacgaagaaaaactagcgaactatcaaagtgtaggcgaatacctctacaaagaatatttccaaaaattcaaagaaaactcaaaggagttcacaaacgtacgaaataaaaaagaatcatacgaaagatgcatagcacaatcatttctaaaagacgaattaaaacttatttttaagaaacagagagaatttggcttctcgttcagcaaaaaatttgaagaagaagtactatcagtagccttttacaaacgagcactaaaagacttcagtcatctagttggcaattgctcattcttcactgacgaaaaacgagcacccaaaaactcacctttagcttttatgttcgtggccttaacgcgaattataaaccttctaaataatttaaaaaacacagaaggtatactatacacgaaagacgacctaaacgcactcctcaatgaatttctcaaaaacggaacactaacttacaagcaaacaaaaaagctcttgggcctcagcgacgattacgaatttaaaggcgaaaaaggaacttatttcatcgaattcaagaaatacaaagaatttatcaaagcactcggagaacacaatctctcacaagatgacttaaatgaaatagccaaagatataacattaataaaggatgaaattaaactaaaaaaagctctcgcaaaatacgacctaaaccagaatcaaatagactcattatcaaaactagaattcaaagaccacctaaacatatcattcaaagcacttaaactcataacccctctaatgctagaaggcaaaaaatatgatgaggcttgtaacgaattaaacttaaaaatagccataaacgaagacaaaaaagactttctaccagcatttaacgaaacatattacaaagacgaagtaacaaatccagtagttctacgagcaattaaagaatatagaaaagtgttaaacgcattattaaaaaaatacgggaaagttcacaaaataaatatagaattagctcgagaagtcgggaagaaccatagccaaagagctaaaatagaaaaggaacaaaatgaaaattataaagcaaagaaggatgcagaactagaatgtgaaaaattaggactaaaaatcaacagcaaaaacatattaaaactaagattattcaaagagcaaaaagaattctgcgcatattccggtgaaaaaataaaaataagtgatctacaagatgagaaaatgcttgaaattgatcacatatacccttatagtcggagtttcgatgactcatatatgaacaaagtactagtatttacaaaacaaaaccaggaaaaacttaatcaaacacctttcgaagcatttggtaacgattcagccaaatggcaaaaaatcgaagtattagcaaaaaacttaccaacaaaaaaacaaaaaagaattttagacaaaaactacaaagataaagaacaaaaaaactttaaagacaggaatctaaatgacacaaggtacatagcaagactagtattaaactacacaaaagattacttagatttcttaccattatctgatgacgaaaataccaaattgaacgacacacaaaaaggatcaaaagtccacgtagaagcaaaatctggaatgttaacatcagctttacgccacacctggggattctcagcaaaagacagaaacaaccatttacaccatgcaatagacgctgtaataatcgcatatgcaaacaacagcatagtaaaagcattctcagactttaaaaaagaacaagaatctaatagcgcagaattatacgcaaaaaaaatatcagaactagactacaaaaacaaaaggaaatttttcgaaccattttccggtttccgacaaaaagtactagacaagatcgacgaaatattcgtatctaaacccgaaagaaaaaaaccaagtggggctctacatgaagaaacatttagaaaagaagaagaattctatcaaagttacggaggaaaagaaggggtactaaaagcactagaactaggcaaaatccgtaaagtgaatggaaaaatagtaaaaaacggagatatgttccgagtagacatatttaaacacaaaaaaactaataaattctacgcagtgccaatatatacaatggactttgcattaaaagtactcccaaacaaagcagtagctcgttcaaaaaaaggcgaaataaaagactggatattaatggacgaaaactatgaattttgttttagcttatacaaagattccctcattctaatccaaacaaaagacatgcaagaaccagaattcgtctattataatgcattcacatcatcgactgtaagtctaatagtaagcaaacatgacaataaattcgaaaccctatcaaaaaaccagaaaatcctattcaaaaatgccaacgaaaaagaagtaatagcaaaaagcatagggatccaaaacttaaaagtcttcgaaaaatacatagtatcagccctaggagaagttacaaaagctgagtttcgtcaaagagaagacttcaaaaaatga

SEQ ID NO: 8364 - RNA, 2955 nt, synthetic construct
  misc_feature 1..2955: note = Cas9 variant
  source 1..2955: mol_type = other RNA
atggtgaggatactagctttcgatataggtatatcaagcattggatgggccttctcagaaaatgacgaactaaaagactgtggagtcagaatcttcactaaagtagaaaacccaaaaacaggcgaatcattagccttaccaagacgactagcaagatcagccagaaaacgtctagcacggaggaaagcaagattaaaccacttaaaacacctaattgctaacgaattcaaactaaactacgaagactatcaatcctttgacgaatcacttgcaaaagcatataaaggctcattaatcagcccatacgaattaagattcagagccctaaacgaattattaagcaaacaagatttcgcaagagtaattctgcatatagccaaacgaagaggatacgatgatataaaaaattcagatgataaagagaaaggagcaatattaaaagccattaaacaaaacgaagaaaaacttgcaaattatcaaagcgtaggcgaatacctatacaaagaatatttccaaaaattcaaagaaaattctaaagaattcaccaacgtaagaaacaaaaaagaatcatatgaacgatgcatcgctcaatccttccttaaagacgaactaaagctaatttttaaaaaacagagagaattcggattttcattcagcaaaaaatttgaagaagaagtactatcggtagccttctataaacgtgcactaaaagactttagccatctagtaggcaactgctcattcttcacagacgaaaaacgagcaccaaaaaattcgcctttggcgttcatgtttgtggctttaacacgcataatcaatttattaaataatctcaaaaacactgaagggatactatatacaaaagacgacttaaatgcattattaaacgaggtattaaaaaatggcacactcacgtacaagcaaacaaaaaaactcttaggattgtctgatgattacgaattcaaaggggaaaaaggaacctacttcattgaattcaaaaaatataaggaatttatcaaagcactcggagaacataacctaagtcaagacgacctaaatgaaatagccaaagatataaccttgattaaagatgagatcaaattaaaaaaagcgttggccaaatacgatttaaatcaaaatcaaatagacagcttaagtaaacttgaattcaaagaccatctaaacatctcgttcaaggctttaaaattaattacaccattaatgttagaaggcaaaaaatacgacgaagcatgcaatgaacttaacttaaaagtagccataaacgaagacaaaaaagacttcttaccagcgttcaatgaaacctactacaaagacgaggtcactaatccagtcgtgttaagggcaataaaggaatacaggaaagtattaaacgcacttctaaaaaaatacgggaaggtacataaaataaacatagaactagctcgagaagtaggtaaaaaccacagccaaagagcaaaaatagaaaaagaacaaaatgaaaactataaggcaaaaaaagatgccgaactagagtgtgaaaaattgggactgaaaataaactcaaaaaacattttaaagctcagactcttcaaagaacagaaagaattttgcgcatattccggagaaaagataaaaatatccgacctacaagacgaaaaaatgctagaaattgaccacatctatccatattcaaggagtttcgacgacagttacatgaataaagtactagtcttcactaaacaaaaccaagaaaaacttaataaaactccattcgaggcatttgggaacgacagcgctaaatggcaaaaaatcgaagtattagcaaaaaacctaccaacaaaaaaacaaaagagaatattagataaaaactataaagataaagaacaaaaagacttcaaggatcggaacttaaacgacactcgctacatagcacgcttagtactaaattacactaaagactacctagactttctacccctatccgatgacgaaaataccaaactaaacgatacacaaaagggctcaaaagtacacgtagaagcaaaaagtggaatgctaacctccgctttaagacacacatggggattctcaaccaaagatcgaaacaatcatctacaccatgcaatcgacgccgtaataatcgcatacgctaataactcaatagtaaaggcattttccgacttcaagaaggaacaagaatcaaatagcgccgaactatatgcaaaaaaaatctccgaattagattacaaaaacaaaagaaagtttttcgaaccattcagtggattcagacaaaaagtcttagataaaatagatgaaatattcgtcagcaaaccagaacgaaaaaaacctagtggagcattacatgaagaaacattccgcaaagaagaagaattttaccaatcttacggcggtaaagaaggtgtacttaaggcactcgaactaggtaaaattaggaaagtaaacggaaagatcgtcaaaaacggagacatgtttagagtagacatatttaaacacaagaaaacaaacaagttttatgctgtcccaatttacacaatggattttgcattaaaagtactgcccaacaaagcagttgcaagaagcaaaaaaggagaaatcaaagactggatactgatggatgaaaattacgaattttgctttagtctatacaaagactcattaatactaatacaaacaaaagatatgcaagaaccagaattcgtatactataatgcgtttacaagttcaacagtctcactaatcgttagcaagcatgacaacaaatttgaaacactgagcaaaaatcaaaaaatattattcaaaaacgcaaatgaaaaagaagtaatagccaaaagtataggaatacaaaacctaaaagtattcgaaaaatatatcgtatcagcactcggagaagtaacaaaggccgaatttagacaaagagaagacttcaaaaaatga

SEQ ID NO: 8365 - RNA, 2955 nt, synthetic construct
  misc_feature 1..2955: note = Cas9 variant
  source 1..2955: mol_type = other RNA
atggctcgaatccttgcatttgatatcggaatatctagtatcggatgggcattctcagaaaatgatgagctaaaagactgtggagtaagaatattcaccaaagccgaaaatccaaaaacaggagaaagtctagccttacctcggaggctagcaagatcagctaggaaaagacttgcaagaagaaaggccagactaaaccacttaaagcacttaattgcaaatgaatttaaattaaattatgaagactatcaaagtttcgacgaatcactagcaaaagcatacaaaggctccctaataagtccatacgaattaagattccgagccctaaacgaactactatcaaaacaggactttgctcgagtaatcctacacatagcaaaacgaagaggatatgacgatataaaaaactcagacgacaaagaaaaaggtgcaatactaaaagccataaaacaaaatgaagaaaaattagcaaactatcaatccgtaggcgagtatctttataaagaatactttcaaaagttcaaagaaaatagtaaagaattcactaatgtaagaaacaaaaaagaatcatatgaacgctgcatagcacaatctttcttaaaagatgaactaaaactaatattcaagaagcaaagagaattcggattcagctttagcaaaaaattcgaagaagaagtcttatctgtagctttctataaaagagcactcaaagactttagccatttagttggcaactgctcctttttcacagatgagaaacgcgctcccaaaaattcacccctagcattcatgtttgtcgctttaacaagaatcattaacctgttgaacaacctaaaaaacacagaaggaattctctacacgaaagacgacttgaacgcactacttaacgaggtactaaaaaacggaactctgacttacaaacaaacaaaaaaattgttaggactatcagatgattatgaattcaaaggggaaaaaggaacatactttatagaattcaaaaaatacaaggaatttataaaagcacttggggaccactctttaagccaagacgatctaaacgaaatagccaaggacattacacttataaaagacgaaatcaaattgaaaaaagcactcgcaaagtacgacttaaatcaaaaccagattgactcattatcaaaattagaatttaaagaccacctaaacatctcattcaaagcactgaaactcattacaccactaatgcttgaaggaaaaaagtatgatgaagcgtgcaacgaattaaatctaaaagtagcaataaatgaagacaaaaaagatttcctaccagcattcaacgaaacgtactataaagacgaagtaacaaacccagtagttcttagagcaataaaggaatatcgaaaagtgttaaacgcactactaaaaaaatatggcaaagttcataaaataaatatagagttagctagagaagtaggtaaaaactacagtcaacgcgccaagatagaaaaagaacaaaacgaaaactataaagctaaaaaagatgcagaactcgaatgcgaaaaattaggattaaaaataaattctaaaaatatactaaaattacgattatttaaagagcaaaaagaattctgtgcctactcaggagaaaaaatcaaaatttcagacctacaagacgaaaaaatgttagaaatagaccacatatacccctactcaagaagctttgatgacagttatatgaacaaagtccttgtctttactaaacaaaaccaggaaaaactaaatcagacgccatttgaagccttcgggaacgattcagcaaaatggcaaaaaattgaagtactagctaagaatctgcccaccaaaaaacaaaaacgaatcttagacaagaactacaaagataaagaacaaaaagatttcaaagaccgaaatctaaacgatacaagatatatcgcaagactagttttaaactatacgaaagactacctggatttcttaccactatcagacgatgaaaacacaaaactaaacgacacccaaaaaggttcgaaagtacacgtagaagcaaaatctggaatgttaacatcagcgctcaggcacacttggggtttctcagcaaaagacagaaacaatcacttacaccatgccattgacgctgttatcatagcatacgcaaacaactcaatagtgaaagcgttcagcgacttcaaaaaggaacaggagtccaacagcgccgaactatatgcaaaaaaaatatcagaacttgattacaaaaacaaaagaaaattctttgaaccattcagcgggttcagacaaaaggtactagacaaaatagatgaaatattcgtcagcaaaccagaacgcaaaaaaccgtctggagcactacacgaagaaacattccgcaaagaggaagaattctaccaatcttacggcggtaaagagggtgtactcaaagctctagaactaggaaaaatacgcaaagttaacggcaaaatagtaaaaaatggagatatgtttagagttgacatattcaaacataaaaaaacaaacaaattttacgcagttccaatatatacaatggactttgcactaaaagtgttaccaaacaaagctgttgcaagatcgaaaaaaggcgaaataaaggattggattctaatggacgaaaattacgaattctgctttagtctatataaagacagcctaatcctgattcaaaccaaagacatgcaagaaccagaatttgtatattataacgcgtttaccagtagtacagtatccctgatagtaagcaagcacgataacaaattcgaaacactatcaaaaaaccaaaaaatactattcaaaaacgcaaatgaaaaagaagtcatagcaaagtcaataggaatccaaaacttaaaagtattcgaaaaatacatagtgtcagcactcggagaagtaacaaaggctgaatttagacaaagagaagatttcaaaaaatga

SEQ ID NO: 8366 - RNA, 2958 nt, synthetic construct
  misc_feature 1..2958: note = Cas9 variant
  source 1..2958: mol_type = other RNA
atggcaaaaattttagcctttgacataggaatatcctccataggatgggcattcgtagaaaacgatgagctaaaagactgtggagtcagaatattcacaaaagcagaaaacccaaaaactggagaatctcttgctctccccagacgattagctcgttcagctcgaaaaagactagcgagaagaaaagcacgattaaatcacttaaaacatctaattgctaatgaattcaaactcaactacgaagattaccaaagctttgatgaaagtcttgcaaaagcctataaaggaacgctaatatcaccttacgagctaagatttaaagcgttaaacgaattgctatcgaaacaagacttagctagagttatattacatatagcaaaaagaaggggctacgataatatcaaaaactcagatgacaaggaaaaaggcgcaatactaaaagccgtaaaagaaaatgaagaaaaattagcaaactacaaaagcgtaggagaatacctatataaagaatactttcaaaaatttaaagaaaacagcaaagaatttataaatgtacgaaacaaaaaagaatcatatgaaagatgtatagcacaaagtttcttaaaagacgaattaaaactcatattccaaaaacaaagagagttcggctttaatttctcaaaaaaattcgaagaagaagtcctctcagtcgcattctacaagcgggccctcaaagacttctcacatttagtcgggaactgctcgtttttcgtagacgaaaaacgagcccctaaaaactctcctttagccttcgaattcgtagcactaacccgaattgtaaacctcttaaacaacctaaacaaaaataactcgtacatcaaagatgatctaaatgcccttttatcagaggtcctaaaaaatggaacattaacatataaacagacaaaaaagatactaggattatccgacgattatgaatttaagggacaaaaaggcaactactttatagaattcaaaaaatataaagagttcataaaagcgctatgcgaacataacctaaaccaagacgatctaaacgaaatagcaaaagacataactctagttaaagacgaaactaaattaaagaaagcacttgccaaatacgacctgaaccaaaatcaaatagaaaacctatcaaaaatcgaattcaaagatcatctaaatatatcatttaaagctttaaaactaatagtcccgttaatgcgagaaggaaaaaaatacgatgaagtctgcaacgaacttaacctaaaaacagccattaacgaagataaaaaagaattcctaccagcattcaacgaaacatactataaagacgaagtaaacaacccagtagtactgagagcaataaaagaataccgaaaagtactcaactcattacttaaaaaatatggaaaagtgcacaaaataaatattgaattagcaagagaagttggtaaaaatcatcgagaacgatcaaaaatcgaaaaagaacaaaacgaaaacttcaaagcaaaaaaagacgcagaattagaatgcgaaaaactaggattaaaaataaattccaaaaacatcttaaaactacgactattcaaggagcaaaaggaattttgcgtgtattcaggagaaaagataaaaatctcagatctgcaagacgaaaaaatgttagaaattgaccacatatatccatacagcagatcattcgacgactcatatatgaataaagtattagtattcacaaaacaaaatcaagagaaactaaacaagacacctttcgaagcatttggaaaagacgacgtaaaatggcagaaaatagaaacattagcaaaaaatttaccagcgaagaaacaaaaacgaatactcgacaaaaattacaaagacaaagaacaaaaagactttaaagacaggaacctcaatgatacaagatatatagcaagactagtattaaactacacaaaagactatttggaattcctgcccctctcagatgatgaaaatataaaactaaacgacacacagaaaggaagcaaagttcacgtcgaggcaaaaagcggaatgcttacaagcgtcctcagacatacctggggtttttcaactaaagacagaaacaatcatttacaccacgcaattgacgccgttataattgcatatgctaacgctagtgtcgtaaaagcctttagcgattttaaaaaagagcaagaaaactacactgcagaactatacgcaaaaaaaataaacgaactcgactttaaaaacaagagaaaattcttcgaacctttcagcaacttcagacaaaaagtattagaaaaaatagacgaaatattcgtttcaaaacctgaaagaaaaaaaccgtcaggcgcattacacgaagaaaccttttataaagaagaagaattttataaagagtacggaggaaaagaaggcgtattaaaagcactagaattagggaagataagaaaagtaaatggaaagatagtatccaacgccaacatgttcagagtcgacatcttcaaatacaagaaaaccaacaaattttacgccgtcccaatatacacaatggacttcgccttaggtatattaccaaacaaagcagtagtaggtggcaaagacaaacaaggaataataaaggattggctattgatggatgaaaattatgaattctgcttcagcttatacaaggattctctcatattactacaaacaaaagacatgcaagaaccagaactcgtatactttaaatccttcaagtcatccacagcgggattagtagtatcaaaacacgataacaaattcgaaaacctaaacgaaaaccaaaaaaaattattcaaatcagccaatgaaaaaaaagtagtcgccgaaggcataggaatccaaaacctaaaagtattcgaaaaatatatcgtctctgcattaggtgaaatcaccaaagccgaaattaaagaaagagagaatttcaaaaaaaaatga

SEQ ID NO: 8367 - RNA, 2961 nt, synthetic construct
  misc_feature 1..2961: note = Cas9 variant
  source 1..2961: mol_type = other RNA
atgcctagtgatccagcagaagctaaaccactagaattattagatccatatgcattaagagcacaagggttagaccaagcactgccattaacacattttggacgcgcgctatttcatcttaatcaaaggagaggctttaaaagtaatagaaaaacagaccgaggggacaatgaaaacggaaaaattaaagacgctagccagagattggactgggcgatgcatgaagcaaaagctcgaacatatggagagttcttgcatttaagaaggcaaaaagcaccagatcccaggcaggtaccgacagttaggaccaggctaagcgtaggaaaaagaggagggccggacgcaaaagaggaagctgggtatgacttttatccggatagacgacacctagaagaagaatttcacgaattatggtctgcacaagcccaatttcatcctgaattaacacaagatttgagagatttggtatttgagaaaatattttatcaacgtcctctaaaggagccaaaagtaggactttgtctattcacaagtgaagaacgtttagcaaaagcgcacccactcactcaaaggagagtattgtacgaaactgtaaatcaactacgaataactgccgatggcagatctgtcagaccattaagtagagaacaaagagatcagataattctggcattagatactaagaaaccaacaaagagcttaaacagtatggttgttacattacaagcgcttggaaaagttttaaaactaagagaaggtgaaagatttacactagaatcaggagtccgagaggcaatagcatgcgatcctgtacgggctgcaatgctggcaacatttggaccacggtggtcagcactcgactggcctgaacaatggcaagtcataagcagggtaaggaaattgcaagatgacaaagattttgcagaacttgtagaatggctaatagaattatacggtgtagacaaagaagcagctgtcaaaatagctaatacacaccttcccgaaggatacggccgactaggattaacagcgacaacaagaatactagatagattaaaatcaaatgtattcacatatgcacaagcagttgccgcttgcggatggcaccattcggatcaaagaactggagaatgtcttgatcgtttaccttactacggagccgtattagatcgacatgtcataccaggaacctatgacgaaaatgacgacgatataacgcgattcggtagaataacaaacccaactgttcacattggactaaaccaattaagaagattagtaaataaaataatagaagtttatggaaaaccgaatcagatagtagtggaattagcacgagaactaaaacaaagtgaacaacagaaaaatgacgcaataaaactaataagagatacaaccactgcagctaaacaacgatcagaaaagctcgaagaacttggaattactgataatggtagaaacagaatgttactaagactatgggaagaccttaaccctgatgatgctatgaggagattctgcccatatacaggacaaaggatatcagcagcaatgatattcgacggaagctgcgatgtagatcatatactaccttattcacggacactagatgacggttttgcaaatagaactctatgtttaagagaagcaaaccgagagaaaaggaatcaaaccccctgggaggcttggggcggcacacccaactgggaagcaatagaaactaatcttaaaaacttacctgaaaataaaagatggcgattcgccccagatgcaatggcccgatttgaaggagaaaatgatttcttagatcgagctctcgtagatacacaatatttggcaagaataagtagaacgtatcttgacaccttattcacagaaggaggtcatgtttgggtagttccagggagactaacagaaatgctacgacgtcattggggtttaaattcgctcttgacagataaagatagaggagcagtaaaatccaagaatagaacagatcacaggcaccatagtatagatgcagcagtagtagcagcaacagatcggagcttacttaacagaatttcaagagcagcgggtcaaggtgaagtggcaggccaaagtgcagaattaatagccagagaaacaccacccccatgggaaggatttaggaatgacctaaaatctcaactaggacgtataatagttagccatcgtgccgatcatggcagaatagacagacaagccagaaaacaagggagagatagcacagctggccaattacatcaagaaaccgcttatagcattgtagacgatacaagggtagcgagtaggatagacttccttagtgtaaaaccagcacagctattggatcaaccaggccgtagcggacaagtaagagaccttcaattaagaaaagcattgagagtggcaacgggagacctaactggaaaagattatgaaaaagcattgagagatttcgcagccaaacctggtccatacaaaggtatacgtagggttaggatcataaaacctcttcaggaacaagcaagagtccctgtaccagtattagaccccataaaagcataccaaggaggtagtaaccacgtatttgagatatggcacttgccagacggtaaagtagagccacaggtaataacctcatttgaagcccacgcattagaagttgagaaaagaccacacccagcagcaaaaaggcttcttagagtacataaaggagatatggtagcgttaaaaagagaaggaagaacagtagttggccatgtacaacaaatgcatattaaaaatggcctatttatagtaccacacaatgaagcaaatgcagacgctagaaattccgacaggacagatcctttcaaatggatacaaattgctgcacaaccagctatagccgcaggcataagaagagtcgcagtcgatgaaataggtagacttcgtgacggaggtgcaaaaactatatga

SEQ ID NO: 8368 - RNA, 2964 nt, synthetic construct
  misc_feature 1..2964: note = Cas9 variant
  source 1..2964: mol_type = other RNA
atggcaagaatcctagcattcgacataggaatatcctcaataggatgggcattctcagaaaacgatgagctcaaagactgcggagtcagaatatttacgaaagcagaaaacccaaaaacaggagaatcattagcgctaccaagaagattgagtcgatcagcaagaaaaagacttgcccgaaggaaagcaagactaaaccatctcaaacacttaattgcgaacgagtttaaactaaattacgaagattatcaaagttttgacgaatcacttgcgaaagcttacaaaggtagtctaataagtccatacgaattaagattcagagcactaaacgaatttctcagcaaacaagattttgctagagtgatactacatatagcaaaacgcagaggatacgatgacataaaaaacaatggtgacgaggaaaaaggagaaatcttaaaagccataaaacaaaatgaagaaaaacttgtttcatatcaaagtgtaggagagtatttatacaaagaatacttccaaaaattcaaagaaaactcaaaagaattcatcaacgtacgcaataaaaaagaatcatacgaaagatgcatagcacaaagtttcctaaaagatgagctgaaactcatcttccaaaaacaaagagagttcggtttctcattcagtaaaaaatttgaagaagaagttctcagtgtagctttctataaacgcgccctaaaagatttctcgcacttggtgggtaactgctcttttttcaccgacgagaaacgtgccccgaaaaattcacccctggcattcatgttcgtagcattaactcgcataataaatctattaaataaccttaaaaacacggaagggatactatatacaaaagacgatctgaatacgctactaaatgaggtactaaaaaatggaacattaacctacaagcagacgaaaaaattattaggtctaagcaatgattacgagttcaaaggagaaaaaggtacatatttcatcgaattccaaaaatacaaggaattcgtgaaggcactaggagaacacaacttatcacaagacgacctaaatgaaatagcaaaagacatcacacttattaaagacgaaatcaaactaaaaaaagccctggcaaaatacgacctaaatcaaaaccaaatcgattccctcagtaaattggaatttaaagatcacctaaacatatcgtttaaagcccttaaattaataacaccgcttatgttagaagggaaaaaatatgatgaagcttgtaacgaattaaacctcaaagtagctataaacgaagataaaaaagatttcctacctgcctttaatgaaacatactacaaagacgaagtaaccaacccggtcgtactaagagcaataaaagaatacagaaaagtcttaaacgcgctattaaaaaaatacggtaaagtacacaagatcaatattgaacttgcaagagaagtaggcaaaaaccattcccaaagagcgaaaattgaaaaagaacaaaacgaaaactataaagctaaaaaagatgcagagctagagtgtgaaaaactcggattgaaaataaattctaagaacatattgaaactcagactattcaaagaacagaaagaattctgcgtatatagtggcgaaaaaataaaaatatcagacctacaagacgaaaaaatgttagaaatagaccacatctacccatactcaaggtccttcgacgacagttatatgaacaaggtattagtatttacaaaacaaaaccaagaaaaattaaacaaaacaccattcgaaactttcggaaacgatagagtaaaatggcagaaaattgaagtactcgctaaaaatctaccaactaaaaaacaaaaaagaattctagataaaaactataaagataaagaacaaaaagatttcaaagacagaaacctaaacgacaccagatacatagcaagactcgtactaaattacactaaagattacttagacttcctgccgcttagcgacgacgaaaacacaaagctaaacgacacccaaaagggttcaaaagttcacgtagaagcaaaaagtggcatgctaactagcacccttagacatacatggggtttctcaaccaaagacagagataaccacctacatcacgctattgacgcagcaattatcgcatacgcaaacaacagtatcgtaaaagccttcagcgacttcaaaaaagaacaagaatcaaacacagcagaactctacgcaaaaaaaatatcagaattagactacaaaaataaaagaaagtttttcgaacccttttcaggttttagacaaaaactacttgataaaatagacgaaatattcgtaagcaaacctgaacgtaaaaaaccatcaggagcactccacgaagaaacatttaggaaagaagaagagttctaccaaagttatggaggcaaagagggcgtcttaaaagctttagagttaggtaaaataagaaaagttaatggaaaaatggtaaaaaatggtgatatgtttagagttgatatattcaaacacaaaaaaacaaacaaattctacgcagtaccaatctatacaatggacttcgcattaaaagttctcccaaacaaagcagtcgtacaaggtaaagacaaaaaaagtggactaataaaggattggatcttaatggacgaaaactacgaattttgcttctcactatacaaagattcattaatactaatccaaacaaaagacatgcaagaacccgaactagtatactatgaaagactggacagcagcaacgcatctctcacagtatcaaaacatgataacaaattcgaaacactcagtaaaaaccaaaaaatactatttaaaaacgcgaacgaaaaagaagtcatcgcaaaaagtatagggatccagaatctaaaagtctttgaaaaatatatagtatccgccctaggcgaggtaaccaaagcagaatttagacaaagagaagacttcaaaaaatga

SEQ ID NO: 8369 - RNA, 2964 nt, synthetic construct
  misc_feature 1..2964: note = Cas9 variant
  source 1..2964: mol_type = other RNA
atggccagaatcttagcatttgatatagggataagctcgataggatgggcattttcggaaaatgacgaattaaaagattgcggagtaagaatatttacaaaagctgaaaacccaaaaaccggcgaaagcttagcattaccaaggcgattagcaagatcggcacgtaaaagacttgcaagaagaaaagcaagactgaatcacctaaaacacttgattgcaaacgaatttaaactcaactacgaagattatcaatcattcgacgaatcattagccaaagcatataaaggaagtctaatatcaccgtacgaattacgattcagagctttaaatgaactactatcaaaacaggatttcgccagagtaatattacacatcgctaaaagaaggggctatgatgacataaaaaactcagatgacaaagaaaaaggcgcaatcttaaaagcaataaaacaaaatgaagaaaaattagctaactatcaatcagtaggggaatacctatataaagaatatttccaaaagtttaaagaaaattccaaagaattcaccaacgtgcgaaacaaaaaagaatcatacgaaaggtgtattgcccaatcattcctaaaagatgaactaaaattgatattcaaaaaacaaagggaatttggattctccttctcaaaaaagttcgaagaagaggttctatcggttgctttttacaagagagctctaaaagatttctcccacctagtaggaaattgcagcttctttacagacgaaaagcgagcaccaaaaaattcacctttagcgtttatgtttgtagctttaacaagaattataaacctcttgaacaatttaaaaaacacagaaggaatactatacaccaaagacgacctaaatgcgttactgaacgaagtattaaagaacggaactctaacgtacaaacaaacaaaaaaactgttaggacttagcgacgattacgaattcaaaggcgaaaaaggaacatatttcatagaatttaaaaaatacaaagaatttataaaagcattaggagatcacagtctgagtcaagatgacctaaacgaaatagctaaggacattactctaataaaagacgaaattaaacttaaaaaagcacttgcaaaatatgatctaaaccaaaatcaaatagattcattgagcaaactagagttcaaagaccacttaaatatatcgttcaaagcattaaaattaattacaccactaatgttagaaggaaaaaaatacgatgaagcgtgcaacgaactaaatctcaaagttgccataaatgaagataaaaaggacttcctaccagcctttaatgaaacctattataaagacgaagtaacaaacccagtggtattaagagcgataaaagaatatcgcaaggtattaaacgcactcttgaaaaaatacggaaaagttcacaaaattaacatcgaattagcaagagaggtaggaaaaaattactcacaaagagcaaaaatagaaaaagaacaaaacgaaaattacaaagctaaaaaagacgccgaactcgaatgtgaaaaattaggactcaaaataaattcaaaaaacatacttaaacttagactgttcaaagaacaaaaagaattctgcgcatactcaggggaaaaaataaaaatctccgacttacaagacgaaaaaatgctagagatagaccacatatacccttacagcaggtcctttgatgatagctacatgaacaaagtactagtatttaccaaacaaaatcaagaaaaattaaatcaaacaccctttgaagcattcggcaatgatagcgccaaatggcaaaaaatagaagtactagcaaaaaacttgcctacaaaaaaacaaaagagaatactagataaaaattacaaagacaaggaacaaaaagacttcaaagatcggaacctaaatgacactaggtacattgcaagattagtgctaaactacaccaaagactacctagactttctacctctaagcgacgacgaaaacactaaactaaacgatacacaaaaaggaagcaaagtacatgtagaagcaaagagcggaatgctaacaagcgcgctcagacacacatggggattcagcgccaaagacagaaacaatcatttgcaccatgctatagacgcagttatcatagcatatgcaaacaattctattgtaaaagccttcagcgacttcaaaaaagaacaagaaagcaatagcgcagaactttacgcaaaaaaaatcagcgagctcgattataaaaacaaaagaaaattttttgaacctttctccgggttcagacaaaaagtactagataagatagatgaaatatttgtatcaaaaccggaaagaaaaaaaccatcaggagcactacatgaagaaacattccgcaaagaagaagaattctaccaatcatatggaggaaaagagggagtattaaaagctcttgaattaggtaaaataagaaaagtaaacggaaaaatagtaaaaaacggagatatgttcagagttgatatattcaaacacaaaaaaacaaacaaattctacgcagtacccatatatacaatggacttcgcactaaaggtccttccaaataaagcagtagcaaggtcaaaaaaaggggaaataaaagattggatattaatggacgaaaattacgaattttgtttctcactttataaagactcattaatactaattcaaaccaaagacatgcaagaacccgagttagtctatttcaacgcctttacaagtagtactgtatccctaatagtgtcaaaacacgacaataaattcgaaactctaagtaaaaatcaaaaaatcttatttaaaaacgcaaacgaaaaagaggttatagcgaaatcaataggaattcaaaatctaaaagtattcgagaaatatatcgtaagcgcactaggagaagttactaaagcagaatttagacaaagagaggatttcaaaaacgaactcagatga

SEQ ID NO: 8370 - RNA, 2964 nt, synthetic construct
  misc_feature 1..2964: note = Cas9 variant
  source 1..2964: mol_type = other RNA
atggcaagaatactcgccttcgacatcggaatctcttccataggatgggcattctccgaaaacgacgaattaaaagactgcggagtacgaatattcactaaagcagaaaacccaaaaacaggagaatcacttgctctacccagaagacttgcaagaagcgcaagaaaacgactcgcgaggagaaaagcgagactaaaccatttaaagcatttaatagccaatgaatttaaacttaattacgaagattaccaatcttttgacgaatcactcgcaaaagcatacaagggaagcttaatttcaccatacgagctcagattccgagcgctaaacgagttactaagtaaacaagatttcgcacgagtaatactacatatcgccaaacgaagaggctacgatgatatcaaaaacaatggagacgaagaaaaaagtgaaatactaaaggctatcaaacaaaacgaagaaaaactcgtaaattaccaaagcgtaggagaatacctttacaaagaatacttccaaaaattcaaagagaactcaaaagaattcatcaacgttagaaacaaaaaagaaagctacgaacgttgcatagcacagagcttcctcaaagatgaactaaaactgatttttcagaaacaacgagaattcggcttcagctttagtaaaaaattcgaagaggaggtactctcagtagcattttataaacgagcacttaaggacttcagccatctagtgggaaactgctcattcttcaccgacgaaaaaagagcacccaaaaattcaccattggtctttatgtttgtagcgttaacaagaattatcaacttattaaacaatttaaagaatacagaaggaatactatacacaaaagacgacttaaacgcactcctaaatgaggttttaaaaaatggaacattaacgtacaagcaaaccaaaaaactgttaggtctatcagatgactacgaattcaaaggcgaaaaagggacatatttcatagaatttaaaaaatacaaagaatttattaaagcattagacgaacattctctaagtcaagacgatctcaatgaaattgccaaagacataactctcattaaagacgaaataaaacttaagaaagccttagcaaaatacgatcttaaggaaaatcaaatcgactcattatccaaattagaatttaaagatcatcttaacatatcatttaaagcattaaaattaataacaccactcatgttagaaggaaaaaagtacgacgaggcatgcaacgaattaaatctaaaagtagccatcaacgaagacaaaaaagacttcctcccagcatttaacgaaacttactacaaagacgaagtcactaatccagtcgtactacgagccataaaggaataccgaaaaatactaaatgcactcttaaaaaaatatggaaaagtacataaaataaatatagaactcgccagagaagtgggaaaaaatcattctcaaagggccaaaattgagaaagagcagaacgaaaattacaaagccaaaaaagatgcagaattagaatgcgaaaaattaggcttaaaaatcaactcaaaaaacatactaaaattaagactatttaaagaacaaaaagaattttgtgtttactcaggagaaaaaatcaaacttagtgatttgcaagacgaaaaaatgctcgaaatagaccacatctacccatatagtagatcattcgatgactcatacatgaacaaagtactagtatttgcgaaacaaaaccaagaaaaactaaacaaaacgccatttgaagcgtttggaaatgacagcacaaaatggcaaaaaatagaagtactaaccaagaatttacccacaaaaaaacaaaaacgtatcctagataaaaactacaaagacaaagaacaaaaagatttcaaagatcgaaacctcaacgacactcgatacatcgcaagattagtattaaattacacaaaagactacttagatttcctcccattatcagatgacgagaatacaaaactaaacgacacacaaaaagggtctaaagtccatgtagaagcaaagagcggtatgttaacatcagctttacgacatacatggggattctcaactaaagacagaaacaatcatttacatcatgctatcgatgcagtaatcatagcctatgcaaacaactcaattgtaaaggcattcagtgattttaagaaagaacaagagagcaatagcgccgaactatatgccaaaaaaatctcggaattagactacaaaaacaaacgtaaattctttgaaccattctcgggcttcaggcaaaaagtgctcgacaagatagatgaaatatttgtatcaaaaccagaaagaaaaaaacccagtggagcactacacgaggagacatttagaaaagaagaagaattttaccaaagttacggaggcaaagaaggtgttctaaaagctctcgagctcggaaaaatacgaaaagttaacggcaaaattgtaaaaaatggtgatatgtttagagtagacatatttaaacacaaaaaaacaaacaaattctacgcagtccccatctacaccatggacttcgcactcaaagtattacccaataaagcagtagcacgtagcaaaaagggagaaataaaagattggatattaatggacgaaaactatgaattctgtttttcattatacaaagactcattaatacttatacaaactaaagacatgcaagagcctgagttagtatacttcaacgcattcacatcatcgacagtctcattaattgtctcaaaacatgataataaatttgagacattatccaagaatcagaaaatactatttaaaaatgccaacgaaaaagaagtaatagcaaaatcaatcggaatacaaaacttaaaagtattcgaaaagtacatagtatccgcacttggagaagtcaccaaggctgaattcaggcaaagagaagatttcaaaaacgaattaagatga

SEQ ID NO: 8371 - RNA, 2964 nt, synthetic construct
  misc_feature 1..2964: note = Cas9 variant
  source 1..2964: mol_type = other RNA
atggcaagaatattggcattcgacataggaataagctcaataggatgggccttctccgagaatgatgaattaaaagattgcggagtcagaatctttacaaaagccgaaaacccaaagacaggggagtcattggccttaccaaggagattagcaagatcagcaagaaaacgactagcgaggagaaaagcacgattgaaccaccttaaacatctaattgcaaatgaattcaaattaaactacgaagactatcagtccttcgacgaatccctcgcaaaagcatacaagggctcactcataagtccatacgaattaagattcagagcactaaatgagctactatcaaagcaagacttcgcacgagtcattctccacatagccaaaagaagaggttacgacgatatcaaaaacagtgacgacaaggaaaagggagcaattttaaaagcaataaaacaaaatgaagagaaactcgcgaattaccaatcagtaggtgaatacctatacaaagaatattttcagaaatttaaagaaaacagtaaagaattcacaaacgtccgaaacaaaaaagaatcatacgaaagatgtatcgcacaaagttttctcaaagacgaattaaagctcatctttaaaaaacaaagagaatttggttttagtttcagcaaaaaatttgaagaagaagtcctaagtgtagctttctacaagagagccctaaaagacttcagccatttagtcggaaactgttcatttttcacagatgaaaaaagagcaccgaaaaattcccccctagcgttcatgtttgtagcattaacaagaatcatcaatttattaaacaatctaaaaaacacagaaggaatattatacacaaaagatgacctaaacacccttctaaatgaggtacttaaaaacggaacattaacatacaagcagacaaaaaagttactaggactgtcagatgattatgaattcaaaggagaaaagggcacgtattttatcgaattcaaaaaatataaagaattcataaaagcactgggagagcacaatctctcacaggatgatctcaacgaaatagcaaaagatattacactaataaaagatgaaataaaactaaaaaaagctctagcaaaatacgaccttaaccaaaatcaaatcgacagcttgagcaaactagaattcaaagatcacttaaacataagcttcaaagccttaaaattagtaacgccattaatgctcgaaggaaaaaaatacgatgaagcatgtaatgaactcaatctaaaagtagccatcaacgaagataaaaaagatttcctaccagcatttaacgaaacatactataaagatgaagtaacaaacccagtagtccttcgagctataaaagaatatagaaaagtattaaatgctttattaaaaaaatacggaaaagtacataaaattaacatagaacttgcacgagaggtcggaaaaaaccactctcaaagagccaaaatagaaaaagaacaaaacgaaaactataaagcaaaaaaagacgcagaactcgaatgtgaaaaacttggacttaaaataaacagtaaaaacatactaaaactaaggttgttcaaagaacagaaagaattttgcgcatactcaggagaaaaaataaaaatatcagacctacaagatgagaaaatgttagaaatagaccatatatatccctatagtagaagcttcgacgattcttacatgaataaagtattagtattcacgaaacaaaaccaggaaaaactaaatcaaacaccattcgaagcattcggtaatgactcagcaaaatggcaaaaaatcgaagtcctagcgaaaaaccttccaacaaagaaacaaaaaagaatcctcgataaaaactataaagataaagaacaaaaaaactttaaagacagaaatctaaacgacacaagatatatagcaagactagtgttaaattatacaaaagattacctagactttctcccattgtcagacgacgaaaatacaaaacttaacgacacccaaaaaggatctaaagtacacgtagaagcaaaaagtggaatgttaacctccgcactaagacatacatggggtttctcagctaaagacagaaataatcatctacaccacgcaatagacgccgttattatagcatacgcaaacaattctatcgtcaaagccttctcagacttcaaaaaagagcaagaaagcaattcagcagaattatatgcaaaaaaaatctcagaacttgattataagaataaacgcaaattcttcgaaccgttttcaggctttcgacaaaaggtcttggacaaaatcgacgaaatatttgtatccaaaccagagagaaaaaaaccatcaggagcactacatgaagaaacatttagaaaagaggaagaattctatcaaagctatggaggtaaggaaggagtactaaaagcattagaattaggaaaaataagaaaagtaaacggtaaaattgtgaaaaatggtgacatgttcagagtagacatattcaaacataaaaagaccaacaaattttacgccgttccaatatacacaatggatttcgcattaaaagttttaccgaacaaagcagttgcgcggtctaaaaaaggagaaatcaaagactggatactaatggatgaaaactacgaattctgcttttcattatataaagacagtctcatcttaatccaaactaaagacatgcaagaaccagaactcgtatatttcaacgcctttacgagcagcacagttagtttaatcgtatcaaaacacgataacaaatttgaaacattatcaaaaaatcagaaaatactcttcaaaaacgccaatgaaaaagaagtaatagctaaatcaataggtatccaaaacttaaaagtattcgaaaaatatatagttagtgctctgggcgaagtgacaaaagcagaattcagacaacgagaagactttaaaaacgaattacgatga

SEQ ID NO: 8372 - RNA, 2964 nt, synthetic construct
  misc_feature 1..2964: note = Cas9 variant
  source 1..2964: mol_type = other RNA
atggcacgaatattagcattcgacataggaataagctcaataggatgggcattcagtgaaaacgatgaactaaaagactgtggagtccgaatattcactaaggcagaaaacccaaaaacaggagaatctctagcactgccaagaagactagcgcgctcagcaagaaaacgactagcaagaagaaaagctcgattaaatcacttaaaacacctcatagccaatgagtttaaactaaactacgaagactatcaaagttttgacgaatcactagcaaaagcatacaaaggatccttaataagcccatacgaactcagattcagagccctaaacgaactactatcaaaacaagacttcgcacgagtaatcttacatattgcaaaacgaaggggctatgatgatattaagaacagcgacgataaggagaaaggcgcaatacttaaagcaataaagcaaaacgaagaaaagctagcaaactatcaatcagtcggagaatatctatacaaagaatatttccaaaaattcaaagagaactccaaagaatttacaaacgtaagaaacaaaaaagagtcatatgaaagatgcatagcacagagctttcttaaagacgaactaaaactaattttcaaaaaacaaagagaattcggcttctccttctcaaaaaaatttgaagaagaagtactatcggtcgccttttacaaacgagcattaaaagacttctcacacctcgtaggaaactgcagcttttttactgacgaaaaaagagcgccaaaaaactcacccttagcatttatgttcgttgcattgacaagaatcatcaatctattaaataatttaaaaaacacagaaggaatattgtacacaaaagacgaccttaacgctctcttaaatgaggtccttaaaaactcaaccctaacttacaaacaaacaaaaaaactacttggactatctgacgattacgaattcaaaggcgaaaaaggcacatattttattgaattcaaaaaatacaaagagttcataaaagccttaggagatcatagcctatcccaagacgacctaaatgaaatagccaaagacataaccttaattaaagatgaaataaaactaaaaaaggcgttagcaaaatatgacctaaaccaaaatcaaatcgatagtttaagcaagctcgaattcaaagaccatctaaatataagcttcaaagcactgaaactaataacgcctctaatgctagaaggaaaaaaatacgatgaagcttgtaatgaattaaacctgaaagtagctataaatgaagacaaaaaagacttcttaccagcatttaatgaaacatattataaagacgaagtaacaaatcccgtcgtactaagggccatcaaggaataccgtaaggtcctaaatgctttacttaaaaaatatggaaaagtacataaaataaacatagaactagccagagaagtaggaaaaaactactcgcaaagagcaaaaatcgagaaggaacaaaacgaaaattacaaagccaaaaaagacgcagaattagaatgcgaaaaactaggcctaaaaatcaactcaaaaaatatattaaaactaagactgtttaaagaacaaaaagaattctgcgcttactccggagaaaaaatcaaaatctcagacctgcaagatgaaaaaatgctagaaatcgatcacatctacccgtacagcaggtctttcgatgatagctatatgaacaaggtactcgtcttcactaagcaaaatcaagaaaaactaaataaaaccccattcgaagccttcggaaatgatagcgccaaatggcaaaaaatcgaagttctagcaaaaaacctaccaacaaaaaaacaaaaacgtatactagacaaaaattataaggacaaagaacaaaaagatttcaaagatcgaaatctaaacgacaccagatatatcgctagacttgtcctaaactacacaaaagattatctggacttcctacctttatcggacgacgaaaacactaaattaaatgatactcaaaaaggctctaaagtacacgtagaagcaaaatcaggaatgctaacatccgcgttaagacacacctggggtttctcggccaaagatagaaataatcacttacatcatgcaatagacgccgtgataatagcatacgcaaacaactcaatagtaaaagctttcagcgacttcaaaaaagaacaagagtcaaactccgctgaattatacgctaaaaaaatctccgaactagactataaaaataaaagaaaattcttcgaaccattctcaggattcagacaaaaggttttagacaaaatagatgaaatctttgtctccaaaccagaaagaaaaaaaccatcgggcgcacttcacgaagaaacttttagaaaagaagaagaattctaccaaagttatgggggtaaagaaggggttttaaaagcactcgaacttggcaaaatcagaaaagtaaatggaaagatagtcaagaatggagacatgtttagagtggatatctttaagcacaaaaaaaccaacaaattctacgcagtccccatatatacaatggactttgcattaaaagtcctcccaaacaaagcagtagcacgcagcaaaaaaggggaaatcaaagattggattttgatggatgaaaattacgaattctgcttctccctctataaagactcactcatattaatacaaacaaaagacatgcaagaacccgaactcgtttacttcaacgctttcacaagctcaacagtctctctaatagtatcaaagcacgacaataaattcgaaacactatccaagaatcaaaaaatactattcaaaaatgcaaacgaaaaagaagtaatagcaaaatcaatcggcatacaaaacttaaaagtatttgaaaaatatatagtatccgcactgggtgaagtaacaaaagcggaattcagacaaagagaagatttcaaaaacgaattaagatga

SEQ ID NO: 8373 - RNA, 2964 nt, synthetic construct
  misc_feature 1..2964: note = Cas9 variant
  source 1..2964: mol_type = other RNA
atggccagaatactcgcatttgacataggaataagttcgatagggtgggcattttcagaaaatgacgaattaaaagattgcggcgtaagaatctttacaaaggcagaaaatcccaaaacaggagaatccctagcattaccacgcagattagcaagatcagctagaaaacgactagcaagaagaaaagcaagactgaaccacctgaaacacctaatcgcaaatgaatttaaacttaattacgaagactaccaatctttcgatgaatcactagcgaaagcatacaaaggctcattaattagcccatatgaactacgatttagagcactaaacgaactactttcgaaacaagacttcgcccgagtaattctacacatagccaaaagacgaggatacgacgatattaaaaactcagacgataaagaaaaaggagcaatacttaaggccataaaacaaaacgaggaaaaactagcaaattatcaaagcgttggagaatatctatacaaagaatacttccaaaagttcaaagaaaactccaaagagttcacaaatgtcagaaacaagaaagaatcatacgaacgatgtatagcacaatcatttctcaaagatgaattaaaattaatcttcaagaaacaaagagagttcggattttccttttcaaagaaattcgaagaagaagtactatcagtagccttctacaaacgagcgttaaaagacttttctcacttagtcggaaactgctcatttttcactgacgagaaaagagcgcccaaaaactcaccactagcgttcatgtttgtggcacttacaagaattataaatctattaaacaacctgaaaaacacagaaggaatattatacacaaaagacgacttaaacgcccttcttaacgaagtacttaaaaacggaacattaacatataaacaaacaaagaaattattaggactctcagacgattatgaatttaaaggagaaaaaggcacatatttcatcgaatttaagaaatataaagagttcattaaagctctaggagaccactcattaagccaagacgatttaaacgaaatcgctaaagacatcacactgataaaagacgaaattaaactaaagaaagcactggctaaatatgacttgaaccaaaaccaaatagacagcctctcaaaactcgaatttaaagaccacctaaatatatctttcaaagcattaaaattaataacacccctaatgcttgaaggaaagaaatacgatgaagcctgcaacgaactcaacttaaaagtcgccatcaatgaagacaaaaaggattttcttccagcttttaacgaaacctactacaaagatgaagtaacaaacccggtcgtcttacgagcaataaaagaatatcgaaaagtcctgaacgcactattaaagaaatatggaaaagtacacaaaataaatatagaactagcccgagaggtaggcaaaaactactctcaacgagcaaaaatagaaaaagaacaaaacgaaaattataaagcaaagaaagacgcagaattagaatgtgaaaaactaggattaaaaataaacagcaaaaacatcttgaaactacgactattcaaagaacaaaaagagttctgcgcatactcaggtgagaaaataaaaatatcagacctccaagatgagaaaatgttagaaatagatcatatttacccctacagtcgcagcttcgacgacagctatatgaacaaagtactcgtatttaccaaacaaaatcaagaaaagttaaatcagacaccttttgaagccttcggaaatgacagtgcgaaatggcaaaagatagaagtactagctaaaaatttaccaacaaagaaacaaaaacgtatactagacaaaaactataaagacaaagaacaaaaagacttcaaagacagaaatttaaacgacacaagatatatagctagattagtattaaactataccaaagactacctagactttctgccactatcagacgatgaaaacacgaaactaaacgacacacaaaaaggtagcaaagttcacgtagaagccaaatcaggcatgctaacttcagcactaagacatacatggggattctcggccaaagacaggaacaatcatctccatcacgccatagacgcagttataatagcatacgcaaacaattccatagtaaaagcattttcagacttcaagaaagaacaagaaagcaatagtgcggaactttacgccaagaaaataagtgaattagattataaaaataaaagaaaattctttgaaccattttcaggattcagacaaaaagtcttagataaaatcgacgagatatttgtaagcaaacctgaaagaaagaaaccgtcaggggcattacacgaagaaacattccgaaaagaagaagagttttaccaaagttatggaggcaaagaaggagtattaaaagcactagaactaggaaaaataagaaaagtcaacggaaaaatcgttaaaaacggcgatatgttcagagtagacatttttaaacacaagaaaacaaataaattttatgccgtacccatatataccatggactttgcacttaaagtattaccgaacaaagctgttgcacgatccaagaaaggagaaataaaagattggattttaatggatgaaaactatgagttctgttttagcctatataaagatagtctaatattgatacaaaccaaagacatgcaagaaccagagttcgtatactataatgcatttacaagctccaccgtctcactaatcgtaagtaaacacgacaacaaatttgaaacactaagcaaaaatcagaaaatattatttaaaaatgctaatgaaaaagaagtaatcgccaaatcaataggtatacaaaacttgaaagtcttcgaaaaatacatagtaagtgctctcggagaagttaccaaagcagaatttcgacaacgagaagatttcaaaaacgaactccgatga

SEQ ID NO: 8374 - RNA, 2979 nt, synthetic construct
  misc_feature 1..2979: note = Cas9 variant
  source 1..2979: mol_type = other RNA
atgagaatattcagcgatggaaggaatccaaaagacggatcaagcctagcggtcacaaggagggcagcgagagcaatgcgtcgaagaagagacagacttttaaaaagaaaaacaagaatgcaagctaaattagtagaacatgggtttttcccagcagatgcaggtaaacgaaaagcattggaacaactaaatccatacgcacttcgagctaagggtctacaggaggctttattaccgggagagttcgctagagcattatttcacattaaccaaagacgtggtttcaagagtaatagaaagaccgataagaaagacaacgattcaggagtattaaagaaagcaattggtcaactaagacaacaaatggctgaacaaggaagtcgaacagtcggagaatacttatggacacgtctccaacaaggacagggagtgagagctaggtatagagaaaaaccatataccacagaagaaggaaagaaacgtatagataaaagctatgacttgtatatagacagagcaatgatagaacaagaatttgatgcattgtgggcagcacaagcagcattcaatcctactctattccacgaagcagcccgtgctgatctaaaagatacattactacaccaaagacccttacgccctgtcaaaccaggaaggtgtactttactacccgaagaagaaagggcaccattagctttgccatcaacacaaagatttcgtatacaccaagaagtaaatcatctgagactattagatgaaaatttaagagaagtagcattaacattggcacaaagagatgcagttgtcacagcattagagacgaaagcaaaacttagttttgagcaaattagaaaattactcaaactatctggaagcgtacagtttaatctagaagatgcaaaacgaaccgaattaaaaggcaacgcaaccagtgcagccttagctcgaaaagaattatttggagcagcctggagtggattcgatgaagcgttacaagatgaaatagtgtggcagctagtaactgaggaaggagaaggagctttgattgcatggttgcaaactcacactggggtagatgaagccagagcccaagctatagtggacgtaagcctccccgaaggttacggaaatctaagtagaaaagctctagcgcgcatagttccagcactacgtgctgcggtaattacttacgataaagcggtacaagcagcaggatttgatcatcacagccaactagggtttgaatatgatgcaagtgaagttgaggacttagtacacccggaaacaggagaaataagaagtgtctttaaacaactaccatattacggtaaagcattacaaagacatgtagcttttggttcaggaaaacctgaagacccagatgaaaaacgttacgggaaaatagcaaacccgaccgtacacatagggctaaaccaagtacgaatggtagttaatgcgctaattagaagatatggacgcccaacagaagtagtaatagagttagcgcgtgatttaaaacaaagtcgcgaacaaaaagtagaggctcagagaagacaagcagataatcagagacgcaatgcaagaattagaagaagcattgcagaagtactcgggattggagaagaaagggtacgagggagtgatatacagaaatggatatgttgggaagaattaagttttgatgctgcagataggaggtgtccatactcaggagtccaaataagtgcagcgatgttactaagcgacgaagttgaagtagaacatattctcccgtttagtaaaacattagatgatagccttaacaatagaacagtagcaatgagacaagcaaataggataaaaagaaataggacaccatgggatgcaagagcagaatttgaggctcaaggctggtcatatgaagacatattacagcgtgctgaaagaatgccattaagaaaaagatatcgttttgcgcctgatggttatgaacgatggttaggagatgataaagactttttggcacgagctttgaacgatacacgatatttgagtcgagtggctgcggaatatttaagattggtatgtccaggaacgagagtaataccggggcagctaacagctttattgaggggtaaatttggtctaaatgatgtacttggtttagacggagagaaaaatagaaatgatcacaggcaccatgcggtagatgcatgtgttataggtgttacagatcaagggctaatgcaaagatttgccacagcaagtgcacaagcgagaggagatggactaacacggctagtagatggtatgccaatgccatggccaacttacagagaccatgtagagagagcagtccgacatatatgggtgagccacagaccagaccatggatttgaaggagcaatgatggaagaaacatcatacggaataaggaaagacggatcaataaaacagagacgaaaagctgacggaagtgcaggccgtgaaatatcaaatctaatcaggatacatgaagccactcaaccattaagacacggtgtatcagcagatgggcaaccattagcatacaaaggatacgtcggaggatctaattactgtatagagataacagtaaatgacaaaggaaaatgggaaggcgaagtaatatctacatttagggcttatggagtagtcagagctggaggaatgggtagattaaggaatcctcacgaaggacaaaacggaagaaaattgatcatgagattggtgattggagactccgtaaggctagaagtagatggcgcagaaaggacaatgcgaatagtaaaaataagtggttccaatggacaaatctttatggcacccatacatgaagcaaacgtagacgcacgaaacacagataaacaagatgcgttcacatacacaagtaaatatgcaggaagtttacagaaagcaaaaacgcgaagagtaacaatatcacctataggagaagtaagagaccctggattcaaaggatga

SEQ ID NO: 8375 - RNA, 2985 nt, synthetic construct
  misc_feature 1..2985: note = Cas9 variant
  source 1..2985: mol_type = other RNA
atgacactcggattagatctgggtacaaattccataggatgggcacttatagattttgacgacaatcaacaacccagaaatttaatagcttgcggctcgagaatatttcaagaagctgtagaagcaaaaaccggaacccctaaaaatcatgcacgaagaacggcacgggcagccagaaaattggtcgcccgaagaaagcaacgccgaaccaaactgttaaatctcctaataagacacggtttattaccacaagatgttgccgaaagaaatgcactgttacttgataaccaagccaataacccatatcaactcaggaaacgcggattggatgaaaaactagaaccttttgccttcggcagagccctctatcatttagcacacagaagaggtttccaatcaaaccgcaaagctgcaagcgacgaagatggcaaagtaaaaacggccatatcaacactaagagccgaaatgcaaggtcgaaccctaggtgcattccttgcagatcaaccaacccaaagacgcagatatactgatagagcaatgtatgtagaagaatttgaacaactatggagtaaacaagcaagtttcacccaagaacagttaacacaagccctaaaagtagctatccataactccatattctttcaaagaccattaaaatctcaaaaacatttggttggaaaatgcacattcgaacctacaagaaaaagagcggctaaagcaatactactaacacaaagatttcgaatattacaagacgtgaatcatctagcagtgaaaaatccaataacaagagaatttcgcccattaacacaagacgaaagaaataaattagctgaagcgttagacaaacaaaagtcaatgacatggggcgcagtaagaaaagtaatcggatggaataagaaagactccttacatgaaggagaaacttttaaccttgaagaaggcaagaaagacaaactaattggaaatagaacagcatgtgatttaagaggagctctaggagaccgatgggacgctttaactgcacaacaacaagatgatctcgtaacagatttactaacaattgacaacacagatggcttcctaaaaagaatgaaaactcattgggaatttgacgatgcgaccgcagaagtaatagcaaaaattgaactggaaccgggatacgcacgactgagtgcaaaagcgatgagagctatacttccttatttagaacaaggaatgatatatagcgatgcctgcaaagcagcagggtatgatcatagtaaccccaatcagcgaacaataactgataaattgggtctgccatcgaatgtaagaaacccagtagtacaaaaggccttatttgaaactcgaaaagtagtcaatgccatagttagaaaatatgggaaaccagcagttataagagttgaaatggccagagacatgaaacttagtaaaagacaaaaagaagaattacaaaaagaacaaaataaacaaaagaaagcaaatgaactagcagaaggcatactgcgaaaagaatttggaatccaacaaccagcaagggcagatatacaaaaatacaatctttggttagaatgcaaagaagtatgcccttacacggggacgacaataagtagagaaatgttgttctcacctgaagtagatgtggaacacatactcccatactctagaagtttagatgattcatacatgaataaaacattgtgcatggcaacatttaataggcaagtcaaattaaacaatacaccttatgaaattggacaaggagaccctctggcctatgcagaaatcttccaaagaataaaaacactcccttttccaaaaagaagaagatttgagcaaaaggaaatcgaaaccgacaaattcattgaaagacaactaaacgatacaagatatatttgtgtagaagttagagacttccttcaacaactcggcgcaccagtagaagtttcaaaaggagaagcaacagcaaaattaagaggacgttggaaactcaatacattactatcacctgatggatctaacgagaaatatcgaggtgatcatcgacaccacgcaatagacgcagtagtaattgcactaacaaatcgttctttatttcataaactaagtagattatcggcacaatcaataagtcttgacaaatcacgattcgacgtaccaccgccatgggacggattctatgatgacgtttacgagaaaatagacaaagttatcgtatcacacgcccctgcacgtaaaattggaggagcgttacacgaagatacagcttatggacattttaaagaagaagtagcagatccaaaaacaggaaaagtcagcatagaagatagattcgtttaccgaaagccactagcaacacttacggccaatgaagtaggaaaaataagagacgctaaagtaagagaatttgtagaagccagattggctcagttcggaaataattccaaaaccgcattcggcgatcccaataatcccctattacatgctgacggaaaaacacctataagaaccgtaagacttgttactaatttcaataaagcaaccactcatgcaattcaaaagggacaaggccgagactacaagttctttaagtacggtaataatcatcacgtagagataatagagcacgtagaaaccgggaaaagaaaaggcatatttgtaactgcaatggaagcagcaagaagagtacgaggcgtagccaacacggagaaaagtgatatagtacaaagaaaccatggtgaagaatggagattcgttatgtcactaagcatcaatgatctagtaagtatacaagaagccgatcaagtacgaattatgagggtccaactcttcgatgcaagcaatggtaacataatattccgggaccagaaaagtgcaatgctagacgacaaattatcacgttatcaaacaaaagcgcaccttctagtatgccagaaaattacaacagatccactaggaaatctagctccttgtaatgattga

SEQ ID NO: 8376 - RNA, 2988 nt, synthetic construct
  misc_feature 1..2988: note = Cas9 variant
  source 1..2988: mol_type = other RNA
atgagtaaagtcctaggattggacataggggctaattcaataggatgggctctgatagatgacgaagaaaatgatatcattggggctggtgtaagggtctttaaagaaggagtaaatttaaaaggagttaaagaagaatccaaaaacgtggaaaggagagcagccagactagctagaagacaacataaaagaagaagtcaaagaagaaaccgattagtagccctattaaaaacgttagaaatgttcccagaaaataatgaagatataagtgattattatgcacaagacccctacgaattacgaaagaaaggcctttacgaaaaactaaccatgtatgagttcggaagagtgctattgcatatatgccgacgtagaggatttaaaagctccagaaaaacagatatttcagaagaaggaaaaatattcgaaggcaaagatggtatagtgggtataaatcaaacgagagactctatcagagaaggaggattcaaaacaataggagaatatttagccagcttagatccccatgttattagacgaagaaaccgcttcactctacgagatatgtatgaagaagagttcaatttaatgtgggaaaaacaacaatcattctacccactacaattaagcaatgagttcaaagaagcaatagcagaagtaatattatcacaaaggaaattgaaatctcaaaaagctctagtaggaaattgcggcctagaacctaataagaaaacagcaccaaaaagttctcctgcatttcaatacttcaggatactagaacaactctccagaatactaataagcattcctcatacaggaagatataatgatccactcaatgaagaagaaagaagaatgctaattgacaaactatcggtaacagaaaaactaaaattctcagacatgagaaagatgttgaatctacccggagaaagtgacatcaatatcgaagaagaaggagggcgattgctaggcaatacaacatatgctcgacttataaaagtctttggcaagaaacgatgggctggcttctcagaagaagaaaaagaacaaatatggcatacatttcacttcgcagataatcatgaatggttaaaagaatatgcattaaagaaatggagtataacccctgacgaaataaaagaacttggaaaagttgccctcgaaaaagaatacgcaagattcagtaagaaatcactaaagaaaattattccacaattagaggaaggactcacattagacaaagctaaaattgaggcaggatatacgcctgaatatgagatagagaaaagtttaagcgcctatttaccattaccagaaaatatcagaaacccgatagtacaacaagcattatacgaattaagacatgtggtaaatgctgttataagaacatacggaaaaccagacatagctagagttgaattagccagagaaatgaagaaaccaaaacaaaaacgagagaaaatgagaagcgaactaagaaaaagacaaatgaaattcgaagaaataaaatcaatcttaaaagaacgattaggcttcatagacccaaaaagagatgaaatccataaatacatgttatgggaagaatgcagggaaacatgcccctacacaggcagaaaaatttcattaagtgcattatacggtggagatttcgaagtggaacatataatcccatataaaaggagcttggacgacagtctattcaataaaaccgtatgcttgagagaagaaaatcaaataaaaggtgacagaacaccatatgaagcatatagcggtgaccgacaaaaatatgaagaaataatattaagagttcagaaaacaagcatgccgagaggaaagaaaaacttgtttgcaataaaagagcttaaagatgattttgcacacagacaacttagtgacactgcatatattagtagagagacacgaaaatatttaggaagtacaataaagaaagtacaagccgtaaaaggtggaagcacagcaaaacttcgatactattggggactaaacagcatattaggagttagagacataaaaatgcgagacgatcacagacaccacgcagtagatgcacttgtaattgcaaacacaacatatgcattcgtaaatacgttatcaagatatcactcaatggacgtagagccccatgaaagtagattcccgctcccatgggagcaatttcggaatgatgcagaatcagtagtacgaaatatattcgtttcacatagacttggaaagaaagctacagggcaattacatgaagaaacatattatggaaaaatcagaaataccgatggagaaccatattttgtagtaagaaagaaacttggcactctgactgcaaaacaaatagctaatatagtagacccagtagttaaaacccaagttttcgaaagattggaagagaaaggaatcgacatagaatcaagtaacaaaattccagctgatgcattcgttgaaacattatacatgccagacagaaaaaccccaataaaaagtgttagagtaaaagtaccaagtacaacaatgatacaactatataaagataaagaactatatgttgatccaggttcaaatcaccatatagtaatatttgagaacgaagagggcaaaagagatggcatagtcgtaagcctctttgaagcagcacaaaggttaagaagaaatgaaccggtcatacagaaaacctggaaaccagaatggcacttcgtaatgagtttgagtatagacgaactaatcctactagatgtagacgagaaaaatatagattggggtgacacaggccttgcgttaagatacagtaaagcattgtaccgtgtacagaaaatggacgtaaataaaataattacgttgagacatcatttagtagcaagattaaaagatgacgaaggcaaagagttcggtcgagaacacaggataccaagtactctaagaggattaaaagtcaaaatagaccatataggtagattacgacgagcatacgattga

SEQ ID NO: 8377 - RNA, 2988 nt, synthetic construct
  misc_feature 1..2988: note = Cas9 variant
  source 1..2988: mol_type = other RNA
atgaaagttatcggcttcgacatcggaataaacagcataggatgggcatttgtcgaaaatgacgaactcaaagactgcggagttcgaatattcacaaaagctgaaaatccaaaaaacaaagagtctctagcattaccaagaagaaacgcacggagctcccgcaaaagattaaaaagaagaaaattacgactaatcgccatgaaacacatcttagctaaagaactaaatcttaactacaaggactacatcgccaatgatggagaattaccaaaagcttacgaaggcaaattaataagcccatacgaacttcgatacaaagccctaaaccaaaaattagaagcaaaagaccttgtacgggttatactacacatagccaaacatcgcggttacatgaacaaaaacgacaaaaaatccaacgacgcagaaaaaggaaaaatacttagcgcactaaaaaacaacgcattaaaactagaaaagtaccaatcagtaggagaatacttctataaagaatttttccaaaaatacaaagaaaacacaaaagatttcataaaaattagaaatataaaagataattataataactgcgttctcgcttcagatctagaaaaagaattaaaactcatactagaaaaacaaaaagagttcggatactcatactcaaatgacttcattgaagaagtgatacaagtggcattcttccaaagacccctaaaagacttctcacacctagtgggcacatgtaccttcttcgaagaagaaaaaagagcttgcaaaaattcctacagtgcatgggaatttgtcgccctaacaaaaatagtaaacgaactaaaatctctagaaaaaataagtggcgaattaatttccacccaaacaataaacgaaatattaaactacattctagataaaggaagcataacctataaaaaattcagatcatacatcaacctgtatgaatctataaaattcaaaagtctcaaatacgacaaggataacgccgaatcagcaaagctcatcgacttcagaaaattagtcgagtttaaaaaagcattaggagaacattatttcaaccgtcaagaattagaccaaatcagtacatacattaccctgataaaagacaatgtcaaactaaaaacagctctagaaaaatacaacttgtccaatgaacagataaacaatttactggaaatagagtttaacgatcatataaacctcagctttaaagcgctgagtatgattctaccactaatgaaagaaggaaaaaaatacgatgaagcctgtgaaatagcaaaccttaaaccaaagaccacaaaccaaaaacaagactttctaccagcattctgtaacagcatctttgtgcacgaactctcaaaccccatagttaaccgagcaataagcgaataccgaaaagtcctaaacgcattactaaaaaaatatggcaaagttcacaaaattcacttagaattagcccgagacattggactttcaaaaaaagcccgagaaaaaatagaaaaagaacaaaaagaaaatcaagcaataaatacgtgggccctaaacgaatgtgaaaacatgggcataaaagctaatgcaaaaaacatacttaaattaaagctttggaaagagcaaaaagaaatatgtatatactcaggaaaaaaaatatccatcgaacatctaaaagacgaaaaagccctagaagtagaccatatatacccatatagcagaagcttcgacgactcatatatgaacaaagtgttagttttcaccaaagaaaaccaagaaaaactaaataaaactccattcgaagcattcggcaaaaacatcgaaaaatggaacaaaatacaaacccttgctcagattctcccatacaaaaaaaaaaataaaattttagacgagaatttcaaagacaaccaacaacaagacttcatctcaagaaacttaaatgatacaagatacatagccactctaatagcaaaatatacaaaagaatacctaaattttctgcccctcaacgaaaacgaaaacatcaacctaaaatcgggagaaaaaggaagcaaaattcatattcaaaccgttaacggaatgctaacaagcgttctaagacacacatggggtttcgacaaaaaagacagaaataaccacttacaccatgcattagatgcaataatagtggcatactctaccaatagtcttattaaagcattcagcgacttcaaaaaaaaccaagaactactcaaagcaaaattatatgccaaagaattaacaaacgacaactatatccatcaagcaaaattttttgaaccatttgaaggatttagagaaaaaatacttaacaaaatcgacgaaatctttgtaagcaaaccaccaagaaaacgagcaagaggcgcactacataaagaaaccttctattccgaaaaaaaaatgataaaaaagtacaactcaaaagaaggactcaacatagccctagattgtggcaaaatcagaaaaatcgggacaaaatacgtggaaaatgacactatggtgcgggtcgacatctttaaaaaacagaataaattctacgccataccaatatatacaatggactttgcgttaggcattctccccaacaaaatagtagtaataggcaaagataaaaacaacaaccccaaacaatggcaagaaatcgatgagtcatacgaattctgcttctcactatacaaaaacgacttaatactgctacaaaaaaaagacatgcaagaagcagaattcgcttattataacggattcgacatcgacagttcgcgaatcaatataaaaaaacacgataacaaattcgaaaacctaacctcaaaccaaaaactcttattcactaacaaagaaaaaaacagaacagggatccaaaatcttaaaatatttgaaaaatacattgtaacacctcttggaaataaaatcaaagcagatttccaacctagacaaaatataagccttaaaagcagcaagaaaaatggattatga

SEQ ID NO: 8378 - RNA, 2988 nt, synthetic construct
  misc_feature 1..2988: note = Cas9 variant
  source 1..2988: mol_type = other RNA
atgaaaattctcggatttgacataggtattaattcaatcggctgggctttcgttgaaaatgacgaactaaaagattgtggcgtaagaatattcacaaaagctgaaaacccaaaaaacaaagaaagcttagccctaccacgaagaaacgctcgctcaaaccgaagaagactcaaaaggcgcaaatctagactcatagccatcaaacacatactcgctaaagaactgaacctaaactacaaagactacatcgcgaacgacggggaactcccaaaagcatacgaaggaaaactaacgaacgtatacgaactacgatataaagcactaaaccaaaaactagaagcaaaagacctagcacgagtaatactccatatagcaaaacatagaggctatatgaacaaaaatgaaaaaaaatcaaacgattccgaaaaaggaaaaatattatccgccttaaaaaataacgcactcaagttagaaaaataccaatcagtaggtgaatatttttataaagaattcttccaaaaatataaagaaaacactaaaaatttcataaaaatccgaaacacaaaagataattacaataattgcgttttggcttcagacctcgaaaaagaactaaaactaattctcgaaaaacaaaaagaatttggatactcatataacgacgacttcataaaggaaattatcaacatagcatttttccaacgtccactgaaagatttttcccacctagttggaagctgtactttcttcgaagaagaaaaacgcgcctgcaaaaactcttacagcgcatgggaatttgttgcgttatcaaaaatcataaacgaactcaaacgattagaaaaaataagcggagaacttatctccgcacaaacgattaacgaaatccttaaccatatactagacaaaggaaacataacatacaaaaaattcagatcctgtataaatctacacgaaagcatagaattcaaatctttaaattatgataaagacaacgcagaatcagccaaactagttgattttaaaaagctaatagaattcaaaaaggcactaggcgaacactcctttaacagacaagagcttgacgaaatagcaactcacatcactctgatcaaagacaatgataaattaaaaacagccctcgaaaaatataacctaaacaatgaacaaattaatgcactccttgagattgaatttaacgaccatataaacttatctttcaaagcactaaatcttattcttcccctgatgagagaaggcaaacgatacgatgaagcttgcgaaatagtcaacttaaaatcaaaaacctcaaatcaaaaacaagacctattacccgcattctgcgactcaatcttctctcaagaactatcaaacccagtggtcaacagagctatatccgaatatagaaaagtattaaacgcccttctcaaaaaatacggaaaagttcataaaatccaccttgaattagcacgcgacgtcggactatcaaaaaaagccagggagaaaattgagaaagaacaaaaagaaaataaagaaattaatgactgggcattagacgaatgcgagaaattcggactcaaagccaacaataaaaatatcctaaaactaaaactatggaaagaacaaaaggaaatttgcgcttattccggaaaaaaaatatcaatcgaacatctgaaggacgaaaaagcccttgaagtcgatcacatatatccctattctagatcattcgacgacagctatatgaacaaagtactggtattcaccaaggaaaatcaagaaaaattaaacaaaactcctttcgaagccttcggaaaaaacatagaaagatggaacaaaatacaagcacttgcacagaacttgccatacaaaaaaaaaaacaaaatacttgatgaaaacttcaaagataaacaacaacaggactttatctcccgcaacctaaacgacacccgatacatagcaacactcatcgcaaaatatacaaaagaatacctcaatttcctccccctaaacgaaaacgaaaatacaaacctaaaaagcggagaaaaaggttcaaaaattcacgtacaaacaataaatggaatgttaacatcagtactacgacacacctggggatttgacaaaaaagacagaaataaccacctacaccatgcactagatgcaatcatagtagcctacagcacaaattctatcatcaaagcattttcggatttcaaaaaaaaccaagaactcttaaaagccaaattatacgctaaagaactcacctccgataattacaagcatcaagccaaattcttcgaaccattcgaaggattccgtgaaaaaattttaaataaaatagatgaaatattcgtctctaaaccaccacgtaaaagagccagaggcacactacacaaagagaccttctaccccgaagaaacaatgatcaaaaaatacaattcaaaagaaggattaaacatcgcactaaactgtggaaaaatcagaaaaataggcactaaatacgtagaaaacgacacgatggtaagattagacatcttcaaaaaacaaaataaattttacgcaattccaatttatacaatggacttcgcactaggcatcttaccaaacaagatagtaatagctggaaaagacaaaaacaataaccctaaacaatggcaagaaatagacgaaagctacgaattctgcttctcactttataaaaatgacctaatattactacaaaagaaagatatgcaagaagccgagttcgcatactacaatagctttgacatagactcatccagaatcaacataaaaaaacacgataacaaatttgaaaatttaaccgataaccagaaactactatttaccaaccaagaaaaaaacagaacaggaattcaaaacctaaaaatatttgagaaatatatagtaaccccactaggagacaaaatcaaagcagactttcaaccacgacaaaacatttcactaaaaacaagtaaaaaatatgggctatga

SEQ ID NO: 8379 - RNA, 2991 nt, synthetic construct
  misc_feature 1..2991: note = Cas9 variant
  source 1..2991: mol_type = other RNA
atgatgggtaatttcacactaggacttgacctcggaacaaattcaatagggtgggcccttatagactttgatgacaatcagcaaccgcaaaatttaatagcatgtggtagtcgtatatttcaagaagcagttgaagcaaaaacaggaactccgaaaaaccatgctcgtagggcagcaagagcagcaagaaagctagtagcaagaagaaaacaaagacgcaccaaactactaaatctattagtctgtcacgatctactaccacaagacgaagctgaaagaaacgcattactactagacaaccaagcaaataacccatatcaacttagaaaacgagggttagatgaaaaactagaaccattcgcttttggcagagcattataccatctagctcataggcgtggattccaatcaaatagaaaagcagcttcagatgaagacggaaaagtcaaaactgctatttcggcactccgtgcagaaatgcaaggtcacacactcggagcattcttggctgatcaacctacccaaaggcgaagatacaccgatagagcaatgtacgcagaagaatttgaacaattatggtccaaacaaacaatattcgctcctgaacagttaacacaagctcttaaagttgaaattaaaaactcaatatttttccagcgacccctaaaatcacaaaaacacttggtaggcaaatgcacattcgaaccaacacgaaaaagagcagccaaagcaattctcttagctcaacattttcgtatactgcaagatgtcaaccacctcgcagtcaaaaaccctatcacaagagaatttagaccattaacccaagacgaaagaaacaaactagctgaagcgctagacaaacagaaaggaatgaactggtcagcagtaagaaaagtaatcggctggaacaagaaagactccctacacgagggagaaacatttaatttagaagaaggaaagaaagataaacttataggaaatagaacagcatgtgacctaagaggagctttaggagacaggtgggacgcatttacagcacctcagcaagatgatctggttacagatttactaaccatagacaaccctgacggattcctaaaaagaatgaaaacccattggggtttcgatgacgccacagctgaagcactagcaacaacggaactcgaacctggctatgcaagactatcaagtaaagctatgagagcaatacttccacatttagaacagggtatgatctattctgatgcatgcaaagcagcaggatacgaccacagtaatccaaaccaacgaacaataacagacaaacttggtttaccatctaatgtacgaaatccagtggtccaaaaagcattatttgaaacacgaaaagtagtaaacgcaatagtaagaaaatacggcaaacctgccgtcattagagtagaaatggctagagacatgaaattatcaaaaagacaaaaagaggaattacagaaagaacaaaataaacaaaagaaagcaaatgaattagcagaaggcatacttcgaaaagagttcggtatccaacaaccagcacgaacagatatccaaaaatataatctttggttagaatgcaaagaagtctgtccatacacaggaacagtaataagtagagaaatgttatattctccagaagtcgatgtcgaacatattcttccatactcaaggtcattagatgactcatatatgaacaaaacgctctgcatggccacctacaacagacaaacaaaactaaataacacaccatacgaaataggacagggagacccagtggcttacgcagaaatatttcaaagaataaaaacactgccattccccaaaagacgtagatttgaacaaaaagaaatagaaaccgacaagtttattgaaagacaactcaatgatacaagatacatctgtgtagaagttagagattttctccaacaacttggcgctccagttgaagtttcaaaaggggaagcaacagcaaagttaagaggcagatggaaactaaatacacttttgagtccaggaggagggaatgagaaaaaccgagcagaccatagacaccatgcaatcgatgccgttgtcatagcactaaccaatcgatcattgtttcataaactatcaagactaagcgctcaaagcatttcattcgacaaatcaagatttgacgtaccaccgccctgggacgatttctatgatgatgtatatgagaaaatagacaaagttatagtctcacatgcaccaacaagaaaaatctcaggagccttacacgaagctactgcatacggccatttcaaagaagaaatcgctgaccccaagaccggaaaattctcaatagaagacagatttgtttacagaaaaccattaacaaccctaacggcaaacgaagtcggaaaaataagggacgctaaagtaagagaacttgtcgaggccagactcgcacaattcggtaataactcaaaagcagcattcggagacccaaatgaaccactacttcacgctgacggcaaaactccaatacgaacaatacggctaacaaccaattttaataaaacaaccacacacgctatacaaaaaggtcaggatcgagactacaaattctttaaatatggaaataatcatcatgtagaaataattgagcatgtagaaacaggaaagagaaaaggaattttcgtcactgctatggaagcagctcgcagagcaagaggagtcgcgaacacagagaaaagtaacatcgtacaaagaaatcatggtgatggatggaaattcgtcatgtctctagcagttaatgacatggttagaacagaagacacacaagcaatatatcgagtccaaaaattagatggcagtaataacagatttactttaagaagtcataatgcagcaacactggacgataaacaaacaggagtggacaaaacaccaaacctcttcaaaggtaccaaaatcattgtcgacccactaggaaatctaacacaatgtaacgattga

SEQ ID NO: 8380 - RNA, 2994 nt, synthetic construct
  misc_feature 1..2994: note = Cas9 variant
  source 1..2994: mol_type = other RNA
atgaaagttctagtagatgcaggattgatgccatcggatccagcagcagccaaagcccttgagacactagatccatatgagctcagagccacaggactcgatgtaatgttacctcttacacaccttggtagagcagtatttcatctaaaccaacggagagggtttaaaagtaatagaaaaacagatcgaggagataacgaatcaggtaaaataaaagacgcaactaaaagactaacatgggcaatgcaagaagcaggggctcgcacatatggcgagttcttacacatgagacgagccagagcgtctgacccaagacaagtaccgagtgtacgaacacggctatcggtggcctcacgaggaggcccagatagtaaagaagaagcaggttatgatttctatccggaaagagcacatttagaagacgaatttcatgccctttggtcagcccaagcagcctttcacccagatttaacttgtgaactaagagatgttgtgtttgaaaagatattctaccagagaccattgaaagaaccaaaagtaggattatgtttatttacagcagaagaaagacttccaaaagcacatccgcttacgggaagaagagtattatacgaaacagttaaccaattgagagtgaccgcagacggacgaactacaagaccgttaactctggaagaacgcgatatgattgtctatgctttagataataagaaaccagtaaagagcttatcatcaatgcacttaaaactcgtggcattaggtaagctagtaaaattaaaagatggagaaaggttcacacttgaaagcggagtccgtgacgcaatagcctgtgatcctatacgtgctacaatgggacatcctgacggatttggacccgcatggtcacgattagattggcaagcacaatgggctttaatagaaaaactccggcaggtacaatcggacgacgacttcgcaagtctagtagcatggttaggagcaacacacaacttatcagaagatcatgcgaaacgagtcgcaaatttacacctaccagagggatatggtcgcttaggtctaactgcaacagaagctatattatgtaacttaaaagcggaagtctgtacctacagccaagcagtagaacgctggggaaaacaccattcaaaccaaagaacaggtgaatgcttagaagctctaccttattatggagaagtactcgaccgacatgtaataccaggaacatataacgaagatgatgacgacgtaactagatatggaagaataactaatcctacagttcatataggattaaatcagcttcgtcgcttagttaatagaataatcgccacttatggtaaaccagatcaaatagtagtagaactagctagggaacttaaacaatcagaagctcaaaaatcagaagcattaaagaaaataagagatacaacagcagacgcaataagaagaggaagacaactcgaagaaataggtcagaaaaataccggcgcaaatagacttttattaaggttatgggaagatttaggaccagcagtaggtccacgctgctgtccatataccggaaaaccaatatcggtaactatgttattcgatggtgcctgcgatgtagaccacatactaccttattcacgcacattagatgactctttcgccaacaggacaatatgtttaagagaagcaaacagacaaaaaggagacagaacaccctgggaagcctggggcggatcagaccaatgggatgcaatagaagcaaatttaaaagacttgccagagaacaaaagaaaacgatttgcaccagatgctatggaacgatttgaaggagagagagactttttagatagagcattagttgacacacaatatctagcacgcataagtagagcttatctagacacactatttacagaaggtggacatgtatgggttgtacccgggagaatgacagaaatgttaagaagacactggggattaaacgctctcctaagtgataaagatagaggggcaggcaaagttaaaaatcgcacagaccatcgacaccacgctatagacgcagcagtaatagccgcaacagaccacagtctagtaaacagaatatccaaagcagctggccaaggcgaatcagccggacaatcagcagaattaattgctcgagatactcctgaaccttgggaaggtttccgtaacgatatttcagcacaaatagctagaattgtagttagccatagagcagaccatgggagaatagatgttgaaggaagaaaacatggcaaagatagcaccgcaggaagattacataatgatacagcgtacggaatagtagacgaccacactgtagtgtcaagaacacctcttttaagccttaaaccaggagacatagaagtaactacaaaaggtaaaaatataagagacactcaattacaaaaagctctatcagtagctacaacaggaaaagatggaaaaggattcgaagaagcacttcgtaactttgctgaaaaagaagggccgtaccaaggaattagaagagtaaggttaatagaaacactacaatcatcagctagagtagaagtaggtagtgatgaagacggccagccattaaaagcatacaaaggggacagtaatcactgctatgatctatggaaattaccggatggaaaggtcgttccacatgtagtatccacttacgaagcgcacgcgggtaccgacaagagacctcatccagcagcaaaaagaatactaagagtttttaagaaagacatggtcgctattgaacaagatgaccaaactgcaatattttacgtacaaaaattagacagagcaaatggtctctttttagcaccccacctcgaagcaaacgcagacgcaagacacagaaatccaaatgatgcatttaaattcctacaaatgggtgctggttccgtagtaagaaataaattaagacgagtgtatgtcgatgaaattggcaggattaaagacccaggtccaccgaaacactga

SEQ ID NO: 8381 - RNA, 2994 nt, synthetic construct
  misc_feature 1..2994: note = Cas9 variant
  source 1..2994: mol_type = other RNA
atgaaaattctaggattcgacataggtattaactcaataggttgggcattcgtagaaaatgatgaactaaaagattgtggagtcagaatatttacagaagcagaaaacccgtccaacaaagaatctctcgcacttccccgaaggaacgccaggtcatcaagaagaagattaaaaagaagaaaagcccggctagtagcaataaaacgcatacttgcaaaagaactaaaactcaatttcaaagactatgtagccgcagatggagaactacctaaagcatacgaagggaaactaacgagtatctatgaactaagatataaagcccttatacaacaactagaaactaaagatctcgcacgagtaatcttacatatcgcaaaacataggggatacatgaacaaaaacgaaaagaaatcaaacgacactaagaaaggaaaaattctaagtgcactcaaaaacaacgcactaaaactagaaaactatcaatccgtaggcgaatacttctataaagagttcttccaaaaatataaagaaaataccaaaaacttcatcaaaatacgcaataccaaagacaactacaacaattgcgtattgtcatccgatttagaaaaagaactgaaattaatactggaaaaacaaaaagaatttggatacaactattcagaagacttcataaacgaaatactaaaagtagcattcttccaaagaccactaaaagatttttcacacctagttggagcctgcacattcttcgaagaagaaaaacgagcatgtaaaaacagttactcagcatgggaatttgtagctctcaccaaaattataaacgaaataaaatcacttgagaaaatatccggagaaatcgtaccaacccagacaataaacgaaatactcaacttaatcctcgataaaggaagcattacatataagaaattcagatcatgtatcaatcttcatgaaagcatttcttttaaatcgctaaaatacgacaaagaaaacgccgaaaacgcaaaactaatcgacttcagaaaacttgtcgagttcaagaaagcactaggagtccatagcttatccagacaagaactagaccaaatttcaacacacattaccctcataaaagataacgtaaaacttaaaaccgtcctagaaaaatacaacttatcaaacgaacaaatcaataatctactagaaatcgagttcaacgactacataaacttgtcgttcaaagccttaggaatgattctaccactaatgagagaaggaaaacgctattacgaagcatgcgaaatcactaacctaaaaccaaaaaccgtagacgaaaaagaagactttctcccagcattttgtgattcaatattcgcacatgaattaagtaatccagtcgttaacagagccatctccgaatacagaaaagtattaaatgctctacttaagaaatacggaaaagtccacaaaatacatctagaactagcgagagatgtaggcctatccaagaaagctagagagaaaatagaagatcaacagaaaaataacaaagcgatcaacgactgggctctaaaagaatgcgaaaacataggaataaaagcaagtgcgaaaaacatactaaaactcaaactatggaaagaacaaaaagaaatatgcatttatagcggcaacaaaatcagcatagaacatctaaaggatgaaaaagcactagaagtagatcacatatatccctacagccgttctttcgacgactcattcataaacaaagtcctagtatttactaaagaaaaccaagaaaaactaaacaaaaccccctttgaagcattcggtaaaaatattgaaaaatggagtaaaatccaaacactagcacaaaatcttccatacaaaaagaaaaacaaaatcctagacgaaaacttcaaagacaaacaacaacaagacttcatttcccgaaatctaaatgatacacgatatataaccacattaatcgcaaaatatacaaaggaataccttaatttcctaccactctcagaaaacgaaaacaccaatttaaaatctggagaaaaaggaagcaaaatacacattcaaactatctcgggaatgctaacatcagtcctccgtcatacgtggggattcgacaagaaagatcgtaacaatcatcttcatcatgcattagatgcaataatcgtagcatactcaacttcaagcatcataaaagcattcagtgatttcaagaaaaaccaagaattattaaaagcaagattttacgcaaaagaacttacaagtgataactataaacatcaagtaaaatttttcgaaccattcaaaggtttccgcgagaaaatactttccaaaatcgatgaaatattcgtctcaacacccccacgaaaacgcgcaagaggggcgctacacgaagaaacgttttatagtgaagacaaaatgataaagaaatacaattctaaagaaggtttacaaatagcattatcctgcggaagagtaagaaaaataggcaccaaatacgtcgaaaacgatacaatggttagagtcgacatcttcaagaaacaaaacaaattttacgccataccaatttacgtaatggacttcgcgctaggaatattaccaaacaaaatagttataaccggaaaagacaaaaataataaccccaaacaatggcaaacaatagacgaatcatacgaattttgtttttccctttacaaaaacgacttaatactactacaaaagaaaaatatgcaagaaccagagttcgcttactacaacagtttcgacatagatagatcacgaataaaaataaagaaacacgacaataaattcgaaaatttaacatcaaaccaaaaattactattcacaaataaagacaaaggtaaaaaccgaacaggaatacagaatctaaaaatatttgaaaaatatatagtcactcctctaggagataaaataaaagcggactttcagccacgagaaaacatttcattaaaaacatccaagaaacacggcttatga

SEQ ID NO: 8382 - RNA, 2994 nt, synthetic construct
  misc_feature 1..2994: note = Cas9 variant
  source 1..2994: mol_type = other RNA
atgggaaattatacactaggacttgatataggaagtaattcaataggctgggcattagtagaagacgcagtggaagcaccaagaatagtcgacatgggcgttcgcgtatttcccgaaggagtagatagggacacaaagggactagagaaaagtaaaaatgcaacgagaagggaagcaagaggagccaggagaacacatcaaagaagaagacagagaaaacaacgattagtccgagcccttagacaagtaggattgctcccgtgtgataaagccgaagtacgaagtttattccaaacagatccctatgaaataagaaaaagaggactagaccatagactggaactatacgaaataggacgagcgttctaccatctaagccaaaggagaggcttcaaaagcaatagaaaaagcggagctttgaaggaagatggaacagtcaagaaagaagcaggagaactacaacggaaaatagacgaagcaggttgccgtacaatcggagaatattttgcaggattagatcccgaacaacaacgtataagaggaagatatactttcagatcgatgtatcaaaaagaatttgacttattatgggctaaacaagtagaattttatccaaaagtcttaactgaagacctaaggagtaaagtacgagatgaaattattttctttcaaagaccattgaaatctgcaaaggacttaatcggagattgcgaattagaaccaacagaaaagagatgcccacgagccgactggtatgcaagaagatttaggttattacaagacataaataatttaattatacaaaaccccgacggtacggaacaaaaactttcgccagaccaaagagcagccttactaggagaacttggacaaagagaaaaattaacatttgataatatcagagctaaattaggtctactagaaactcaaaaattcaatgcggaatatcgaataggccgtaaaggaaagaaagtggaagctataaaaggagatgtcttcgtttggacaatgagaggaaaaagtgtgtttggacctaaggcatgggatgcaatggcagatgaaagaaaagtttcattaaacgaattatttgtagaactggaagatgatgatttagctaggaaattagaaacggaatatggattgacagataaacaagttcaagcagcaatgaaagcaagtcttccacaaggatatatgagttttagtagaaaagcagtccttaagctgttaccatttatggaagcaggagcactaacgcatgaagcgatagatcaagccggatatagaaaagaggaacctactcaaacagacgctatagcaagggttagctttccaccggatttaagaaatccaatagtacaaaaagcattatttgaagtacgaaaagtggtaaatgcgctagtccgagaatatggaaaaccaactagaataaaaatagaaatggcaagagacgtacaaggaagtaaaagacaaagagaagaattacactggagaaatgaggataataggaagaaaaatgaagaggtaagggatagactaaggactgatattcacatagatgatccatcaagagacgacgttattaaatataaactttggcaagaatctggaaaaatgtgtccatatacaggaagacaaatatgtcaagaggcgttatttggtccaaatccggaatttcaagtggaacatatacttccctatgatagaagtttagatgattcatatatgaatcttactttatgtgaggttcatgaaaatattcatggaaaacgcaaccaaacaccatttgaagcatacggatccggagcggagagatatgaacagatcaaacaaagaataaaagtcttaccatggcccaaacgccaaaagttccttcaacaagaaataaatctagattctcacataagcagagagctaaatgacactagatacatatgtagagaaacagttgcgtatttaaaacaattgggggtacacgtaagaggaacaagaggaaaaataaccgcagaactaaggcaccagtggggactagatggtatatttagtgagcttggggtaagaagagatgatgatcacagacgacacgcggtggatgcattggtcgtagcagtaacggacaatgaacacctaaggaggcttgccgtatcaaagtatgtattagctggtccaaggtttgaaacaccgtggtctgcatttagagatgaagcgcgaggtaatgtaaaacgtatgaatgtgtcacacagagtatgtcgtaaagtaagcggtgcactacatgaagaaacgaattacggaccaaccggagtaagggaccaagcagggcaagatatttatgcctaccgaaagaaattagaagatctaacgacgccaatggttgagaaaattgtagatccagtcgttagagatattgtaagacaaaggcttttaatgaaaggaatcgatcctgcagcagcagatagaaaaatcccaaaagatgtttggaaggaaccactatatatgaggagaactaaaagtgataaaatgatacaaatacggagagtacgaatacacgatgtcaaaaactcaattatagttttgacagatgaatcaggaagaccatacagagctgttgaaccaggcggaaaccaccatgttgaagtattcgaatacgttcatggaacaaaaacaggcacgagagaggcagaagtagtcactatgtttgaagcggtaagaagatcacgtgcaagagcgccagtagttagaagggaccatggaccaggaacgcgatttgtctgcagcttagcaataaatgacatggtaatgatgccggataaaagcggaaagatggacttatttaggattcaaaagatgagtgctagtaaacaggtctattttagacaccatacagctgccagaatcgacagcgaaagaactctaattagaaaacaagcacatttattcaatggatataaagtctccgtagacccaacaggagcaatatgtagggcaaatgattga

SEQ ID NO: 8383 - RNA, 3000 nt, synthetic construct
  misc_feature 1..3000: note = Cas9 variant
  source 1..3000: mol_type = other RNA
atgaaaatcctaggcttcgacatcggaataaacagtataggatgggcatttgtagaagacaatcaactacaagactgcggggttagactatttaccaaagcagaagatccaaaaacaaaagaaagtctagcactaccaagaagaaatgctcgctccaatagacgacgattaggaagaagaagatctcgcttgatagcactgaaacacatcattagcaaaggactcaaactcaattatcaagattatatagccaatgatggagaattaccaaaagcctacgaaggcagattaataagcccatatgaactacgatataaagcacttaatgaaaaaattgaacctaaagacctagcacgagtaatcctacacatagccaaacacagaggctacatgaataaaaatgaaaagaagagctcagacaacgagaaaggcaagatcctctcggcactaaaaacaaacgctctgaagctagaaaaatatcaaagcgtaggagaatatttctacaaagaattctttcaaaagtacagagaaaacacaaaagacttcataaacataagaaataaagaaggaagttatgaaaactgtgttctggcaagtgatctcgaaaaagaattaaaactcatcttggaaaaacaaaaagaatggggctattcatataatgacaactttataaaagaaatactaaaagttgcattcttccaaagaccactaaaagacttctcatacctagtaggagcctgcacgttctttgaggacgaaaaacgtgcatgcaaaaactcctactctgcatgggaatttgtagcattaacaaaaataataaacgaattaaaatcattagaaaaagaaagcggggaattagtatcatcccagataataaatgaaatcttaaaccacatactcgacaaaggatctattacttacaaaaaatttagagaatatattaaactacatgaatcaatgaagtttaaatcattaaaatacgataaagacaacgtcgaatccacaaaactaatcgaatttcgaaaattagttgaattcaaaaaagccctaggtgaacatagcctatctcgcgaagaacttgaccaaattgcaacatacataacgctaataaaagataacgaaaaactcaagataacactagaaaagtactctttgaataacgagcaaataaaaaacctactggaaatcgatttcaacgatcatataaacctatccttcaaagcactcaatcttattctaccactaatgaaagaagggaagagatacgacgaagcctgcaaactcttaaacttaaaaacaaaatcaaacaaccaaaaatttgacttcctacctgcattctgtgatagtatcttcgcacaagaattaaccaatcctatagtcaacagagcaataagcgaatacagaaaagtactaaatgcattactcaaaaaatacggtaaaatgcacaaaatacacatagaactagcaagagacatcggattatcaaaaaaactcagagccaaaatagaaaaagaacaaaaagagaactacgaaaataacatatgggcacttaatgaatgcgaaaaattcggtctaaaagcaaatgctaaaaacattctaaaattaaaactatggaaagaacaaaaggaattttgcatctactcaggaaaaaaaatatcgatcgaacatttaagagacgaaaaagctttagaagtagaccacatatatccctattcacgatcattcgacgactcatttttaaacaaagtactagtattcacaaaagaaaaccaagaaaaattaaacaagacaccattcgaggcattcggcgccaatgaagaaagatggagcaaaatacaggccctggcccaaaacttgccttacaaaaagaaaaacaaaatactagacgaggccttcaaaggaaaacaacaacaagacttcatatcaagaaatctaaatgacacaagatacatcagcacactaatcgttaaatatacaaaagaatacctagactttctacctctcgacgagaaagaagacgtaaacttaaaatctggtgaaaaaggaagcaaaatacatgtacaaacaataaacggaatgctgacaagcgtattacgacacacatggggcttcgcacaaaaagaccgaaataatcacctacaccacgctctggatgctacaatagtggcatatagcacaaacgctataataaaagcattttctgatttcaaaaaagaacaagaactacttaaagcaaaactgtacgcaaaagaactcacatccgacagttacaaacaccaagccaaattttttgaaccattcgaaggatttagagaacaaattctcaatcaaataaataagttattcgttagtaaaccaccaagaaaaagagcacggggagcactccacaaagaaacattctactcaaaagatgaaatgattaaaaaatacaattcacaagaaggagtagaaattgccttaaactgcggcaaaatacgaaaaataggaacaaagtacgtcgaaaatgatacaatggtcagaatagacatatttaaaaaacaaaacaaattttacgcaataccgatttatacaatggacttcgccttaggagtacttccaaacaaaatagtaataataggaaaagataaaaaaggaaatccaaaacagtggcaagaaatagacgaatcatacgaattctgtttttcactacacaaggatgacttagtactcattcaaaaaaaagatatgcaagaaccagaattcgcatactataacggcttcgacatatcaaactcttctatctgtgtagaaaaacatgacaataaatttgaaaatcttaccgataaccaaagattactctttactaacgccgagggaaacgtcaaagcaaaaaaaatcgggatccaaggcttaaggatattcgaaaaatacataataacgccattaggcgaaaaaataaaagcagacttcaaacctagagaagacatagccctcaaaacatcaaaaaaacatggtctttga

SEQ ID NO: 8384 - RNA, 3003 nt, synthetic construct
  misc_feature 1..3003: note = Cas9 variant
  source 1..3003: mol_type = other RNA
atgaaaatattaggtttcgatataggaataaacagcatcggttgggcattcgtagaaaatgacgaattgaaagattgtggcgtcagaatatttacgaaagctgagaaccccaaaaataaagaatcgcttgcccttcccagacgaaacgcacgtagctccagacgacgactaaaacgacggaaagccagactaatcgctataaaacgcattctcgcgaaagaacttaaattaaactttaaagattacgttgccgcagacggagaattaccaaaagcatacgaaggctcattggcttccgtttatgaacttagatataaagccctaacacaaaaactagagacaaaagacttagctcgagtaatactacacatagccaaacaccgaggatatatgaacaaaaacgaaaagaaaagcaatgacgcaaaaaaaggaaaaatcttaagcgctctcaaaaacaacgctctaaaattagaaaattaccagtccgttggagaatacttctacaaagaattctttcagaaatataaagaaaacactaaaaacttcatcaaaataagaaacactaaagacaactacaacaattgtgttctgtcttcagatctagaaaaggaattaaaattcatactagaaaaacaaaaagaatttggatataagtactcagaaggatttattaacgaaatacttaaagtagcattcttccagagaccactaaaggacttttcacatcttgtaggggcatgcacattctttgaagaagaaaatcgagcatgtaaaaactcatacagtgcatgggagtttgtagcattaactaaaataataaatgaaataaaaagcctggaaaaaatctccggagaaatagtatcaactcaaacaataaatgaagtcctaaacttaatactagacaaaggtagtattacctataaaaaattccgatcctgcataaacttacatgaatcaatatccttcaaatcactcaagtatgataaagaaaacgcagaaaatgcgaaactcatagactttcgcaaactagtagaattcaaaaaagcactaggcgtacactcactcagtagacaagaattagatcaaatatcaacccatgtcacactaataaaagacaacgtaaaattaaagactgttctcgaaaaatacaacctttcaaacgaacaaattaacaatctacttgaaatagaatttaacgattacataaatctaagcttcaaagcccttggaatgattctccctctaatgagagaaggaaaaagatacgatgaagcatgtgaaataaccaatctaaaaccaaaaacggtagatgagaaaaaagatttcctaccagctttctgtgactccatctttgcacatgaactctcaaacccggttgtcaacagagcaatttccgaatacagaaaagtcctaaacgcactactcaaaaaatacgacaaagtccacaaaatacatttagaactagcaagagacgtgggcctcagcaaaaaagcaagagaaaaaatagaaaaagaacaaaaagaaaaccaagccgtcaatgcatgggcacttaaggaatgcgaaaatattggattaaaagcaagcgcaaaaaacatactaaaattaaaactttggaaagaacaaaaagaaatatgcatatactcaggtaacaaaatatctatcgaacacttaaaagacgaaaaggctctagaggtcgaccacatctatccatatagcagaagctttgacgactcatttatgaacaaagtacttgtattcacaaaagaaaaccaggaaaagcttaacaaaacaccatttgaggcattcggcaaaaacatagaaaaatggtcaaaaatccaaacactagctcaaaacctcccctacaaaaaaaaaaataaaatactagacgaaaactttaaagacaaacaacaagaagatttcatatctagaaacttaaatgacaccagatacatagcaacactcataacaaaatatactaaagaatatctaaatttcttacctctaaacgaaaatgaaaatacgaacctaaaatcaggcgaaaaaggtagtaaaatacatgtacaaacagtcaacggcatgctaacatcagtactcaggcacacatggggattcgacaaaaaagacagaaacaatcacttacatcacgcacttgacgctattattgttgcctactcaaccaattcaataataaaagcatttagcgacttcaaaaagaatcaagaacttctaaaagcacgattctacgccaaagagctaacctccgacaactataaacaccaagttaaattctttgaaccattcaaaggcttcagagagaaaatactatcaaaaatagatgaaattttcgtatctaaaccgccacgaaaaagagccagaggcgcattacataaagaaactttttactcagaagacgaaatgataaaaaaatacaattcaaaagaaggacttcaaatagcattgtcatgtggccgggtcagaaaaatcggaacaaaatacgtagaaaacgacacaatggtacgtgtagacatctttaaaaaacaaaacaaattctacgcaatacctatttacgccatggatttcgcactcggaattctaccaaacaaaatagtcgtcgttggcaaggacaaaaataataatcccaaacaatggcaaaccattgatgaatcctatgaattctgcttttccctatacaaaaacgaccttataatgcttcaaaaaaaagatatgcaagaagctgaattcgcttactacaacggattcgatatatcaacatcatcgatctgcgtagaaaaacacgactccaaatttgaaaacttaacaagtaatcaaaaactgctgtttagtaacgccaaagaaggttcagtcaaagtcgaaaatttaggtatacaaaacctaaaaatcttcgaaaagtatatcataacaccactcggagataaaattaaagcagatttccaacccagagaaaacatctcattaaaaacaagcaaaaaaaacggactctga

SEQ ID NO: 8385 - RNA, 3003 nt, synthetic construct
  misc_feature 1..3003: note = Cas9 variant
  source 1..3003: mol_type = other RNA
atggcacgcgcccaaagaagactaatctccagaagagcaaatagaatgaataagctaagaagattgctcaaacaagaaaacgtcctacaagctaacgattacgacgaaaaaggattaattatcggacttccaaaccaagcatgggaattgagggcacaagggctagacagaaaacttgaaccgaaagagtgggcagcagttctaataaacctcgtaaaacatagaggatacctatctcaaagaaaaaacgaaagtcaaactgccgacaaagaactaggtgcattactatccggaatgaatcataaccatcaacttctacaaagtcagtcgaaccaatatagaacaccagcagaactcgctatcaaacaattcgccactcaagacggacatatcagaaatcaaagaggagcatatacacacacattcaacagactagatctacaaaatgaacttaatcaattatttgatgcccaaactagacttgggaatcctcacgtctccggaagcttaaaaacagcaataaatgatctactaatgaatcagaaagcagcattaagtggtgacgcaatcctcgaaatgttaggccgatgcacattcgaaccatcagaatacaaagccgcaaaaaacacatacagtgccgaaagatttgtctggctaggaaaactaacgaatctcaggatacaagacaacggcttggaatccgcactatcaagagaacagagagaattacttttaaacgaaccttataacaaaactaaactaacatatcaacaagtaagaaaactcctaagattacccgaaacagcattctttaaaggattacgttacggaaaagacaatgcggaatcagccacctttatggaaatgaaatcataccacgcaataagaaaatccctagaaaacaaaagcctaaaaagcgaatgggaaaaattaaaaacccaaccaaaactccttgatcttattggaacagcattttcaatatacaaaaccgacgatgaaattgcaggttgcttaaaaaaccaactaccagaaaacgtaattatcgcattacaagaacaactaaacttcagtaacttcatggaattgtccttaaaagcgttagaaaaattgttaccattaatggaacaaggtttacgatatgacgaagcatgcacgcaaatatacggaaatcgacacgaaaaaatagccgataaaacagaaaaattcctaccaaacatacctgccgacaaattaagaaatccagtagtcctgagaaccttaacccaagcaagaaaagtaataaacgcaatcataagaagatatggaagtccagccagagtacacatagaaacaggacgagaagtaggaaaatcattttccgacagggacaaactaaaaaaacaacaagaagaaaaccaagaacaaagaagaagagcaattgacgaatggaaacaatttttccccaatgcagctcacgaaccgaaagcagtagatatactaaaattacgactatatcaacttcagcaaggaaaatgcctctactcaggattacctatagatgtaagacgcctaccagaaaaaggctacgtagaaatagaccatgctctacctttctcacgcacatgggatgacagcttcaacaataaaattctcgtattagccagcgaaaaccaaaacaaaggaaaccaaactccatatgaatatttacgaggcgcagataactccgagagttggagattattcgtagaaaacgttcaaaactgtcaattcagcccaaataaaaaacagaaaattatggccaaacaactagatgaaaaaggttttctagaacgtaacctaaatgatacccgatacgtatcccgattcctgtgtcaattcataagtgaacacctacacctaactggaaaaggaaaaaagcgcgtatttgcatcaaatggacaaataacagcacttctgcgtgggagatggggattaagtaaaaatcgagaagaaaatgaccgtcatcacgcagtagatgccgtagtcgtagcttgctcaacagtcgcaatgcaacagaaaataacacagttcgtacgctatcaaaaaggaaatgtcttcacaggtgaaagaatagacaaggaaacaggtgaagtaataagcattcattttcccacaccttgggaacattttcgagaagaagtaatgataagagtattcgacgacaacccactgagaacactgccagagaaattacctaaccgaccagaggcacttcacgaatatgtaatgcccctatttgtatcaagaatgcccacaagaaaaatgactggacagggacacaaagaaacaatcaaatcagctaaaagactcgacgaaaaaattagcgtattgagagtccccctcacacaacttaagttaaacgacctagaaaacatggtaaaccgagaaagggaacccgcactatacgaagcactaaaagctcgacttgaacaatttaaaaatgatccagccaaagcattcgcagaaccattcttcaaacaaggaggacaacaggtaaaagcagtccgagtagaaatagttcaaaaaagcggaatgcttctaagaaaaataaatggagttgcggacaacgggagtatggttagggtagacgtattcgaaaaaagcggaaaattttatctagttcctatttacgcctggcaagtagccgaaggaatactccccaactacgcagtagtagcacataaagacgaaagtgactggatactaatggatgaatcatatcattttaaattcgccttatataaaaacgaccttttagaagtacaaaccaagaaaggtgggataatgggatattttgcaagtttagatagagcaacaggagccatcaccataagagagcacgatcgagacaaaaaaaaatgtaaagacggagaacacagatcaataggagtaaaaatggcatcaagcttcaaaaaactacaagttgacgaactgggaaagaacattcacgaaacacgatcacgcaagaggccaaatatcggatga

SEQ ID NO: 8386 - RNA, 3012 nt, synthetic construct
  misc_feature 1..3012: note = Cas9 variant
  source 1..3012: mol_type = other RNA
atgagaattctcggatttgacataggcatcaactccatagggtgggcattcgtcgaaaacgatgaactaaaagattgcggagtgcgaatctttacaaaagcagaaaatccaaaaaacaaagaaagtctcgcattacccaggagaaatgcaagatcatccagaagacgccttaaaaggcgtaaagcaaggctaatagccattaaaagaattttagcaaaagaactcaaattaaactacaaagactacgtagccgcagatggcgaacttcctaaagcctatgaaggatcccttgcatccgtatacgaacttagatacaaagcattgactcagaatctcgagaccaaagatctagcaagagtaatattacacatcgcaaaacatcgaggatatatgaataaaaacgaaaaaaaatctaatgacgccaaaaagggaaaaatcctatccgctttaaaaaacaacgccttaaaattagaaaactaccaatcagttggagaatatttctacaaagaattcttccaaaaatataaaaaaaacaccaaaaacttcattaaaattagaaacacgaaggataactataacaactgcgtactaagctcagatctcgaaaaagagttaaaattaatactagaaaaacaaaaagaattcggctacaactactcagaagacttcattaacgaaatactcaaagttgccttctttcagagaccccttaaggatttctcacacctagtcggagcatgcacattctttgaggaagaaaaaagagcatgcaaaaactcttactcagcatgggaatttgtcgcattaacaaaaatcatcaacgaaatcaaatcactcgaaaaaatcagcggagaaatagtcccaactcaaacaattaatgaagttctaaatttgatattagacaaaggcagcataacatacaaaaaattcagatcatgcatcaatctacacgaatcaatatccttcaaaagtcttaaatatgataaagaaaacgcagaaaacgcaaaactaattgacttcagaaaattagtagaatttaaaaaagcactcggagtacactcactatcacggcaagaactagaccaaatatcaacacatataactcttattaaagacaacgtaaaattaaaaacggttctagaaaaatacaatctttcaaacgaacaaataaacaacttacttgaaatagaattcaatgactacattaacctctcctttaaggccctaggaatgatacttccattgatgcgagaaggaaaaagatacgacgaagcatgcgagatagcaaacttaaagccaaaaacagtcgacgaaaaaaaagattttctcccagccttttgcgattcaatattcgcacatgaactatctaacccagtcgtcaacagggcaattagcgaatatcgcaaagtattaaacgccttgcttaagaaatacggaaaagtacacaagatacacctagaactagccagggatgtaggattatcaaaaaaagcaagagaaaaaatagaaaaagaacaaaaagaaaatcaagcagtaaatgcctgggctctaaaagaatgtgaaaatattggactaaaagcctcggcaaaaaatatactcaaactcaagttatggaaagaacaaaaagaaatatgcatatactcaggaaataaaatatcaattgaacacctaaaagatgaaaaagctctagaagtcgaccatatttacccatactccagatcctttgatgacagtttcataaataaggtattagtcttcaccaaagaaaaccaagaaaaactcaataagactccattcgaagcctttggcaaaaacatagaaaaatggtcaaaaatacagacactcgctcaaaatctaccctacaaaaaaaaaaataaaatcctagacgaaaattttaaagataaacaacaagaagacttcataagccgaaatcttaatgacacacgatacatagcgacactaatagcaaaatacaccaaagaatacctaaattttctattattatcagaaaacgaaaatgctaatctaaagtcaggcgaaaaaggatcaaaaatacacgttcaaacaatctcaggcatgttaactagtgtcctcagacatacctggggattcgacaaaaaagaccgaaataaccacttacaccacgccttagatgcaataatagttgcttattcaactaattccataatcaaagccttttctgacttcaggaaaaatcaagaattactaaaagccagattctacgcaaaagaactcacctccgataactataaacaccaagtaaaattcttcgagcctttcaaatcctttagagaaaaaatcctctccaaaatagacgaaatttttgtaagtaaacccccaaggaaaagagcaagaagagcattacacaaagatacgtttcattcagaaaacaaaatcatcgacaaatgtagttataactctaaagaaggccttcaaattgcactctcgtgtggccgagtaagaaaaatcggtactaaatacgttgaaaatgacaccatagtaagagtggatatatttaaaaaacaaaacaaattttatgccataccaatttatgcgatggacttcgcactgggaatactcccaaataaaatcgtaataaccggaaaagacaaaaataataaccccaaacaatggcaaacaattgatgaaagttacgaattctgcttttcactttacaaaaacgacctaatactactacagaaaaaaaatatgcaagaaccagaattcgcttactacaacgacttctccatctccacatcttccatatgcgttgaaaagcacgacaacaaattcgagaacctaacttcaaatcaaaaactactcttctccaacgcgaaagaaggtagcgtaaaagttgaaagcctaggaattcaaaacctaaaagtcttcgaaaaatatataataaccccactcggagacaaaattaaagccgacttccaacccagagaaaatatcagtctaaaaacatcgaaaaaatatggcctaagatga

SEQ ID NO: 8387 - RNA, 3012 nt, synthetic construct
  misc_feature 1..3012: note = Cas9 variant
  source 1..3012: mol_type = other RNA
atgatagatgaatcacttacctttggaatagatcttggaataggtagctgcggctgggccgtgcttagaagaccaagcgcatttggccgtaaaggagtcattgaaggcatgggttcatggtgctttgacgtacctgaaacgtcaaaagaaagaacaccgactaaccaaataagaagatcaaatcgtttgctaagaagagtaatcagaagaagacggaatcgaatggccgctatcaggagattgttacacgcagctggattattacctagtactgactcagatgctttaaaaaggcccggacatgatccatgggagctaagagcacgaggattagataaaccactaaagccggtagaatttgccgtagtattaggccatattgctaaaagaagaggtttcaagagcgctgcaaaaagaaaagcgacaaatatatctagtgacgataagaaaatgttaacagcattagaagctacgcgcgaaagattgggaagatatagaacagtaggagaaatgtttgcacgagacccagacttcgcgtcgagacgaagaaaccgagaaggaaaatacgatagaaccacagctagagatgatttggagcatgaagtacatgctttgttcgccgcacaaagaaggctaggacagggatttgcaagcccagagttggaagaagcatttacagcaagtgcatttcaccaaagaccaatgcaagattctgaacggttagtagggttctgcccatttgaaagaacagagaaaagagccgcgaaattaacacctagcttcgaacgatttagactattagcaagacttttaaatttaagaataaccacaccagacggtgaaagaccattaacggtggatgaaatagcacttgttacaagagatttgggaaaaaccgcaaaattaagtattaaaagagtacgaacattaattggattagaggacaaccaaagatttaccacaatccgcccagaagatgaagacagagacatagtagcacgaacgggtggagcgatgactggtactgcgacattaagaaaagcactaggagaagcactatggacggatatgcaagaaagaccagaacaacttgacgcaatagtacaagtactatcatttttcgaagccaatgaaactatcacagaaaaactaagagaaataggactgacattagctgtattagatgtgttattaacagctttagacgcgggcgtgtttgctaaatttaaaggagcagcgcatatttccacaaaagctgcaagaaacctgctaccacatttagaacaaggaagaaggtatgatgaggcatgtacaatggcaggttatgatcacgcagcatccagattgtcacatcatggtcagatagtagcaaaaacccaatttaatgcgctggtgacagaaatcggagaatcaatagcaaatcctatagcacgaaaggctttgatagaaggattaaaacaaatatgggcgatgagaaatcactggggattacccgggtcaatacatgtagaactagctagggacgtgggaaactcaatagagaaaagaagagaaatagaaaaacacattgagaaaaataccgcattaagagcacgagaaaggcgggaagtgcatgatctcttagatttagaagatgtaaatggggatactctattgcgatatagattatggaaagaacaaggaggaaaatgtctatataccggtaaagcaattcacatccggcaaatagccgcgactgacaatagcgtacaagtagatcatatcttaccatggagcagatttggggacgactcatttaacaacaagacattatgcctagcatctgccaatcaacagaaaaagagatcaacaccttacgaatggctctcgggacaaacaggagatgcgtggaatgcctttgtacaaagaatcgaaacgaacaaagaattaagaggatttaagaaaagaaattatcttttaaagaatgcaaaagaagcagaagaaaaatttcggtctcgaaatttaaatgatacaagatacgccgcaagactatttgcagaagcagtaaaattgctatacgcctttggagaaagacaagaaaaaggaggaaatagaagggtatttacaagaccaggggcattaacagccgcactcagacaagcatggggagtagaatcactgaagaaacaggacggtaaaagaataaatgacgatcggcatcatgcacttgatgcactaacagtcgcagcagtagatgaggcagaaatacaaagactaacaaaatcctttcacgagtgggaacagcaaggactaggcaggccattaagaagggtagaaccaccttgggagtcctttagagcagacgtagaggcgacttacccagaagtattcgttgcgagaccagagagaagaagggcaaggggtgaaggacatgcggctacgatacgacaagtaaaagaaagagaatgcacgccaatcgtatttgaacgaaaagcagtgtctagcctcaaagaagctgatctagaacgaataaaagacggtgaaaggaatgaagctatagtagaagcgataagatcatggatagcaacgggaaggccggctgatgcaccgcctagaagtccaagaggggatataatcacaaaaatcagactagcaacaacgataaaagcagcagtacctgtacgaggaggaacagctggtagaggagaaatggtcagggcagatgtatttagtaaaccaaaccgaagagggaaagacgaatggtatctagtaccagtctatccacatcaaattatgaatagaaaagcgtggccaaaacctccaatgagatctattgtcgcaaacaaagacgaagatgagtggacagaagtaggtccagaacatcaatttagatttagtctgtatccaaggtcaaacatagagatcatcagaccaagcggagaagttatagaaggatactttgtaggcttacatagaaataccggtgccctcattcccacgccagtgggtcctgatagttatgtaatagcttga

SEQ ID NO: 8388 - RNA, 3024 nt, synthetic construct
  misc_feature 1..3024: note = Cas9 variant
  source 1..3024: mol_type = other RNA
atgaaagtactaggcttcgacatcggaatcaacagcatcggctgggcttttgtagaaaacaacgaattaaaggactgcggtgtcagattattcactaaagcagaaaacccaaaaaccaaagagtcccttgcactaccacgacgaaatgccagatcgagtagggtacgcctacgacgacgaagatctagattattatctctaaagcatataatatcaaaggaatttggactacattacgaagactatatagcattagacggaaatctacccaaagcctatacgggaaaaatagaatccatatacaaacttcgatatgaagccctaagccaagcaatatcaaaagaagacttagcaagagttatactacacattgccaaacacagaggatacatgaacaaaaaccaaaaaacatctcaagactccgaaaaaggagcaatcctatcagccattaaggaaaactccaacaagataaaacattaccaaactgccggcgaatacttctataaagaactattcgaaaacttaagagatggaacaaaagaatttaaaaatataagaaacaaagccatgaaaaatgaaaaaacaggcaacatggaatccacctactataatacaatactagcaagtgatctagaaaaggaactaaaactaatcctagaaaagcaacaggcttaccacaactactcagacacatttataaaggaagtactcgaaatagctttctaccaacgcccactaaaagatttttcacacctcgtcggaagctgcacattctacgaaaatgaaaaaagggcatgcaaaaattcatatagcgcctgggaatttatagcattaggaaaaataatcaacacacttgaatcaatcaaaaaagacactggagaaatattttcaaacgaaataatcacgcaaatactaaaagaagtcctggataaaggatccctctcatacactaaacttcgaaaaatgataaacttggacgaaaaagttaaatttaaaggactcaaatatgacaaagaaggagtagaaaaaaccaatttaatagaatttaaaaaactgaaagagttcaaaaaagcattaggagaacacaacttagaacgaaaaacactcgatgaaatagccacacatataactcttacaaaagacgaaaatcaattaaaaaaacaactagagcaatacgcattatctcaaaaccaaatagacgcactcgcagaactggattttaacgaccacataaatctctcattcaaagcactatacgaaatattgcctctaatggaaaaaggcaaaagatacgatgaagcatgcaacgaattaggactgaaagcaaaaacatccaatcaaaaatccgaattcctacctgcattctgcgactctatattcgcacaggaactcaccaacccaatagtaaatagagcaataagcgagtaccgcaaagtattaaacagactcctgaaaaaatacggcaaaatgcacaaaatacacatagaactggcacgcgatgcaggattatctaaagaggcacgaaacaaaatcgaaaaagaacaaaaagaaaataaagatataaacgataaagcagaaaaaacatgtaaggaattcggacttaaaccaaacgccaaaaatatcctaaaaattaaattgtggcgggaacaaggagagatatgcgcttacagtggtaaaaaaataaccatcgatgacctaaaagaagacaaagcactcgaagtagaccatatatatccatactccagatcatatgacgatagttacaacaataaagtactagtatttataaaagaaaatcagttaaaacttaaccagaccccgtacgaagcgtttggatcaaaccaagaaaaatggagtaaaatacaagtactagcccaaaaattaccatataaaaaaaaaaacagaatactagatgagaacttcaaaaacaaagatcaaatagagttcatatcaagaaacttaaacgacacccgatatgcaacctcactaatagcaaaatacacaaaagaatacctagaatttctacccttatccgacgacgaagatatttccctaaaatcaggagaaaaaggatcaaaaacacatgtacaaacaatgaacggaatgctaacatccgtcctgagacacgcttggggattttctcaaaaagatcgaaacaaccatcttcaccatgcactagacgcaattataattgcctactccactaacagtatcataaaagcctttagcgattttaaaaaaaaccaagaaatacttaaagctaaactctacgccaaaaaactaacatccgaagaatataagaaccaatccaaattcaccggattcgaaaaatatagatcaaagatactagaaaaactcgactctatcttcgtctcaaaaccacctaataaaaataccaaaggagcactacacgaacaaaccttctactcttaccaagacatattagaagaatacaaaactcaagaaggattaaaaagagcactagaatgtggaaaagttagaaaaataggaacaaaatatgtagtaaacgacagaatggtaagactagacatatttaaaaaagacaataaattttatggaatccccatatacacaatggactttgcactaggagtattacctaataaagtagttaccataggaaccgacaaagacaaaatcaaaaaagaatggaaaacaatagacgaaacctacgaattctgtttcagcctatacaaaggcgatctagttctcatacaaaaaaaagagatgcaagaatcagaattcgcatactataacggattcgatataagttcagcaagtatatctctagaaaaacatgacaacaaattcgaaaacctaaccgaaaaccaaaaactactgttcccaaaagcaaaagaaggagatgttgaagtacgcggaatcggaatacaaggacttaaagtatttaaaaaatacatggtaactccactcggcgaaatacaggagaccagaacagaagctagacaaaacatacaaccgcgaaaaaaacacggccttagatga

SEQ ID NO: 8389 - RNA, 3033 nt, synthetic construct
  misc_feature 1..3033: note = Cas9 variant
  source 1..3033: mol_type = other RNA
atgagcgattcaagttatgtactcggcctagacttaggaacaaattccatcggatgggcatgcgtaagacttaacaagggaaaaccagatgggttacttgcacaaggtgtacgaatattcgaagctggattagaaatagatgcgtatggtagagggacaccattaaatacagaaaggcgcaacgcaagacaaaggcgacgtttacatgatagaagaaagagaagaatattaaaagttagacgcattctacaagaagcaggaatgttaccagccaataaaccagaccataaggacgcagaatggaaaatgcttttagcacgaaacccatatcgattacgtgcaaaggccttagacgaacaaatcgatctaaaagaaataggactttgtatatatcaatttgcacatagaagaggatttttatccaattcaaaaatactcaagaaagacgatgacagaggaaaactaaaagacgcaacaaaagcgttcgcagaagatatggaacaaaaaggagcaagaacctggggtgaatatttaagccacttagatcctcatgaacagagaataagaacaaattacaccttaagagaatggtacacatcagaatttgacctaatttgggaaaaacaacaatcgttctacccacacgtgttgaccgacgacctatataaacgagttaaagaagctctcttttaccaacgtccacttaaaagtcaagcacacttattgggacaatgcgaattagagccaggacgaaaacgagctcccttcgcattactgatggcgcaagagttcaggttactacagagcttaaaccaccttagagtcgtaagcagcacaggtgacgaacggctactaacagatgaagaaagaaaacaagcattggctctactgcgaagcagaggaaatcaaaaattcacaacattgaggaaagtcctaaatttaagaggtactaaatttaatctagaacgaggcggagagaaaacaatacaaggaaataacacagcagctgcgttaggaaacttattcggagaggcttgggatcattttagctctgaacaaaagaatcaaattgttgaagatagattgacgataggagatacagatgcattaataagacgcatgaagaaaacttggggcctcgattcagtaaccgcagaaatgttctcagaaacagaattagaagatggatactgcggattcagtcgaaaagcattagaaaaactactcccactattagaaaggggacatgcccttatggaagctgtacaagcagcctacccagattatcagaaaaatctaccaagaacagatacacttccaccactagaaaacctgcgaaaccctatcgtacaacgaacactttcagaattaagaagagtagtaaatgccataatcaaagaatacggaaaaagcgacaaaataagaatagaattagcaagagacatgaaacaaacagctaaaaacagagaaaaatcatgggacaggatgagagtgagagaaagacaaagaaaagaagcagcaaagaaaatactcgaagaaacaggaaacccagcaccacgcagacacgaaatagaaaaagtattattagctgaagaatgtaactgggaatgtccatatacaggaaaacgaatttgcatgaacacattattaggagatgcaccacaatttgacattgaacacataattccatttagtagaagttttgataattcattcagtaataaaacattatgtgacgtaaactacaacagaaacgtaaaaggaaataagactccatacgaaagcgctagtgaaactgaacacgaagaaatggtctgtagagtcaaaagattcacaggagactataaagaaataaaattagacagattcaatacacgcgaaacagactcacgcgctgactttatagaagaattttccacaagccaattaaacgatactagatacgcaagtagactagccggagaatacctaggtaaattatatggatcagaatggagaaagcacatacaaatagcaaaaggaggaacaactaaatatctacgtgatgcatgggacttaaatcgcattctatcagatggaggaactaaaagtcgcgatgatcatagacatcatgcagtcgacgcagttgtagtcgcgttaacaactcctcaaacagtgaaagcactgtctgacgcaaaccaaagagcaccggaacaccgaaggtatgcgttcagtgacatgcccttgccttgggaaacatttcgacaagatgtagaacaagcaataaatagcattaccgtgagccacaaagtatgcagaaaagcgaatggccaattacacaaggaaacattctacggcttaataaaagacagaaaaacgggagacacacgaactgtactaagaaaaccgttacacgaacttaccgataaagaaataaagcgggcagaaattgtagactcttcaataagaaaattaatagaacaaaaactgaaagacttagaccaaccgccaaaaacagcatttaaagatagaaataatcatccattcataatcgacaaaaatggcaataaaagatttatacataaagtcagagtttatcaagatgcaaaaccagtcaaaatcgcagaaaacagacatgtcaaactaggtggcaatcatcaccttgaaatattcgaagttatagataagaaaggaaacccaacatggaaatgcgaagtaatatcactattcgatactaggcaaagggtaaaagagaaaagaccagtcattgtcagacaagaccaaaatggaaatccactaaaatttagcctatcaatcggggaagctgttcaactagattggaatggaggtagggaaactgcagtagtacaaaagatgtccaaaacaccaaatacagtagaatacgtttttagaaaacataacgacgctcgaaaagctgccgacataccatataaagaaacaataactgtaaaatcggattccgctctctttgcctcaaatttgcagaaaatagtcataactccaacaggattaataagacgagcaaatgactga

SEQ ID NO: 8390 - RNA, 3033 nt, synthetic construct
  misc_feature 1..3033: note = Cas9 variant
  source 1..3033: mol_type = other RNA
atgaaaaatagaaatgtgataggaatcgacgtaggaacaaatagtatagggtgggcattggtagaagaaaacgagaacggtcttccacaaagtttaaaagcagcaggagtacgaatatttcaagaagctgtggaagccaaaacccgaactccaaagaatcacaagaggagacaagcaagattagcaaggagagtgctagctaggcgcgcaagacgaaaacagagattacaaaatctattgttaaaacatgggttattaccaggaggtgtaaccgatccagtacaaagggaagcagcatttacaactcttggcgatccataccaactaagagccaagggtctaaatcttcccctaggattgcatgaatttggaagagtactatttcaacttggcgcaaggagaggttttctatcaaaccgtaaaactcgatacgggcacttaaacaaattagatgaattagcagacttaatagaagccgaagacgcagctcccaaaacaggagatgcagaagaaggaatcataagaaaagaaatcggagaacttcgtcaagcaatgagtgcggcaggtagcagaaccctaggagagtacctagcaggactagcaaaagaggaaagaaaaagatgtagacacactgaaagagcaatgctcgaagaagagttcgaaaggctttggatggtccaagcaagatttcatccagaattatctgatgaacttaaagtacaagttcacactgtcattttctttcaacgtccactgaaatcaaatagagcatcactaggtaagtgtagtctcgaaccctcacgaagaaaagcagcacgtgcctggccagaagcccaacgctttcgactactacaggatttgaataatttagaaatactagacccaaggacaggggaattaagaagacttcgggatacagaacgagcaatactgttaaacgcgcttgaacaacagaaaagtatgacatggaatgctgtaagaaagaaattagggttacatcaaggagaaaaatttaatttagaaacaggagcaaaagcagaaacagggctgaaaggtctacaaactctagcaagtcttcatgcaatattacagggatggttcgatgaattgggagataaaagagacctattgatcgaagatcttataactatagaagactcagctggtttatatagacgtctgcgagaacactgggggttcgatagagaaacagcatttagattagccacgctagaattagaaccaggatacgcttcattgtcattaaaagcaatacgaaaactactaccacatatgggagcaggacataggtattcagaagctagacaacaagtaggctatggttatgaaacaggacaacgagatcttcaagaaagattaggagaacctccagacccgcgtaatcctgtagtcgataaagcactacatgaattgagaagagttataaatgcactaatacatagatttggacgaccagacgtagtaagagttgaacttgcgagagatttaaaattagcaaaacgagataaagaaagattagagaaacaaaacagagagaatcaaagattaaatagaaaagctgaagctgcgctcgcagagttaggactaggacaaccatctcgagacgatttaattaaatatcgtctatgggaagaaagtaaaggactatgcccttatacaggaagagaaattggattatcaacattattctcaccagaagtcgacgtagaacacataataccctattcacgatgcttagatgattcatatatgaataaaaccctatgtatgacagaagaaaacagaatgcaaaaagggaacagaacaccatgggaagcgtatggaggcgatccagcccgatatgaacagatattacaatgtgcgagatattttccgatggcgaaaagaaaaagattcttggagcaaggaagtgacttcgtggatcaatttattcaaagacagctgaacgatacgcgatacatagcaaaattggcgaaagaatacctcgcagcagtctgtacaaacgtgcaagttacaaaaggaggaacgacagcaatgctgagacatcactggggtttaaatagactactgggagaggatgatggacaaaaagaaaggggcgaccatcgacatcatgcactagatgcagctgtaatagctgtaacaagccgtagtctatatcaaagactagctagaatagcacatcaaagaggtcacgcaccaagccaacgaggattctacatcgatccaccatggcaaggctaccaagctgatctggcacaaactttagcaggaatcgtcgttagccacgcaactaacagaaaactcacaggtgcattgcatgaagagacggcatatggacacatacctcacgttggattcgtttacagaaaaacgctaaataaagactttaaactaggtgatattgaagcaatatatgatccttcactccaagaattggtaaaggcacatttagaacaccatggaaatgatccaaaaagagcctttgcagaaggaatacaatgctaccacaaagacggccacacacccatcaaaagggtcagaataagagcaaaacaagtaagcgaaaagggaacttttagtataagcgatagagcgggtagggcctataaacaccataaaacgggtagcaaccatcatgtagaaatattgagacacagagcaaccgggaaaatagaaccagtttatcttacaacaaaagaagcaactgaaagggcaagaagaggaggagaacctgtaatacaacgtgaccacggaccagaatgggagttcatcataagtctgtgtataaacgatatggtacgacttggtgaaggaggacaagtagcatattttagggtacagaaaatagaagcaacaaacaaccgggtaacactgagaagccacctagcggcaacattagatgacgaagatatgaaggtaacaacttcagtaccaaaattagcagtaatgcctggatttcaaaaagtactcgttacagcggtaggagaagttctagaattacatgactga

SEQ ID NO: 8391 - RNA, 3033 nt, synthetic construct
  misc_feature 1..3033: note = Cas9 variant
  source 1..3033: mol_type = other RNA
atgaaaagaatggcagcagttggcctcatgccagcagatcccacagaagcaaaagcattagaactattagatccctatgccttaagagctgcaggattagaccaagccctgccattaacacattttggtagagcactatttcatttgaaccaaagaagaggatttaaaagcaatcgaaaaaccgacaaaggagataacgaatcaggaaaaataaaagatgcaactaaaagattagacgaggagatggctattaaaaacgcaaggacatatggagaatttctacatatgagaagaacttcagcaactgacccgaaaaatgtaccaacagtacgtactagactttcaatcgctaggagggacaacgcagaaaaagaagaggctggatatgacttttatccagataggaggcatctggcagaagaatttgacaaattatggaaagcacaagccggttatagtccagatgtcctaacagatgaactacgagacgagataagtgtgatcatcttccatcagaggccactaaaaacacccgaagtaggactatgtttattttcaggcagccatggagtaccaaagaaagacaagagaataccatcggcacacccattaaatcaaagacgaatactatttgaaactataaacaatttgagagtagcagcaagaggtgaaccagctagaggcctaacacgggatgaacgagatgcaatagtacatgcgctagacaacaaagcgcatacaaaaagcctgagtggtatgtccatgaaattgaaagccttaggaaaagtgataaagctaaggccagaacaatcattcacattacaaacagcgaatagggaaactatagcatgtgatcccgtacgagcaagtcttagtcatcccgatagatttggcccaaggtggagtatgcttgatgctgatgcacaatgggatgtggttcaaagaatcagagcagtccaatccgaagctgaacacgatgccctagtaaaatggttaatggcaacacacggactagatcgagaccacgcagaatcaacagccaaggcgcctcttcctgaaggttatggaaggctcggattaactgcaacaaaacgaatacttgcagcactagaagcagatgtaataccatatagcgacgcagttaaagcatgcggttggcatcacagcgatggaagaacaggagaagtgcttaccgaattaccatattatggacaaattctggatagacatgtaatccccggcacatataacgaatcagatgacgatgtaaccagatatggcaggatcacaaatccaacagtacatataggactaaatcaattacgtaggttggtaaataaaatcattaccgtgtatggaaaacctgatgaaatcgtagtagaattagcacgagacttaaagctctcagaagatcaaaaacgtgacgtacaacgagatattaagaaaaatacagatgcagccatagctagaggagcaaaactatcagaaatgggagttcccgataccggagcaaaccgtatggtcctgcgtctatgggaatccttaggagatgatgtaatgacacgaaactgcccttatagtggaaaaagaatatctgcaactatgctatttgatggaagttgtgatgtggaccatatcttaccttattctagaaccctggatgatggattcgcaaatagaacactatgtctaaaagaatttaatcgacagaaaacagataaaactccatgggaggcatggggagataccccggcgtgggcaacaatagaagctaatttgaaaaaccttcctgcgaacaaagcatggagatttgcaccagatgcaatggaaagatttgagggagaaaacgactttacttcaagagcactaaaagatgcccaataccttagtagaatagcaagaacttacttggatgcactatatgatggtgctgatggaaaatcacacgtctgggtagtaccaggacgactaaccgaaatgctaagaagacattggggattaaattcattactacccgataaagatggagcagtgaaagccaaaaaccgaactgaccatagacatcatgcaatagatgccgctgtcgtagcggcgacagatcgctcacttatacaaagaataagtaaaatggccaggaaagatgaagtgaatggtgctgaagaagttgctcggagcgtaccaccaccttgggagggatttcgcacagacatagaaacgcaactagatagaataataatatcacatagagcagatcacggaagaatagatccagctgctagaaaggatggtcatgacagtacgtcaggccaactacacaacgacactgcatatgggctgggtgaaggaaactcagttgtaagtagaaaacccttacttagtctaaaatctaatgatattgaagtaacaactaaaggtgctaatataagagacgtagatttacaacgtcacctagaaagaataacaagaggactagatggcaaagcactagaagcagcattggcagaatttgcagcaacagccaaacttccagatgggacagacaacccttactacggtcttcgacgagtaagactagaagaaacgttacaacaaggagctagagtggaagttaaagatagaaatggaaaaccctttaaagcctacaaaggtgactcgaatcattgttatgaaatatggagaatgcctgacggaaaagtagtaccccaggtaattacaacttatgaagcacatcaaatagacgttgagaagaaaccacatccggcagctaaaagacttctaagaatttttaaaagagacatggttgcaatcgaacaagatgacaaagcaataatcggatacgtccagtcaatgcatgtagccaatggtttatttattgccccgcatacagaagctaacgcagatgccagaagcagagataaatcagacagctttaggttaatacagatgtcagcaggtccacttgtaaaagcaaacgcacgaagagtttatgtcgacgagatgggaagactaagagatccaggtgcaccaagctga

SEQ ID NO: 8392 - RNA, 3039 nt, synthetic construct
  misc_feature 1..3039: note = Cas9 variant
  source 1..3039: mol_type = other RNA
atggcgaatatgagatacagactagctttagacctcggatcaacatcattaggatgggccatggtcagattagatgcccaaaatgaaacatgcgcagtaataaaagccggtgttcgaatcttttcagatggtcgaaacccgaaagacggtagttcactagcagtatccagacgagaagcacgtgcaatgagaagacggcgagacagattactaaaaagaaaaaccagaatgatggcaacgctaatgaaacatggtttctttccacaagatgaagcagccagacaagcgctagtaaataaagaaccatttgcactcagagctaaaggtttggatcacgcattattaccagaagaatttgcacgcgctctatttcacatcaaccaacgccgtggatttaaatctaatagaaaaacagataagaaagaaaccgatagttctgccttaaagaaagcgattggacaactcagagaagcaatgcaggcaagcggatgtagaactgtgggtgaatggttatgcgcacgccaccaacaaggattatcagtaagagcaaggtatagagaaaaccgaattacaaaagatgacggtaaaacaaaaatcgaaaaatcatacgacttatatatagatagagcaatgatagaagcggagttcgacgctctttgggcaaaacaaagtgaactaaacccggaacttttccatgaaacagcaagagcagaacttaaagactgtctcctacatcaacgaccattaaaacccgtaaaaccgggaagatgtacactattaccagacgaagaaagggcaccacttgcattgccatcacaacaaagatttaggatataccaagaagtcaacaaccttcgtctattacgagaaggacttaacgaagaaccactgacacttactcaacgagatcaactcattcaagcacttgaaaccaatccaaaacgttcttttacacaaatacaaaaactgctgggattttcaggacaattcaatctccaagatgataaaagaactgaactaaaagggaactcaacatcagcaatgttatcaaagaaagaatttttcggtagtcaatggctgagttttgacgaaacacaccaagacgaaatagtgatgcaattagtcagtgaggagaacgaagcccgattgatagcatggctccaagcagaaacaggagtagatgaaataactgcagaaagaatagcaaatacaccattagcagaagggtatggttccctatcagcaaaagccttagagaaaatattaccagctctccgagccgatgtcataacttatgacaaagctgttttagctgccggattcgaccatcattctcacatatctcatgccgctacaggagagattctacccgatctaccatattatgggcaatatcttcaaagacatgttggattcggaacaggaaaaccagaagacccagccgagaaaagatatgggaaaattgctaatccaacagtacacataggattaaatcaggtcagaacggtagtaaatgctttaataaaacgatatggacatccttctgaagttgtagtcgaattagcgcgagacttaaaacaaagtcaagaacaaaggaaagaagaacaagctcaacaagctaaaaaccaaagaagaaacgaaagaatgaggcaagacattgctggtcttctaaatacatcgacagaaagagtacgggcattggatttacagaaaatgatcctttgggaggaactaagttttaatgtcgcagaccgtagatgtccctattctggagtacaaataagtgcccaaatgttattttccgaccaggtcgaaatcgaacacatactgccatttagtcaaacattagacgattctttaaacaacaaaacagttgcaatgagacaggctaacagaattaaaggaaaccgaacaccagcagaagcagcagcagactttgcagcacagggctggcctgtagaagatatgctacatcgtgcaagtctgatgccaaaaggcaaaaggtatcgattcgcacaagatggaatggctcaatggttaagagaagacaaaggatttctagctcgagctctaaatgatacgcgacacttaagcagggtagcaagagaatacctatctctagtatgcccacaaggtactagggtaataccaggaagaatgaccgcaatgctgagagctaaatttggcctaaatgatatacttggattaaatggtgaaaagaatcgcaatgatcaccgccaccacgcagtcgacgcatgtgtaatagctgtgacagatcaatcaatgttacaaaaatttgcaaaagcatcagcaagcgccagagaaaaacaactaaataagctagtagaaagtatgccacttccttgggattcatatagagatcacgtccaaagagctgtagaacgaatatgggtatcccacaaaccagaccatggtcatgaaggggcaatgcacaacgatacagcatacggactgctaggcggtgggcacgtccaagttagaaaaaggatggatggggtaagaactcgagaaactgctgccctaaaagttatagaatttgccgacagacaagcacaccctagacatggacttcttccaaacggagaaccaatgccttataaaggatataaaggcgattcaaactactgtatggaaattgtaagaaatgataaaggtaaatgggaaggagaagtagtatcaacttttgaggcttaccagctcgttcgacaacatggattagcaaggcttagacatccagccctttcagtatctggaagaccattagttatgagattattacgaaacgataccctcagagtaatacacaatggagaacaaagaacagtcagaatatgtaaaatgactgctgaaggagtaattgcattagctgatactacagaatccaacgtagacgcacgtacacgaacgaaagacttaagctacatatttaaaacagcaggaagtttacaaaaatctaaaggtagaagagtagctataagcccatctggagaaatgaaagatcctggattctttgattga

SEQ ID NO: 8393 - RNA, 3051 nt, synthetic construct
  misc_feature 1..3051: note = Cas9 variant
  source 1..3051: mol_type = other RNA
atggaagtatttgtagatgtttcagctaggcagttgggaatagatttaggaatagggacttgtggttgggcgctactagcagaagatagcctaatcgctcttggtacaaggacatttgatgttccagagacagataaagaaagaataccgacaaaccaaatacgaaggcaagcgagaggaatgcgaagggttatagatagaagaaggcaacgcatgaatgcagtaagacgtctactagcagatcatggtttattggcggacggtggaaaactgggattagctaccgtcagattagacccttggcaagccagagcagaaggccttgaccgactattgagcgcaggagagctagctgtggcactcgggcacatagcaaaacatagaggatttagatcaaatagcaaaagagatcgaggtgcgaacgctccaaaagaaagctcggcaatgctaggcgcaattgcacaaacaggtgagcgattacaacattggcgaacagtaggtgaaatgttttggaaagacgaattttatcaaacacgaaggagaaatagagatggcgattatagtagaacagtacaaagacttgacttggaaacagaagtacatcgacttctagccgcacaaagacgtttaggaaacccattagcaacatttgatttagaacagagctttatagacgtcgcgttctttcaaagaccgctcgctgactcagacgacaaagtgggaccctgcccatttgaaccttcggaaaaacgcgcagcaaggcactcaccatcgtttgaaagatttagactacttagccgtctggcagctcttagactatctagcggagcaggagaacgacctcttagcgatgccgaatttgctgcagcctgcgcagattttggaagattgcaaggattcagcttcaaaagattaagacaacatctaaaattagatccatcaatacgatttgcgggaatagcaccagatgaagaaggcaaacgagatgtagttgctcggagcggcgaagctactccagggagtgcagcgctccgtcactgtctaggagacacagtatgggacaatatgctcggaactagaccagctttattagatgctatcgcagcaatactaacattcagagacgatgctgacagaatagcagaaggtctagctggtttaggaatagaggaaccaattttagatgcattaatggacggtgtaagaaatggttctttcggtaaatttaaagggcctggacatatctcggcgaaagcgtgtcgagctttactaccacacttagcaagaggacgagtgtattccgatgcatgcgcagatgcgggatatgaccatagtagacaaacagaaacaaatttagacgacataagaaatccagtagcaagaaaagcactaggagaagcattaaaacaaattaaaataataatacacacacacggaaggcctacagccatacatgtggaaatggcaagagacataggaaaaagtgcagatgaaagagatgaaattaaaaagggaatagacaaaagaaattcagaaaaagatagagcaagacaacaattccacgaaatggtaggcacaccggcagcaggggccgaagatttactgaggtttgaattatggaaagaacaaaatggatggtgcttatacacaggacgagaaataccaattgatgctctagttagcagcgacaatagaatacaagtagatcatatactaccgtggagtagaagcggtgacgattcatacattaataaaactttatgttttacggaagctaaccaacataagaaaggaatgactccttgggaatggctccatgatgatccggaaagatgggaaaaatttgcaagaacagttgaaggatgtaaaacaatgaaaggtagaaagaaaagaaaccttctgctaagagattcaagcagattagaaaaagagtttcggtcgaggaacttgaacgatactaggtatgcctgtagactactacttggtatactaaaacacacctatccagatatagtggtagcagcgaggccaggcccactaacagatagattaaggagggcctggggattacaatctttaaagaaacatgaggatgggactagaaaagatgatgatagacaccacgctctagatgccgcagttgttgcagcaacttcacaatcaatgctacaacgactgaccactctattccaaaaagcagaaagggaaggaggaaggcgagatttcgtaggactagaacccccatggccaggatttagagcagacttagaggcaaaattagagggggtagttgtttcaagggccgaaagacggagagcaagaggcgccggacacaaagacaccataagagctattggcgaaggcgatgcaggccctgtcgtttatgaaagaaaaccagtagccgccctgacagaaaaagatttagatcgagttaaagacccggaaaggaataaagtactaattgaaaatttaagacaatggatagcggcaggaaaaccaaaggatccagataaagcaccgagatcacccaaaggggatcctatgactaaagtaaaattggttactacagatgatgtacgtatattggtcagaggcggaactgccgaccgaggagatatggcacgagtagatgtatttagacaagccgatcccaaaggtagatggagattctttcttgtaccggtgtatccccatcaagtttttgacccaacagattggccacaacctcctaatagagcagtagtagcctataaaccagaaaaagaatggacagtgatgggaccagaccatgagttcctatggtcattgtatccatttagttggatagcagtagaaaaagctgacggaacacggatagaagggtattttagaggcatgcatcgaagtacaggtgctatatcaatttctcctcatcactcaaaatcgttagcctcaacaggaataggagccaaaacccttgctagctttagaaagttcgcaatggatagaatgggaaacctaagcgaaatagaacgagaagtcagaacttggcatggagttgcttgtacttga

SEQ ID NO: 8394 - RNA, 3054 nt, synthetic construct
  misc_feature 1..3054: note = Cas9 variant
  source 1..3054: mol_type = other RNA
atgcgagtagatagcttaggacgatgcctctctgacgaagaatgggcaagagtgatataccatttatgcaaacatagaggattccattggataagccgggcagaagcaaaacaaactgaaggagattcaaaaagcgaaggtggcaaagtaaaacaaggtttggctggcacagccaagttaatggacgaaaagggctacaggtcggccgcagaaatggtattagctgaatttccggaagctcaacgaaataagcagggagaatatcgaaaagccctatctagagaactattagcaaaagaactagccttactatttgcacgacaaagagtattcggaaacagacacgctacagataccttagaaacagcaatactaggaaactcagacaagaaaagtgggctattttggcagcaaaaacccgcactagcaggagccgatttattaaaaatgctgggcacatgtacctttgagaaaaacgaatatcgagcaccaaaagcatcctttaccgcagaaagacatgtctggttaacaagattaaataatttaagaatagtaactgatgggataacaagacaattaacagaacaagaaagacaattagtcttgccactgccttaccgccaggctggtgatttaacatacaaacaactaggaatggcattaacaaaagcaggattattagaagctgggtgcttcaaattcataggacttgcctacccaactgaagcacaaaaagcagaaggcaaaaccaaagaccccgaaagcgcgaccctagtaaaaataccagcatggcaagaactcaggcaaacactaaataaggctagtttaaacgacgaatgggaaaaactttctggtgatgcattatgcggacaacccgaaatctttgacaaaatcgcgtggatcctatcagtatacaaagacgacgatgaagtacgaaccgaactagcaaaattagttctacccaatccggaaggactgacagaagcactcttaaatataaggtttgataaatttcatgctctctcactaaaagcattaagagcaatcgtaccacacatggaaaaaggtttgaggtatgatgaggcttgtgtacaagcaggatatcaccactcacaattacataaaattggagaaggagaacataagtatttacctcccctttatgatggaagagatggagacggacggatgatcttcgccgaagatgccgatatcccaagaaatcctgttgtgttaagatcactaaaccaagcaaggaaggtagtaaacgcaataataagaagatacggctcaccaagcgcagttcatatagaaatggcaagagacctctctcgaccatttgacgagagaaacaaaataaagaaagatcaagatgaataccaagcaagaaaccaaagagacagagaacaatttatagaactattcggtcacccacccaaaggattagaatttgaaaaatggagattgtatcgagaacaaaatggacaatgtgcctatagccagaaacccttagcaagtagtggagatgtagcagaaattttccttgatggatccacagaaatcgatcatgccctaccctacagtagaagttttgatgatagtaaaaataacaaagtattagtacttacgagagaaaacagagataaaggaaatagaacaccctatgaatatctaggaggagctgaaaattcagaaagatggcagagatttttctcatttgttgaaagtaataaagcatatcgacttgcaaaacgaacaagattattacgcaaagactttggggcaaaagaatccgaagaatttagagaacgaaacctcaatgacacaagatacgtatgtagatttttcaaaaactacgtagaacaacacttgaaacttgcggaaggaagcgaagctaaacggtgcgtcgtagtatccggacaattaacaaattttcttagaaccagatggggcctactaaagattcgaagtgatagcgatagacatcatgctttagacgctgcagtagtagcagcatgttcacattccatggtacaacgattgtcgaactattcaagaacaagagaactggaacaagtaagagacggatttgtgaatatcgaaactggagaaatagtaaatcctgcgatgcatcaacaactacgagaacatttcccagacccctggccctattttagacatgaattagaagcaagattaaaaatcgacagcccggctttactaagagaagaaatggcacgattatcaagttatacagaagaagaactcgcagctttaaaacccttatttgtgagcagagccccgcagagaagaaacggcggtgcagcacacaaagataccatttacggacaaccagagaaattaaagaaaaatggatcagtctcacaaaaagtcgccttagcttctttagcactaaaagacatagacttactagctgatccacacagaaacgcaaaactctacggcgcgataagagaaagattggaagcccatgggggaaaaggggacaaagcgtttcctgcaacaaatcctctaagaaaacctgataaagaaggcaatcccaccggaccaatagtaaggaccgtaacaaaagtcattgataaactatctggcataccggtaagagggggaattgctaaaaatgacactatgctcagggtagacgttttcacaaaagccggaagatttcacctagtaccagtatatgtacatcaccgagtaacaggactaccaaatcaagcaattacccgaggtaaagatgaaaatcaatgggcaataattgatgatacatttgaatggagatttagcttatatccaaatgatttagttcaaataagacttaaagacgaaacgcacctaggttactacgcatcaacggaccgaagtaccagcagtataagcatttgggcacacgatcgaaatcaaagcgtcggaaaagatggattaattagatcgattggtgtgacaactgcaaaagatatagagaaatttcatgtagatacacttggcaatgtatatccagccccaccagagaaaaggagagggcttgcttga

SEQ ID NO: 8395 - RNA, 3066 nt, synthetic construct
  misc_feature 1..3066: note = Cas9 variant
  source 1..3066: mol_type = other RNA
atgagaagaagaagagatagatttaaacagagacaagcagctttgctaaagcatctagctggtgtcggactatttcctgcagatgaagcagccagaagggaactggccggactagatccatatgaattaagggccagggcattacacgaagcactaccactaaaccatataggtagagccctatttcatctaaatcaaagaagaggattcaagtcaaatagaaagacagacagaggaaaggcagatgacgaaggtaaaattagactaggtgtggctaggctacaagaagcaatgcacgaaaaaggtagcgcaacgcttggagaatttctacatgggagacgagctgcagcaacagacccaaatcaaatcccaagtgtcagaacccgattaagagcagaaagtggagaaggagcaagaggagatggatacgatttttatccagatagaagaatgcttgaggacgaatttgaagcaatatgggagagccaacaggttcatcatcctgctgtactaactgatgaaataaaacagcgattctttgaagttattttctatcaacgtccgctcaaacaacctgaaataggtacatgtactctagtagcaggagaaagaagactaccgaaggctcatcctctttttcagaaaagaagactattggaagaactgaacgcactaagaattgtatggccaggagtacaagcagaactactaagcagagaacaaagagatttagcgtacctaaaacttaaagataaaagagctgtccgttttgagagtttgagaaaagcattaaaattggatcccgatgcaagatttaataaagaatcagaaaatagaagcgaattgaaaggtgatgaagtagctgcagaattaggtgcaaaatcgagattcggagggagatggggacatacagcgccggctgatcagtgggaaattgtatcgcgtattcaagccttggaaagtgacgatgacgaagctcaattttgtgtatggttaagtgaaagatatggactcgacagcgaacaggcaagagcggtagcagccgctagattacctcagggatttggtagatttgggctaactgctactacgaggcttataaaggcgttacaagatgaagtaatcgtttacagtgaagcagtacagaaaacaggattagggcaccatagtgatttcagaaatggtgaagttttagcggagttaccatattatggaatcgcactagagagacatataatgccaggaacaggggatccaggtgatagtgatgaaatgagagtaggtagagtaaccaacccaactgttcacataggactaaatcaacttaggagggttgtcaatcgtctaataaaacgttatggtccaccacgccaaatcgcagtagaacttgctagagaattaaaattagatgaccaacacaaaagagaaataaatggacgaaacagacaaaatagagaggcggcagaaagaagatctcaaaagttagtcgacattggaatagcggacaaaggagcaaatagagcattactaaaattgtgggaagaactaaatccggacaacgctcttgatagacgatgcgtctatacgggtcggcagataagtatagaaatgctattttctggggcagttgaagtagatcacatattaccgtttgcggctacattagatgattcaaatgcaaataagttgttatgtcttagagaagctaacagaaacaaacgaaggagatcaccttttgaagcatttgggcaaggggcagattgggaagaaatagcagctcgggcagcaagattacctcgggagaaaagatggagatttgaacctgatgcaatggcgagatttgatacagaagaaaaattcttagcaagacaacttgtagacactcagtatctttcaagactagccagagaatacttgggcgtattgtttccagataaaggtgaaggatcaggtcgagtctgggtgagtccaggaaggctgacggaaatgttaagaagaagttggggactgaatcatctattaccggaccataaccttggcggaggagcggatcaacctaaaaatagaagggaccatagacaccatgcgatagatgcaatcgtagtggctgtaacggatagacatttattacaagcaattgcaagagaagccggacaaaggggacatgaagcggctaatcgaatgacagcagatttaccagttccatggcctgacttcgatcgggatgtagggcaggtaataagacaagttgtcgtatcacatcgagctgaccatgggaccgtatccaaagcaggcgcagcaaaagggcaagattcaactgcaggacgattgcataacgacacagcttatgggttaacaggtcaaactgatgaaaaaggaaatacaattgtagtgagaagggtaccattgacagcattaaagaaaccaacaagtatagaagcagttagagatgatgagctaaggaaagcattatcagtatggacgagaggatatgatgggaaggccttcgaagcaaggttaagtaggtttccggaattaggtccactgcagttccgaggcattaggcgcgtacgagtggtagaaccactgacagtaatacctataagagatagtagtggaagagtatacaagggatataaaggtgacagcaattacagatacgatgtatgggagttaaaagatggaaaatgggtagccgaagttgtgagtatgtttgatgcacatcaatctagttggacaagcccagtaagaagagaaaatcccacagcaaggaaagtgcttagcttacaacaaaatgatatagtagcaatagaaccggaaggtaaagagagagaacttatgagagtagcacaactgcgacagggtggacaaataacactagcggcctgtcatgaagcaggagatctgaaaagacgcgatgcagaaagtaatgaagtagatccatttaaatatttcagtccgaccgctgggggcctaaaaagagtaagagcacgacaagtgagagtagatgagctaggaagagtattggatccgggcagtcgtgatagagaaagaggagcggcgtga

SEQ ID NO: 8396 - RNA, 3066 nt, synthetic construct
  misc_feature 1..3066: note = Cas9 variant
  source 1..3066: mol_type = other RNA
atgaaatacacactcggcctagacgtaggaatagcatctgtaggatgggccgtaatcgacaaagataacaataaaataatagatttaggtgtaagatgtttcgacaaagcagaagaatcaaaaaccggagaatctctagctactgccagaagaatagcccgaggaatgagaagaagaatttcacgtagatcacaaaggctaagattagtaaagaaactatttgtacaatacgaaataatcaaagactcctccgaatttaacagaatttttgacacttcaagagacggatggaaagatccatgggaactcagatacaatgcgctttcacgaatattaaaaccttacgagttagttcaagtactcacacacataacaaaacgcagagggttcaaatcaaaccgaaaagaagacctcagtaccacaaaagaaggagtagtaataacctcaattaaaaacaactcagaaatgctaagaactaaaaactaccgaacaataggagaaatgatattcatggaaacaccagaaaactcaaacaaaaggaacaaagtagacgaatatatacatacaatagctagagaagatttactaaacgaaataaaatacatattcagcatacaaagaaaacttggttcaccgttcgtaactgaaaaattagaacatgacttccttaacatctgggagttccaaagaccttttgcaagtggagactctatattaagtaaagtaggaaaatgcactttattaaaagaagaactaagagctcctacttcatgttacacctcagaatatttcggccttcttcaatcaataaacaatctagtattagtagaagacaataacacattaacactaaacaatgatcaacgcgcaaaaataattgaatatgcccactttaaaaatgaaataaaatacagtgaaataagaaaattgctggacatagaaccagaaatcctattcaaagcacacaatttaacccacaaaaatccgagcggtaataacgaatccaagaaattctacgaaatgaaaagctaccacaaattaaaatcaacactaccaacggatatatggggaaaacttcacagcaacaaagaatctctagacaatttattttactgtctcacggtatacaaaaacgataatgaaataaaagactatctacaagctaataatttagactatctcatagaatacatcgcaaaattaccaacattcaacaaatttaaacatttgtctttagtagctatgaaaagaataatacctttcatggaaaaaggatacaaatatagtgatgcctgcaacatggcagaactagatttcacaggaagttcaaaattagagaaatgcaataaactgacggttgaaccaatcatagaaaacgtaacaaatccagtcgtaatcagggcattaacacaagcacgtaaagtcataaacgcaatcatacaaaaatatggactaccatacatggtgaacatagaactggcaagagaagcaggaatgacaagacaagaccgagacaacttaaagaaagaacacgaaaataacagaaaagccagagagaaaatatcggacttaattcgacaaaacggcagagtagcatcaggtttagatatcctaaaatggcgactttgggaagatcagggcggccgatgtgcttattcggggaaaccaatacccgtctgtgatttattaaacgattcactaacccaaattgaccacatatacccctacagcagatcaatggatgactcatacatgaacaaagttctagtcttaactgatgaaaaccaaaataaaagaagctacacaccctatgaagtatggggctcaaccgaaaaatgggaagattttgaagcgagaatatattcaatgcacctaccacaatctaaagagaaaagattactcaaccgtaatttcattactaaagacttagactcattcataagccgaaacttaaatgacacaaggtacataagcagattcctaaagaactatatcgaatcctacctccaattttcaaatgactcacccaaatcatgtgtagtatgcgtaaacggacaatgtacagcccaactaagatcgcgatggggactaaacaagaacagagaagaatcagacctacatcacgcactagacgcagctgtaatcgcatgcgcggataggaaaataataaaggaaataactaattattataacgaacgagaaaatcataactacaaagtaaagtacccactaccctggcatagttttagacaagatctaatggaaacacttgcgggcgtattcataagtagggctccaagaagaaaaatcacaggaccagcccatgatgaaaccataagatcccctaaacatttcaacaaaggacttacaagtgtgaaaataccactcactacagtgactctagaaaaattagaaacaatggtcaaaaacacaaagggaggcatttcagataaagccgtttacaatgtattaaagaaccgcttaatagaacataacaacaaaccattaaaggctttcgccgagaaaatatacaaacctcttaaaaatgggacaaatggagcaataatacgttcaataagagtagaaacaccaagttacacaggagtatttaggaatgaagggaaaggcattagcgacaatagtttaatggttcgagttgacgtctttaaaaagaaagacaaatactatttagtcccaatctacgtcgctcacatgataaagaaagaactaccaagcaaagctattgtacccttaaaaccagaatcccaatgggaactaatagactctacgcacgaatttctgttctctctataccaaaatgactacctagtcataaaaaccaagaaaggcataacagagggatattaccgatcctgccacagaggcacaggatccctaagccttatgcctcatttcgcaaataacaaaaacgtaaaaattgacattggcgttaggacagcaatatccatagaaaaatacaatgtagatatcctaggaaataaatcaattgtgaaaggagaaccaagacgaggaatggaaaaatacaattcattcaaaagcaattga

SEQ ID NO: 8397 - RNA, 3072 nt, synthetic construct
  misc_feature 1..3072: note = Cas9 variant
  source 1..3072: mol_type = other RNA
atgaaaatcctgggattcgacataggagttgcttcaataggatgggcatttgtagaaggtgacgaaatacgagattgtggtgtacgaatattcaccaaagcggaaaatcctaaaacaggcgaatcactagccctaccaagaagagaagcccgaggtgttagaaggagattagcgaggcgaagagttagattaaacacaattaagaaaataatttgtaaagaatttgacttaagattaagcgactatatagcagacgatggagaattaccaaaagcctaccaaaccaataaagataccaaatcgccatacgaattaagatataaagctctaaatgaaagactaagcaaagaagaactagctagagtcatactacacatcgcaaaacacagaggttatggaaacaaacatgcaaaagacggagacgacaaagacagtggaaaagtcaagaaagcaataggagaaaacaaaacgctattagagcaaaaaggatacgaatcagtaggtgaatattgcttcagggaatttttcaaaagtataaaagataaagatggagaaacacacaatataccaagccaaaatattagaaataagaaaggtaactacgatagatgcgtctcacaaaaacaattagaagacgaactaaaattaatatttgcgaaacaaagaaaactaggattcaacaaagagttcgaagacgcgatcctagaagtggcattttatcaaagaccgctaaaagacttcgacgacaaaataggagactgcatattctttgacaacgagaaaagagccccaaaagaatcaataagtgccatagaatttgtggcattaacccgaattattaataccttaaaatacctaagtaaaacaaccggagaagtatacgaaaaagaaatcatcaataaaatatggcaaaagatacttgaaaatggaaaaatgacatacgctgaacttcgcaaaatattagcgcttgatagcagcgtattcttcaaagacaaagatttagattatacattaggcataaaagaagctgagaaaataaaattcatagagttcaagaaactaatcaaattcaagaaagcactaggaagtttcgacggactgtcacgagaaattctagacaatatagcaatgcaaatagcaataacaaaagacagacaaagactattagaaaaacttgaagtttttccattaaataaagaacaaaaagaaaatctctcgcaactaaacttttcaaaatacatagacttatcattaaaagccctaaaccaaatattaccatttatgcgtgaaggtcgaaggtatgacgaagcaaaagacgacgcaaaactacaagaaaaagccaaaaacacaaagaaagaagagttccttcctccactgaaagagttcgacttaaacctaacaaaccctgtagtagcaagagcgttagctgaatttagaaaagtactaaatgctttattaaagaaatacggaaaagtacataaaatacacctagagttcgcacgagacatgagattagactttgatgaaagggaaagattaataagcatccaaaatgacaatttcaacaaacgccaattagcagaagatttctgtaaagaacacggcctagaaccaagtaacgccaacatacttaaaattaaattatggcaagaacaacaatggcattgcatgtatagcggagaattaataggcataccagacttaaaagatcctactaaactccaagttgaccatatatacccgtacagcagatcatttgacgacagttacacgaacaaagtcctagtaagagcagaatggaaccaagaaaaaggaaaccataccccattcgaagcattcggaggcgataaaaataaatgggataaaatagtcgcccttgcagaaaaattacctccaagtaagaaattgaatagatccgagaaatcaaagaaagataaacttttagatgagaaattcaacgataaagaactaggatttttagcaagaaacatcgtagacacgggatacatagcacgtctagtagccaaatatatagatatgtacttagaatttctacccttagaagaaaatgagaacacatcattggccagaggagaaaaaggaagtaagaaacacataggaatagtcaatggacgtctaacaagcgaggtaagacacaattggggtctcgaccctaaagaccgcgacaaccacctccatcatgctattgatgcaattgtaattgcatacatgaatgataaacgcattaaagcgtttgcagatttcagaagactcaaagaactaaaaataaaacgatacggtagagaaattacagaagatgaataccaagaaaagaagaaagaactgtcatgtgcaccatttgacgacttcagaaatagaaccctagaaaacatagataaaatattcgtcagccgtcctccaaggaaaagagcaagggggactctacacgaagagacattctacagcatagatgacaagaaacttctaaaagcatatggaggaaaagaaggtatgcaaagagctctatcgctaggtaaaataagacaaataggcacaaaaatagtcaaaaacggaacaatggtaagggtagacatttttaaagacaaacgtggaagattttacggagtaccaatatataccatggatttcgctctcggagtattaccgaataaagctgcagtttcgggaaaagacaaaaatggactaataaaagaatgggctgagatggatagtggatacgagttctgcttctcactattcaaagacgacctgatacttgtacaacgaaaagaaatgcaagaaccagaactatgttactttgtaagttttgattcaagcaacgcccaaattgatgttagatcccacaataaccacttttcagtattaaacgaaaaccaaaaattactattcaaaagtgcaacacaagctgaagttataggagaaagcattggaatacaaaatctaaaagtatttgaaaaatggcacgtaagcccactgggagaagttaggaaagccgaattttcaccacgaggtgaagcaaaactaaagacaagtaagaaacgaaagaaatga

SEQ ID NO: 8398 - RNA, 3072 nt, synthetic construct
  misc_feature 1..3072: note = Cas9 variant
  source 1..3072: mol_type = other RNA
atgaaaatatactcatttgatataggagtcgcatcaataggatgggctttcatagaaaacgaagtactacaagattgtggcatcagaatcttcacgaaagctgaaaatcccaaaaatggagcctcactagccctaccaaggcgagaagcacgaggtgtaagaaaaaggttagcgagaaggcgtggaagattgaacacaatcaaacaactactctgcaaagaatttggattacaactagaggactacctctcaaatgatggcgaattaccaaaagcatatacagcatcaaaagcaaatccgctcaaatcaccttatgaactacgaaccttagctctgagtcaaaaactagactcaaaagatctagttagagtcatactacatattgcaaaacacagaggctacggaaacaaacatgccaaagattccaaagacacagagagcggaaaagtaaagaaagcaattgagttcaatagaaaaactctagccgaaaaaggatacagaagtgtcggcgaatacctataccgtgagttctttcaacaatcaagaatttcccaaaacaacggagcaacagaatttattaacgtaagaaacaaagcaggcaattatgaacactgcgtcgcccaagatatgctaaaagaagaactcgaatcaatactcaacgcacaaagacaatttgggtttagtttaaaacaggattttgagtccaaacttctaactaaaatcttcgaacaacggccgctcaaatctttcgccgataaagtaggaaactgttgtttcattgcaggagagaaaagagcaccaaaagatagccccagcgcaatcgagttcatcgccttatctagaacaattaacacattaatcaacctgtcaaaagaaagtggagaaatatacaacagagcaataatattacaaatagtagaatcaactttaaagaaaggtgaaatatcatataaagaattaagggaaatcataagacttgacgaacgcttgaggtttaaagacccaagattagactacagtagagaaatcaaagaagcagaaaaagtgaaatttctggaatttaaacaactaaaaggattcaagaaagctctaggagagagctttacaacactagctataagccaactagacgaaattgcagaacacatagctttaatcaaagacagagtgaaactaaatgaaaaacttgaatcttacgccctgaccaaagaacagagagaagccctctctaatctgagtttttctgcacatattaacctgagcttacaagcattaaaacaaatactacccttcatgagaggcgataatggagaacaatgtctagattacgacgaaagcgttgaaaaagcaggactaaaagcactatccaaagacacactaaaaggacagatgttaccaccactgaatgaatttgaaccatatctttcaaacccagtagtagcaagagcattagctgaatatagaaaagtcttgaacgtactcctaaaacaatacgggagcccacataaaattcatatagaatatgcgcgcgaagcgaaattaagctccacagaaagacaaaaatatgaaaaagaacaaaaagacaactacgcagcaaatcaagcagcacacaagaaatgtcaagaactaggactagaacctagttcaactaacctcttaaaactaaaattatggcaagaacaaggaggactgtgcttatactcgggagcaaaaataacaatatcctatctacaagatccgacagcccttcaggtagatcacatatacccatatagccgctctttcgatgactcatacatgaacaaatgcctagtattaaccaaagccaatcaagaaaaaggtaacagaacacctttcgaagcattcggcacagattcagcaaaatggggagtgataacaactctagcacaaaaactaccccataagaaacgaagaagaatactaaatacagctttcaacgataaagaagctgggtttaaacttcggaacttaaacgacacctcatatatagcaagattagtagcagattacacagaaacttacctagagttccttccattagtagaatccgaaaacacaacactatcaaaaggacaaaaaggatccaagaaacacatagcaatagtgaacggtgtactgacttcaactatgcggtactatctcgggttcgcctccaaagatagagacaaccacttacaccacgctctggatgcagtcattattggattcatgaacgacagtgtaataaaagccttctcagactttaagaaaacccaagaaacaagcaaagccgcatattatgcacacacattatcaaaacaagaatacaagaaacagcgagcctttatacaattaccctctggtgaaaattttagagtatcagtattagaaaaagtcgaaagtgttttcgtatcaaaaccaccccgcaaaagagtacgaggagcattacatgaagcaacattttatagtccaaatgaccccaaactgctgaaaaattatggaggtacaaaaggagtcgaaagagccctagctcttggtaaaatgagaaaagtaggggcaaaaatagtatccaacggagcaatggtacgcgttgatatattcaggcataaatcttctggaaaattctacggcgttcctgtttacacaatggatttcgctcttggcatcttaccaaacaaagctgtagtcgtcggtaaagaccaaaatggtgttataaaagactggttagagatggacagctcctatgaatttatattctcactatataaagacgacgtaatattagtacaaaagaaagaaatgcaaagaccagaactatgttactttgtcagctttgatacctcaggagcatcaataaaagttgcaaaacatgacaataacttttcaactctaacagaaaatcaaaaactgctattttctaacgccacaaaagaagaagtcgttggaaaaagcataggtatacaaaacttaaaagttttcgaaaaatggcaagtatcagtactaggtgaagtgaaaagaacccaaagttacccaagagaaaatattagccttgcaagcaaagccaagaaatga
